United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 16

SEQ ID NO: 245664 - DNA, 20 bp, Artificial Sequence
  Description of Artificial Sequence: Synthetic oligonucleotide
  Target: ATXN1; (+) strand; PAM type: YTN; PAM sequence: CTT
gtgaaacaataattaggtta

SEQ ID NO: 245665 - DNA, 20 bp, Artificial Sequence
  Description of Artificial Sequence: Synthetic oligonucleotide
  Target: ATXN1; (+) strand; PAM type: YTN; PAM sequence: TTG
tgaaacaataattaggttaa

SEQ ID NO: 245666 - DNA, 20 bp, Artificial Sequence
  Description of Artificial Sequence: Synthetic oligonucleotide
  Target: ATXN1; (+) strand; PAM type: YTN; PAM sequence: TTA
ggttaatctaaattggtata

SEQ ID NO: 245667 - DNA, 20 bp, Artificial Sequence
  Description of Artificial Sequence: Synthetic oligonucleotide
  Target: ATXN1; (+) strand; PAM type: YTN; PAM sequence: TTA
atctaaattggtatacccca

SEQ ID NO: 245668 - DNA, 20 bp, Artificial Sequence
  Description of Artificial Sequence: Synthetic oligonucleotide
  Target: ATXN1; (+) strand; PAM type: YTN; PAM sequence: CTA
aattggtataccccaaactg

SEQ ID NO: 245669 - DNA, 20 bp, Artificial Sequence
  Description of Artificial Sequence: Synthetic oligonucleotide
  Target: ATXN1; (+) strand; PAM type: YTN; PAM sequence: TTG
gtataccccaaactgtggcc

SEQ ID NO: 245670 - DNA, 20 bp, Artificial Sequence
  Description of Artificial Sequence: Synthetic oligonucleotide
  Target: ATXN1; (+) strand; PAM type: YTN; PAM sequence: CTG
tggccagggaacaggcagat

SEQ ID NO: 245671 - DNA, 20 bp, Artificial Sequence
  Description of Artificial Sequence: Synthetic oligonucleotide
  Target: ATXN1; (+) strand; PAM type: YTN; PAM sequence: TTA
ctcagtgtaatgtcaccagg

SEQ ID NO: 245672 - DNA, 20 bp, Artificial Sequence
  Description of Artificial Sequence: Synthetic oligonucleotide
  Target: ATXN1; (+) strand; PAM type: YTN; PAM sequence: CTC
agtgtaatgtcaccagggcc

SEQ ID NO: 245673 - DNA, 20 bp, Artificial Sequence
  Description of Artificial Sequence: Synthetic oligonucleotide
  Target: ATXN1; (+) strand; PAM type: YTN; PAM sequence: CTC
agagaaagcctccctgtgga

SEQ ID NO: 245674 - DNA, 20 bp, Artificial Sequence
  Description of Artificial Sequence: Synthetic oligonucleotide
  Target: ATXN1; (+) strand; PAM type: YTN; PAM sequence: CTC
cctgtggaaatctccccaat

SEQ ID NO: 245675 - DNA, 20 bp, Artificial Sequence
  Description of Artificial Sequence: Synthetic oligonucleotide
  Target: ATXN1; (+) strand; PAM type: YTN; PAM sequence: CTG
tggaaatctccccaatggca

SEQ ID NO: 245676 - DNA, 20 bp, Artificial Sequence
  Description of Artificial Sequence: Synthetic oligonucleotide
  Target: ATXN1; (+) strand; PAM type: YTN; PAM sequence: CTC
cccaatggcacatacatgta

SEQ ID NO: 245677 - DNA, 20 bp, Artificial Sequence
  Description of Artificial Sequence: Synthetic oligonucleotide
  Target: ATXN1; (+) strand; PAM type: YTN; PAM sequence: CTG
agtggatcaatttttggggt

SEQ ID NO: 245678 - DNA, 20 bp, Artificial Sequence
  Description of Artificial Sequence: Synthetic oligonucleotide
  Target: ATXN1; (+) strand; PAM type: YTN; PAM sequence: TTT
ttggggtacagagttcaaag

SEQ ID NO: 245679 - DNA, 20 bp, Artificial Sequence
  Description of Artificial Sequence: Synthetic oligonucleotide
  Target: ATXN1; (+) strand; PAM type: YTN; PAM sequence: TTT
tggggtacagagttcaaagt

SEQ ID NO: 245680 - DNA, 20 bp, Artificial Sequence
  Description of Artificial Sequence: Synthetic oligonucleotide
  Target: ATXN1; (+) strand; PAM type: YTN; PAM sequence: TTT
ggggtacagagttcaaagtg

SEQ ID NO: 245681 - DNA, 20 bp, Artificial Sequence
  Description of Artificial Sequence: Synthetic oligonucleotide
  Target: ATXN1; (+) strand; PAM type: YTN; PAM sequence: TTG
gggtacagagttcaaagtgt

SEQ ID NO: 245682 - DNA, 20 bp, Artificial Sequence
  Description of Artificial Sequence: Synthetic oligonucleotide
  Target: ATXN1; (+) strand; PAM type: YTN; PAM sequence: TTC
aaagtgttggagcaatgggg

SEQ ID NO: 245683 - DNA, 20 bp, Artificial Sequence
  Description of Artificial Sequence: Synthetic oligonucleotide
  Target: ATXN1; (+) strand; PAM type: YTN; PAM sequence: TTG
gagcaatgggggaacacatc

SEQ ID NO: 245684 - DNA, 20 bp, Artificial Sequence
  Description of Artificial Sequence: Synthetic oligonucleotide
  Target: ATXN1; (+) strand; PAM type: YTN; PAM sequence: CTA
acttccggtgtcttaatatc

SEQ ID NO: 245685 - DNA, 20 bp, Artificial Sequence
  Description of Artificial Sequence: Synthetic oligonucleotide
  Target: ATXN1; (+) strand; PAM type: YTN; PAM sequence: CTT
ccggtgtcttaatatcctca

SEQ ID NO: 245686 - DNA, 20 bp, Artificial Sequence
  Description of Artificial Sequence: Synthetic oligonucleotide
  Target: ATXN1; (+) strand; PAM type: YTN; PAM sequence: TTC
cggtgtcttaatatcctcag

SEQ ID NO: 245687 - DNA, 20 bp, Artificial Sequence
  Description of Artificial Sequence: Synthetic oligonucleotide
  Target: ATXN1; (+) strand; PAM type: YTN; PAM sequence: CTT
aatatcctcagcccactgag

SEQ ID NO: 245688 - DNA, 20 bp, Artificial Sequence
  Description of Artificial Sequence: Synthetic oligonucleotide
  Target: ATXN1; (+) strand; PAM type: YTN; PAM sequence: TTA
atatcctcagcccactgagt

SEQ ID NO: 245689 - DNA, 20 bp, Artificial Sequence
  Description of Artificial Sequence: Synthetic oligonucleotide
  Target: ATXN1; (+) strand; PAM type: YTN; PAM sequence: CTC
agcccactgagtgaaattga

SEQ ID NO: 245690 - DNA, 20 bp, Artificial Sequence
  Description of Artificial Sequence: Synthetic oligonucleotide
  Target: ATXN1; (+) strand; PAM type: YTN; PAM sequence: CTG
agtgaaattgacttactaga

SEQ ID NO: 245691 - DNA, 20 bp, Artificial Sequence
  Description of Artificial Sequence: Synthetic oligonucleotide
  Target: ATXN1; (+) strand; PAM type: YTN; PAM sequence: TTG
acttactagaaatctaccat

SEQ ID NO: 245692 - DNA, 20 bp, Artificial Sequence
  Description of Artificial Sequence: Synthetic oligonucleotide
  Target: ATXN1; (+) strand; PAM type: YTN; PAM sequence: CTT
actagaaatctaccatagaa

SEQ ID NO: 245693 - DNA, 20 bp, Artificial Sequence
  Description of Artificial Sequence: Synthetic oligonucleotide
  Target: ATXN1; (+) strand; PAM type: YTN; PAM sequence: TTA
ctagaaatctaccatagaat

SEQ ID NO: 245694 - DNA, 20 bp, Artificial Sequence
  Description of Artificial Sequence: Synthetic oligonucleotide
  Target: ATXN1; (+) strand; PAM type: YTN; PAM sequence: CTA
gaaatctaccatagaatact

SEQ ID NO: 245695 - DNA, 20 bp, Artificial Sequence
  Description of Artificial Sequence: Synthetic oligonucleotide
  Target: ATXN1; (+) strand; PAM type: YTN; PAM sequence: CTA
ccatagaatactgaacatcc

SEQ ID NO: 245696 - DNA, 20 bp, Artificial Sequence
  Description of Artificial Sequence: Synthetic oligonucleotide
  Target: ATXN1; (+) strand; PAM type: YTN; PAM sequence: CTG
aacatcccaacagaccaaat

SEQ ID NO: 245697 - DNA, 20 bp, Artificial Sequence
  Description of Artificial Sequence: Synthetic oligonucleotide
  Target: ATXN1; (+) strand; PAM type: YTN; PAM sequence: TTG
gctcccgcacttggctctgc

SEQ ID NO: 245698 - DNA, 20 bp, Artificial Sequence
  Description of Artificial Sequence: Synthetic oligonucleotide
  Target: ATXN1; (+) strand; PAM type: YTN; PAM sequence: CTC
ccgcacttggctctgcagat

SEQ ID NO: 245699 - DNA, 20 bp, Artificial Sequence
  Description of Artificial Sequence: Synthetic oligonucleotide
  Target: ATXN1; (+) strand; PAM type: YTN; PAM sequence: CTT
ggctctgcagattttgggga

SEQ ID NO: 245700 - DNA, 20 bp, Artificial Sequence
  Description of Artificial Sequence: Synthetic oligonucleotide
  Target: ATXN1; (+) strand; PAM type: YTN; PAM sequence: TTG
gctctgcagattttggggac

SEQ ID NO: 245701 - DNA, 20 bp, Artificial Sequence
  Description of Artificial Sequence: Synthetic oligonucleotide
  Target: ATXN1; (+) strand; PAM type: YTN; PAM sequence: CTC
tgcagattttggggacatat

SEQ ID NO: 245702 - DNA, 20 bp, Artificial Sequence
  Description of Artificial Sequence: Synthetic oligonucleotide
  Target: ATXN1; (+) strand; PAM type: YTN; PAM sequence: CTG
cagattttggggacatattt

SEQ ID NO: 245703 - DNA, 20 bp, Artificial Sequence
  Description of Artificial Sequence: Synthetic oligonucleotide
  Target: ATXN1; (+) strand; PAM type: YTN; PAM sequence: TTT
tggggacatatttcctccac

SEQ ID NO: 245704 - DNA, 20 bp, Artificial Sequence
  Description of Artificial Sequence: Synthetic oligonucleotide
  Target: ATXN1; (+) strand; PAM type: YTN; PAM sequence: TTT
ggggacatatttcctccaca

SEQ ID NO: 245705 - DNA, 20 bp, Artificial Sequence
  Description of Artificial Sequence: Synthetic oligonucleotide
  Target: ATXN1; (+) strand; PAM type: YTN; PAM sequence: TTG
gggacatatttcctccacaa

SEQ ID NO: 245706 - DNA, 20 bp, Artificial Sequence
  Description of Artificial Sequence: Synthetic oligonucleotide
  Target: ATXN1; (+) strand; PAM type: YTN; PAM sequence: TTT
cctccacaatacaaaggagg

SEQ ID NO: 245707 - DNA, 20 bp, Artificial Sequence
  Description of Artificial Sequence: Synthetic oligonucleotide
  Target: ATXN1; (+) strand; PAM type: YTN; PAM sequence: TTC
ctccacaatacaaaggagga

SEQ ID NO: 245708 - DNA, 20 bp, Artificial Sequence
  Description of Artificial Sequence: Synthetic oligonucleotide
  Target: ATXN1; (+) strand; PAM type: YTN; PAM sequence: CTC
cacaatacaaaggaggatgc

SEQ ID NO: 245709 - DNA, 20 bp, Artificial Sequence
  Description of Artificial Sequence: Synthetic oligonucleotide
  Target: ATXN1; (+) strand; PAM type: YTN; PAM sequence: CTG
ggacactactggtttcactg

SEQ ID NO: 245710 - DNA, 20 bp, Artificial Sequence
  Description of Artificial Sequence: Synthetic oligonucleotide
  Target: ATXN1; (+) strand; PAM type: YTN; PAM sequence: CTA
ctggtttcactgtgtttgtg

SEQ ID NO: 245711 - DNA, 20 bp, Artificial Sequence
  Description of Artificial Sequence: Synthetic oligonucleotide
  Target: ATXN1; (+) strand; PAM type: YTN; PAM sequence: CTG
gtttcactgtgtttgtggtc

SEQ ID NO: 245712 - DNA, 20 bp, Artificial Sequence
  Description of Artificial Sequence: Synthetic oligonucleotide
  Target: ATXN1; (+) strand; PAM type: YTN; PAM sequence: TTT
cactgtgtttgtggtcatgc

SEQ ID NO: 245713 - DNA, 20 bp, Artificial Sequence
  Description of Artificial Sequence: Synthetic oligonucleotide
  Target: ATXN1; (+) strand; PAM type: YTN; PAM sequence: TTC
actgtgtttgtggtcatgct

SEQ ID NO: 245714 - DNA, 20 bp, Artificial Sequence
  Description of Artificial Sequence: Synthetic oligonucleotide
  Target: ATXN1; (+) strand; PAM type: YTN; PAM sequence: CTG
tgtttgtggtcatgctgaat

SEQ ID NO: 245715 - DNA, 20 bp, Artificial Sequence
  Description of Artificial Sequence: Synthetic oligonucleotide
  Target: ATXN1; (+) strand; PAM type: YTN; PAM sequence: TTT
gtggtcatgctgaataatgg

SEQ ID NO: 245716 - DNA, 20 bp, Artificial Sequence
  Description of Artificial Sequence: Synthetic oligonucleotide
  Target: ATXN1; (+) strand; PAM type: YTN; PAM sequence: TTG
tggtcatgctgaataatggt

SEQ ID NO: 245717 - DNA, 20 bp, Artificial Sequence
  Description of Artificial Sequence: Synthetic oligonucleotide
  Target: ATXN1; (+) strand; PAM type: YTN; PAM sequence: CTG
aataatggtgtatcagtggc

SEQ ID NO: 245718 - DNA, 20 bp, Artificial Sequence
  Description of Artificial Sequence: Synthetic oligonucleotide
  Target: ATXN1; (+) strand; PAM type: YTN; PAM sequence: CTC
tggctgagagaccagaaccc

SEQ ID NO: 245719 - DNA, 20 bp, Artificial Sequence
  Description of Artificial Sequence: Synthetic oligonucleotide
  Target: ATXN1; (+) strand; PAM type: YTN; PAM sequence: CTG
gctgagagaccagaaccctt

SEQ ID NO: 245720 - DNA, 20 bp, Artificial Sequence
  Description of Artificial Sequence: Synthetic oligonucleotide
  Target: ATXN1; (+) strand; PAM type: YTN; PAM sequence: CTG
agagaccagaacccttgcag

SEQ ID NO: 245721 - DNA, 20 bp, Artificial Sequence
  Description of Artificial Sequence: Synthetic oligonucleotide
  Target: ATXN1; (+) strand; PAM type: YTN; PAM sequence: CTT
gcagccttagtactagggcc

SEQ ID NO: 245722 - DNA, 20 bp, Artificial Sequence
  Description of Artificial Sequence: Synthetic oligonucleotide
  Target: ATXN1; (+) strand; PAM type: YTN; PAM sequence: TTG
cagccttagtactagggcca

SEQ ID NO: 245723 - DNA, 20 bp, Artificial Sequence
  Description of Artificial Sequence: Synthetic oligonucleotide
  Target: ATXN1; (+) strand; PAM type: YTN; PAM sequence: CTT
agtactagggccatactctc

SEQ ID NO: 245724 - DNA, 20 bp, Artificial Sequence
  Description of Artificial Sequence: Synthetic oligonucleotide
  Target: ATXN1; (+) strand; PAM type: YTN; PAM sequence: TTA
gtactagggccatactctct

SEQ ID NO: 245725 - DNA, 20 bp, Artificial Sequence
  Description of Artificial Sequence: Synthetic oligonucleotide
  Target: ATXN1; (+) strand; PAM type: YTN; PAM sequence: CTA
gggccatactctctcacctg

SEQ ID NO: 245726 - DNA, 20 bp, Artificial Sequence
  Description of Artificial Sequence: Synthetic oligonucleotide
  Target: ATXN1; (+) strand; PAM type: YTN; PAM sequence: CTC
tctcacctgcagaataagaa

SEQ ID NO: 245727 - DNA, 20 bp, Artificial Sequence
  Description of Artificial Sequence: Synthetic oligonucleotide
  Target: ATXN1; (+) strand; PAM type: YTN; PAM sequence: CTC
tcacctgcagaataagaaat

SEQ ID NO: 245728 - DNA, 20 bp, Artificial Sequence
  Description of Artificial Sequence: Synthetic oligonucleotide
  Target: ATXN1; (+) strand; PAM type: YTN; PAM sequence: CTC
acctgcagaataagaaatca

SEQ ID NO: 245729 - DNA, 20 bp, Artificial Sequence
  Description of Artificial Sequence: Synthetic oligonucleotide
  Target: ATXN1; (+) strand; PAM type: YTN; PAM sequence: CTG
cagaataagaaatcaatgct

SEQ ID NO: 245730 - DNA, 20 bp, Artificial Sequence
  Description of Artificial Sequence: Synthetic oligonucleotide
  Target: ATXN1; (+) strand; PAM type: YTN; PAM sequence: CTG
acggcacatcagactcaccc

SEQ ID NO: 245731 - DNA, 20 bp, Artificial Sequence
  Description of Artificial Sequence: Synthetic oligonucleotide
  Target: ATXN1; (+) strand; PAM type: YTN; PAM sequence: CTC
acccagggagcttttaaaaa

SEQ ID NO: 245732 - DNA, 20 bp, Artificial Sequence
  Description of Artificial Sequence: Synthetic oligonucleotide
  Target: ATXN1; (+) strand; PAM type: YTN; PAM sequence: CTT
ttaaaaacataatgtccaga

SEQ ID NO: 245733 - DNA, 20 bp, Artificial Sequence
  Description of Artificial Sequence: Synthetic oligonucleotide
  Target: ATXN1; (+) strand; PAM type: YTN; PAM sequence: TTT
taaaaacataatgtccagat

SEQ ID NO: 245734 - DNA, 20 bp, Artificial Sequence
  Description of Artificial Sequence: Synthetic oligonucleotide
  Target: ATXN1; (+) strand; PAM type: YTN; PAM sequence: TTT
aaaaacataatgtccagatc

SEQ ID NO: 245735 - DNA, 20 bp, Artificial Sequence
  Description of Artificial Sequence: Synthetic oligonucleotide
  Target: ATXN1; (+) strand; PAM type: YTN; PAM sequence: TTA
aaaacataatgtccagatct

SEQ ID NO: 245736 - DNA, 20 bp, Artificial Sequence
  Description of Artificial Sequence: Synthetic oligonucleotide
  Target: ATXN1; (+) strand; PAM type: YTN; PAM sequence: CTA
ccccagaccaactgaataag

SEQ ID NO: 245737 - DNA, 20 bp, Artificial Sequence
  Description of Artificial Sequence: Synthetic oligonucleotide
  Target: ATXN1; (+) strand; PAM type: YTN; PAM sequence: CTG
aataagaatccctagatgtt

SEQ ID NO: 245738 - DNA, 20 bp, Artificial Sequence
  Description of Artificial Sequence: Synthetic oligonucleotide
  Target: ATXN1; (+) strand; PAM type: YTN; PAM sequence: CTA
gatgttgggaccaccactgg

SEQ ID NO: 245739 - DNA, 20 bp, Artificial Sequence
  Description of Artificial Sequence: Synthetic oligonucleotide
  Target: ATXN1; (+) strand; PAM type: YTN; PAM sequence: TTG
ggaccaccactggcatttta

SEQ ID NO: 245740 - DNA, 20 bp, Artificial Sequence
  Description of Artificial Sequence: Synthetic oligonucleotide
  Target: ATXN1; (+) strand; PAM type: YTN; PAM sequence: CTG
gcattttaggaaatgcacca

SEQ ID NO: 245741 - DNA, 20 bp, Artificial Sequence
  Description of Artificial Sequence: Synthetic oligonucleotide
  Target: ATXN1; (+) strand; PAM type: YTN; PAM sequence: TTT
taggaaatgcaccaggggat

SEQ ID NO: 245742 - DNA, 20 bp, Artificial Sequence
  Description of Artificial Sequence: Synthetic oligonucleotide
  Target: ATXN1; (+) strand; PAM type: YTN; PAM sequence: TTT
aggaaatgcaccaggggatt

SEQ ID NO: 245743 - DNA, 20 bp, Artificial Sequence
  Description of Artificial Sequence: Synthetic oligonucleotide
  Target: ATXN1; (+) strand; PAM type: YTN; PAM sequence: TTA
ggaaatgcaccaggggattc

SEQ ID NO: 245744 - DNA, 20 bp, Artificial Sequence
  Description of Artificial Sequence: Synthetic oligonucleotide
  Target: ATXN1; (+) strand; PAM type: YTN; PAM sequence: TTC
taatttgcagccagaggtga

SEQ ID NO: 245745 - DNA, 20 bp, Artificial Sequence
  Description of Artificial Sequence: Synthetic oligonucleotide
  Target: ATXN1; (+) strand; PAM type: YTN; PAM sequence: CTA
atttgcagccagaggtgaga

SEQ ID NO: 245746 - DNA, 20 bp, Artificial Sequence
  Description of Artificial Sequence: Synthetic oligonucleotide
  Target: ATXN1; (+) strand; PAM type: YTN; PAM sequence: TTT
gcagccagaggtgagaacct

SEQ ID NO: 245747 - DNA, 20 bp, Artificial Sequence
  Description of Artificial Sequence: Synthetic oligonucleotide
  Target: ATXN1; (+) strand; PAM type: YTN; PAM sequence: TTG
cagccagaggtgagaacctc

SEQ ID NO: 245748 - DNA, 20 bp, Artificial Sequence
  Description of Artificial Sequence: Synthetic oligonucleotide
  Target: ATXN1; (+) strand; PAM type: YTN; PAM sequence: CTC
tggtatagaggatttttttt

SEQ ID NO: 245749 - DNA, 20 bp, Artificial Sequence
  Description of Artificial Sequence: Synthetic oligonucleotide
  Target: ATXN1; (+) strand; PAM type: YTN; PAM sequence: CTG
gtatagaggatttttttttt

SEQ ID NO: 245750 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttg

SEQ ID NO: 245751 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttga

SEQ ID NO: 245752 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttgag

SEQ ID NO: 245753 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttgaga

SEQ ID NO: 245754 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttgagac

SEQ ID NO: 245755 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgagaca

SEQ ID NO: 245756 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgagacag

SEQ ID NO: 245757 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgagacaga

SEQ ID NO: 245758 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgagacagag

SEQ ID NO: 245759 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgagacagagt

SEQ ID NO: 245760 - DNA, 20 bp, Artificial Sequence
  Description of Artificial Sequence: Synthetic oligonucleotide
  Target: ATXN1; (+) strand; PAM type: YTN; PAM sequence: TTT
tttttttttgagacagagtc

SEQ ID NO: 245761 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagacagagtct

SEQ ID NO: 245762 - DNA, 20 bp, Artificial Sequence
  Description of Artificial Sequence: Synthetic oligonucleotide
  Target: ATXN1; (+) strand; PAM type: YTN; PAM sequence: TTT
tttttttgagacagagtctc

SEQ ID NO: 245763 - DNA, 20 bp, Artificial Sequence
  Description of Artificial Sequence: Synthetic oligonucleotide
  Target: ATXN1; (+) strand; PAM type: YTN; PAM sequence: TTT
ttttttgagacagagtctcg

SEQ ID NO: 245764 - DNA, 20 bp, Artificial Sequence
  Description of Artificial Sequence: Synthetic oligonucleotide
  Target: ATXN1; (+) strand; PAM type: YTN; PAM sequence: TTT
tttttgagacagagtctcgc

SEQ ID NO: 245765 - DNA, 20 bp, Artificial Sequence
  Description of Artificial Sequence: Synthetic oligonucleotide
  Target: ATXN1; (+) strand; PAM type: YTN; PAM sequence: TTT
ttttgagacagagtctcgct

SEQ ID NO: 245766 - DNA, 20 bp, Artificial Sequence
  Description of Artificial Sequence: Synthetic oligonucleotide
  Target: ATXN1; (+) strand; PAM type: YTN; PAM sequence: TTT
tttgagacagagtctcgctc

SEQ ID NO: 245767 - DNA, 20 bp, Artificial Sequence
  Description of Artificial Sequence: Synthetic oligonucleotide
  Target: ATXN1; (+) strand; PAM type: YTN; PAM sequence: TTT
ttgagacagagtctcgctct

SEQ ID NO: 245768 - DNA, 20 bp, Artificial Sequence
  Description of Artificial Sequence: Synthetic oligonucleotide
  Target: ATXN1; (+) strand; PAM type: YTN; PAM sequence: TTT
tgagacagagtctcgctctg

SEQ ID NO: 245769 - DNA, 20 bp, Artificial Sequence
  Description of Artificial Sequence: Synthetic oligonucleotide
  Target: ATXN1; (+) strand; PAM type: YTN; PAM sequence: TTT
gagacagagtctcgctctgt

SEQ ID NO: 245770 - DNA, 20 bp, Artificial Sequence
  Description of Artificial Sequence: Synthetic oligonucleotide
  Target: ATXN1; (+) strand; PAM type: YTN; PAM sequence: TTG
agacagagtctcgctctgtc

SEQ ID NO: 245771 - DNA, 20 bp, Artificial Sequence
  Description of Artificial Sequence: Synthetic oligonucleotide
  Target: ATXN1; (+) strand; PAM type: YTN; PAM sequence: CTC
gctctgtcccccaggctgga

SEQ ID NO: 245772 - DNA, 20 bp, Artificial Sequence
  Description of Artificial Sequence: Synthetic oligonucleotide
  Target: ATXN1; (+) strand; PAM type: YTN; PAM sequence: CTC
tgtcccccaggctggaatgc

SEQ ID NO: 245773 - DNA, 20 bp, Artificial Sequence
  Description of Artificial Sequence: Synthetic oligonucleotide
  Target: ATXN1; (+) strand; PAM type: YTN; PAM sequence: CTG
tcccccaggctggaatgcag

SEQ ID NO: 245774 - DNA, 20 bp, Artificial Sequence
  Description of Artificial Sequence: Synthetic oligonucleotide
  Target: ATXN1; (+) strand; PAM type: YTN; PAM sequence: CTG
gaatgcagtggcgtgatctc

SEQ ID NO: 245775 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcaagctccacc

SEQ ID NO: 245776 - DNA, 20 bp, Artificial Sequence
  Description of Artificial Sequence: Synthetic oligonucleotide
  Target: ATXN1; (+) strand; PAM type: YTN; PAM sequence: CTC
actgcaagctccacctcccg

SEQ ID NO: 245777 - DNA, 20 bp, Artificial Sequence
  Description of Artificial Sequence: Synthetic oligonucleotide
  Target: ATXN1; (+) strand; PAM type: YTN; PAM sequence: CTG
caagctccacctcccgggtt

SEQ ID NO: 245778 - DNA, 20 bp, Artificial Sequence
  Description of Artificial Sequence: Synthetic oligonucleotide
  Target: ATXN1; (+) strand; PAM type: YTN; PAM sequence: CTC
cacctcccgggttcacacca

SEQ ID NO: 245779 - DNA, 20 bp, Artificial Sequence
  Description of Artificial Sequence: Synthetic oligonucleotide
  Target: ATXN1; (+) strand; PAM type: YTN; PAM sequence: CTC
ccgggttcacaccattctcc

SEQ ID NO: 245780 - DNA, 20 bp, Artificial Sequence
  Description of Artificial Sequence: Synthetic oligonucleotide
  Target: ATXN1; (+) strand; PAM type: YTN; PAM sequence: TTC
acaccattctcctgcctcag

SEQ ID NO: 245781 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccgag

SEQ ID NO: 245782 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccgagtg

SEQ ID NO: 245783 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccgagtggct

SEQ ID NO: 245784 - DNA, 20 bp, Artificial Sequence
  Description of Artificial Sequence: Synthetic oligonucleotide
  Target: ATXN1; (+) strand; PAM type: YTN; PAM sequence: CTC
agcctcccgagtggctggga

SEQ ID NO: 245785 - DNA, 20 bp, Artificial Sequence
  Description of Artificial Sequence: Synthetic oligonucleotide
  Target: ATXN1; (+) strand; PAM type: YTN; PAM sequence: CTC
ccgagtggctgggactacag

SEQ ID NO: 245786 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcacccaccac

SEQ ID NO: 245787 - DNA, 20 bp, Artificial Sequence
  Description of Artificial Sequence: Synthetic oligonucleotide
  Target: ATXN1; (+) strand; PAM type: YTN; PAM sequence: CTA
caggcacccaccaccacgcc

SEQ ID NO: 245788 - DNA, 20 bp, Artificial Sequence
  Description of Artificial Sequence: Synthetic oligonucleotide
  Target: ATXN1; (+) strand; PAM type: YTN; PAM sequence: CTG
gctaatttttttgtattttt

SEQ ID NO: 245789 - DNA, 20 bp, Artificial Sequence
  Description of Artificial Sequence: Synthetic oligonucleotide
  Target: ATXN1; (+) strand; PAM type: YTN; PAM sequence: CTA
atttttttgtatttttagta

SEQ ID NO: 245790 - DNA, 20 bp, Artificial Sequence
  Description of Artificial Sequence: Synthetic oligonucleotide
  Target: ATXN1; (+) strand; PAM type: YTN; PAM sequence: TTT
ttttgtatttttagtagaga

SEQ ID NO: 245791 - DNA, 20 bp, Artificial Sequence
  Description of Artificial Sequence: Synthetic oligonucleotide
  Target: ATXN1; (+) strand; PAM type: YTN; PAM sequence: TTT
tttgtatttttagtagagat

SEQ ID NO: 245792 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagatg

SEQ ID NO: 245793 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagatgg

SEQ ID NO: 245794 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagatggg

SEQ ID NO: 245795 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagatgggg

SEQ ID NO: 245796 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatggggtttca

SEQ ID NO: 245797 - DNA, 20 bp, Artificial Sequence
  Description of Artificial Sequence: Synthetic oligonucleotide
  Target: ATXN1; (+) strand; PAM type: YTN; PAM sequence: TTT
tagtagagatggggtttcac

SEQ ID NO: 245798 - DNA, 20 bp, Artificial Sequence
  Description of Artificial Sequence: Synthetic oligonucleotide
  Target: ATXN1; (+) strand; PAM type: YTN; PAM sequence: TTT
agtagagatggggtttcacc

SEQ ID NO: 245799 - DNA, 20 bp, Artificial Sequence
  Description of Artificial Sequence: Synthetic oligonucleotide
  Target: ATXN1; (+) strand; PAM type: YTN; PAM sequence: TTA
gtagagatggggtttcaccg

SEQ ID NO: 245800 - DNA, 20 bp, Artificial Sequence
  Description of Artificial Sequence: Synthetic oligonucleotide
  Target: ATXN1; (+) strand; PAM type: YTN; PAM sequence: TTT
caccgtgttagccaggatgg

SEQ ID NO: 245801 - DNA, 20 bp, Artificial Sequence
  Description of Artificial Sequence: Synthetic oligonucleotide
  Target: ATXN1; (+) strand; PAM type: YTN; PAM sequence: TTC
accgtgttagccaggatggt

SEQ ID NO: 245802 - DNA, 20 bp, Artificial Sequence
  Description of Artificial Sequence: Synthetic oligonucleotide
  Target: ATXN1; (+) strand; PAM type: YTN; PAM sequence: TTA
gccaggatggtcttgatctc

SEQ ID NO: 245803 - DNA, 20 bp, Artificial Sequence
  Description of Artificial Sequence: Synthetic oligonucleotide
  Target: ATXN1; (+) strand; PAM type: YTN; PAM sequence: CTT
gatctcctgacctcttgatc

SEQ ID NO: 245804 - DNA, 20 bp, Artificial Sequence
  Description of Artificial Sequence: Synthetic oligonucleotide
  Target: ATXN1; (+) strand; PAM type: YTN; PAM sequence: TTG
atctcctgacctcttgatct

SEQ ID NO: 245805 - DNA, 20 bp, Artificial Sequence
  Description of Artificial Sequence: Synthetic oligonucleotide
  Target: ATXN1; (+) strand; PAM type: YTN; PAM sequence: CTC
ctgacctcttgatctgcctg

SEQ ID NO: 245806 - DNA, 20 bp, Artificial Sequence
  Description of Artificial Sequence: Synthetic oligonucleotide
  Target: ATXN1; (+) strand; PAM type: YTN; PAM sequence: CTG
acctcttgatctgcctgcct

SEQ ID NO: 245807 - DNA, 20 bp, Artificial Sequence
  Description of Artificial Sequence: Synthetic oligonucleotide
  Target: ATXN1; (+) strand; PAM type: YTN; PAM sequence: CTC
ttgatctgcctgcctcggcc

SEQ ID NO: 245808 - DNA, 20 bp, Artificial Sequence
  Description of Artificial Sequence: Synthetic oligonucleotide
  Target: ATXN1; (+) strand; PAM type: YTN; PAM sequence: CTT
gatctgcctgcctcggcctc

SEQ ID NO: 245809 - DNA, 20 bp, Artificial Sequence
  Description of Artificial Sequence: Synthetic oligonucleotide
  Target: ATXN1; (+) strand; PAM type: YTN; PAM sequence: TTG
atctgcctgcctcggcctcc

SEQ ID NO: 245810 - DNA, 20 bp, Artificial Sequence
  Description of Artificial Sequence: Synthetic oligonucleotide
  Target: ATXN1; (+) strand; PAM type: YTN; PAM sequence: CTG
cctgcctcggcctcccaaag

SEQ ID NO: 245811 - DNA, 20 bp, Artificial Sequence
  Description of Artificial Sequence: Synthetic oligonucleotide
  Target: ATXN1; (+) strand; PAM type: YTN; PAM sequence: CTG
cctcggcctcccaaagtact

SEQ ID NO: 245812 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaagtactggga

SEQ ID NO: 245813 - DNA, 20 bp, Artificial Sequence
  Description of Artificial Sequence: Synthetic oligonucleotide
  Target: ATXN1; (+) strand; PAM type: YTN; PAM sequence: CTC
ccaaagtactgggattatag

SEQ ID NO: 245814 - DNA, 20 bp, Artificial Sequence
  Description of Artificial Sequence: Synthetic oligonucleotide
  Target: ATXN1; (+) strand; PAM type: YTN; PAM sequence: CTG
ggattataggcgtgagccac

SEQ ID NO: 245815 - DNA, 20 bp, Artificial Sequence
  Description of Artificial Sequence: Synthetic oligonucleotide
  Target: ATXN1; (+) strand; PAM type: YTN; PAM sequence: TTA
taggcgtgagccaccgcacc

SEQ ID NO: 245816 - DNA, 20 bp, Artificial Sequence
  Description of Artificial Sequence: Synthetic oligonucleotide
  Target: ATXN1; (+) strand; PAM type: YTN; PAM sequence: CTG
gtatagaggatctttaagcc

SEQ ID NO: 245817 - DNA, 20 bp, Artificial Sequence
  Description of Artificial Sequence: Synthetic oligonucleotide
  Target: ATXN1; (+) strand; PAM type: YTN; PAM sequence: CTT
taagccccctaactccatct

SEQ ID NO: 245818 - DNA, 20 bp, Artificial Sequence
  Description of Artificial Sequence: Synthetic oligonucleotide
  Target: ATXN1; (+) strand; PAM type: YTN; PAM sequence: TTT
aagccccctaactccatctg

SEQ ID NO: 245819 - DNA, 20 bp, Artificial Sequence
  Description of Artificial Sequence: Synthetic oligonucleotide
  Target: ATXN1; (+) strand; PAM type: YTN; PAM sequence: TTA
agccccctaactccatctgt

SEQ ID NO: 245820 - DNA, 20 bp, Artificial Sequence
  Description of Artificial Sequence: Synthetic oligonucleotide
  Target: ATXN1; (+) strand; PAM type: YTN; PAM sequence: CTA
actccatctgtccttggcag

SEQ ID NO: 245821 - DNA, 20 bp, Artificial Sequence
  Description of Artificial Sequence: Synthetic oligonucleotide
  Target: ATXN1; (+) strand; PAM type: YTN; PAM sequence: CTC
catctgtccttggcagtatg

SEQ ID NO: 245822 - DNA, 20 bp, Artificial Sequence
  Description of Artificial Sequence: Synthetic oligonucleotide
  Target: ATXN1; (+) strand; PAM type: YTN; PAM sequence: CTG
tccttggcagtatgtctcag

SEQ ID NO: 245823 - DNA, 20 bp, Artificial Sequence
  Description of Artificial Sequence: Synthetic oligonucleotide
  Target: ATXN1; (+) strand; PAM type: YTN; PAM sequence: CTT
ggcagtatgtctcagtgatt

SEQ ID NO: 245824 - DNA, 20 bp, Artificial Sequence
  Description of Artificial Sequence: Synthetic oligonucleotide
  Target: ATXN1; (+) strand; PAM type: YTN; PAM sequence: TTG
gcagtatgtctcagtgattt

SEQ ID NO: 245825 - DNA, 20 bp, Artificial Sequence
  Description of Artificial Sequence: Synthetic oligonucleotide
  Target: ATXN1; (+) strand; PAM type: YTN; PAM sequence: CTC
agtgattttttttttttttt

SEQ ID NO: 245826 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttg

SEQ ID NO: 245827 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttga

SEQ ID NO: 245828 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttgag

SEQ ID NO: 245829 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttgaga

SEQ ID NO: 245830 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttgagac

SEQ ID NO: 245831 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgagacg

SEQ ID NO: 245832 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgagacgg

SEQ ID NO: 245833 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgagacgga

SEQ ID NO: 245834 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgagacggag

SEQ ID NO: 245835 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgagacggagt

SEQ ID NO: 245836 - DNA, 20 bp, Artificial Sequence
  Description of Artificial Sequence: Synthetic oligonucleotide
  Target: ATXN1; (+) strand; PAM type: YTN; PAM sequence: TTT
tttttttttgagacggagtc

SEQ ID NO: 245837 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagacggagtct

SEQ ID NO: 245838 - DNA, 20 bp, Artificial Sequence
  Description of Artificial Sequence: Synthetic oligonucleotide
  Target: ATXN1; (+) strand; PAM type: YTN; PAM sequence: TTT
tttttttgagacggagtctc

SEQ ID NO: 245839 - DNA, 20 bp, Artificial Sequence
  Description of Artificial Sequence: Synthetic oligonucleotide
  Target: ATXN1; (+) strand; PAM type: YTN; PAM sequence: TTT
ttttttgagacggagtctcg

SEQ ID NO: 245840 - DNA, 20 bp, Artificial Sequence
  Description of Artificial Sequence: Synthetic oligonucleotide
  Target: ATXN1; (+) strand; PAM type: YTN; PAM sequence: TTT
tttttgagacggagtctcgc

SEQ ID NO: 245841 - DNA, 20 bp, Artificial Sequence
  Description of Artificial Sequence: Synthetic oligonucleotide
  Target: ATXN1; (+) strand; PAM type: YTN; PAM sequence: TTT
ttttgagacggagtctcgct

SEQ ID NO: 245842 - DNA, 20 bp, Artificial Sequence
  Description of Artificial Sequence: Synthetic oligonucleotide
  Target: ATXN1; (+) strand; PAM type: YTN; PAM sequence: TTT
tttgagacggagtctcgctc

SEQ ID NO: 245843 - DNA, 20 bp, Artificial Sequence
  Description of Artificial Sequence: Synthetic oligonucleotide
  Target: ATXN1; (+) strand; PAM type: YTN; PAM sequence: TTT
ttgagacggagtctcgctct

SEQ ID NO: 245844 - DNA, 20 bp, Artificial Sequence
  Description of Artificial Sequence: Synthetic oligonucleotide
  Target: ATXN1; (+) strand; PAM type: YTN; PAM sequence: TTT
tgagacggagtctcgctctg

SEQ ID NO: 245845 - DNA, 20 bp, Artificial Sequence
  Description of Artificial Sequence: Synthetic oligonucleotide
  Target: ATXN1; (+) strand; PAM type: YTN; PAM sequence: TTT
gagacggagtctcgctctgt

SEQ ID NO: 245846 - DNA, 20 bp, Artificial Sequence
  Description of Artificial Sequence: Synthetic oligonucleotide
  Target: ATXN1; (+) strand; PAM type: YTN; PAM sequence: TTG
agacggagtctcgctctgtc

SEQ ID NO: 245847 - DNA, 20 bp, Artificial Sequence
  Description of Artificial Sequence: Synthetic oligonucleotide
  Target: ATXN1; (+) strand; PAM type: YTN; PAM sequence: CTC
gctctgtcacccaggctggt

SEQ ID NO: 245848 - DNA, 20 bp, Artificial Sequence
  Description of Artificial Sequence: Synthetic oligonucleotide
  Target: ATXN1; (+) strand; PAM type: YTN; PAM sequence: CTC
tgtcacccaggctggtgtgc

SEQ ID NO: 245849 - DNA, 20 bp, Artificial Sequence
  Description of Artificial Sequence: Synthetic oligonucleotide
  Target: ATXN1; (+) strand; PAM type: YTN; PAM sequence: CTG
tcacccaggctggtgtgcaa

SEQ ID NO: 245850 - DNA, 20 bp, Artificial Sequence
  Description of Artificial Sequence: Synthetic oligonucleotide
  Target: ATXN1; (+) strand; PAM type: YTN; PAM sequence: CTG
gtgtgcaatgggtgcagtct

SEQ ID NO: 245851 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcacctcccagg

SEQ ID NO: 245852 - DNA, 20 bp, Artificial Sequence
  Description of Artificial Sequence: Synthetic oligonucleotide
  Target: ATXN1; (+) strand; PAM type: YTN; PAM sequence: CTC
actgcacctcccaggttcaa

SEQ ID NO: 245853 - DNA, 20 bp, Artificial Sequence
  Description of Artificial Sequence: Synthetic oligonucleotide
  Target: ATXN1; (+) strand; PAM type: YTN; PAM sequence: CTG
cacctcccaggttcaagtga

SEQ ID NO: 245854 - DNA, 20 bp, Artificial Sequence
  Description of Artificial Sequence: Synthetic oligonucleotide
  Target: ATXN1; (+) strand; PAM type: YTN; PAM sequence: CTC
ccaggttcaagtgattctcc

SEQ ID NO: 245855 - DNA, 20 bp, Artificial Sequence
  Description of Artificial Sequence: Synthetic oligonucleotide
  Target: ATXN1; (+) strand; PAM type: YTN; PAM sequence: TTC
aagtgattctcctgcctcag

SEQ ID NO: 245856 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccaag

SEQ ID NO: 245857 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccaagta

SEQ ID NO: 245858 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaagtagtt

SEQ ID NO: 245859 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtagttggga

SEQ ID NO: 245860 - DNA, 20 bp, Artificial Sequence
  Description of Artificial Sequence: Synthetic oligonucleotide
  Target: ATXN1; (+) strand; PAM type: YTN; PAM sequence: CTC
ccaagtagttgggattacag

SEQ ID NO: 245861 - DNA, 20 bp, Artificial Sequence
  Description of Artificial Sequence: Synthetic oligonucleotide
  Target: ATXN1; (+) strand; PAM type: YTN; PAM sequence: TTG
ggattacaggtgcctgccac

SEQ ID NO: 245862 - DNA, 20 bp, Artificial Sequence
  Description of Artificial Sequence: Synthetic oligonucleotide
  Target: ATXN1; (+) strand; PAM type: YTN; PAM sequence: TTA
caggtgcctgccaccacacc

SEQ ID NO: 245863 - DNA, 20 bp, Artificial Sequence
  Description of Artificial Sequence: Synthetic oligonucleotide
  Target: ATXN1; (+) strand; PAM type: YTN; PAM sequence: CTG
ccaccacacctggctatgtt

SEQ ID NO: 245864 - DNA, 20 bp, Artificial Sequence
  Description of Artificial Sequence: Synthetic oligonucleotide
  Target: ATXN1; (+) strand; PAM type: YTN; PAM sequence: CTG
gctatgttatttttattttt

SEQ ID NO: 245865 - DNA, 20 bp, Artificial Sequence
  Description of Artificial Sequence: Synthetic oligonucleotide
  Target: ATXN1; (+) strand; PAM type: YTN; PAM sequence: CTA
tgttatttttatttttattt

SEQ ID NO: 245866 - DNA, 20 bp, Artificial Sequence
  Description of Artificial Sequence: Synthetic oligonucleotide
  Target: ATXN1; (+) strand; PAM type: YTN; PAM sequence: TTA
tttttatttttatttttggt

SEQ ID NO: 245867 - DNA, 20 bp, Artificial Sequence
  Description of Artificial Sequence: Synthetic oligonucleotide
  Target: ATXN1; (+) strand; PAM type: YTN; PAM sequence: TTT
ttatttttatttttggtaga

SEQ ID NO: 245868 - DNA, 20 bp, Artificial Sequence
  Description of Artificial Sequence: Synthetic oligonucleotide
  Target: ATXN1; (+) strand; PAM type: YTN; PAM sequence: TTT
tatttttatttttggtagag

SEQ ID NO: 245869 - DNA, 20 bp, Artificial Sequence
  Description of Artificial Sequence: Synthetic oligonucleotide
  Target: ATXN1; (+) strand; PAM type: YTN; PAM sequence: TTT
atttttatttttggtagaga

SEQ ID NO: 245870 - DNA, 20 bp, Artificial Sequence
  Description of Artificial Sequence: Synthetic oligonucleotide
  Target: ATXN1; (+) strand; PAM type: YTN; PAM sequence: TTA
tttttatttttggtagagac

SEQ ID NO: 245871 - DNA, 20 bp, Artificial Sequence
  Description of Artificial Sequence: Synthetic oligonucleotide
  Target: ATXN1; (+) strand; PAM type: YTN; PAM sequence: TTT
ttatttttggtagagacggg

SEQ ID NO: 245872 - DNA, 20 bp, Artificial Sequence
  Description of Artificial Sequence: Synthetic oligonucleotide
  Target: ATXN1; (+) strand; PAM type: YTN; PAM sequence: TTT
tatttttggtagagacgggg

SEQ ID NO: 245873 - DNA, 20 bp, Artificial Sequence
  Description of Artificial Sequence: Synthetic oligonucleotide
  Target: ATXN1; (+) strand; PAM type: YTN; PAM sequence: TTT
atttttggtagagacggggt

SEQ ID NO: 245874 - DNA, 20 bp, Artificial Sequence
  Description of Artificial Sequence: Synthetic oligonucleotide
  Target: ATXN1; (+) strand; PAM type: YTN; PAM sequence: TTA
tttttggtagagacggggtt

SEQ ID NO: 245875 - DNA, 20 bp, Artificial Sequence
  Description of Artificial Sequence: Synthetic oligonucleotide
  Target: ATXN1; (+) strand; PAM type: YTN; PAM sequence: TTT
ttggtagagacggggtttta

SEQ ID NO: 245876 - DNA, 20 bp, Artificial Sequence
  Description of Artificial Sequence: Synthetic oligonucleotide
  Target: ATXN1; (+) strand; PAM type: YTN; PAM sequence: TTT
tggtagagacggggttttac

SEQ ID NO: 245877 - DNA, 20 bp, Artificial Sequence
  Description of Artificial Sequence: Synthetic oligonucleotide
  Target: ATXN1; (+) strand; PAM type: YTN; PAM sequence: TTT
ggtagagacggggttttacc

SEQ ID NO: 245878 - DNA, 20 bp, Artificial Sequence
  Description of Artificial Sequence: Synthetic oligonucleotide
  Target: ATXN1; (+) strand; PAM type: YTN; PAM sequence: TTG
gtagagacggggttttacca

SEQ ID NO: 245879 - DNA, 20 bp, Artificial Sequence
  Description of Artificial Sequence: Synthetic oligonucleotide
  Target: ATXN1; (+) strand; PAM type: YTN; PAM sequence: TTT
taccatgttggccaggctgg

SEQ ID NO: 245880 - DNA, 20 bp, Artificial Sequence
  Description of Artificial Sequence: Synthetic oligonucleotide
  Target: ATXN1; (+) strand; PAM type: YTN; PAM sequence: TTT
accatgttggccaggctggt

SEQ ID NO: 245881 - DNA, 20 bp, Artificial Sequence
  Description of Artificial Sequence: Synthetic oligonucleotide
  Target: ATXN1; (+) strand; PAM type: YTN; PAM sequence: TTA
ccatgttggccaggctggtc

SEQ ID NO: 245882 - DNA, 20 bp, Artificial Sequence
  Description of Artificial Sequence: Synthetic oligonucleotide
  Target: ATXN1; (+) strand; PAM type: YTN; PAM sequence: TTG
gccaggctggtctcaaactc

SEQ ID NO: 245883 - DNA, 20 bp, Artificial Sequence
  Description of Artificial Sequence: Synthetic oligonucleotide
  Target: ATXN1; (+) strand; PAM type: YTN; PAM sequence: CTG
gtctcaaactcctgacctga

SEQ ID NO: 245884 - DNA, 20 bp, Artificial Sequence
  Description of Artificial Sequence: Synthetic oligonucleotide
  Target: ATXN1; (+) strand; PAM type: YTN; PAM sequence: CTC
aaactcctgacctgagcgat

SEQ ID NO: 245885 - DNA, 20 bp, Artificial Sequence
  Description of Artificial Sequence: Synthetic oligonucleotide
  Target: ATXN1; (+) strand; PAM type: YTN; PAM sequence: CTC
ctgacctgagcgatccacct

SEQ ID NO: 245886 - DNA, 20 bp, Artificial Sequence
  Description of Artificial Sequence: Synthetic oligonucleotide
  Target: ATXN1; (+) strand; PAM type: YTN; PAM sequence: CTG
acctgagcgatccacctacc

SEQ ID NO: 245887 - DNA, 20 bp, Artificial Sequence
  Description of Artificial Sequence: Synthetic oligonucleotide
  Target: ATXN1; (+) strand; PAM type: YTN; PAM sequence: CTG
agcgatccacctaccttggc

SEQ ID NO: 245888 - DNA, 20 bp, Artificial Sequence
  Description of Artificial Sequence: Synthetic oligonucleotide
  Target: ATXN1; (+) strand; PAM type: YTN; PAM sequence: CTA
ccttggcctcccaacgtgct

SEQ ID NO: 245889 - DNA, 20 bp, Artificial Sequence
  Description of Artificial Sequence: Synthetic oligonucleotide
  Target: ATXN1; (+) strand; PAM type: YTN; PAM sequence: CTT
ggcctcccaacgtgctggga

SEQ ID NO: 245890 - DNA, 20 bp, Artificial Sequence
  Description of Artificial Sequence: Synthetic oligonucleotide
  Target: ATXN1; (+) strand; PAM type: YTN; PAM sequence: TTG
gcctcccaacgtgctgggat

SEQ ID NO: 245891 - DNA, 20 bp, Artificial Sequence
  Description of Artificial Sequence: Synthetic oligonucleotide
  Target: ATXN1; (+) strand; PAM type: YTN; PAM sequence: CTC
ccaacgtgctgggattacag

SEQ ID NO: 245892 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgtgagccac

SEQ ID NO: 245893 - DNA, 20 bp, Artificial Sequence
  Description of Artificial Sequence: Synthetic oligonucleotide
  Target: ATXN1; (+) strand; PAM type: YTN; PAM sequence: TTA
caggcgtgagccactgagcc

SEQ ID NO: 245894 - DNA, 20 bp, Artificial Sequence
  Description of Artificial Sequence: Synthetic oligonucleotide
  Target: ATXN1; (+) strand; PAM type: YTN; PAM sequence: CTG
agcccggcctgtctcagtga

SEQ ID NO: 245895 - DNA, 20 bp, Artificial Sequence
  Description of Artificial Sequence: Synthetic oligonucleotide
  Target: ATXN1; (+) strand; PAM type: YTN; PAM sequence: CTG
tctcagtgattttaattaca

SEQ ID NO: 245896 - DNA, 20 bp, Artificial Sequence
  Description of Artificial Sequence: Synthetic oligonucleotide
  Target: ATXN1; (+) strand; PAM type: YTN; PAM sequence: CTC
agtgattttaattacagcag

SEQ ID NO: 245897 - DNA, 20 bp, Artificial Sequence
  Description of Artificial Sequence: Synthetic oligonucleotide
  Target: ATXN1; (+) strand; PAM type: YTN; PAM sequence: TTT
taattacagcagccaatcct

SEQ ID NO: 245898 - DNA, 20 bp, Artificial Sequence
  Description of Artificial Sequence: Synthetic oligonucleotide
  Target: ATXN1; (+) strand; PAM type: YTN; PAM sequence: TTT
aattacagcagccaatcctt

SEQ ID NO: 245899 - DNA, 20 bp, Artificial Sequence
  Description of Artificial Sequence: Synthetic oligonucleotide
  Target: ATXN1; (+) strand; PAM type: YTN; PAM sequence: TTA
attacagcagccaatccttt

SEQ ID NO: 245900 - DNA, 20 bp, Artificial Sequence
  Description of Artificial Sequence: Synthetic oligonucleotide
  Target: ATXN1; (+) strand; PAM type: YTN; PAM sequence: TTA
cagcagccaatccttttccc

SEQ ID NO: 245901 - DNA, 20 bp, Artificial Sequence
  Description of Artificial Sequence: Synthetic oligonucleotide
  Target: ATXN1; (+) strand; PAM type: YTN; PAM sequence: CTT
ttccccactttgccaacaca

SEQ ID NO: 245902 - DNA, 20 bp, Artificial Sequence
  Description of Artificial Sequence: Synthetic oligonucleotide
  Target: ATXN1; (+) strand; PAM type: YTN; PAM sequence: TTT
tccccactttgccaacacaa

SEQ ID NO: 245903 - DNA, 20 bp, Artificial Sequence
  Description of Artificial Sequence: Synthetic oligonucleotide
  Target: ATXN1; (+) strand; PAM type: YTN; PAM sequence: TTT
ccccactttgccaacacaaa

SEQ ID NO: 245904 - DNA, 20 bp, Artificial Sequence
  Description of Artificial Sequence: Synthetic oligonucleotide
  Target: ATXN1; (+) strand; PAM type: YTN; PAM sequence: TTC
cccactttgccaacacaaaa

SEQ ID NO: 245905 - DNA, 20 bp, Artificial Sequence
  Description of Artificial Sequence: Synthetic oligonucleotide
  Target: ATXN1; (+) strand; PAM type: YTN; PAM sequence: CTT
tgccaacacaaaagtcgtgt

SEQ ID NO: 245906 - DNA, 20 bp, Artificial Sequence
  Description of Artificial Sequence: Synthetic oligonucleotide
  Target: ATXN1; (+) strand; PAM type: YTN; PAM sequence: TTT
gccaacacaaaagtcgtgtt

SEQ ID NO: 245907 - DNA, 20 bp, Artificial Sequence
  Description of Artificial Sequence: Synthetic oligonucleotide
  Target: ATXN1; (+) strand; PAM type: YTN; PAM sequence: TTG
ccaacacaaaagtcgtgttc

SEQ ID NO: 245908 - DNA, 20 bp, Artificial Sequence
  Description of Artificial Sequence: Synthetic oligonucleotide
  Target: ATXN1; (+) strand; PAM type: YTN; PAM sequence: TTC
taacctcctttaatcatact

SEQ ID NO: 245909 - DNA, 20 bp, Artificial Sequence
  Description of Artificial Sequence: Synthetic oligonucleotide
  Target: ATXN1; (+) strand; PAM type: YTN; PAM sequence: CTA
acctcctttaatcatactta

SEQ ID NO: 245910 - DNA, 20 bp, Artificial Sequence
  Description of Artificial Sequence: Synthetic oligonucleotide
  Target: ATXN1; (+) strand; PAM type: YTN; PAM sequence: CTC
ctttaatcatacttaaaatt

SEQ ID NO: 245911 - DNA, 20 bp, Artificial Sequence
  Description of Artificial Sequence: Synthetic oligonucleotide
  Target: ATXN1; (+) strand; PAM type: YTN; PAM sequence: CTT
taatcatacttaaaattata

SEQ ID NO: 245912 - DNA, 20 bp, Artificial Sequence
  Description of Artificial Sequence: Synthetic oligonucleotide
  Target: ATXN1; (+) strand; PAM type: YTN; PAM sequence: TTT
aatcatacttaaaattatat

SEQ ID NO: 245913 - DNA, 20 bp, Artificial Sequence
  Description of Artificial Sequence: Synthetic oligonucleotide
  Target: ATXN1; (+) strand; PAM type: YTN; PAM sequence: TTA
atcatacttaaaattatatg

SEQ ID NO: 245914 - DNA, 20 bp, Artificial Sequence
  Description of Artificial Sequence: Synthetic oligonucleotide
  Target: ATXN1; (+) strand; PAM type: YTN; PAM sequence: CTT
aaaattatatgctatgtcca

SEQ ID NO: 245915 - DNA, 20 bp, Artificial Sequence
  Description of Artificial Sequence: Synthetic oligonucleotide
  Target: ATXN1; (+) strand; PAM type: YTN; PAM sequence: TTA
aaattatatgctatgtccac

SEQ ID NO: 245916 - DNA, 20 bp, Artificial Sequence
  Description of Artificial Sequence: Synthetic oligonucleotide
  Target: ATXN1; (+) strand; PAM type: YTN; PAM sequence: TTA
tatgctatgtccacaatgag

SEQ ID NO: 245917 - DNA, 20 bp, Artificial Sequence
  Description of Artificial Sequence: Synthetic oligonucleotide
  Target: ATXN1; (+) strand; PAM type: YTN; PAM sequence: CTA
tgtccacaatgagacaccac

SEQ ID NO: 245918 - DNA, 20 bp, Artificial Sequence
  Description of Artificial Sequence: Synthetic oligonucleotide
  Target: ATXN1; (+) strand; PAM type: YTN; PAM sequence: CTT
cacactcattaagatggaca

SEQ ID NO: 245919 - DNA, 20 bp, Artificial Sequence
  Description of Artificial Sequence: Synthetic oligonucleotide
  Target: ATXN1; (+) strand; PAM type: YTN; PAM sequence: TTC
acactcattaagatggacat

SEQ ID NO: 245920 - DNA, 20 bp, Artificial Sequence
  Description of Artificial Sequence: Synthetic oligonucleotide
  Target: ATXN1; (+) strand; PAM type: YTN; PAM sequence: CTC
attaagatggacattatatt

SEQ ID NO: 245921 - DNA, 20 bp, Artificial Sequence
  Description of Artificial Sequence: Synthetic oligonucleotide
  Target: ATXN1; (+) strand; PAM type: YTN; PAM sequence: TTA
agatggacattatattcttt

SEQ ID NO: 245922 - DNA, 20 bp, Artificial Sequence
  Description of Artificial Sequence: Synthetic oligonucleotide
  Target: ATXN1; (+) strand; PAM type: YTN; PAM sequence: TTA
tattcttttttttaaaaaaa

SEQ ID NO: 245923 - DNA, 20 bp, Artificial Sequence
  Description of Artificial Sequence: Synthetic oligonucleotide
  Target: ATXN1; (+) strand; PAM type: YTN; PAM sequence: TTC
ttttttttaaaaaaaaaaac

SEQ ID NO: 245924 - DNA, 20 bp, Artificial Sequence
  Description of Artificial Sequence: Synthetic oligonucleotide
  Target: ATXN1; (+) strand; PAM type: YTN; PAM sequence: CTT
ttttttaaaaaaaaaaacaa

SEQ ID NO: 245925 - DNA, 20 bp, Artificial Sequence
  Description of Artificial Sequence: Synthetic oligonucleotide
  Target: ATXN1; (+) strand; PAM type: YTN; PAM sequence: TTT
tttttaaaaaaaaaaacaaa

SEQ ID NO: 245926 - DNA, 20 bp, Artificial Sequence
  Description of Artificial Sequence: Synthetic oligonucleotide
  Target: ATXN1; (+) strand; PAM type: YTN; PAM sequence: TTT
ttttaaaaaaaaaaacaaaa

SEQ ID NO: 245927 - DNA, 20 bp, Artificial Sequence
  Description of Artificial Sequence: Synthetic oligonucleotide
  Target: ATXN1; (+) strand; PAM type: YTN; PAM sequence: TTT
tttaaaaaaaaaaacaaaac

SEQ ID NO: 245928 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaaaaaaacaaaaca

SEQ ID NO: 245929 - DNA, 20 bp, Artificial Sequence
  Description of Artificial Sequence: Synthetic oligonucleotide
  Target: ATXN1; (+) strand; PAM type: YTN; PAM sequence: TTT
taaaaaaaaaaacaaaacaa

SEQ ID NO: 245930 - DNA, 20 bp, Artificial Sequence
  Description of Artificial Sequence: Synthetic oligonucleotide
  Target: ATXN1; (+) strand; PAM type: YTN; PAM sequence: TTT
aaaaaaaaaaacaaaacaaa

SEQ ID NO: 245931 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaaacaaaacaaaa

SEQ ID NO: 245932 - DNA, 20 bp, Artificial Sequence
  Description of Artificial Sequence: Synthetic oligonucleotide
  Target: ATXN1; (+) strand; PAM type: YTN; PAM sequence: TTG
gtggagatggggaaacgaga

SEQ ID NO: 245933 - DNA, 20 bp, Artificial Sequence
  Description of Artificial Sequence: Synthetic oligonucleotide
  Target: ATXN1; (+) strand; PAM type: YTN; PAM sequence: CTA
tgtgcatcgttggtgggaac

SEQ ID NO: 245934 - DNA, 20 bp, Artificial Sequence
  Description of Artificial Sequence: Synthetic oligonucleotide
  Target: ATXN1; (+) strand; PAM type: YTN; PAM sequence: TTG
gtgggaacgtaaaatgatgc

SEQ ID NO: 245935 - DNA, 20 bp, Artificial Sequence
  Description of Artificial Sequence: Synthetic oligonucleotide
  Target: ATXN1; (+) strand; PAM type: YTN; PAM sequence: CTG
catggaaaacattttggcag

SEQ ID NO: 245936 - DNA, 20 bp, Artificial Sequence
  Description of Artificial Sequence: Synthetic oligonucleotide
  Target: ATXN1; (+) strand; PAM type: YTN; PAM sequence: TTT
tggcagttcctcaaaatgtg

SEQ ID NO: 245937 - DNA, 20 bp, Artificial Sequence
  Description of Artificial Sequence: Synthetic oligonucleotide
  Target: ATXN1; (+) strand; PAM type: YTN; PAM sequence: TTT
ggcagttcctcaaaatgtga

SEQ ID NO: 245938 - DNA, 20 bp, Artificial Sequence
  Description of Artificial Sequence: Synthetic oligonucleotide
  Target: ATXN1; (+) strand; PAM type: YTN; PAM sequence: TTG
gcagttcctcaaaatgtgaa

SEQ ID NO: 245939 - DNA, 20 bp, Artificial Sequence
  Description of Artificial Sequence: Synthetic oligonucleotide
  Target: ATXN1; (+) strand; PAM type: YTN; PAM sequence: TTC
ctcaaaatgtgaaatacaga

SEQ ID NO: 245940 - DNA, 20 bp, Artificial Sequence
  Description of Artificial Sequence: Synthetic oligonucleotide
  Target: ATXN1; (+) strand; PAM type: YTN; PAM sequence: CTC
aaaatgtgaaatacagaatt

SEQ ID NO: 245941 - DNA, 20 bp, Artificial Sequence
  Description of Artificial Sequence: Synthetic oligonucleotide
  Target: ATXN1; (+) strand; PAM type: YTN; PAM sequence: TTA
ccacatgactcagcaattcc

SEQ ID NO: 245942 - DNA, 20 bp, Artificial Sequence
  Description of Artificial Sequence: Synthetic oligonucleotide
  Target: ATXN1; (+) strand; PAM type: YTN; PAM sequence: CTC
agcaattccacgtctggata

SEQ ID NO: 245943 - DNA, 20 bp, Artificial Sequence
  Description of Artificial Sequence: Synthetic oligonucleotide
  Target: ATXN1; (+) strand; PAM type: YTN; PAM sequence: TTC
cacgtctggatatctaccac

SEQ ID NO: 245944 - DNA, 20 bp, Artificial Sequence
  Description of Artificial Sequence: Synthetic oligonucleotide
  Target: ATXN1; (+) strand; PAM type: YTN; PAM sequence: CTG
gatatctaccacaaagcact

SEQ ID NO: 245945 - DNA, 20 bp, Artificial Sequence
  Description of Artificial Sequence: Synthetic oligonucleotide
  Target: ATXN1; (+) strand; PAM type: YTN; PAM sequence: CTA
ccacaaagcactgaaagcag

SEQ ID NO: 245946 - DNA, 20 bp, Artificial Sequence
  Description of Artificial Sequence: Synthetic oligonucleotide
  Target: ATXN1; (+) strand; PAM type: YTN; PAM sequence: CTG
aaagcagggactcagatatt

SEQ ID NO: 245947 - DNA, 20 bp, Artificial Sequence
  Description of Artificial Sequence: Synthetic oligonucleotide
  Target: ATXN1; (+) strand; PAM type: YTN; PAM sequence: CTC
agatattccacacccgtgtt

SEQ ID NO: 245948 - DNA, 20 bp, Artificial Sequence
  Description of Artificial Sequence: Synthetic oligonucleotide
  Target: ATXN1; (+) strand; PAM type: YTN; PAM sequence: TTC
cacacccgtgttcatagcag

SEQ ID NO: 245949 - DNA, 20 bp, Artificial Sequence
  Description of Artificial Sequence: Synthetic oligonucleotide
  Target: ATXN1; (+) strand; PAM type: YTN; PAM sequence: TTC
atagcagcattgtgcacacg

SEQ ID NO: 245950 - DNA, 20 bp, Artificial Sequence
  Description of Artificial Sequence: Synthetic oligonucleotide
  Target: ATXN1; (+) strand; PAM type: YTN; PAM sequence: TTG
tgcacacgagccaaaaggtg

SEQ ID NO: 245951 - DNA, 20 bp, Artificial Sequence
  Description of Artificial Sequence: Synthetic oligonucleotide
  Target: ATXN1; (+) strand; PAM type: YTN; PAM sequence: CTT
taaaaatgtggtatatcctt

SEQ ID NO: 245952 - DNA, 20 bp, Artificial Sequence
  Description of Artificial Sequence: Synthetic oligonucleotide
  Target: ATXN1; (+) strand; PAM type: YTN; PAM sequence: TTT
aaaaatgtggtatatcctta

SEQ ID NO: 245953 - DNA, 20 bp, Artificial Sequence
  Description of Artificial Sequence: Synthetic oligonucleotide
  Target: ATXN1; (+) strand; PAM type: YTN; PAM sequence: TTA
aaaatgtggtatatccttat

SEQ ID NO: 245954 - DNA, 20 bp, Artificial Sequence
  Description of Artificial Sequence: Synthetic oligonucleotide
  Target: ATXN1; (+) strand; PAM type: YTN; PAM sequence: CTT
atgacgagctattattcatc

SEQ ID NO: 245955 - DNA, 20 bp, Artificial Sequence
  Description of Artificial Sequence: Synthetic oligonucleotide
  Target: ATXN1; (+) strand; PAM type: YTN; PAM sequence: TTA
tgacgagctattattcatcc

SEQ ID NO: 245956 - DNA, 20 bp, Artificial Sequence
  Description of Artificial Sequence: Synthetic oligonucleotide
  Target: ATXN1; (+) strand; PAM type: YTN; PAM sequence: CTA
ttattcatccccctctcctt

SEQ ID NO: 245957 - DNA, 20 bp, Artificial Sequence
  Description of Artificial Sequence: Synthetic oligonucleotide
  Target: ATXN1; (+) strand; PAM type: YTN; PAM sequence: TTA
ttcatccccctctccttaca

SEQ ID NO: 245958 - DNA, 20 bp, Artificial Sequence
  Description of Artificial Sequence: Synthetic oligonucleotide
  Target: ATXN1; (+) strand; PAM type: YTN; PAM sequence: TTC
atccccctctccttacaaag

SEQ ID NO: 245959 - DNA, 20 bp, Artificial Sequence
  Description of Artificial Sequence: Synthetic oligonucleotide
  Target: ATXN1; (+) strand; PAM type: YTN; PAM sequence: CTC
tccttacaaaggaatgacat

SEQ ID NO: 245960 - DNA, 20 bp, Artificial Sequence
  Description of Artificial Sequence: Synthetic oligonucleotide
  Target: ATXN1; (+) strand; PAM type: YTN; PAM sequence: CTC
cttacaaaggaatgacattc

SEQ ID NO: 245961 - DNA, 20 bp, Artificial Sequence
  Description of Artificial Sequence: Synthetic oligonucleotide
  Target: ATXN1; (+) strand; PAM type: YTN; PAM sequence: CTT
acaaaggaatgacattctgt

SEQ ID NO: 245962 - DNA, 20 bp, Artificial Sequence
  Description of Artificial Sequence: Synthetic oligonucleotide
  Target: ATXN1; (+) strand; PAM type: YTN; PAM sequence: TTA
caaaggaatgacattctgtt

SEQ ID NO: 245963 - DNA, 20 bp, Artificial Sequence
  Description of Artificial Sequence: Synthetic oligonucleotide
  Target: ATXN1; (+) strand; PAM type: YTN; PAM sequence: TTC
tgttacatgctatgacattg

SEQ ID NO: 245964 - DNA, 20 bp, Artificial Sequence
  Description of Artificial Sequence: Synthetic oligonucleotide
  Target: ATXN1; (+) strand; PAM type: YTN; PAM sequence: CTG
ttacatgctatgacattgat

SEQ ID NO: 245965 - DNA, 20 bp, Artificial Sequence
  Description of Artificial Sequence: Synthetic oligonucleotide
  Target: ATXN1; (+) strand; PAM type: YTN; PAM sequence: TTA
catgctatgacattgataaa

SEQ ID NO: 245966 - DNA, 20 bp, Artificial Sequence
  Description of Artificial Sequence: Synthetic oligonucleotide
  Target: ATXN1; (+) strand; PAM type: YTN; PAM sequence: CTA
tgacattgataaatcttcaa

SEQ ID NO: 245967 - DNA, 20 bp, Artificial Sequence
  Description of Artificial Sequence: Synthetic oligonucleotide
  Target: ATXN1; (+) strand; PAM type: YTN; PAM sequence: TTG
ataaatcttcaaacattatg

SEQ ID NO: 245968 - DNA, 20 bp, Artificial Sequence
  Description of Artificial Sequence: Synthetic oligonucleotide
  Target: ATXN1; (+) strand; PAM type: YTN; PAM sequence: CTT
caaacattatgctaagtgaa

SEQ ID NO: 245969 - DNA, 20 bp, Artificial Sequence
  Description of Artificial Sequence: Synthetic oligonucleotide
  Target: ATXN1; (+) strand; PAM type: YTN; PAM sequence: TTC
aaacattatgctaagtgaaa

SEQ ID NO: 245970 - DNA, 20 bp, Artificial Sequence
  Description of Artificial Sequence: Synthetic oligonucleotide
  Target: ATXN1; (+) strand; PAM type: YTN; PAM sequence: TTA
tgctaagtgaaagaagccag

SEQ ID NO: 245971 - DNA, 20 bp, Artificial Sequence
  Description of Artificial Sequence: Synthetic oligonucleotide
  Target: ATXN1; (+) strand; PAM type: YTN; PAM sequence: CTA
agtgaaagaagccagacaca

SEQ ID NO: 245972 - DNA, 20 bp, Artificial Sequence
  Description of Artificial Sequence: Synthetic oligonucleotide
  Target: ATXN1; (+) strand; PAM type: YTN; PAM sequence: TTC
cccttctatgaggaatctag

SEQ ID NO: 245973 - DNA, 20 bp, Artificial Sequence
  Description of Artificial Sequence: Synthetic oligonucleotide
  Target: ATXN1; (+) strand; PAM type: YTN; PAM sequence: CTT
ctatgaggaatctagaatag

SEQ ID NO: 245974 - DNA, 20 bp, Artificial Sequence
  Description of Artificial Sequence: Synthetic oligonucleotide
  Target: ATXN1; (+) strand; PAM type: YTN; PAM sequence: TTC
tatgaggaatctagaatagt

SEQ ID NO: 245975 - DNA, 20 bp, Artificial Sequence
  Description of Artificial Sequence: Synthetic oligonucleotide
  Target: ATXN1; (+) strand; PAM type: YTN; PAM sequence: CTA
tgaggaatctagaatagtca

SEQ ID NO: 245976 - DNA, 20 bp, Artificial Sequence
  Description of Artificial Sequence: Synthetic oligonucleotide
  Target: ATXN1; (+) strand; PAM type: YTN; PAM sequence: CTA
gaatagtcaaatttggagag

SEQ ID NO: 245977 - DNA, 20 bp, Artificial Sequence
  Description of Artificial Sequence: Synthetic oligonucleotide
  Target: ATXN1; (+) strand; PAM type: YTN; PAM sequence: TTT
ggagagagcgtagaacaggc

SEQ ID NO: 245978 - DNA, 20 bp, Artificial Sequence
  Description of Artificial Sequence: Synthetic oligonucleotide
  Target: ATXN1; (+) strand; PAM type: YTN; PAM sequence: TTG
gagagagcgtagaacaggcg

SEQ ID NO: 245979 - DNA, 20 bp, Artificial Sequence
  Description of Artificial Sequence: Synthetic oligonucleotide
  Target: ATXN1; (+) strand; PAM type: YTN; PAM sequence: TTA
gcaggagctgggaggacggg

SEQ ID NO: 245980 - DNA, 20 bp, Artificial Sequence
  Description of Artificial Sequence: Synthetic oligonucleotide
  Target: ATXN1; (+) strand; PAM type: YTN; PAM sequence: CTG
ggaggacggggcaatgggag

SEQ ID NO: 245981 - DNA, 20 bp, Artificial Sequence
  Description of Artificial Sequence: Synthetic oligonucleotide
  Target: ATXN1; (+) strand; PAM type: YTN; PAM sequence: TTG
tttaacggttccagaatttc

SEQ ID NO: 245982 - DNA, 20 bp, Artificial Sequence
  Description of Artificial Sequence: Synthetic oligonucleotide
  Target: ATXN1; (+) strand; PAM type: YTN; PAM sequence: TTT
aacggttccagaatttcagt

SEQ ID NO: 245983 - DNA, 20 bp, Artificial Sequence
  Description of Artificial Sequence: Synthetic oligonucleotide
  Target: ATXN1; (+) strand; PAM type: YTN; PAM sequence: TTA
acggttccagaatttcagtt

SEQ ID NO: 245984 - DNA, 20 bp, Artificial Sequence
  Description of Artificial Sequence: Synthetic oligonucleotide
  Target: ATXN1; (+) strand; PAM type: YTN; PAM sequence: TTC
cagaatttcagtttggtatg

SEQ ID NO: 245985 - DNA, 20 bp, Artificial Sequence
  Description of Artificial Sequence: Synthetic oligonucleotide
  Target: ATXN1; (+) strand; PAM type: YTN; PAM sequence: TTT
cagtttggtatgatggaaac

SEQ ID NO: 245986 - DNA, 20 bp, Artificial Sequence
  Description of Artificial Sequence: Synthetic oligonucleotide
  Target: ATXN1; (+) strand; PAM type: YTN; PAM sequence: TTC
agtttggtatgatggaaaca

SEQ ID NO: 245987 - DNA, 20 bp, Artificial Sequence
  Description of Artificial Sequence: Synthetic oligonucleotide
  Target: ATXN1; (+) strand; PAM type: YTN; PAM sequence: TTT
ggtatgatggaaacattctg

SEQ ID NO: 245988 - DNA, 20 bp, Artificial Sequence
  Description of Artificial Sequence: Synthetic oligonucleotide
  Target: ATXN1; (+) strand; PAM type: YTN; PAM sequence: TTG
gtatgatggaaacattctgg

SEQ ID NO: 245989 - DNA, 20 bp, Artificial Sequence
  Description of Artificial Sequence: Synthetic oligonucleotide
  Target: ATXN1; (+) strand; PAM type: YTN; PAM sequence: TTC
tggagacagatggtggtgat

SEQ ID NO: 245990 - DNA, 20 bp, Artificial Sequence
  Description of Artificial Sequence: Synthetic oligonucleotide
  Target: ATXN1; (+) strand; PAM type: YTN; PAM sequence: CTG
gagacagatggtggtgatgg

SEQ ID NO: 245991 - DNA, 20 bp, Artificial Sequence
  Description of Artificial Sequence: Synthetic oligonucleotide
  Target: ATXN1; (+) strand; PAM type: YTN; PAM sequence: TTG
aacaagaatgtgccacttaa

SEQ ID NO: 245992 - DNA, 20 bp, Artificial Sequence
  Description of Artificial Sequence: Synthetic oligonucleotide
  Target: ATXN1; (+) strand; PAM type: YTN; PAM sequence: CTT
aaccgtgcacgtaaaaatga

SEQ ID NO: 245993 - DNA, 20 bp, Artificial Sequence
  Description of Artificial Sequence: Synthetic oligonucleotide
  Target: ATXN1; (+) strand; PAM type: YTN; PAM sequence: TTA
accgtgcacgtaaaaatgat

SEQ ID NO: 245994 - DNA, 20 bp, Artificial Sequence
  Description of Artificial Sequence: Synthetic oligonucleotide
  Target: ATXN1; (+) strand; PAM type: YTN; PAM sequence: TTA
agatggtaaatttcatatta

SEQ ID NO: 245995 - DNA, 20 bp, Artificial Sequence
  Description of Artificial Sequence: Synthetic oligonucleotide
  Target: ATXN1; (+) strand; PAM type: YTN; PAM sequence: TTT
catattatgcatattttgtc

SEQ ID NO: 245996 - DNA, 20 bp, Artificial Sequence
  Description of Artificial Sequence: Synthetic oligonucleotide
  Target: ATXN1; (+) strand; PAM type: YTN; PAM sequence: TTC
atattatgcatattttgtca

SEQ ID NO: 245997 - DNA, 20 bp, Artificial Sequence
  Description of Artificial Sequence: Synthetic oligonucleotide
  Target: ATXN1; (+) strand; PAM type: YTN; PAM sequence: TTA
tgcatattttgtcaccagtc

SEQ ID NO: 245998 - DNA, 20 bp, Artificial Sequence
  Description of Artificial Sequence: Synthetic oligonucleotide
  Target: ATXN1; (+) strand; PAM type: YTN; PAM sequence: TTT
tgtcaccagtcaaaaatttt

SEQ ID NO: 245999 - DNA, 20 bp, Artificial Sequence
  Description of Artificial Sequence: Synthetic oligonucleotide
  Target: ATXN1; (+) strand; PAM type: YTN; PAM sequence: TTT
gtcaccagtcaaaaattttt

SEQ ID NO: 246000 - DNA, 20 bp, Artificial Sequence
  Description of Artificial Sequence: Synthetic oligonucleotide
  Target: ATXN1; (+) strand; PAM type: YTN; PAM sequence: TTG
tcaccagtcaaaaattttta

SEQ ID NO: 246001 - DNA, 20 bp, Artificial Sequence
  Description of Artificial Sequence: Synthetic oligonucleotide
  Target: ATXN1; (+) strand; PAM type: YTN; PAM sequence: TTT
ttaaaaataagtatgtcatg

SEQ ID NO: 246002 - DNA, 20 bp, Artificial Sequence
  Description of Artificial Sequence: Synthetic oligonucleotide
  Target: ATXN1; (+) strand; PAM type: YTN; PAM sequence: TTT
taaaaataagtatgtcatgg

SEQ ID NO: 246003 - DNA, 20 bp, Artificial Sequence
  Description of Artificial Sequence: Synthetic oligonucleotide
  Target: ATXN1; (+) strand; PAM type: YTN; PAM sequence: TTT
aaaaataagtatgtcatggc

SEQ ID NO: 246004 - DNA, 20 bp, Artificial Sequence
  Description of Artificial Sequence: Synthetic oligonucleotide
  Target: ATXN1; (+) strand; PAM type: YTN; PAM sequence: TTA
aaaataagtatgtcatggct

SEQ ID NO: 246005 - DNA, 20 bp, Artificial Sequence
  Description of Artificial Sequence: Synthetic oligonucleotide
  Target: ATXN1; (+) strand; PAM type: YTN; PAM sequence: CTG
ggcgcgttggctcacgcctg

SEQ ID NO: 246006 - DNA, 20 bp, Artificial Sequence
  Description of Artificial Sequence: Synthetic oligonucleotide
  Target: ATXN1; (+) strand; PAM type: YTN; PAM sequence: TTG
gctcacgcctgtaatcccag

SEQ ID NO: 246007 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 246008 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 246009 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaggcgcgcag

SEQ ID NO: 246010 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggcgcgcaga

SEQ ID NO: 246011 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcgcgcagat

SEQ ID NO: 246012 - DNA, 20 bp, Artificial Sequence
  Description of Artificial Sequence: Synthetic oligonucleotide
  Target: ATXN1; (+) strand; PAM type: YTN; PAM sequence: CTG
aggcgcgcagatcacaaggt

SEQ ID NO: 246013 - DNA, 20 bp, Artificial Sequence
  Description of Artificial Sequence: Synthetic oligonucleotide
  Target: ATXN1; (+) strand; PAM type: YTN; PAM sequence: CTG
gctaacacggtgaaaccctg

SEQ ID NO: 246014 - DNA, 20 bp, Artificial Sequence
  Description of Artificial Sequence: Synthetic oligonucleotide
  Target: ATXN1; (+) strand; PAM type: YTN; PAM sequence: CTA
acacggtgaaaccctgtctc

SEQ ID NO: 246015 - DNA, 20 bp, Artificial Sequence
  Description of Artificial Sequence: Synthetic oligonucleotide
  Target: ATXN1; (+) strand; PAM type: YTN; PAM sequence: CTG
tctctactaaaaaatagaaa

SEQ ID NO: 246016 - DNA, 20 bp, Artificial Sequence
  Description of Artificial Sequence: Synthetic oligonucleotide
  Target: ATXN1; (+) strand; PAM type: YTN; PAM sequence: CTC
tactaaaaaatagaaaaaat

SEQ ID NO: 246017 - DNA, 20 bp, Artificial Sequence
  Description of Artificial Sequence: Synthetic oligonucleotide
  Target: ATXN1; (+) strand; PAM type: YTN; PAM sequence: CTA
ctaaaaaatagaaaaaatta

SEQ ID NO: 246018 - DNA, 20 bp, Artificial Sequence
  Description of Artificial Sequence: Synthetic oligonucleotide
  Target: ATXN1; (+) strand; PAM type: YTN; PAM sequence: CTA
aaaaatagaaaaaattagcc

SEQ ID NO: 246019 - DNA, 20 bp, Artificial Sequence
  Description of Artificial Sequence: Synthetic oligonucleotide
  Target: ATXN1; (+) strand; PAM type: YTN; PAM sequence: TTA
gccgggcgtggtggtgggca

SEQ ID NO: 246020 - DNA, 20 bp, Artificial Sequence
  Description of Artificial Sequence: Synthetic oligonucleotide
  Target: ATXN1; (+) strand; PAM type: YTN; PAM sequence: CTA
ctcgagaggctgagacagga

SEQ ID NO: 246021 - DNA, 20 bp, Artificial Sequence
  Description of Artificial Sequence: Synthetic oligonucleotide
  Target: ATXN1; (+) strand; PAM type: YTN; PAM sequence: CTC
gagaggctgagacaggagaa

SEQ ID NO: 246022 - DNA, 20 bp, Artificial Sequence
  Description of Artificial Sequence: Synthetic oligonucleotide
  Target: ATXN1; (+) strand; PAM type: YTN; PAM sequence: CTG
agacaggagaatggcgtgaa

SEQ ID NO: 246023 - DNA, 20 bp, Artificial Sequence
  Description of Artificial Sequence: Synthetic oligonucleotide
  Target: ATXN1; (+) strand; PAM type: YTN; PAM sequence: CTG
ggaggcaggcttgcagtgag

SEQ ID NO: 246024 - DNA, 20 bp, Artificial Sequence
  Description of Artificial Sequence: Synthetic oligonucleotide
  Target: ATXN1; (+) strand; PAM type: YTN; PAM sequence: CTT
gcagtgagctgagatcgcac

SEQ ID NO: 246025 - DNA, 20 bp, Artificial Sequence
  Description of Artificial Sequence: Synthetic oligonucleotide
  Target: ATXN1; (+) strand; PAM type: YTN; PAM sequence: TTG
cagtgagctgagatcgcacc

SEQ ID NO: 246026 - DNA, 20 bp, Artificial Sequence
  Description of Artificial Sequence: Synthetic oligonucleotide
  Target: ATXN1; (+) strand; PAM type: YTN; PAM sequence: CTG
agatcgcaccactgcactcc

SEQ ID NO: 246027 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggtgacag

SEQ ID NO: 246028 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacagagcga

SEQ ID NO: 246029 - DNA, 20 bp, Artificial Sequence
  Description of Artificial Sequence: Synthetic oligonucleotide
  Target: ATXN1; (+) strand; PAM type: YTN; PAM sequence: CTG
ggtgacagagcgagactctg

SEQ ID NO: 246030 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaataaataaataa

SEQ ID NO: 246031 - DNA, 20 bp, Artificial Sequence
  Description of Artificial Sequence: Synthetic oligonucleotide
  Target: ATXN1; (+) strand; PAM type: YTN; PAM sequence: CTG
tctcaaataaataaataaat

SEQ ID NO: 246032 - DNA, 20 bp, Artificial Sequence
  Description of Artificial Sequence: Synthetic oligonucleotide
  Target: ATXN1; (+) strand; PAM type: YTN; PAM sequence: CTC
aaataaataaataaataaat

SEQ ID NO: 246033 - DNA, 20 bp, Artificial Sequence
  Description of Artificial Sequence: Synthetic oligonucleotide
  Target: ATXN1; (+) strand; PAM type: YTN; PAM sequence: CTT
aaaagtttgtgaacaaactg

SEQ ID NO: 246034 - DNA, 20 bp, Artificial Sequence
  Description of Artificial Sequence: Synthetic oligonucleotide
  Target: ATXN1; (+) strand; PAM type: YTN; PAM sequence: TTA
aaagtttgtgaacaaactgc

SEQ ID NO: 246035 - DNA, 20 bp, Artificial Sequence
  Description of Artificial Sequence: Synthetic oligonucleotide
  Target: ATXN1; (+) strand; PAM type: YTN; PAM sequence: TTT
gtgaacaaactgcatttctg

SEQ ID NO: 246036 - DNA, 20 bp, Artificial Sequence
  Description of Artificial Sequence: Synthetic oligonucleotide
  Target: ATXN1; (+) strand; PAM type: YTN; PAM sequence: TTG
tgaacaaactgcatttctgt

SEQ ID NO: 246037 - DNA, 20 bp, Artificial Sequence
  Description of Artificial Sequence: Synthetic oligonucleotide
  Target: ATXN1; (+) strand; PAM type: YTN; PAM sequence: CTG
catttctgttttgaaaccac

SEQ ID NO: 246038 - DNA, 20 bp, Artificial Sequence
  Description of Artificial Sequence: Synthetic oligonucleotide
  Target: ATXN1; (+) strand; PAM type: YTN; PAM sequence: TTT
ctgttttgaaaccacacagc

SEQ ID NO: 246039 - DNA, 20 bp, Artificial Sequence
  Description of Artificial Sequence: Synthetic oligonucleotide
  Target: ATXN1; (+) strand; PAM type: YTN; PAM sequence: TTC
tgttttgaaaccacacagcg

SEQ ID NO: 246040 - DNA, 20 bp, Artificial Sequence
  Description of Artificial Sequence: Synthetic oligonucleotide
  Target: ATXN1; (+) strand; PAM type: YTN; PAM sequence: CTG
ttttgaaaccacacagcgcc

SEQ ID NO: 246041 - DNA, 20 bp, Artificial Sequence
  Description of Artificial Sequence: Synthetic oligonucleotide
  Target: ATXN1; (+) strand; PAM type: YTN; PAM sequence: TTT
tgaaaccacacagcgccccg

SEQ ID NO: 246042 - DNA, 20 bp, Artificial Sequence
  Description of Artificial Sequence: Synthetic oligonucleotide
  Target: ATXN1; (+) strand; PAM type: YTN; PAM sequence: TTT
gaaaccacacagcgccccgc

SEQ ID NO: 246043 - DNA, 20 bp, Artificial Sequence
  Description of Artificial Sequence: Synthetic oligonucleotide
  Target: ATXN1; (+) strand; PAM type: YTN; PAM sequence: TTG
aaaccacacagcgccccgct

SEQ ID NO: 246044 - DNA, 20 bp, Artificial Sequence
  Description of Artificial Sequence: Synthetic oligonucleotide
  Target: ATXN1; (+) strand; PAM type: YTN; PAM sequence: CTC
cctcatctgcttggagctac

SEQ ID NO: 246045 - DNA, 20 bp, Artificial Sequence
  Description of Artificial Sequence: Synthetic oligonucleotide
  Target: ATXN1; (+) strand; PAM type: YTN; PAM sequence: CTC
atctgcttggagctacaagg

SEQ ID NO: 246046 - DNA, 20 bp, Artificial Sequence
  Description of Artificial Sequence: Synthetic oligonucleotide
  Target: ATXN1; (+) strand; PAM type: YTN; PAM sequence: CTG
cttggagctacaaggatctc

SEQ ID NO: 246047 - DNA, 20 bp, Artificial Sequence
  Description of Artificial Sequence: Synthetic oligonucleotide
  Target: ATXN1; (+) strand; PAM type: YTN; PAM sequence: CTT
ggagctacaaggatctctga

SEQ ID NO: 246048 - DNA, 20 bp, Artificial Sequence
  Description of Artificial Sequence: Synthetic oligonucleotide
  Target: ATXN1; (+) strand; PAM type: YTN; PAM sequence: TTG
gagctacaaggatctctgag

SEQ ID NO: 246049 - DNA, 20 bp, Artificial Sequence
  Description of Artificial Sequence: Synthetic oligonucleotide
  Target: ATXN1; (+) strand; PAM type: YTN; PAM sequence: CTA
caaggatctctgagatacct

SEQ ID NO: 246050 - DNA, 20 bp, Artificial Sequence
  Description of Artificial Sequence: Synthetic oligonucleotide
  Target: ATXN1; (+) strand; PAM type: YTN; PAM sequence: CTC
tgagatacctgctggcatta

SEQ ID NO: 246051 - DNA, 20 bp, Artificial Sequence
  Description of Artificial Sequence: Synthetic oligonucleotide
  Target: ATXN1; (+) strand; PAM type: YTN; PAM sequence: CTG
agatacctgctggcattagc

SEQ ID NO: 246052 - DNA, 20 bp, Artificial Sequence
  Description of Artificial Sequence: Synthetic oligonucleotide
  Target: ATXN1; (+) strand; PAM type: YTN; PAM sequence: CTG
ctggcattagcctgtattcc

SEQ ID NO: 246053 - DNA, 20 bp, Artificial Sequence
  Description of Artificial Sequence: Synthetic oligonucleotide
  Target: ATXN1; (+) strand; PAM type: YTN; PAM sequence: CTG
gcattagcctgtattccagg

SEQ ID NO: 246054 - DNA, 20 bp, Artificial Sequence
  Description of Artificial Sequence: Synthetic oligonucleotide
  Target: ATXN1; (+) strand; PAM type: YTN; PAM sequence: TTA
gcctgtattccaggactgga

SEQ ID NO: 246055 - DNA, 20 bp, Artificial Sequence
  Description of Artificial Sequence: Synthetic oligonucleotide
  Target: ATXN1; (+) strand; PAM type: YTN; PAM sequence: CTG
tattccaggactggacgtca

SEQ ID NO: 246056 - DNA, 20 bp, Artificial Sequence
  Description of Artificial Sequence: Synthetic oligonucleotide
  Target: ATXN1; (+) strand; PAM type: YTN; PAM sequence: TTC
caggactggacgtcagggca

SEQ ID NO: 246057 - DNA, 20 bp, Artificial Sequence
  Description of Artificial Sequence: Synthetic oligonucleotide
  Target: ATXN1; (+) strand; PAM type: YTN; PAM sequence: CTG
gacgtcagggcatcctttaa

SEQ ID NO: 246058 - DNA, 20 bp, Artificial Sequence
  Description of Artificial Sequence: Synthetic oligonucleotide
  Target: ATXN1; (+) strand; PAM type: YTN; PAM sequence: CTT
taagcccttaaagctgtatg

SEQ ID NO: 246059 - DNA, 20 bp, Artificial Sequence
  Description of Artificial Sequence: Synthetic oligonucleotide
  Target: ATXN1; (+) strand; PAM type: YTN; PAM sequence: TTT
aagcccttaaagctgtatgc

SEQ ID NO: 246060 - DNA, 20 bp, Artificial Sequence
  Description of Artificial Sequence: Synthetic oligonucleotide
  Target: ATXN1; (+) strand; PAM type: YTN; PAM sequence: TTA
agcccttaaagctgtatgcc

SEQ ID NO: 246061 - DNA, 20 bp, Artificial Sequence
  Description of Artificial Sequence: Synthetic oligonucleotide
  Target: ATXN1; (+) strand; PAM type: YTN; PAM sequence: CTT
aaagctgtatgccctttctc

SEQ ID NO: 246062 - DNA, 20 bp, Artificial Sequence
  Description of Artificial Sequence: Synthetic oligonucleotide
  Target: ATXN1; (+) strand; PAM type: YTN; PAM sequence: TTA
aagctgtatgccctttctca

SEQ ID NO: 246063 - DNA, 20 bp, Artificial Sequence
  Description of Artificial Sequence: Synthetic oligonucleotide
  Target: ATXN1; (+) strand; PAM type: YTN; PAM sequence: CTG
tatgccctttctcacatccg

SEQ ID NO: 246064 - DNA, 20 bp, Artificial Sequence
  Description of Artificial Sequence: Synthetic oligonucleotide
  Target: ATXN1; (+) strand; PAM type: YTN; PAM sequence: CTT
tctcacatccgcaaagggga

SEQ ID NO: 246065 - DNA, 20 bp, Artificial Sequence
  Description of Artificial Sequence: Synthetic oligonucleotide
  Target: ATXN1; (+) strand; PAM type: YTN; PAM sequence: TTT
ctcacatccgcaaaggggac

SEQ ID NO: 246066 - DNA, 20 bp, Artificial Sequence
  Description of Artificial Sequence: Synthetic oligonucleotide
  Target: ATXN1; (+) strand; PAM type: YTN; PAM sequence: TTC
tcacatccgcaaaggggact

SEQ ID NO: 246067 - DNA, 20 bp, Artificial Sequence
  Description of Artificial Sequence: Synthetic oligonucleotide
  Target: ATXN1; (+) strand; PAM type: YTN; PAM sequence: CTC
acatccgcaaaggggactgt

SEQ ID NO: 246068 - DNA, 20 bp, Artificial Sequence
  Description of Artificial Sequence: Synthetic oligonucleotide
  Target: ATXN1; (+) strand; PAM type: YTN; PAM sequence: CTG
tgagctgtaaaaagtgaggc

SEQ ID NO: 246069 - DNA, 20 bp, Artificial Sequence
  Description of Artificial Sequence: Synthetic oligonucleotide
  Target: ATXN1; (+) strand; PAM type: YTN; PAM sequence: CTG
taaaaagtgaggcagcagta

SEQ ID NO: 246070 - DNA, 20 bp, Artificial Sequence
  Description of Artificial Sequence: Synthetic oligonucleotide
  Target: ATXN1; (+) strand; PAM type: YTN; PAM sequence: CTT
agtgtcactgctctatcatg

SEQ ID NO: 246071 - DNA, 20 bp, Artificial Sequence
  Description of Artificial Sequence: Synthetic oligonucleotide
  Target: ATXN1; (+) strand; PAM type: YTN; PAM sequence: TTA
gtgtcactgctctatcatgt

SEQ ID NO: 246072 - DNA, 20 bp, Artificial Sequence
  Description of Artificial Sequence: Synthetic oligonucleotide
  Target: ATXN1; (+) strand; PAM type: YTN; PAM sequence: CTG
ctctatcatgtcattgctca

SEQ ID NO: 246073 - DNA, 20 bp, Artificial Sequence
  Description of Artificial Sequence: Synthetic oligonucleotide
  Target: ATXN1; (+) strand; PAM type: YTN; PAM sequence: CTC
tatcatgtcattgctcactg

SEQ ID NO: 246074 - DNA, 20 bp, Artificial Sequence
  Description of Artificial Sequence: Synthetic oligonucleotide
  Target: ATXN1; (+) strand; PAM type: YTN; PAM sequence: CTA
tcatgtcattgctcactgaa

SEQ ID NO: 246075 - DNA, 20 bp, Artificial Sequence
  Description of Artificial Sequence: Synthetic oligonucleotide
  Target: ATXN1; (+) strand; PAM type: YTN; PAM sequence: TTG
ctcactgaagactgaaagct

SEQ ID NO: 246076 - DNA, 20 bp, Artificial Sequence
  Description of Artificial Sequence: Synthetic oligonucleotide
  Target: ATXN1; (+) strand; PAM type: YTN; PAM sequence: CTC
actgaagactgaaagctggc

SEQ ID NO: 246077 - DNA, 20 bp, Artificial Sequence
  Description of Artificial Sequence: Synthetic oligonucleotide
  Target: ATXN1; (+) strand; PAM type: YTN; PAM sequence: CTG
aagactgaaagctggccgat

SEQ ID NO: 246078 - DNA, 20 bp, Artificial Sequence
  Description of Artificial Sequence: Synthetic oligonucleotide
  Target: ATXN1; (+) strand; PAM type: YTN; PAM sequence: CTG
aaagctggccgatatccctg

SEQ ID NO: 246079 - DNA, 20 bp, Artificial Sequence
  Description of Artificial Sequence: Synthetic oligonucleotide
  Target: ATXN1; (+) strand; PAM type: YTN; PAM sequence: CTG
gccgatatccctgtatgcct

SEQ ID NO: 246080 - DNA, 20 bp, Artificial Sequence
  Description of Artificial Sequence: Synthetic oligonucleotide
  Target: ATXN1; (+) strand; PAM type: YTN; PAM sequence: CTG
tatgcctcttctcccctgat

SEQ ID NO: 246081 - DNA, 20 bp, Artificial Sequence
  Description of Artificial Sequence: Synthetic oligonucleotide
  Target: ATXN1; (+) strand; PAM type: YTN; PAM sequence: CTC
ttctcccctgattctgtcat

SEQ ID NO: 246082 - DNA, 20 bp, Artificial Sequence
  Description of Artificial Sequence: Synthetic oligonucleotide
  Target: ATXN1; (+) strand; PAM type: YTN; PAM sequence: CTT
ctcccctgattctgtcatca

SEQ ID NO: 246083 - DNA, 20 bp, Artificial Sequence
  Description of Artificial Sequence: Synthetic oligonucleotide
  Target: ATXN1; (+) strand; PAM type: YTN; PAM sequence: TTC
tcccctgattctgtcatcag

SEQ ID NO: 246084 - DNA, 20 bp, Artificial Sequence
  Description of Artificial Sequence: Synthetic oligonucleotide
  Target: ATXN1; (+) strand; PAM type: YTN; PAM sequence: CTC
ccctgattctgtcatcaggt

SEQ ID NO: 246085 - DNA, 20 bp, Artificial Sequence
  Description of Artificial Sequence: Synthetic oligonucleotide
  Target: ATXN1; (+) strand; PAM type: YTN; PAM sequence: CTG
attctgtcatcaggttatgt

SEQ ID NO: 246086 - DNA, 20 bp, Artificial Sequence
  Description of Artificial Sequence: Synthetic oligonucleotide
  Target: ATXN1; (+) strand; PAM type: YTN; PAM sequence: TTC
tgtcatcaggttatgtcagt

SEQ ID NO: 246087 - DNA, 20 bp, Artificial Sequence
  Description of Artificial Sequence: Synthetic oligonucleotide
  Target: ATXN1; (+) strand; PAM type: YTN; PAM sequence: CTG
tcatcaggttatgtcagttc

SEQ ID NO: 246088 - DNA, 20 bp, Artificial Sequence
  Description of Artificial Sequence: Synthetic oligonucleotide
  Target: ATXN1; (+) strand; PAM type: YTN; PAM sequence: TTA
tgtcagttccaccctctgaa

SEQ ID NO: 246089 - DNA, 20 bp, Artificial Sequence
  Description of Artificial Sequence: Synthetic oligonucleotide
  Target: ATXN1; (+) strand; PAM type: YTN; PAM sequence: TTC
caccctctgaatcagggact

SEQ ID NO: 246090 - DNA, 20 bp, Artificial Sequence
  Description of Artificial Sequence: Synthetic oligonucleotide
  Target: ATXN1; (+) strand; PAM type: YTN; PAM sequence: CTC
tgaatcagggactggaaaac

SEQ ID NO: 246091 - DNA, 20 bp, Artificial Sequence
  Description of Artificial Sequence: Synthetic oligonucleotide
  Target: ATXN1; (+) strand; PAM type: YTN; PAM sequence: CTG
aatcagggactggaaaacct

SEQ ID NO: 246092 - DNA, 20 bp, Artificial Sequence
  Description of Artificial Sequence: Synthetic oligonucleotide
  Target: ATXN1; (+) strand; PAM type: YTN; PAM sequence: CTG
gaaaaccttgacgatgcgcg

SEQ ID NO: 246093 - DNA, 20 bp, Artificial Sequence
  Description of Artificial Sequence: Synthetic oligonucleotide
  Target: ATXN1; (+) strand; PAM type: YTN; PAM sequence: CTT
gacgatgcgcggccacctag

SEQ ID NO: 246094 - DNA, 20 bp, Artificial Sequence
  Description of Artificial Sequence: Synthetic oligonucleotide
  Target: ATXN1; (+) strand; PAM type: YTN; PAM sequence: TTG
acgatgcgcggccacctagt

SEQ ID NO: 246095 - DNA, 20 bp, Artificial Sequence
  Description of Artificial Sequence: Synthetic oligonucleotide
  Target: ATXN1; (+) strand; PAM type: YTN; PAM sequence: CTA
gtaaatcgtgtggctttgcg

SEQ ID NO: 246096 - DNA, 20 bp, Artificial Sequence
  Description of Artificial Sequence: Synthetic oligonucleotide
  Target: ATXN1; (+) strand; PAM type: YTN; PAM sequence: CTT
tgcgggccatacacctctgt

SEQ ID NO: 246097 - DNA, 20 bp, Artificial Sequence
  Description of Artificial Sequence: Synthetic oligonucleotide
  Target: ATXN1; (+) strand; PAM type: YTN; PAM sequence: TTT
gcgggccatacacctctgtg

SEQ ID NO: 246098 - DNA, 20 bp, Artificial Sequence
  Description of Artificial Sequence: Synthetic oligonucleotide
  Target: ATXN1; (+) strand; PAM type: YTN; PAM sequence: TTG
cgggccatacacctctgtgg

SEQ ID NO: 246099 - DNA, 20 bp, Artificial Sequence
  Description of Artificial Sequence: Synthetic oligonucleotide
  Target: ATXN1; (+) strand; PAM type: YTN; PAM sequence: CTC
tgtggccattactcagctct

SEQ ID NO: 246100 - DNA, 20 bp, Artificial Sequence
  Description of Artificial Sequence: Synthetic oligonucleotide
  Target: ATXN1; (+) strand; PAM type: YTN; PAM sequence: CTG
tggccattactcagctctac

SEQ ID NO: 246101 - DNA, 20 bp, Artificial Sequence
  Description of Artificial Sequence: Synthetic oligonucleotide
  Target: ATXN1; (+) strand; PAM type: YTN; PAM sequence: TTA
ctcagctctacctctgcagg

SEQ ID NO: 246102 - DNA, 20 bp, Artificial Sequence
  Description of Artificial Sequence: Synthetic oligonucleotide
  Target: ATXN1; (+) strand; PAM type: YTN; PAM sequence: CTC
agctctacctctgcaggctg

SEQ ID NO: 246103 - DNA, 20 bp, Artificial Sequence
  Description of Artificial Sequence: Synthetic oligonucleotide
  Target: ATXN1; (+) strand; PAM type: YTN; PAM sequence: CTC
tacctctgcaggctgaaagc

SEQ ID NO: 246104 - DNA, 20 bp, Artificial Sequence
  Description of Artificial Sequence: Synthetic oligonucleotide
  Target: ATXN1; (+) strand; PAM type: YTN; PAM sequence: CTA
cctctgcaggctgaaagcaa

SEQ ID NO: 246105 - DNA, 20 bp, Artificial Sequence
  Description of Artificial Sequence: Synthetic oligonucleotide
  Target: ATXN1; (+) strand; PAM type: YTN; PAM sequence: CTC
tgcaggctgaaagcaaccac

SEQ ID NO: 246106 - DNA, 20 bp, Artificial Sequence
  Description of Artificial Sequence: Synthetic oligonucleotide
  Target: ATXN1; (+) strand; PAM type: YTN; PAM sequence: CTG
caggctgaaagcaaccacag

SEQ ID NO: 246107 - DNA, 20 bp, Artificial Sequence
  Description of Artificial Sequence: Synthetic oligonucleotide
  Target: ATXN1; (+) strand; PAM type: YTN; PAM sequence: CTG
aaagcaaccacagataattt

SEQ ID NO: 246108 - DNA, 20 bp, Artificial Sequence
  Description of Artificial Sequence: Synthetic oligonucleotide
  Target: ATXN1; (+) strand; PAM type: YTN; PAM sequence: TTT
gtaaccagtgggtgtgggtg

SEQ ID NO: 246109 - DNA, 20 bp, Artificial Sequence
  Description of Artificial Sequence: Synthetic oligonucleotide
  Target: ATXN1; (+) strand; PAM type: YTN; PAM sequence: TTG
taaccagtgggtgtgggtgg

SEQ ID NO: 246110 - DNA, 20 bp, Artificial Sequence
  Description of Artificial Sequence: Synthetic oligonucleotide
  Target: ATXN1; (+) strand; PAM type: YTN; PAM sequence: CTG
tgtcctgatcaagcctcaaa

SEQ ID NO: 246111 - DNA, 20 bp, Artificial Sequence
  Description of Artificial Sequence: Synthetic oligonucleotide
  Target: ATXN1; (+) strand; PAM type: YTN; PAM sequence: CTG
atcaagcctcaaatatgcct

SEQ ID NO: 246112 - DNA, 20 bp, Artificial Sequence
  Description of Artificial Sequence: Synthetic oligonucleotide
  Target: ATXN1; (+) strand; PAM type: YTN; PAM sequence: CTC
aaatatgcctgctgcaggcc

SEQ ID NO: 246113 - DNA, 20 bp, Artificial Sequence
  Description of Artificial Sequence: Synthetic oligonucleotide
  Target: ATXN1; (+) strand; PAM type: YTN; PAM sequence: CTG
ctgcaggcctctgggtatgt

SEQ ID NO: 246114 - DNA, 20 bp, Artificial Sequence
  Description of Artificial Sequence: Synthetic oligonucleotide
  Target: ATXN1; (+) strand; PAM type: YTN; PAM sequence: CTG
caggcctctgggtatgtgtt

SEQ ID NO: 246115 - DNA, 20 bp, Artificial Sequence
  Description of Artificial Sequence: Synthetic oligonucleotide
  Target: ATXN1; (+) strand; PAM type: YTN; PAM sequence: CTC
tgggtatgtgttccctctgc

SEQ ID NO: 246116 - DNA, 20 bp, Artificial Sequence
  Description of Artificial Sequence: Synthetic oligonucleotide
  Target: ATXN1; (+) strand; PAM type: YTN; PAM sequence: CTG
ggtatgtgttccctctgctc

SEQ ID NO: 246117 - DNA, 20 bp, Artificial Sequence
  Description of Artificial Sequence: Synthetic oligonucleotide
  Target: ATXN1; (+) strand; PAM type: YTN; PAM sequence: TTC
cctctgctctgttagagtac

SEQ ID NO: 246118 - DNA, 20 bp, Artificial Sequence
  Description of Artificial Sequence: Synthetic oligonucleotide
  Target: ATXN1; (+) strand; PAM type: YTN; PAM sequence: CTC
tgctctgttagagtactttc

SEQ ID NO: 246119 - DNA, 20 bp, Artificial Sequence
  Description of Artificial Sequence: Synthetic oligonucleotide
  Target: ATXN1; (+) strand; PAM type: YTN; PAM sequence: CTG
ctctgttagagtactttcca

SEQ ID NO: 246120 - DNA, 20 bp, Artificial Sequence
  Description of Artificial Sequence: Synthetic oligonucleotide
  Target: ATXN1; (+) strand; PAM type: YTN; PAM sequence: CTC
tgttagagtactttccacac

SEQ ID NO: 246121 - DNA, 20 bp, Artificial Sequence
  Description of Artificial Sequence: Synthetic oligonucleotide
  Target: ATXN1; (+) strand; PAM type: YTN; PAM sequence: CTG
ttagagtactttccacacca

SEQ ID NO: 246122 - DNA, 20 bp, Artificial Sequence
  Description of Artificial Sequence: Synthetic oligonucleotide
  Target: ATXN1; (+) strand; PAM type: YTN; PAM sequence: TTA
gagtactttccacaccagcc

SEQ ID NO: 246123 - DNA, 20 bp, Artificial Sequence
  Description of Artificial Sequence: Synthetic oligonucleotide
  Target: ATXN1; (+) strand; PAM type: YTN; PAM sequence: CTT
tccacaccagccaccgctcc

SEQ ID NO: 246124 - DNA, 20 bp, Artificial Sequence
  Description of Artificial Sequence: Synthetic oligonucleotide
  Target: ATXN1; (+) strand; PAM type: YTN; PAM sequence: TTT
ccacaccagccaccgctcct

SEQ ID NO: 246125 - DNA, 20 bp, Artificial Sequence
  Description of Artificial Sequence: Synthetic oligonucleotide
  Target: ATXN1; (+) strand; PAM type: YTN; PAM sequence: TTC
cacaccagccaccgctcctc

SEQ ID NO: 246126 - DNA, 20 bp, Artificial Sequence
  Description of Artificial Sequence: Synthetic oligonucleotide
  Target: ATXN1; (+) strand; PAM type: YTN; PAM sequence: CTC
ctccgcaaggcactgtcacc

SEQ ID NO: 246127 - DNA, 20 bp, Artificial Sequence
  Description of Artificial Sequence: Synthetic oligonucleotide
  Target: ATXN1; (+) strand; PAM type: YTN; PAM sequence: CTC
cgcaaggcactgtcacctgt

SEQ ID NO: 246128 - DNA, 20 bp, Artificial Sequence
  Description of Artificial Sequence: Synthetic oligonucleotide
  Target: ATXN1; (+) strand; PAM type: YTN; PAM sequence: CTG
tcacctgttttctaatgcag

SEQ ID NO: 246129 - DNA, 20 bp, Artificial Sequence
  Description of Artificial Sequence: Synthetic oligonucleotide
  Target: ATXN1; (+) strand; PAM type: YTN; PAM sequence: CTG
ttttctaatgcagtggttct

SEQ ID NO: 246130 - DNA, 20 bp, Artificial Sequence
  Description of Artificial Sequence: Synthetic oligonucleotide
  Target: ATXN1; (+) strand; PAM type: YTN; PAM sequence: TTT
tctaatgcagtggttcttat

SEQ ID NO: 246131 - DNA, 20 bp, Artificial Sequence
  Description of Artificial Sequence: Synthetic oligonucleotide
  Target: ATXN1; (+) strand; PAM type: YTN; PAM sequence: TTT
ctaatgcagtggttcttata

SEQ ID NO: 246132 - DNA, 20 bp, Artificial Sequence
  Description of Artificial Sequence: Synthetic oligonucleotide
  Target: ATXN1; (+) strand; PAM type: YTN; PAM sequence: TTC
taatgcagtggttcttatac

SEQ ID NO: 246133 - DNA, 20 bp, Artificial Sequence
  Description of Artificial Sequence: Synthetic oligonucleotide
  Target: ATXN1; (+) strand; PAM type: YTN; PAM sequence: CTA
atgcagtggttcttatactc

SEQ ID NO: 246134 - DNA, 20 bp, Artificial Sequence
  Description of Artificial Sequence: Synthetic oligonucleotide
  Target: ATXN1; (+) strand; PAM type: YTN; PAM sequence: TTC
ttatactcgagcgtgcgcat

SEQ ID NO: 246135 - DNA, 20 bp, Artificial Sequence
  Description of Artificial Sequence: Synthetic oligonucleotide
  Target: ATXN1; (+) strand; PAM type: YTN; PAM sequence: CTT
atactcgagcgtgcgcatca

SEQ ID NO: 246136 - DNA, 20 bp, Artificial Sequence
  Description of Artificial Sequence: Synthetic oligonucleotide
  Target: ATXN1; (+) strand; PAM type: YTN; PAM sequence: TTA
tactcgagcgtgcgcatcac

SEQ ID NO: 246137 - DNA, 20 bp, Artificial Sequence
  Description of Artificial Sequence: Synthetic oligonucleotide
  Target: ATXN1; (+) strand; PAM type: YTN; PAM sequence: CTC
gagcgtgcgcatcacattca

SEQ ID NO: 246138 - DNA, 20 bp, Artificial Sequence
  Description of Artificial Sequence: Synthetic oligonucleotide
  Target: ATXN1; (+) strand; PAM type: YTN; PAM sequence: TTC
acccggagttcccagatgct

SEQ ID NO: 246139 - DNA, 20 bp, Artificial Sequence
  Description of Artificial Sequence: Synthetic oligonucleotide
  Target: ATXN1; (+) strand; PAM type: YTN; PAM sequence: TTC
ccagatgctgctgatgctgc

SEQ ID NO: 246140 - DNA, 20 bp, Artificial Sequence
  Description of Artificial Sequence: Synthetic oligonucleotide
  Target: ATXN1; (+) strand; PAM type: YTN; PAM sequence: CTG
ctgatgctgctggtccagga

SEQ ID NO: 246141 - DNA, 20 bp, Artificial Sequence
  Description of Artificial Sequence: Synthetic oligonucleotide
  Target: ATXN1; (+) strand; PAM type: YTN; PAM sequence: CTG
atgctgctggtccaggaacc

SEQ ID NO: 246142 - DNA, 20 bp, Artificial Sequence
  Description of Artificial Sequence: Synthetic oligonucleotide
  Target: ATXN1; (+) strand; PAM type: YTN; PAM sequence: CTG
ctggtccaggaaccacactt

SEQ ID NO: 246143 - DNA, 20 bp, Artificial Sequence
  Description of Artificial Sequence: Synthetic oligonucleotide
  Target: ATXN1; (+) strand; PAM type: YTN; PAM sequence: CTG
gtccaggaaccacacttcca

SEQ ID NO: 246144 - DNA, 20 bp, Artificial Sequence
  Description of Artificial Sequence: Synthetic oligonucleotide
  Target: ATXN1; (+) strand; PAM type: YTN; PAM sequence: CTT
ccagaagcactggcctcacc

SEQ ID NO: 246145 - DNA, 20 bp, Artificial Sequence
  Description of Artificial Sequence: Synthetic oligonucleotide
  Target: ATXN1; (+) strand; PAM type: YTN; PAM sequence: TTC
cagaagcactggcctcaccc

SEQ ID NO: 246146 - DNA, 20 bp, Artificial Sequence
  Description of Artificial Sequence: Synthetic oligonucleotide
  Target: ATXN1; (+) strand; PAM type: YTN; PAM sequence: CTG
gcctcacccatctttcaggt

SEQ ID NO: 246147 - DNA, 20 bp, Artificial Sequence
  Description of Artificial Sequence: Synthetic oligonucleotide
  Target: ATXN1; (+) strand; PAM type: YTN; PAM sequence: CTC
acccatctttcaggtctctc

SEQ ID NO: 246148 - DNA, 20 bp, Artificial Sequence
  Description of Artificial Sequence: Synthetic oligonucleotide
  Target: ATXN1; (+) strand; PAM type: YTN; PAM sequence: CTT
tcaggtctctccttccatgt

SEQ ID NO: 246149 - DNA, 20 bp, Artificial Sequence
  Description of Artificial Sequence: Synthetic oligonucleotide
  Target: ATXN1; (+) strand; PAM type: YTN; PAM sequence: TTT
caggtctctccttccatgtc

SEQ ID NO: 246150 - DNA, 20 bp, Artificial Sequence
  Description of Artificial Sequence: Synthetic oligonucleotide
  Target: ATXN1; (+) strand; PAM type: YTN; PAM sequence: TTC
aggtctctccttccatgtca

SEQ ID NO: 246151 - DNA, 20 bp, Artificial Sequence
  Description of Artificial Sequence: Synthetic oligonucleotide
  Target: ATXN1; (+) strand; PAM type: YTN; PAM sequence: CTC
tccttccatgtcacctcctt

SEQ ID NO: 246152 - DNA, 20 bp, Artificial Sequence
  Description of Artificial Sequence: Synthetic oligonucleotide
  Target: ATXN1; (+) strand; PAM type: YTN; PAM sequence: CTC
cttccatgtcacctccttaa

SEQ ID NO: 246153 - DNA, 20 bp, Artificial Sequence
  Description of Artificial Sequence: Synthetic oligonucleotide
  Target: ATXN1; (+) strand; PAM type: YTN; PAM sequence: CTT
ccatgtcacctccttaaggc

SEQ ID NO: 246154 - DNA, 20 bp, Artificial Sequence
  Description of Artificial Sequence: Synthetic oligonucleotide
  Target: ATXN1; (+) strand; PAM type: YTN; PAM sequence: TTC
catgtcacctccttaaggct

SEQ ID NO: 246155 - DNA, 20 bp, Artificial Sequence
  Description of Artificial Sequence: Synthetic oligonucleotide
  Target: ATXN1; (+) strand; PAM type: YTN; PAM sequence: CTC
cttaaggctctccccactcc

SEQ ID NO: 246156 - DNA, 20 bp, Artificial Sequence
  Description of Artificial Sequence: Synthetic oligonucleotide
  Target: ATXN1; (+) strand; PAM type: YTN; PAM sequence: CTT
aaggctctccccactccaac

SEQ ID NO: 246157 - DNA, 20 bp, Artificial Sequence
  Description of Artificial Sequence: Synthetic oligonucleotide
  Target: ATXN1; (+) strand; PAM type: YTN; PAM sequence: TTA
aggctctccccactccaacc

SEQ ID NO: 246158 - DNA, 20 bp, Artificial Sequence
  Description of Artificial Sequence: Synthetic oligonucleotide
  Target: ATXN1; (+) strand; PAM type: YTN; PAM sequence: CTC
tccccactccaaccccatac

SEQ ID NO: 246159 - DNA, 20 bp, Artificial Sequence
  Description of Artificial Sequence: Synthetic oligonucleotide
  Target: ATXN1; (+) strand; PAM type: YTN; PAM sequence: CTC
cccactccaaccccataccc

SEQ ID NO: 246160 - DNA, 20 bp, Artificial Sequence
  Description of Artificial Sequence: Synthetic oligonucleotide
  Target: ATXN1; (+) strand; PAM type: YTN; PAM sequence: CTC
caaccccataccctctgcct

SEQ ID NO: 246161 - DNA, 20 bp, Artificial Sequence
  Description of Artificial Sequence: Synthetic oligonucleotide
  Target: ATXN1; (+) strand; PAM type: YTN; PAM sequence: CTC
tgcctctcctctgtgcctcc

SEQ ID NO: 246162 - DNA, 20 bp, Artificial Sequence
  Description of Artificial Sequence: Synthetic oligonucleotide
  Target: ATXN1; (+) strand; PAM type: YTN; PAM sequence: CTG
cctctcctctgtgcctcctt

SEQ ID NO: 246163 - DNA, 20 bp, Artificial Sequence
  Description of Artificial Sequence: Synthetic oligonucleotide
  Target: ATXN1; (+) strand; PAM type: YTN; PAM sequence: CTC
tcctctgtgcctccttagca

SEQ ID NO: 246164 - DNA, 20 bp, Artificial Sequence
  Description of Artificial Sequence: Synthetic oligonucleotide
  Target: ATXN1; (+) strand; PAM type: YTN; PAM sequence: CTC
ctctgtgcctccttagcacc

SEQ ID NO: 246165 - DNA, 20 bp, Artificial Sequence
  Description of Artificial Sequence: Synthetic oligonucleotide
  Target: ATXN1; (+) strand; PAM type: YTN; PAM sequence: CTC
tgtgcctccttagcaccctg

SEQ ID NO: 246166 - DNA, 20 bp, Artificial Sequence
  Description of Artificial Sequence: Synthetic oligonucleotide
  Target: ATXN1; (+) strand; PAM type: YTN; PAM sequence: CTG
tgcctccttagcaccctgct

SEQ ID NO: 246167 - DNA, 20 bp, Artificial Sequence
  Description of Artificial Sequence: Synthetic oligonucleotide
  Target: ATXN1; (+) strand; PAM type: YTN; PAM sequence: CTC
cttagcaccctgctccaaca

SEQ ID NO: 246168 - DNA, 20 bp, Artificial Sequence
  Description of Artificial Sequence: Synthetic oligonucleotide
  Target: ATXN1; (+) strand; PAM type: YTN; PAM sequence: CTT
agcaccctgctccaacattc

SEQ ID NO: 246169 - DNA, 20 bp, Artificial Sequence
  Description of Artificial Sequence: Synthetic oligonucleotide
  Target: ATXN1; (+) strand; PAM type: YTN; PAM sequence: TTA
gcaccctgctccaacattct

SEQ ID NO: 246170 - DNA, 20 bp, Artificial Sequence
  Description of Artificial Sequence: Synthetic oligonucleotide
  Target: ATXN1; (+) strand; PAM type: YTN; PAM sequence: CTG
ctccaacattctcatccaca

SEQ ID NO: 246171 - DNA, 20 bp, Artificial Sequence
  Description of Artificial Sequence: Synthetic oligonucleotide
  Target: ATXN1; (+) strand; PAM type: YTN; PAM sequence: CTC
caacattctcatccacacac

SEQ ID NO: 246172 - DNA, 20 bp, Artificial Sequence
  Description of Artificial Sequence: Synthetic oligonucleotide
  Target: ATXN1; (+) strand; PAM type: YTN; PAM sequence: TTC
tcatccacacaccgttcagg

SEQ ID NO: 246173 - DNA, 20 bp, Artificial Sequence
  Description of Artificial Sequence: Synthetic oligonucleotide
  Target: ATXN1; (+) strand; PAM type: YTN; PAM sequence: CTC
atccacacaccgttcaggaa

SEQ ID NO: 246174 - DNA, 20 bp, Artificial Sequence
  Description of Artificial Sequence: Synthetic oligonucleotide
  Target: ATXN1; (+) strand; PAM type: YTN; PAM sequence: TTC
aggaaccgtttcctcgacta

SEQ ID NO: 246175 - DNA, 20 bp, Artificial Sequence
  Description of Artificial Sequence: Synthetic oligonucleotide
  Target: ATXN1; (+) strand; PAM type: YTN; PAM sequence: TTT
cctcgactatcctccaaggc

SEQ ID NO: 246176 - DNA, 20 bp, Artificial Sequence
  Description of Artificial Sequence: Synthetic oligonucleotide
  Target: ATXN1; (+) strand; PAM type: YTN; PAM sequence: TTC
ctcgactatcctccaaggct

SEQ ID NO: 246177 - DNA, 20 bp, Artificial Sequence
  Description of Artificial Sequence: Synthetic oligonucleotide
  Target: ATXN1; (+) strand; PAM type: YTN; PAM sequence: CTC
gactatcctccaaggctcca

SEQ ID NO: 246178 - DNA, 20 bp, Artificial Sequence
  Description of Artificial Sequence: Synthetic oligonucleotide
  Target: ATXN1; (+) strand; PAM type: YTN; PAM sequence: CTA
tcctccaaggctccaattag

SEQ ID NO: 246179 - DNA, 20 bp, Artificial Sequence
  Description of Artificial Sequence: Synthetic oligonucleotide
  Target: ATXN1; (+) strand; PAM type: YTN; PAM sequence: CTC
caaggctccaattagtctaa

SEQ ID NO: 246180 - DNA, 20 bp, Artificial Sequence
  Description of Artificial Sequence: Synthetic oligonucleotide
  Target: ATXN1; (+) strand; PAM type: YTN; PAM sequence: CTC
caattagtctaacaccagcc

SEQ ID NO: 246181 - DNA, 20 bp, Artificial Sequence
  Description of Artificial Sequence: Synthetic oligonucleotide
  Target: ATXN1; (+) strand; PAM type: YTN; PAM sequence: TTA
gtctaacaccagccaccccc

SEQ ID NO: 246182 - DNA, 20 bp, Artificial Sequence
  Description of Artificial Sequence: Synthetic oligonucleotide
  Target: ATXN1; (+) strand; PAM type: YTN; PAM sequence: CTA
acaccagccacccccgcatg

SEQ ID NO: 246183 - DNA, 20 bp, Artificial Sequence
  Description of Artificial Sequence: Synthetic oligonucleotide
  Target: ATXN1; (+) strand; PAM type: YTN; PAM sequence: CTT
caccatggtgggcatgatgg

SEQ ID NO: 246184 - DNA, 20 bp, Artificial Sequence
  Description of Artificial Sequence: Synthetic oligonucleotide
  Target: ATXN1; (+) strand; PAM type: YTN; PAM sequence: TTC
accatggtgggcatgatggt

SEQ ID NO: 246185 - DNA, 20 bp, Artificial Sequence
  Description of Artificial Sequence: Synthetic oligonucleotide
  Target: ATXN1; (+) strand; PAM type: YTN; PAM sequence: TTA
atactgagtgtcaacttgat

SEQ ID NO: 246186 - DNA, 20 bp, Artificial Sequence
  Description of Artificial Sequence: Synthetic oligonucleotide
  Target: ATXN1; (+) strand; PAM type: YTN; PAM sequence: CTG
agtgtcaacttgattggatt

SEQ ID NO: 246187 - DNA, 20 bp, Artificial Sequence
  Description of Artificial Sequence: Synthetic oligonucleotide
  Target: ATXN1; (+) strand; PAM type: YTN; PAM sequence: CTT
gattggattgaaggatgcaa

SEQ ID NO: 246188 - DNA, 20 bp, Artificial Sequence
  Description of Artificial Sequence: Synthetic oligonucleotide
  Target: ATXN1; (+) strand; PAM type: YTN; PAM sequence: TTG
attggattgaaggatgcaaa

SEQ ID NO: 246189 - DNA, 20 bp, Artificial Sequence
  Description of Artificial Sequence: Synthetic oligonucleotide
  Target: ATXN1; (+) strand; PAM type: YTN; PAM sequence: TTG
gattgaaggatgcaaagtat

SEQ ID NO: 246190 - DNA, 20 bp, Artificial Sequence
  Description of Artificial Sequence: Synthetic oligonucleotide
  Target: ATXN1; (+) strand; PAM type: YTN; PAM sequence: TTG
aaggatgcaaagtattattc

SEQ ID NO: 246191 - DNA, 20 bp, Artificial Sequence
  Description of Artificial Sequence: Synthetic oligonucleotide
  Target: ATXN1; (+) strand; PAM type: YTN; PAM sequence: TTA
ttcttggttgtgtctgtgag

SEQ ID NO: 246192 - DNA, 20 bp, Artificial Sequence
  Description of Artificial Sequence: Synthetic oligonucleotide
  Target: ATXN1; (+) strand; PAM type: YTN; PAM sequence: TTC
ttggttgtgtctgtgagggt

SEQ ID NO: 246193 - DNA, 20 bp, Artificial Sequence
  Description of Artificial Sequence: Synthetic oligonucleotide
  Target: ATXN1; (+) strand; PAM type: YTN; PAM sequence: CTT
ggttgtgtctgtgagggtgt

SEQ ID NO: 246194 - DNA, 20 bp, Artificial Sequence
  Description of Artificial Sequence: Synthetic oligonucleotide
  Target: ATXN1; (+) strand; PAM type: YTN; PAM sequence: TTG
gttgtgtctgtgagggtgtt

SEQ ID NO: 246195 - DNA, 20 bp, Artificial Sequence
  Description of Artificial Sequence: Synthetic oligonucleotide
  Target: ATXN1; (+) strand; PAM type: YTN; PAM sequence: TTG
tgtctgtgagggtgttgcca

SEQ ID NO: 246196 - DNA, 20 bp, Artificial Sequence
  Description of Artificial Sequence: Synthetic oligonucleotide
  Target: ATXN1; (+) strand; PAM type: YTN; PAM sequence: CTG
tgagggtgttgccaaaggag

SEQ ID NO: 246197 - DNA, 20 bp, Artificial Sequence
  Description of Artificial Sequence: Synthetic oligonucleotide
  Target: ATXN1; (+) strand; PAM type: YTN; PAM sequence: TTG
ccaaaggagataaacatttg

SEQ ID NO: 246198 - DNA, 20 bp, Artificial Sequence
  Description of Artificial Sequence: Synthetic oligonucleotide
  Target: ATXN1; (+) strand; PAM type: YTN; PAM sequence: TTT
gggtcatgggcttggagagg

SEQ ID NO: 246199 - DNA, 20 bp, Artificial Sequence
  Description of Artificial Sequence: Synthetic oligonucleotide
  Target: ATXN1; (+) strand; PAM type: YTN; PAM sequence: TTG
ggtcatgggcttggagagga

SEQ ID NO: 246200 - DNA, 20 bp, Artificial Sequence
  Description of Artificial Sequence: Synthetic oligonucleotide
  Target: ATXN1; (+) strand; PAM type: YTN; PAM sequence: CTT
ggagaggaagacccaccctc

SEQ ID NO: 246201 - DNA, 20 bp, Artificial Sequence
  Description of Artificial Sequence: Synthetic oligonucleotide
  Target: ATXN1; (+) strand; PAM type: YTN; PAM sequence: TTG
gagaggaagacccaccctca

SEQ ID NO: 246202 - DNA, 20 bp, Artificial Sequence
  Description of Artificial Sequence: Synthetic oligonucleotide
  Target: ATXN1; (+) strand; PAM type: YTN; PAM sequence: CTC
aatctgggtgggcacaatct

SEQ ID NO: 246203 - DNA, 20 bp, Artificial Sequence
  Description of Artificial Sequence: Synthetic oligonucleotide
  Target: ATXN1; (+) strand; PAM type: YTN; PAM sequence: CTG
ggtgggcacaatctaatcag

SEQ ID NO: 246204 - DNA, 20 bp, Artificial Sequence
  Description of Artificial Sequence: Synthetic oligonucleotide
  Target: ATXN1; (+) strand; PAM type: YTN; PAM sequence: CTA
atcagctgccagtgaggcta

SEQ ID NO: 246205 - DNA, 20 bp, Artificial Sequence
  Description of Artificial Sequence: Synthetic oligonucleotide
  Target: ATXN1; (+) strand; PAM type: YTN; PAM sequence: CTG
ccagtgaggctagaatgaaa

SEQ ID NO: 246206 - DNA, 20 bp, Artificial Sequence
  Description of Artificial Sequence: Synthetic oligonucleotide
  Target: ATXN1; (+) strand; PAM type: YTN; PAM sequence: CTA
gaatgaaagcaggcagaaga

SEQ ID NO: 246207 - DNA, 20 bp, Artificial Sequence
  Description of Artificial Sequence: Synthetic oligonucleotide
  Target: ATXN1; (+) strand; PAM type: YTN; PAM sequence: CTA
gactggctgagtcttctggc

SEQ ID NO: 246208 - DNA, 20 bp, Artificial Sequence
  Description of Artificial Sequence: Synthetic oligonucleotide
  Target: ATXN1; (+) strand; PAM type: YTN; PAM sequence: CTG
gctgagtcttctggccttca

SEQ ID NO: 246209 - DNA, 20 bp, Artificial Sequence
  Description of Artificial Sequence: Synthetic oligonucleotide
  Target: ATXN1; (+) strand; PAM type: YTN; PAM sequence: CTG
agtcttctggccttcatctt

SEQ ID NO: 246210 - DNA, 20 bp, Artificial Sequence
  Description of Artificial Sequence: Synthetic oligonucleotide
  Target: ATXN1; (+) strand; PAM type: YTN; PAM sequence: CTT
ctggccttcatctttttctc

SEQ ID NO: 246211 - DNA, 20 bp, Artificial Sequence
  Description of Artificial Sequence: Synthetic oligonucleotide
  Target: ATXN1; (+) strand; PAM type: YTN; PAM sequence: TTC
tggccttcatctttttctcg

SEQ ID NO: 246212 - DNA, 20 bp, Artificial Sequence
  Description of Artificial Sequence: Synthetic oligonucleotide
  Target: ATXN1; (+) strand; PAM type: YTN; PAM sequence: CTG
gccttcatctttttctcgtg

SEQ ID NO: 246213 - DNA, 20 bp, Artificial Sequence
  Description of Artificial Sequence: Synthetic oligonucleotide
  Target: ATXN1; (+) strand; PAM type: YTN; PAM sequence: CTT
catctttttctcgtgctgga

SEQ ID NO: 246214 - DNA, 20 bp, Artificial Sequence
  Description of Artificial Sequence: Synthetic oligonucleotide
  Target: ATXN1; (+) strand; PAM type: YTN; PAM sequence: TTC
atctttttctcgtgctggat

SEQ ID NO: 246215 - DNA, 20 bp, Artificial Sequence
  Description of Artificial Sequence: Synthetic oligonucleotide
  Target: ATXN1; (+) strand; PAM type: YTN; PAM sequence: CTT
tttctcgtgctggatgcttc

SEQ ID NO: 246216 - DNA, 20 bp, Artificial Sequence
  Description of Artificial Sequence: Synthetic oligonucleotide
  Target: ATXN1; (+) strand; PAM type: YTN; PAM sequence: TTT
ttctcgtgctggatgcttcc

SEQ ID NO: 246217 - DNA, 20 bp, Artificial Sequence
  Description of Artificial Sequence: Synthetic oligonucleotide
  Target: ATXN1; (+) strand; PAM type: YTN; PAM sequence: TTT
tctcgtgctggatgcttcct

SEQ ID NO: 246218 - DNA, 20 bp, Artificial Sequence
  Description of Artificial Sequence: Synthetic oligonucleotide
  Target: ATXN1; (+) strand; PAM type: YTN; PAM sequence: TTT
ctcgtgctggatgcttcctg

SEQ ID NO: 246219 - DNA, 20 bp, Artificial Sequence
  Description of Artificial Sequence: Synthetic oligonucleotide
  Target: ATXN1; (+) strand; PAM type: YTN; PAM sequence: TTC
tcgtgctggatgcttcctgc

SEQ ID NO: 246220 - DNA, 20 bp, Artificial Sequence
  Description of Artificial Sequence: Synthetic oligonucleotide
  Target: ATXN1; (+) strand; PAM type: YTN; PAM sequence: CTC
gtgctggatgcttcctgccc

SEQ ID NO: 246221 - DNA, 20 bp, Artificial Sequence
  Description of Artificial Sequence: Synthetic oligonucleotide
  Target: ATXN1; (+) strand; PAM type: YTN; PAM sequence: CTG
gatgcttcctgccctcgaac

SEQ ID NO: 246222 - DNA, 20 bp, Artificial Sequence
  Description of Artificial Sequence: Synthetic oligonucleotide
  Target: ATXN1; (+) strand; PAM type: YTN; PAM sequence: CTT
cctgccctcgaacacccgac

SEQ ID NO: 246223 - DNA, 20 bp, Artificial Sequence
  Description of Artificial Sequence: Synthetic oligonucleotide
  Target: ATXN1; (+) strand; PAM type: YTN; PAM sequence: TTC
ctgccctcgaacacccgact

SEQ ID NO: 246224 - DNA, 20 bp, Artificial Sequence
  Description of Artificial Sequence: Synthetic oligonucleotide
  Target: ATXN1; (+) strand; PAM type: YTN; PAM sequence: CTG
ccctcgaacacccgacttga

SEQ ID NO: 246225 - DNA, 20 bp, Artificial Sequence
  Description of Artificial Sequence: Synthetic oligonucleotide
  Target: ATXN1; (+) strand; PAM type: YTN; PAM sequence: CTC
gaacacccgacttgaagttc

SEQ ID NO: 246226 - DNA, 20 bp, Artificial Sequence
  Description of Artificial Sequence: Synthetic oligonucleotide
  Target: ATXN1; (+) strand; PAM type: YTN; PAM sequence: CTT
gaagttcttcagcttttgga

SEQ ID NO: 246227 - DNA, 20 bp, Artificial Sequence
  Description of Artificial Sequence: Synthetic oligonucleotide
  Target: ATXN1; (+) strand; PAM type: YTN; PAM sequence: TTG
aagttcttcagcttttggac

SEQ ID NO: 246228 - DNA, 20 bp, Artificial Sequence
  Description of Artificial Sequence: Synthetic oligonucleotide
  Target: ATXN1; (+) strand; PAM type: YTN; PAM sequence: TTC
ttcagcttttggactcttgg

SEQ ID NO: 246229 - DNA, 20 bp, Artificial Sequence
  Description of Artificial Sequence: Synthetic oligonucleotide
  Target: ATXN1; (+) strand; PAM type: YTN; PAM sequence: CTT
cagcttttggactcttggac

SEQ ID NO: 246230 - DNA, 20 bp, Artificial Sequence
  Description of Artificial Sequence: Synthetic oligonucleotide
  Target: ATXN1; (+) strand; PAM type: YTN; PAM sequence: TTC
agcttttggactcttggacc

SEQ ID NO: 246231 - DNA, 20 bp, Artificial Sequence
  Description of Artificial Sequence: Synthetic oligonucleotide
  Target: ATXN1; (+) strand; PAM type: YTN; PAM sequence: CTT
ttggactcttggacctacac

SEQ ID NO: 246232 - DNA, 20 bp, Artificial Sequence
  Description of Artificial Sequence: Synthetic oligonucleotide
  Target: ATXN1; (+) strand; PAM type: YTN; PAM sequence: TTT
tggactcttggacctacact

SEQ ID NO: 246233 - DNA, 20 bp, Artificial Sequence
  Description of Artificial Sequence: Synthetic oligonucleotide
  Target: ATXN1; (+) strand; PAM type: YTN; PAM sequence: TTT
ggactcttggacctacacta

SEQ ID NO: 246234 - DNA, 20 bp, Artificial Sequence
  Description of Artificial Sequence: Synthetic oligonucleotide
  Target: ATXN1; (+) strand; PAM type: YTN; PAM sequence: TTG
gactcttggacctacactaa

SEQ ID NO: 246235 - DNA, 20 bp, Artificial Sequence
  Description of Artificial Sequence: Synthetic oligonucleotide
  Target: ATXN1; (+) strand; PAM type: YTN; PAM sequence: CTC
ttggacctacactaatggtt

SEQ ID NO: 246236 - DNA, 20 bp, Artificial Sequence
  Description of Artificial Sequence: Synthetic oligonucleotide
  Target: ATXN1; (+) strand; PAM type: YTN; PAM sequence: CTT
ggacctacactaatggttgg

SEQ ID NO: 246237 - DNA, 20 bp, Artificial Sequence
  Description of Artificial Sequence: Synthetic oligonucleotide
  Target: ATXN1; (+) strand; PAM type: YTN; PAM sequence: TTG
gacctacactaatggttggc

SEQ ID NO: 246238 - DNA, 20 bp, Artificial Sequence
  Description of Artificial Sequence: Synthetic oligonucleotide
  Target: ATXN1; (+) strand; PAM type: YTN; PAM sequence: CTA
cactaatggttggccagggc

SEQ ID NO: 246239 - DNA, 20 bp, Artificial Sequence
  Description of Artificial Sequence: Synthetic oligonucleotide
  Target: ATXN1; (+) strand; PAM type: YTN; PAM sequence: CTA
atggttggccagggctcttg

SEQ ID NO: 246240 - DNA, 20 bp, Artificial Sequence
  Description of Artificial Sequence: Synthetic oligonucleotide
  Target: ATXN1; (+) strand; PAM type: YTN; PAM sequence: TTG
gccagggctcttgggccttt

SEQ ID NO: 246241 - DNA, 20 bp, Artificial Sequence
  Description of Artificial Sequence: Synthetic oligonucleotide
  Target: ATXN1; (+) strand; PAM type: YTN; PAM sequence: CTC
ttgggcctttggccacaggc

SEQ ID NO: 246242 - DNA, 20 bp, Artificial Sequence
  Description of Artificial Sequence: Synthetic oligonucleotide
  Target: ATXN1; (+) strand; PAM type: YTN; PAM sequence: CTT
gggcctttggccacaggctg

SEQ ID NO: 246243 - DNA, 20 bp, Artificial Sequence
  Description of Artificial Sequence: Synthetic oligonucleotide
  Target: ATXN1; (+) strand; PAM type: YTN; PAM sequence: TTG
ggcctttggccacaggctga

SEQ ID NO: 246244 - DNA, 20 bp, Artificial Sequence
  Description of Artificial Sequence: Synthetic oligonucleotide
  Target: ATXN1; (+) strand; PAM type: YTN; PAM sequence: CTT
tggccacaggctgaaggctg

SEQ ID NO: 246245 - DNA, 20 bp, Artificial Sequence
  Description of Artificial Sequence: Synthetic oligonucleotide
  Target: ATXN1; (+) strand; PAM type: YTN; PAM sequence: TTT
ggccacaggctgaaggctgc

SEQ ID NO: 246246 - DNA, 20 bp, Artificial Sequence
  Description of Artificial Sequence: Synthetic oligonucleotide
  Target: ATXN1; (+) strand; PAM type: YTN; PAM sequence: TTG
gccacaggctgaaggctgca

SEQ ID NO: 246247 - DNA, 20 bp, Artificial Sequence
  Description of Artificial Sequence: Synthetic oligonucleotide
  Target: ATXN1; (+) strand; PAM type: YTN; PAM sequence: CTG
aaggctgcactgtcggcttc

SEQ ID NO: 246248 - DNA, 20 bp, Artificial Sequence
  Description of Artificial Sequence: Synthetic oligonucleotide
  Target: ATXN1; (+) strand; PAM type: YTN; PAM sequence: CTG
cactgtcggcttccctactt

SEQ ID NO: 246249 - DNA, 20 bp, Artificial Sequence
  Description of Artificial Sequence: Synthetic oligonucleotide
  Target: ATXN1; (+) strand; PAM type: YTN; PAM sequence: CTG
tcggcttccctacttttgag

SEQ ID NO: 246250 - DNA, 20 bp, Artificial Sequence
  Description of Artificial Sequence: Synthetic oligonucleotide
  Target: ATXN1; (+) strand; PAM type: YTN; PAM sequence: CTT
ccctacttttgaggtcttgg

SEQ ID NO: 246251 - DNA, 20 bp, Artificial Sequence
  Description of Artificial Sequence: Synthetic oligonucleotide
  Target: ATXN1; (+) strand; PAM type: YTN; PAM sequence: TTC
cctacttttgaggtcttggg

SEQ ID NO: 246252 - DNA, 20 bp, Artificial Sequence
  Description of Artificial Sequence: Synthetic oligonucleotide
  Target: ATXN1; (+) strand; PAM type: YTN; PAM sequence: CTA
cttttgaggtcttgggactc

SEQ ID NO: 246253 - DNA, 20 bp, Artificial Sequence
  Description of Artificial Sequence: Synthetic oligonucleotide
  Target: ATXN1; (+) strand; PAM type: YTN; PAM sequence: CTT
ttgaggtcttgggactcaga

SEQ ID NO: 246254 - DNA, 20 bp, Artificial Sequence
  Description of Artificial Sequence: Synthetic oligonucleotide
  Target: ATXN1; (+) strand; PAM type: YTN; PAM sequence: TTT
tgaggtcttgggactcagac

SEQ ID NO: 246255 - DNA, 20 bp, Artificial Sequence
  Description of Artificial Sequence: Synthetic oligonucleotide
  Target: ATXN1; (+) strand; PAM type: YTN; PAM sequence: TTT
gaggtcttgggactcagact

SEQ ID NO: 246256 - DNA, 20 bp, Artificial Sequence
  Description of Artificial Sequence: Synthetic oligonucleotide
  Target: ATXN1; (+) strand; PAM type: YTN; PAM sequence: TTG
aggtcttgggactcagactg

SEQ ID NO: 246257 - DNA, 20 bp, Artificial Sequence
  Description of Artificial Sequence: Synthetic oligonucleotide
  Target: ATXN1; (+) strand; PAM type: YTN; PAM sequence: CTT
gggactcagactggtcaacc

SEQ ID NO: 246258 - DNA, 20 bp, Artificial Sequence
  Description of Artificial Sequence: Synthetic oligonucleotide
  Target: ATXN1; (+) strand; PAM type: YTN; PAM sequence: TTG
ggactcagactggtcaacca

SEQ ID NO: 246259 - DNA, 20 bp, Artificial Sequence
  Description of Artificial Sequence: Synthetic oligonucleotide
  Target: ATXN1; (+) strand; PAM type: YTN; PAM sequence: CTC
agactggtcaaccactggct

SEQ ID NO: 246260 - DNA, 20 bp, Artificial Sequence
  Description of Artificial Sequence: Synthetic oligonucleotide
  Target: ATXN1; (+) strand; PAM type: YTN; PAM sequence: CTG
gtcaaccactggcttccttg

SEQ ID NO: 246261 - DNA, 20 bp, Artificial Sequence
  Description of Artificial Sequence: Synthetic oligonucleotide
  Target: ATXN1; (+) strand; PAM type: YTN; PAM sequence: CTG
gcttccttgctcctcagctt

SEQ ID NO: 246262 - DNA, 20 bp, Artificial Sequence
  Description of Artificial Sequence: Synthetic oligonucleotide
  Target: ATXN1; (+) strand; PAM type: YTN; PAM sequence: CTT
ccttgctcctcagcttgcag

SEQ ID NO: 246263 - DNA, 20 bp, Artificial Sequence
  Description of Artificial Sequence: Synthetic oligonucleotide
  Target: ATXN1; (+) strand; PAM type: YTN; PAM sequence: TTC
cttgctcctcagcttgcagg

SEQ ID NO: 246264 - DNA, 20 bp, Artificial Sequence
  Description of Artificial Sequence: Synthetic oligonucleotide
  Target: ATXN1; (+) strand; PAM type: YTN; PAM sequence: CTT
gctcctcagcttgcaggtgg

SEQ ID NO: 246265 - DNA, 20 bp, Artificial Sequence
  Description of Artificial Sequence: Synthetic oligonucleotide
  Target: ATXN1; (+) strand; PAM type: YTN; PAM sequence: TTG
ctcctcagcttgcaggtggc

SEQ ID NO: 246266 - DNA, 20 bp, Artificial Sequence
  Description of Artificial Sequence: Synthetic oligonucleotide
  Target: ATXN1; (+) strand; PAM type: YTN; PAM sequence: CTC
ctcagcttgcaggtggccta

SEQ ID NO: 246267 - DNA, 20 bp, Artificial Sequence
  Description of Artificial Sequence: Synthetic oligonucleotide
  Target: ATXN1; (+) strand; PAM type: YTN; PAM sequence: CTC
agcttgcaggtggcctattg

SEQ ID NO: 246268 - DNA, 20 bp, Artificial Sequence
  Description of Artificial Sequence: Synthetic oligonucleotide
  Target: ATXN1; (+) strand; PAM type: YTN; PAM sequence: CTT
gcaggtggcctattgtagga

SEQ ID NO: 246269 - DNA, 20 bp, Artificial Sequence
  Description of Artificial Sequence: Synthetic oligonucleotide
  Target: ATXN1; (+) strand; PAM type: YTN; PAM sequence: TTG
caggtggcctattgtaggac

SEQ ID NO: 246270 - DNA, 20 bp, Artificial Sequence
  Description of Artificial Sequence: Synthetic oligonucleotide
  Target: ATXN1; (+) strand; PAM type: YTN; PAM sequence: CTA
ttgtaggacttgaccttttg

SEQ ID NO: 246271 - DNA, 20 bp, Artificial Sequence
  Description of Artificial Sequence: Synthetic oligonucleotide
  Target: ATXN1; (+) strand; PAM type: YTN; PAM sequence: TTG
taggacttgaccttttgatc

SEQ ID NO: 246272 - DNA, 20 bp, Artificial Sequence
  Description of Artificial Sequence: Synthetic oligonucleotide
  Target: ATXN1; (+) strand; PAM type: YTN; PAM sequence: CTT
gaccttttgatcatgtgagt

SEQ ID NO: 246273 - DNA, 20 bp, Artificial Sequence
  Description of Artificial Sequence: Synthetic oligonucleotide
  Target: ATXN1; (+) strand; PAM type: YTN; PAM sequence: TTG
accttttgatcatgtgagtc

SEQ ID NO: 246274 - DNA, 20 bp, Artificial Sequence
  Description of Artificial Sequence: Synthetic oligonucleotide
  Target: ATXN1; (+) strand; PAM type: YTN; PAM sequence: CTT
ttgatcatgtgagtcaatat

SEQ ID NO: 246275 - DNA, 20 bp, Artificial Sequence
  Description of Artificial Sequence: Synthetic oligonucleotide
  Target: ATXN1; (+) strand; PAM type: YTN; PAM sequence: TTT
tgatcatgtgagtcaatatt

SEQ ID NO: 246276 - DNA, 20 bp, Artificial Sequence
  Description of Artificial Sequence: Synthetic oligonucleotide
  Target: ATXN1; (+) strand; PAM type: YTN; PAM sequence: TTT
gatcatgtgagtcaatattc

SEQ ID NO: 246277 - DNA, 20 bp, Artificial Sequence
  Description of Artificial Sequence: Synthetic oligonucleotide
  Target: ATXN1; (+) strand; PAM type: YTN; PAM sequence: TTG
atcatgtgagtcaatattcc

SEQ ID NO: 246278 - DNA, 20 bp, Artificial Sequence
  Description of Artificial Sequence: Synthetic oligonucleotide
  Target: ATXN1; (+) strand; PAM type: YTN; PAM sequence: TTC
cttaataaactccccttcat

SEQ ID NO: 246279 - DNA, 20 bp, Artificial Sequence
  Description of Artificial Sequence: Synthetic oligonucleotide
  Target: ATXN1; (+) strand; PAM type: YTN; PAM sequence: CTT
aataaactccccttcatata

SEQ ID NO: 246280 - DNA, 20 bp, Artificial Sequence
  Description of Artificial Sequence: Synthetic oligonucleotide
  Target: ATXN1; (+) strand; PAM type: YTN; PAM sequence: TTA
ataaactccccttcatatat

SEQ ID NO: 246281 - DNA, 20 bp, Artificial Sequence
  Description of Artificial Sequence: Synthetic oligonucleotide
  Target: ATXN1; (+) strand; PAM type: YTN; PAM sequence: CTC
cccttcatatatacatctat

SEQ ID NO: 246282 - DNA, 20 bp, Artificial Sequence
  Description of Artificial Sequence: Synthetic oligonucleotide
  Target: ATXN1; (+) strand; PAM type: YTN; PAM sequence: CTT
catatatacatctatcctat

SEQ ID NO: 246283 - DNA, 20 bp, Artificial Sequence
  Description of Artificial Sequence: Synthetic oligonucleotide
  Target: ATXN1; (+) strand; PAM type: YTN; PAM sequence: TTC
atatatacatctatcctatt

SEQ ID NO: 246284 - DNA, 20 bp, Artificial Sequence
  Description of Artificial Sequence: Synthetic oligonucleotide
  Target: ATXN1; (+) strand; PAM type: YTN; PAM sequence: CTA
tcctattagtcctgtctgtc

SEQ ID NO: 246285 - DNA, 20 bp, Artificial Sequence
  Description of Artificial Sequence: Synthetic oligonucleotide
  Target: ATXN1; (+) strand; PAM type: YTN; PAM sequence: CTA
ttagtcctgtctgtctagag

SEQ ID NO: 246286 - DNA, 20 bp, Artificial Sequence
  Description of Artificial Sequence: Synthetic oligonucleotide
  Target: ATXN1; (+) strand; PAM type: YTN; PAM sequence: TTA
gtcctgtctgtctagagaac

SEQ ID NO: 246287 - DNA, 20 bp, Artificial Sequence
  Description of Artificial Sequence: Synthetic oligonucleotide
  Target: ATXN1; (+) strand; PAM type: YTN; PAM sequence: CTG
tctgtctagagaaccctgac

SEQ ID NO: 246288 - DNA, 20 bp, Artificial Sequence
  Description of Artificial Sequence: Synthetic oligonucleotide
  Target: ATXN1; (+) strand; PAM type: YTN; PAM sequence: CTG
tctagagaaccctgactaat

SEQ ID NO: 246289 - DNA, 20 bp, Artificial Sequence
  Description of Artificial Sequence: Synthetic oligonucleotide
  Target: ATXN1; (+) strand; PAM type: YTN; PAM sequence: CTA
gagaaccctgactaatacag

SEQ ID NO: 246290 - DNA, 20 bp, Artificial Sequence
  Description of Artificial Sequence: Synthetic oligonucleotide
  Target: ATXN1; (+) strand; PAM type: YTN; PAM sequence: CTG
actaatacagtgggtcccct

SEQ ID NO: 246291 - DNA, 20 bp, Artificial Sequence
  Description of Artificial Sequence: Synthetic oligonucleotide
  Target: ATXN1; (+) strand; PAM type: YTN; PAM sequence: CTA
atacagtgggtcccctaact

SEQ ID NO: 246292 - DNA, 20 bp, Artificial Sequence
  Description of Artificial Sequence: Synthetic oligonucleotide
  Target: ATXN1; (+) strand; PAM type: YTN; PAM sequence: CTA
actgctacttccttaggcaa

SEQ ID NO: 246293 - DNA, 20 bp, Artificial Sequence
  Description of Artificial Sequence: Synthetic oligonucleotide
  Target: ATXN1; (+) strand; PAM type: YTN; PAM sequence: CTG
ctacttccttaggcaatcat

SEQ ID NO: 246294 - DNA, 20 bp, Artificial Sequence
  Description of Artificial Sequence: Synthetic oligonucleotide
  Target: ATXN1; (+) strand; PAM type: YTN; PAM sequence: CTA
cttccttaggcaatcattcc

SEQ ID NO: 246295 - DNA, 20 bp, Artificial Sequence
  Description of Artificial Sequence: Synthetic oligonucleotide
  Target: ATXN1; (+) strand; PAM type: YTN; PAM sequence: CTT
ccttaggcaatcattcctaa

SEQ ID NO: 246296 - DNA, 20 bp, Artificial Sequence
  Description of Artificial Sequence: Synthetic oligonucleotide
  Target: ATXN1; (+) strand; PAM type: YTN; PAM sequence: TTC
cttaggcaatcattcctaaa

SEQ ID NO: 246297 - DNA, 20 bp, Artificial Sequence
  Description of Artificial Sequence: Synthetic oligonucleotide
  Target: ATXN1; (+) strand; PAM type: YTN; PAM sequence: CTT
aggcaatcattcctaaactc

SEQ ID NO: 246298 - DNA, 20 bp, Artificial Sequence
  Description of Artificial Sequence: Synthetic oligonucleotide
  Target: ATXN1; (+) strand; PAM type: YTN; PAM sequence: TTA
ggcaatcattcctaaactct

SEQ ID NO: 246299 - DNA, 20 bp, Artificial Sequence
  Description of Artificial Sequence: Synthetic oligonucleotide
  Target: ATXN1; (+) strand; PAM type: YTN; PAM sequence: TTC
ctaaactctcagcaaagcca

SEQ ID NO: 246300 - DNA, 20 bp, Artificial Sequence
  Description of Artificial Sequence: Synthetic oligonucleotide
  Target: ATXN1; (+) strand; PAM type: YTN; PAM sequence: CTA
aactctcagcaaagccactt

SEQ ID NO: 246301 - DNA, 20 bp, Artificial Sequence
  Description of Artificial Sequence: Synthetic oligonucleotide
  Target: ATXN1; (+) strand; PAM type: YTN; PAM sequence: CTC
tcagcaaagccacttccggc

SEQ ID NO: 246302 - DNA, 20 bp, Artificial Sequence
  Description of Artificial Sequence: Synthetic oligonucleotide
  Target: ATXN1; (+) strand; PAM type: YTN; PAM sequence: CTC
agcaaagccacttccggctg

SEQ ID NO: 246303 - DNA, 20 bp, Artificial Sequence
  Description of Artificial Sequence: Synthetic oligonucleotide
  Target: ATXN1; (+) strand; PAM type: YTN; PAM sequence: CTT
ccggctgctgcaatccttgt

SEQ ID NO: 246304 - DNA, 20 bp, Artificial Sequence
  Description of Artificial Sequence: Synthetic oligonucleotide
  Target: ATXN1; (+) strand; PAM type: YTN; PAM sequence: TTC
cggctgctgcaatccttgtt

SEQ ID NO: 246305 - DNA, 20 bp, Artificial Sequence
  Description of Artificial Sequence: Synthetic oligonucleotide
  Target: ATXN1; (+) strand; PAM type: YTN; PAM sequence: CTG
ctgcaatccttgttttcacg

SEQ ID NO: 246306 - DNA, 20 bp, Artificial Sequence
  Description of Artificial Sequence: Synthetic oligonucleotide
  Target: ATXN1; (+) strand; PAM type: YTN; PAM sequence: CTG
caatccttgttttcacgtgt

SEQ ID NO: 246307 - DNA, 20 bp, Artificial Sequence
  Description of Artificial Sequence: Synthetic oligonucleotide
  Target: ATXN1; (+) strand; PAM type: YTN; PAM sequence: CTT
gttttcacgtgttttcgtca

SEQ ID NO: 246308 - DNA, 20 bp, Artificial Sequence
  Description of Artificial Sequence: Synthetic oligonucleotide
  Target: ATXN1; (+) strand; PAM type: YTN; PAM sequence: TTG
ttttcacgtgttttcgtcat

SEQ ID NO: 246309 - DNA, 20 bp, Artificial Sequence
  Description of Artificial Sequence: Synthetic oligonucleotide
  Target: ATXN1; (+) strand; PAM type: YTN; PAM sequence: TTT
tcacgtgttttcgtcattag

SEQ ID NO: 246310 - DNA, 20 bp, Artificial Sequence
  Description of Artificial Sequence: Synthetic oligonucleotide
  Target: ATXN1; (+) strand; PAM type: YTN; PAM sequence: TTT
cacgtgttttcgtcattaga

SEQ ID NO: 246311 - DNA, 20 bp, Artificial Sequence
  Description of Artificial Sequence: Synthetic oligonucleotide
  Target: ATXN1; (+) strand; PAM type: YTN; PAM sequence: TTC
acgtgttttcgtcattagac

SEQ ID NO: 246312 - DNA, 20 bp, Artificial Sequence
  Description of Artificial Sequence: Synthetic oligonucleotide
  Target: ATXN1; (+) strand; PAM type: YTN; PAM sequence: TTT
tcgtcattagaccgtaaact

SEQ ID NO: 246313 - DNA, 20 bp, Artificial Sequence
  Description of Artificial Sequence: Synthetic oligonucleotide
  Target: ATXN1; (+) strand; PAM type: YTN; PAM sequence: TTT
cgtcattagaccgtaaactc

SEQ ID NO: 246314 - DNA, 20 bp, Artificial Sequence
  Description of Artificial Sequence: Synthetic oligonucleotide
  Target: ATXN1; (+) strand; PAM type: YTN; PAM sequence: TTC
gtcattagaccgtaaactcc

SEQ ID NO: 246315 - DNA, 20 bp, Artificial Sequence
  Description of Artificial Sequence: Synthetic oligonucleotide
  Target: ATXN1; (+) strand; PAM type: YTN; PAM sequence: TTA
gaccgtaaactccgatgctg

SEQ ID NO: 246316 - DNA, 20 bp, Artificial Sequence
  Description of Artificial Sequence: Synthetic oligonucleotide
  Target: ATXN1; (+) strand; PAM type: YTN; PAM sequence: CTC
cgatgctgcttagagactga

SEQ ID NO: 246317 - DNA, 20 bp, Artificial Sequence
  Description of Artificial Sequence: Synthetic oligonucleotide
  Target: ATXN1; (+) strand; PAM type: YTN; PAM sequence: CTG
cttagagactgaagttcaca

SEQ ID NO: 246318 - DNA, 20 bp, Artificial Sequence
  Description of Artificial Sequence: Synthetic oligonucleotide
  Target: ATXN1; (+) strand; PAM type: YTN; PAM sequence: CTT
agagactgaagttcacaacc

SEQ ID NO: 246319 - DNA, 20 bp, Artificial Sequence
  Description of Artificial Sequence: Synthetic oligonucleotide
  Target: ATXN1; (+) strand; PAM type: YTN; PAM sequence: TTA
gagactgaagttcacaaccc

SEQ ID NO: 246320 - DNA, 20 bp, Artificial Sequence
  Description of Artificial Sequence: Synthetic oligonucleotide
  Target: ATXN1; (+) strand; PAM type: YTN; PAM sequence: CTG
aagttcacaaccccttgggt

SEQ ID NO: 246321 - DNA, 20 bp, Artificial Sequence
  Description of Artificial Sequence: Synthetic oligonucleotide
  Target: ATXN1; (+) strand; PAM type: YTN; PAM sequence: TTC
acaaccccttgggtttctag

SEQ ID NO: 246322 - DNA, 20 bp, Artificial Sequence
  Description of Artificial Sequence: Synthetic oligonucleotide
  Target: ATXN1; (+) strand; PAM type: YTN; PAM sequence: CTT
gggtttctagggtgctgtcc

SEQ ID NO: 246323 - DNA, 20 bp, Artificial Sequence
  Description of Artificial Sequence: Synthetic oligonucleotide
  Target: ATXN1; (+) strand; PAM type: YTN; PAM sequence: TTG
ggtttctagggtgctgtccg

SEQ ID NO: 246324 - DNA, 20 bp, Artificial Sequence
  Description of Artificial Sequence: Synthetic oligonucleotide
  Target: ATXN1; (+) strand; PAM type: YTN; PAM sequence: TTT
ctagggtgctgtccgtcctt

SEQ ID NO: 246325 - DNA, 20 bp, Artificial Sequence
  Description of Artificial Sequence: Synthetic oligonucleotide
  Target: ATXN1; (+) strand; PAM type: YTN; PAM sequence: TTC
tagggtgctgtccgtccttg

SEQ ID NO: 246326 - DNA, 20 bp, Artificial Sequence
  Description of Artificial Sequence: Synthetic oligonucleotide
  Target: ATXN1; (+) strand; PAM type: YTN; PAM sequence: CTA
gggtgctgtccgtccttggt

SEQ ID NO: 246327 - DNA, 20 bp, Artificial Sequence
  Description of Artificial Sequence: Synthetic oligonucleotide
  Target: ATXN1; (+) strand; PAM type: YTN; PAM sequence: CTG
tccgtccttggttggttact

SEQ ID NO: 246328 - DNA, 20 bp, Artificial Sequence
  Description of Artificial Sequence: Synthetic oligonucleotide
  Target: ATXN1; (+) strand; PAM type: YTN; PAM sequence: CTT
ggttggttactgttcttatc

SEQ ID NO: 246329 - DNA, 20 bp, Artificial Sequence
  Description of Artificial Sequence: Synthetic oligonucleotide
  Target: ATXN1; (+) strand; PAM type: YTN; PAM sequence: TTG
gttggttactgttcttatct

SEQ ID NO: 246330 - DNA, 20 bp, Artificial Sequence
  Description of Artificial Sequence: Synthetic oligonucleotide
  Target: ATXN1; (+) strand; PAM type: YTN; PAM sequence: TTG
gttactgttcttatcttgtg

SEQ ID NO: 246331 - DNA, 20 bp, Artificial Sequence
  Description of Artificial Sequence: Synthetic oligonucleotide
  Target: ATXN1; (+) strand; PAM type: YTN; PAM sequence: TTA
ctgttcttatcttgtgtcca

SEQ ID NO: 246332 - DNA, 20 bp, Artificial Sequence
  Description of Artificial Sequence: Synthetic oligonucleotide
  Target: ATXN1; (+) strand; PAM type: YTN; PAM sequence: CTG
ttcttatcttgtgtccatct

SEQ ID NO: 246333 - DNA, 20 bp, Artificial Sequence
  Description of Artificial Sequence: Synthetic oligonucleotide
  Target: ATXN1; (+) strand; PAM type: YTN; PAM sequence: TTC
ttatcttgtgtccatctctt

SEQ ID NO: 246334 - DNA, 20 bp, Artificial Sequence
  Description of Artificial Sequence: Synthetic oligonucleotide
  Target: ATXN1; (+) strand; PAM type: YTN; PAM sequence: CTT
atcttgtgtccatctcttgc

SEQ ID NO: 246335 - DNA, 20 bp, Artificial Sequence
  Description of Artificial Sequence: Synthetic oligonucleotide
  Target: ATXN1; (+) strand; PAM type: YTN; PAM sequence: TTA
tcttgtgtccatctcttgca

SEQ ID NO: 246336 - DNA, 20 bp, Artificial Sequence
  Description of Artificial Sequence: Synthetic oligonucleotide
  Target: ATXN1; (+) strand; PAM type: YTN; PAM sequence: CTT
gtgtccatctcttgcagttt

SEQ ID NO: 246337 - DNA, 20 bp, Artificial Sequence
  Description of Artificial Sequence: Synthetic oligonucleotide
  Target: ATXN1; (+) strand; PAM type: YTN; PAM sequence: TTG
tgtccatctcttgcagtttg

SEQ ID NO: 246338 - DNA, 20 bp, Artificial Sequence
  Description of Artificial Sequence: Synthetic oligonucleotide
  Target: ATXN1; (+) strand; PAM type: YTN; PAM sequence: CTC
ttgcagtttgtcttccttac

SEQ ID NO: 246339 - DNA, 20 bp, Artificial Sequence
  Description of Artificial Sequence: Synthetic oligonucleotide
  Target: ATXN1; (+) strand; PAM type: YTN; PAM sequence: CTT
gcagtttgtcttccttacaa

SEQ ID NO: 246340 - DNA, 20 bp, Artificial Sequence
  Description of Artificial Sequence: Synthetic oligonucleotide
  Target: ATXN1; (+) strand; PAM type: YTN; PAM sequence: TTG
cagtttgtcttccttacaag

SEQ ID NO: 246341 - DNA, 20 bp, Artificial Sequence
  Description of Artificial Sequence: Synthetic oligonucleotide
  Target: ATXN1; (+) strand; PAM type: YTN; PAM sequence: TTT
gtcttccttacaagctggtt

SEQ ID NO: 246342 - DNA, 20 bp, Artificial Sequence
  Description of Artificial Sequence: Synthetic oligonucleotide
  Target: ATXN1; (+) strand; PAM type: YTN; PAM sequence: TTG
tcttccttacaagctggtta

SEQ ID NO: 246343 - DNA, 20 bp, Artificial Sequence
  Description of Artificial Sequence: Synthetic oligonucleotide
  Target: ATXN1; (+) strand; PAM type: YTN; PAM sequence: CTT
ccttacaagctggttattaa

SEQ ID NO: 246344 - DNA, 20 bp, Artificial Sequence
  Description of Artificial Sequence: Synthetic oligonucleotide
  Target: ATXN1; (+) strand; PAM type: YTN; PAM sequence: TTC
cttacaagctggttattaaa

SEQ ID NO: 246345 - DNA, 20 bp, Artificial Sequence
  Description of Artificial Sequence: Synthetic oligonucleotide
  Target: ATXN1; (+) strand; PAM type: YTN; PAM sequence: CTT
acaagctggttattaaaagg

SEQ ID NO: 246346 - DNA, 20 bp, Artificial Sequence
  Description of Artificial Sequence: Synthetic oligonucleotide
  Target: ATXN1; (+) strand; PAM type: YTN; PAM sequence: TTA
caagctggttattaaaaggc

SEQ ID NO: 246347 - DNA, 20 bp, Artificial Sequence
  Description of Artificial Sequence: Synthetic oligonucleotide
  Target: ATXN1; (+) strand; PAM type: YTN; PAM sequence: CTG
gttattaaaaggcaaaggat

SEQ ID NO: 246348 - DNA, 20 bp, Artificial Sequence
  Description of Artificial Sequence: Synthetic oligonucleotide
  Target: ATXN1; (+) strand; PAM type: YTN; PAM sequence: TTA
ttaaaaggcaaaggatttct

SEQ ID NO: 246349 - DNA, 20 bp, Artificial Sequence
  Description of Artificial Sequence: Synthetic oligonucleotide
  Target: ATXN1; (+) strand; PAM type: YTN; PAM sequence: TTA
aaaggcaaaggatttctgga

SEQ ID NO: 246350 - DNA, 20 bp, Artificial Sequence
  Description of Artificial Sequence: Synthetic oligonucleotide
  Target: ATXN1; (+) strand; PAM type: YTN; PAM sequence: TTT
ctggatcattttctagattt

SEQ ID NO: 246351 - DNA, 20 bp, Artificial Sequence
  Description of Artificial Sequence: Synthetic oligonucleotide
  Target: ATXN1; (+) strand; PAM type: YTN; PAM sequence: TTC
tggatcattttctagatttt

SEQ ID NO: 246352 - DNA, 20 bp, Artificial Sequence
  Description of Artificial Sequence: Synthetic oligonucleotide
  Target: ATXN1; (+) strand; PAM type: YTN; PAM sequence: CTG
gatcattttctagattttgg

SEQ ID NO: 246353 - DNA, 20 bp, Artificial Sequence
  Description of Artificial Sequence: Synthetic oligonucleotide
  Target: ATXN1; (+) strand; PAM type: YTN; PAM sequence: TTT
tctagattttggatgtgatg

SEQ ID NO: 246354 - DNA, 20 bp, Artificial Sequence
  Description of Artificial Sequence: Synthetic oligonucleotide
  Target: ATXN1; (+) strand; PAM type: YTN; PAM sequence: TTT
ctagattttggatgtgatga

SEQ ID NO: 246355 - DNA, 20 bp, Artificial Sequence
  Description of Artificial Sequence: Synthetic oligonucleotide
  Target: ATXN1; (+) strand; PAM type: YTN; PAM sequence: TTC
tagattttggatgtgatgat

SEQ ID NO: 246356 - DNA, 20 bp, Artificial Sequence
  Description of Artificial Sequence: Synthetic oligonucleotide
  Target: ATXN1; (+) strand; PAM type: YTN; PAM sequence: CTA
gattttggatgtgatgataa

SEQ ID NO: 246357 - DNA, 20 bp, Artificial Sequence
  Description of Artificial Sequence: Synthetic oligonucleotide
  Target: ATXN1; (+) strand; PAM type: YTN; PAM sequence: TTT
tggatgtgatgataaaaaac

SEQ ID NO: 246358 - DNA, 20 bp, Artificial Sequence
  Description of Artificial Sequence: Synthetic oligonucleotide
  Target: ATXN1; (+) strand; PAM type: YTN; PAM sequence: TTT
ggatgtgatgataaaaaact

SEQ ID NO: 246359 - DNA, 20 bp, Artificial Sequence
  Description of Artificial Sequence: Synthetic oligonucleotide
  Target: ATXN1; (+) strand; PAM type: YTN; PAM sequence: TTG
gatgtgatgataaaaaactg

SEQ ID NO: 246360 - DNA, 20 bp, Artificial Sequence
  Description of Artificial Sequence: Synthetic oligonucleotide
  Target: ATXN1; (+) strand; PAM type: YTN; PAM sequence: CTG
aactcattacggagggacat

SEQ ID NO: 246361 - DNA, 20 bp, Artificial Sequence
  Description of Artificial Sequence: Synthetic oligonucleotide
  Target: ATXN1; (+) strand; PAM type: YTN; PAM sequence: CTC
attacggagggacataaaat

SEQ ID NO: 246362 - DNA, 20 bp, Artificial Sequence
  Description of Artificial Sequence: Synthetic oligonucleotide
  Target: ATXN1; (+) strand; PAM type: YTN; PAM sequence: TTA
cggagggacataaaataatg

SEQ ID NO: 246363 - DNA, 20 bp, Artificial Sequence
  Description of Artificial Sequence: Synthetic oligonucleotide
  Target: ATXN1; (+) strand; PAM type: YTN; PAM sequence: TTG
tggtatctgcaaagaatctg

SEQ ID NO: 246364 - DNA, 20 bp, Artificial Sequence
  Description of Artificial Sequence: Synthetic oligonucleotide
  Target: ATXN1; (+) strand; PAM type: YTN; PAM sequence: CTG
caaagaatctgccccttgag

SEQ ID NO: 246365 - DNA, 20 bp, Artificial Sequence
  Description of Artificial Sequence: Synthetic oligonucleotide
  Target: ATXN1; (+) strand; PAM type: YTN; PAM sequence: CTG
ccccttgagattccatttca

SEQ ID NO: 246366 - DNA, 20 bp, Artificial Sequence
  Description of Artificial Sequence: Synthetic oligonucleotide
  Target: ATXN1; (+) strand; PAM type: YTN; PAM sequence: CTT
gagattccatttcaaacata

SEQ ID NO: 246367 - DNA, 20 bp, Artificial Sequence
  Description of Artificial Sequence: Synthetic oligonucleotide
  Target: ATXN1; (+) strand; PAM type: YTN; PAM sequence: TTG
agattccatttcaaacatac

SEQ ID NO: 246368 - DNA, 20 bp, Artificial Sequence
  Description of Artificial Sequence: Synthetic oligonucleotide
  Target: ATXN1; (+) strand; PAM type: YTN; PAM sequence: TTC
catttcaaacatactttctc

SEQ ID NO: 246369 - DNA, 20 bp, Artificial Sequence
  Description of Artificial Sequence: Synthetic oligonucleotide
  Target: ATXN1; (+) strand; PAM type: YTN; PAM sequence: TTT
caaacatactttctcacgtg

SEQ ID NO: 246370 - DNA, 20 bp, Artificial Sequence
  Description of Artificial Sequence: Synthetic oligonucleotide
  Target: ATXN1; (+) strand; PAM type: YTN; PAM sequence: TTC
aaacatactttctcacgtga

SEQ ID NO: 246371 - DNA, 20 bp, Artificial Sequence
  Description of Artificial Sequence: Synthetic oligonucleotide
  Target: ATXN1; (+) strand; PAM type: YTN; PAM sequence: CTT
tctcacgtgagattattaac

SEQ ID NO: 246372 - DNA, 20 bp, Artificial Sequence
  Description of Artificial Sequence: Synthetic oligonucleotide
  Target: ATXN1; (+) strand; PAM type: YTN; PAM sequence: TTT
ctcacgtgagattattaact

SEQ ID NO: 246373 - DNA, 20 bp, Artificial Sequence
  Description of Artificial Sequence: Synthetic oligonucleotide
  Target: ATXN1; (+) strand; PAM type: YTN; PAM sequence: TTC
tcacgtgagattattaactc

SEQ ID NO: 246374 - DNA, 20 bp, Artificial Sequence
  Description of Artificial Sequence: Synthetic oligonucleotide
  Target: ATXN1; (+) strand; PAM type: YTN; PAM sequence: CTC
acgtgagattattaactcct

SEQ ID NO: 246375 - DNA, 20 bp, Artificial Sequence
  Description of Artificial Sequence: Synthetic oligonucleotide
  Target: ATXN1; (+) strand; PAM type: YTN; PAM sequence: TTA
ttaactcctgttacttctcg

SEQ ID NO: 246376 - DNA, 20 bp, Artificial Sequence
  Description of Artificial Sequence: Synthetic oligonucleotide
  Target: ATXN1; (+) strand; PAM type: YTN; PAM sequence: TTA
actcctgttacttctcgggt

SEQ ID NO: 246377 - DNA, 20 bp, Artificial Sequence
  Description of Artificial Sequence: Synthetic oligonucleotide
  Target: ATXN1; (+) strand; PAM type: YTN; PAM sequence: CTC
ctgttacttctcgggtcagg

SEQ ID NO: 246378 - DNA, 20 bp, Artificial Sequence
  Description of Artificial Sequence: Synthetic oligonucleotide
  Target: ATXN1; (+) strand; PAM type: YTN; PAM sequence: CTG
ttacttctcgggtcaggaag

SEQ ID NO: 246379 - DNA, 20 bp, Artificial Sequence
  Description of Artificial Sequence: Synthetic oligonucleotide
  Target: ATXN1; (+) strand; PAM type: YTN; PAM sequence: TTA
cttctcgggtcaggaagtac

SEQ ID NO: 246380 - DNA, 20 bp, Artificial Sequence
  Description of Artificial Sequence: Synthetic oligonucleotide
  Target: ATXN1; (+) strand; PAM type: YTN; PAM sequence: CTT
ctcgggtcaggaagtacaag

SEQ ID NO: 246381 - DNA, 20 bp, Artificial Sequence
  Description of Artificial Sequence: Synthetic oligonucleotide
  Target: ATXN1; (+) strand; PAM type: YTN; PAM sequence: TTC
tcgggtcaggaagtacaagt

SEQ ID NO: 246382 - DNA, 20 bp, Artificial Sequence
  Description of Artificial Sequence: Synthetic oligonucleotide
  Target: ATXN1; (+) strand; PAM type: YTN; PAM sequence: CTC
gggtcaggaagtacaagtat

SEQ ID NO: 246383 - DNA, 20 bp, Artificial Sequence
  Description of Artificial Sequence: Synthetic oligonucleotide
  Target: ATXN1; (+) strand; PAM type: YTN; PAM sequence: TTG
tgtgagatgttaaagacact

SEQ ID NO: 246384 - DNA, 20 bp, Artificial Sequence
  Description of Artificial Sequence: Synthetic oligonucleotide
  Target: ATXN1; (+) strand; PAM type: YTN; PAM sequence: TTA
aagacacttgctatatggga

SEQ ID NO: 246385 - DNA, 20 bp, Artificial Sequence
  Description of Artificial Sequence: Synthetic oligonucleotide
  Target: ATXN1; (+) strand; PAM type: YTN; PAM sequence: CTT
gctatatgggaaggcctcta

SEQ ID NO: 246386 - DNA, 20 bp, Artificial Sequence
  Description of Artificial Sequence: Synthetic oligonucleotide
  Target: ATXN1; (+) strand; PAM type: YTN; PAM sequence: TTG
ctatatgggaaggcctctaa

SEQ ID NO: 246387 - DNA, 20 bp, Artificial Sequence
  Description of Artificial Sequence: Synthetic oligonucleotide
  Target: ATXN1; (+) strand; PAM type: YTN; PAM sequence: CTA
tatgggaaggcctctaaaca

SEQ ID NO: 246388 - DNA, 20 bp, Artificial Sequence
  Description of Artificial Sequence: Synthetic oligonucleotide
  Target: ATXN1; (+) strand; PAM type: YTN; PAM sequence: CTC
taaacattcatatccaatta

SEQ ID NO: 246389 - DNA, 20 bp, Artificial Sequence
  Description of Artificial Sequence: Synthetic oligonucleotide
  Target: ATXN1; (+) strand; PAM type: YTN; PAM sequence: CTA
aacattcatatccaattatc

SEQ ID NO: 246390 - DNA, 20 bp, Artificial Sequence
  Description of Artificial Sequence: Synthetic oligonucleotide
  Target: ATXN1; (+) strand; PAM type: YTN; PAM sequence: TTC
atatccaattatccaaaact

SEQ ID NO: 246391 - DNA, 20 bp, Artificial Sequence
  Description of Artificial Sequence: Synthetic oligonucleotide
  Target: ATXN1; (+) strand; PAM type: YTN; PAM sequence: TTA
tccaaaactaattaaagatt

SEQ ID NO: 246392 - DNA, 20 bp, Artificial Sequence
  Description of Artificial Sequence: Synthetic oligonucleotide
  Target: ATXN1; (+) strand; PAM type: YTN; PAM sequence: CTA
attaaagattgtcttaggct

SEQ ID NO: 246393 - DNA, 20 bp, Artificial Sequence
  Description of Artificial Sequence: Synthetic oligonucleotide
  Target: ATXN1; (+) strand; PAM type: YTN; PAM sequence: TTA
aagattgtcttaggctcaat

SEQ ID NO: 246394 - DNA, 20 bp, Artificial Sequence
  Description of Artificial Sequence: Synthetic oligonucleotide
  Target: ATXN1; (+) strand; PAM type: YTN; PAM sequence: TTG
tcttaggctcaatctcaagg

SEQ ID NO: 246395 - DNA, 20 bp, Artificial Sequence
  Description of Artificial Sequence: Synthetic oligonucleotide
  Target: ATXN1; (+) strand; PAM type: YTN; PAM sequence: CTT
aggctcaatctcaaggaaac

SEQ ID NO: 246396 - DNA, 20 bp, Artificial Sequence
  Description of Artificial Sequence: Synthetic oligonucleotide
  Target: ATXN1; (+) strand; PAM type: YTN; PAM sequence: TTA
ggctcaatctcaaggaaaca

SEQ ID NO: 246397 - DNA, 20 bp, Artificial Sequence
  Description of Artificial Sequence: Synthetic oligonucleotide
  Target: ATXN1; (+) strand; PAM type: YTN; PAM sequence: CTC
aatctcaaggaaacacctcg

SEQ ID NO: 246398 - DNA, 20 bp, Artificial Sequence
  Description of Artificial Sequence: Synthetic oligonucleotide
  Target: ATXN1; (+) strand; PAM type: YTN; PAM sequence: CTC
aaggaaacacctcggtagtc

SEQ ID NO: 246399 - DNA, 20 bp, Artificial Sequence
  Description of Artificial Sequence: Synthetic oligonucleotide
  Target: ATXN1; (+) strand; PAM type: YTN; PAM sequence: CTC
ggtagtctctggatttactg

SEQ ID NO: 246400 - DNA, 20 bp, Artificial Sequence
  Description of Artificial Sequence: Synthetic oligonucleotide
  Target: ATXN1; (+) strand; PAM type: YTN; PAM sequence: CTC
tggatttactggaagaggtg

SEQ ID NO: 246401 - DNA, 20 bp, Artificial Sequence
  Description of Artificial Sequence: Synthetic oligonucleotide
  Target: ATXN1; (+) strand; PAM type: YTN; PAM sequence: CTG
gatttactggaagaggtgtg

SEQ ID NO: 246402 - DNA, 20 bp, Artificial Sequence
  Description of Artificial Sequence: Synthetic oligonucleotide
  Target: ATXN1; (+) strand; PAM type: YTN; PAM sequence: TTT
actggaagaggtgtgtattt

SEQ ID NO: 246403 - DNA, 20 bp, Artificial Sequence
  Description of Artificial Sequence: Synthetic oligonucleotide
  Target: ATXN1; (+) strand; PAM type: YTN; PAM sequence: TTA
ctggaagaggtgtgtattta

SEQ ID NO: 246404 - DNA, 20 bp, Artificial Sequence
  Description of Artificial Sequence: Synthetic oligonucleotide
  Target: ATXN1; (+) strand; PAM type: YTN; PAM sequence: CTG
gaagaggtgtgtatttacaa

SEQ ID NO: 246405 - DNA, 20 bp, Artificial Sequence
  Description of Artificial Sequence: Synthetic oligonucleotide
  Target: ATXN1; (+) strand; PAM type: YTN; PAM sequence: TTT
acaaagacaacaattttgtt

SEQ ID NO: 246406 - DNA, 20 bp, Artificial Sequence
  Description of Artificial Sequence: Synthetic oligonucleotide
  Target: ATXN1; (+) strand; PAM type: YTN; PAM sequence: TTA
caaagacaacaattttgttg

SEQ ID NO: 246407 - DNA, 20 bp, Artificial Sequence
  Description of Artificial Sequence: Synthetic oligonucleotide
  Target: ATXN1; (+) strand; PAM type: YTN; PAM sequence: TTT
tgttgaaaccagcctaaatc

SEQ ID NO: 246408 - DNA, 20 bp, Artificial Sequence
  Description of Artificial Sequence: Synthetic oligonucleotide
  Target: ATXN1; (+) strand; PAM type: YTN; PAM sequence: TTT
gttgaaaccagcctaaatca

SEQ ID NO: 246409 - DNA, 20 bp, Artificial Sequence
  Description of Artificial Sequence: Synthetic oligonucleotide
  Target: ATXN1; (+) strand; PAM type: YTN; PAM sequence: TTG
ttgaaaccagcctaaatcaa

SEQ ID NO: 246410 - DNA, 20 bp, Artificial Sequence
  Description of Artificial Sequence: Synthetic oligonucleotide
  Target: ATXN1; (+) strand; PAM type: YTN; PAM sequence: TTG
aaaccagcctaaatcaatcg

SEQ ID NO: 246411 - DNA, 20 bp, Artificial Sequence
  Description of Artificial Sequence: Synthetic oligonucleotide
  Target: ATXN1; (+) strand; PAM type: YTN; PAM sequence: CTA
aatcaatcgtaggaaggaca

SEQ ID NO: 246412 - DNA, 20 bp, Artificial Sequence
  Description of Artificial Sequence: Synthetic oligonucleotide
  Target: ATXN1; (+) strand; PAM type: YTN; PAM sequence: CTG
tacacatcggccaagataag

SEQ ID NO: 246413 - DNA, 20 bp, Artificial Sequence
  Description of Artificial Sequence: Synthetic oligonucleotide
  Target: ATXN1; (+) strand; PAM type: YTN; PAM sequence: TTC
tctctgcaataaatgtttgt

SEQ ID NO: 246414 - DNA, 20 bp, Artificial Sequence
  Description of Artificial Sequence: Synthetic oligonucleotide
  Target: ATXN1; (+) strand; PAM type: YTN; PAM sequence: CTC
tctgcaataaatgtttgttt

SEQ ID NO: 246415 - DNA, 20 bp, Artificial Sequence
  Description of Artificial Sequence: Synthetic oligonucleotide
  Target: ATXN1; (+) strand; PAM type: YTN; PAM sequence: CTC
tgcaataaatgtttgtttta

SEQ ID NO: 246416 - DNA, 20 bp, Artificial Sequence
  Description of Artificial Sequence: Synthetic oligonucleotide
  Target: ATXN1; (+) strand; PAM type: YTN; PAM sequence: CTG
caataaatgtttgttttaaa

SEQ ID NO: 246417 - DNA, 20 bp, Artificial Sequence
  Description of Artificial Sequence: Synthetic oligonucleotide
  Target: ATXN1; (+) strand; PAM type: YTN; PAM sequence: TTT
gttttaaaattaggggtatg

SEQ ID NO: 246418 - DNA, 20 bp, Artificial Sequence
  Description of Artificial Sequence: Synthetic oligonucleotide
  Target: ATXN1; (+) strand; PAM type: YTN; PAM sequence: TTG
ttttaaaattaggggtatga

SEQ ID NO: 246419 - DNA, 20 bp, Artificial Sequence
  Description of Artificial Sequence: Synthetic oligonucleotide
  Target: ATXN1; (+) strand; PAM type: YTN; PAM sequence: TTT
taaaattaggggtatgactc

SEQ ID NO: 246420 - DNA, 20 bp, Artificial Sequence
  Description of Artificial Sequence: Synthetic oligonucleotide
  Target: ATXN1; (+) strand; PAM type: YTN; PAM sequence: TTT
aaaattaggggtatgactca

SEQ ID NO: 246421 - DNA, 20 bp, Artificial Sequence
  Description of Artificial Sequence: Synthetic oligonucleotide
  Target: ATXN1; (+) strand; PAM type: YTN; PAM sequence: TTA
aaattaggggtatgactcac

SEQ ID NO: 246422 - DNA, 20 bp, Artificial Sequence
  Description of Artificial Sequence: Synthetic oligonucleotide
  Target: ATXN1; (+) strand; PAM type: YTN; PAM sequence: TTA
ggggtatgactcacactcgg

SEQ ID NO: 246423 - DNA, 20 bp, Artificial Sequence
  Description of Artificial Sequence: Synthetic oligonucleotide
  Target: ATXN1; (+) strand; PAM type: YTN; PAM sequence: CTC
acactcggtgaatgggtggc

SEQ ID NO: 246424 - DNA, 20 bp, Artificial Sequence
  Description of Artificial Sequence: Synthetic oligonucleotide
  Target: ATXN1; (+) strand; PAM type: YTN; PAM sequence: CTC
ggtgaatgggtggctgactt

SEQ ID NO: 246425 - DNA, 20 bp, Artificial Sequence
  Description of Artificial Sequence: Synthetic oligonucleotide
  Target: ATXN1; (+) strand; PAM type: YTN; PAM sequence: CTG
acttctgaccctcaaaagat

SEQ ID NO: 246426 - DNA, 20 bp, Artificial Sequence
  Description of Artificial Sequence: Synthetic oligonucleotide
  Target: ATXN1; (+) strand; PAM type: YTN; PAM sequence: CTT
ctgaccctcaaaagatgaat

SEQ ID NO: 246427 - DNA, 20 bp, Artificial Sequence
  Description of Artificial Sequence: Synthetic oligonucleotide
  Target: ATXN1; (+) strand; PAM type: YTN; PAM sequence: TTC
tgaccctcaaaagatgaatg

SEQ ID NO: 246428 - DNA, 20 bp, Artificial Sequence
  Description of Artificial Sequence: Synthetic oligonucleotide
  Target: ATXN1; (+) strand; PAM type: YTN; PAM sequence: CTG
accctcaaaagatgaatggc

SEQ ID NO: 246429 - DNA, 20 bp, Artificial Sequence
  Description of Artificial Sequence: Synthetic oligonucleotide
  Target: ATXN1; (+) strand; PAM type: YTN; PAM sequence: CTC
aaaagatgaatggctcattt

SEQ ID NO: 246430 - DNA, 20 bp, Artificial Sequence
  Description of Artificial Sequence: Synthetic oligonucleotide
  Target: ATXN1; (+) strand; PAM type: YTN; PAM sequence: CTC
attttgaaaagcccagcaag

SEQ ID NO: 246431 - DNA, 20 bp, Artificial Sequence
  Description of Artificial Sequence: Synthetic oligonucleotide
  Target: ATXN1; (+) strand; PAM type: YTN; PAM sequence: TTT
tgaaaagcccagcaagtggg

SEQ ID NO: 246432 - DNA, 20 bp, Artificial Sequence
  Description of Artificial Sequence: Synthetic oligonucleotide
  Target: ATXN1; (+) strand; PAM type: YTN; PAM sequence: TTT
gaaaagcccagcaagtggga

SEQ ID NO: 246433 - DNA, 20 bp, Artificial Sequence
  Description of Artificial Sequence: Synthetic oligonucleotide
  Target: ATXN1; (+) strand; PAM type: YTN; PAM sequence: TTG
aaaagcccagcaagtgggaa

SEQ ID NO: 246434 - DNA, 20 bp, Artificial Sequence
  Description of Artificial Sequence: Synthetic oligonucleotide
  Target: ATXN1; (+) strand; PAM type: YTN; PAM sequence: CTA
ctttctacctccactgactt

SEQ ID NO: 246435 - DNA, 20 bp, Artificial Sequence
  Description of Artificial Sequence: Synthetic oligonucleotide
  Target: ATXN1; (+) strand; PAM type: YTN; PAM sequence: CTT
tctacctccactgacttcag

SEQ ID NO: 246436 - DNA, 20 bp, Artificial Sequence
  Description of Artificial Sequence: Synthetic oligonucleotide
  Target: ATXN1; (+) strand; PAM type: YTN; PAM sequence: TTT
ctacctccactgacttcaga

SEQ ID NO: 246437 - DNA, 20 bp, Artificial Sequence
  Description of Artificial Sequence: Synthetic oligonucleotide
  Target: ATXN1; (+) strand; PAM type: YTN; PAM sequence: TTC
tacctccactgacttcagaa

SEQ ID NO: 246438 - DNA, 20 bp, Artificial Sequence
  Description of Artificial Sequence: Synthetic oligonucleotide
  Target: ATXN1; (+) strand; PAM type: YTN; PAM sequence: CTA
cctccactgacttcagaatg

SEQ ID NO: 246439 - DNA, 20 bp, Artificial Sequence
  Description of Artificial Sequence: Synthetic oligonucleotide
  Target: ATXN1; (+) strand; PAM type: YTN; PAM sequence: CTC
cactgacttcagaatgaggc

SEQ ID NO: 246440 - DNA, 20 bp, Artificial Sequence
  Description of Artificial Sequence: Synthetic oligonucleotide
  Target: ATXN1; (+) strand; PAM type: YTN; PAM sequence: CTG
acttcagaatgaggctgcag

SEQ ID NO: 246441 - DNA, 20 bp, Artificial Sequence
  Description of Artificial Sequence: Synthetic oligonucleotide
  Target: ATXN1; (+) strand; PAM type: YTN; PAM sequence: CTT
cagaatgaggctgcagtgta

SEQ ID NO: 246442 - DNA, 20 bp, Artificial Sequence
  Description of Artificial Sequence: Synthetic oligonucleotide
  Target: ATXN1; (+) strand; PAM type: YTN; PAM sequence: TTC
agaatgaggctgcagtgtag

SEQ ID NO: 246443 - DNA, 20 bp, Artificial Sequence
  Description of Artificial Sequence: Synthetic oligonucleotide
  Target: ATXN1; (+) strand; PAM type: YTN; PAM sequence: CTG
cagtgtagtggagcccaaga

SEQ ID NO: 246444 - DNA, 20 bp, Artificial Sequence
  Description of Artificial Sequence: Synthetic oligonucleotide
  Target: ATXN1; (+) strand; PAM type: YTN; PAM sequence: TTG
tttccagtcactagcaagat

SEQ ID NO: 246445 - DNA, 20 bp, Artificial Sequence
  Description of Artificial Sequence: Synthetic oligonucleotide
  Target: ATXN1; (+) strand; PAM type: YTN; PAM sequence: TTT
ccagtcactagcaagatgga

SEQ ID NO: 246446 - DNA, 20 bp, Artificial Sequence
  Description of Artificial Sequence: Synthetic oligonucleotide
  Target: ATXN1; (+) strand; PAM type: YTN; PAM sequence: TTC
cagtcactagcaagatggac

SEQ ID NO: 246447 - DNA, 20 bp, Artificial Sequence
  Description of Artificial Sequence: Synthetic oligonucleotide
  Target: ATXN1; (+) strand; PAM type: YTN; PAM sequence: CTA
gcaagatggacaatgggatg

SEQ ID NO: 246448 - DNA, 20 bp, Artificial Sequence
  Description of Artificial Sequence: Synthetic oligonucleotide
  Target: ATXN1; (+) strand; PAM type: YTN; PAM sequence: CTC
gctacctgcagctgttttca

SEQ ID NO: 246449 - DNA, 20 bp, Artificial Sequence
  Description of Artificial Sequence: Synthetic oligonucleotide
  Target: ATXN1; (+) strand; PAM type: YTN; PAM sequence: CTA
cctgcagctgttttcaataa

SEQ ID NO: 246450 - DNA, 20 bp, Artificial Sequence
  Description of Artificial Sequence: Synthetic oligonucleotide
  Target: ATXN1; (+) strand; PAM type: YTN; PAM sequence: CTG
cagctgttttcaataaaaaa

SEQ ID NO: 246451 - DNA, 20 bp, Artificial Sequence
  Description of Artificial Sequence: Synthetic oligonucleotide
  Target: ATXN1; (+) strand; PAM type: YTN; PAM sequence: CTG
ttttcaataaaaaagctgag

SEQ ID NO: 246452 - DNA, 20 bp, Artificial Sequence
  Description of Artificial Sequence: Synthetic oligonucleotide
  Target: ATXN1; (+) strand; PAM type: YTN; PAM sequence: TTT
tcaataaaaaagctgagtaa

SEQ ID NO: 246453 - DNA, 20 bp, Artificial Sequence
  Description of Artificial Sequence: Synthetic oligonucleotide
  Target: ATXN1; (+) strand; PAM type: YTN; PAM sequence: TTT
caataaaaaagctgagtaat

SEQ ID NO: 246454 - DNA, 20 bp, Artificial Sequence
  Description of Artificial Sequence: Synthetic oligonucleotide
  Target: ATXN1; (+) strand; PAM type: YTN; PAM sequence: TTC
aataaaaaagctgagtaatt

SEQ ID NO: 246455 - DNA, 20 bp, Artificial Sequence
  Description of Artificial Sequence: Synthetic oligonucleotide
  Target: ATXN1; (+) strand; PAM type: YTN; PAM sequence: CTG
agtaattacagcagcctctc

SEQ ID NO: 246456 - DNA, 20 bp, Artificial Sequence
  Description of Artificial Sequence: Synthetic oligonucleotide
  Target: ATXN1; (+) strand; PAM type: YTN; PAM sequence: TTA
cagcagcctctcctggggct

SEQ ID NO: 246457 - DNA, 20 bp, Artificial Sequence
  Description of Artificial Sequence: Synthetic oligonucleotide
  Target: ATXN1; (+) strand; PAM type: YTN; PAM sequence: CTC
tcctggggctcacatgcggc

SEQ ID NO: 246458 - DNA, 20 bp, Artificial Sequence
  Description of Artificial Sequence: Synthetic oligonucleotide
  Target: ATXN1; (+) strand; PAM type: YTN; PAM sequence: CTC
ctggggctcacatgcggccc

SEQ ID NO: 246459 - DNA, 20 bp, Artificial Sequence
  Description of Artificial Sequence: Synthetic oligonucleotide
  Target: ATXN1; (+) strand; PAM type: YTN; PAM sequence: CTG
gggctcacatgcggcccagc

SEQ ID NO: 246460 - DNA, 20 bp, Artificial Sequence
  Description of Artificial Sequence: Synthetic oligonucleotide
  Target: ATXN1; (+) strand; PAM type: YTN; PAM sequence: CTC
acatgcggcccagcacaaag

SEQ ID NO: 246461 - DNA, 20 bp, Artificial Sequence
  Description of Artificial Sequence: Synthetic oligonucleotide
  Target: ATXN1; (+) strand; PAM type: YTN; PAM sequence: TTA
aggacactgaatgagctgcc

SEQ ID NO: 246462 - DNA, 20 bp, Artificial Sequence
  Description of Artificial Sequence: Synthetic oligonucleotide
  Target: ATXN1; (+) strand; PAM type: YTN; PAM sequence: CTG
aatgagctgccagaagccct

SEQ ID NO: 246463 - DNA, 20 bp, Artificial Sequence
  Description of Artificial Sequence: Synthetic oligonucleotide
  Target: ATXN1; (+) strand; PAM type: YTN; PAM sequence: CTG
ccagaagcccttcagcattg

SEQ ID NO: 246464 - DNA, 20 bp, Artificial Sequence
  Description of Artificial Sequence: Synthetic oligonucleotide
  Target: ATXN1; (+) strand; PAM type: YTN; PAM sequence: CTT
cagcattgggctgccaaact

SEQ ID NO: 246465 - DNA, 20 bp, Artificial Sequence
  Description of Artificial Sequence: Synthetic oligonucleotide
  Target: ATXN1; (+) strand; PAM type: YTN; PAM sequence: TTC
agcattgggctgccaaactg

SEQ ID NO: 246466 - DNA, 20 bp, Artificial Sequence
  Description of Artificial Sequence: Synthetic oligonucleotide
  Target: ATXN1; (+) strand; PAM type: YTN; PAM sequence: TTG
ggctgccaaactgctcctcc

SEQ ID NO: 246467 - DNA, 20 bp, Artificial Sequence
  Description of Artificial Sequence: Synthetic oligonucleotide
  Target: ATXN1; (+) strand; PAM type: YTN; PAM sequence: CTG
ccaaactgctcctcctcccc

SEQ ID NO: 246468 - DNA, 20 bp, Artificial Sequence
  Description of Artificial Sequence: Synthetic oligonucleotide
  Target: ATXN1; (+) strand; PAM type: YTN; PAM sequence: CTG
ctcctcctcccccagctcag

SEQ ID NO: 246469 - DNA, 20 bp, Artificial Sequence
  Description of Artificial Sequence: Synthetic oligonucleotide
  Target: ATXN1; (+) strand; PAM type: YTN; PAM sequence: CTC
ctcctcccccagctcagcgt

SEQ ID NO: 246470 - DNA, 20 bp, Artificial Sequence
  Description of Artificial Sequence: Synthetic oligonucleotide
  Target: ATXN1; (+) strand; PAM type: YTN; PAM sequence: CTC
ctcccccagctcagcgtcat

SEQ ID NO: 246471 - DNA, 20 bp, Artificial Sequence
  Description of Artificial Sequence: Synthetic oligonucleotide
  Target: ATXN1; (+) strand; PAM type: YTN; PAM sequence: CTC
ccccagctcagcgtcattaa

SEQ ID NO: 246472 - DNA, 20 bp, Artificial Sequence
  Description of Artificial Sequence: Synthetic oligonucleotide
  Target: ATXN1; (+) strand; PAM type: YTN; PAM sequence: CTC
agcgtcattaacttaatcag

SEQ ID NO: 246473 - DNA, 20 bp, Artificial Sequence
  Description of Artificial Sequence: Synthetic oligonucleotide
  Target: ATXN1; (+) strand; PAM type: YTN; PAM sequence: TTA
acttaatcaggtattcattc

SEQ ID NO: 246474 - DNA, 20 bp, Artificial Sequence
  Description of Artificial Sequence: Synthetic oligonucleotide
  Target: ATXN1; (+) strand; PAM type: YTN; PAM sequence: CTT
aatcaggtattcattcaata

SEQ ID NO: 246475 - DNA, 20 bp, Artificial Sequence
  Description of Artificial Sequence: Synthetic oligonucleotide
  Target: ATXN1; (+) strand; PAM type: YTN; PAM sequence: TTA
atcaggtattcattcaataa

SEQ ID NO: 246476 - DNA, 20 bp, Artificial Sequence
  Description of Artificial Sequence: Synthetic oligonucleotide
  Target: ATXN1; (+) strand; PAM type: YTN; PAM sequence: TTC
attcaataaaaaaaaattga

SEQ ID NO: 246477 - DNA, 20 bp, Artificial Sequence
  Description of Artificial Sequence: Synthetic oligonucleotide
  Target: ATXN1; (+) strand; PAM type: YTN; PAM sequence: TTC
aataaaaaaaaattgacact

SEQ ID NO: 246478 - DNA, 20 bp, Artificial Sequence
  Description of Artificial Sequence: Synthetic oligonucleotide
  Target: ATXN1; (+) strand; PAM type: YTN; PAM sequence: TTG
acactccctggatgtaggca

SEQ ID NO: 246479 - DNA, 20 bp, Artificial Sequence
  Description of Artificial Sequence: Synthetic oligonucleotide
  Target: ATXN1; (+) strand; PAM type: YTN; PAM sequence: CTC
cctggatgtaggcaacaccc

SEQ ID NO: 246480 - DNA, 20 bp, Artificial Sequence
  Description of Artificial Sequence: Synthetic oligonucleotide
  Target: ATXN1; (+) strand; PAM type: YTN; PAM sequence: CTG
gatgtaggcaacaccctctg

SEQ ID NO: 246481 - DNA, 20 bp, Artificial Sequence
  Description of Artificial Sequence: Synthetic oligonucleotide
  Target: ATXN1; (+) strand; PAM type: YTN; PAM sequence: CTC
tgaatgaggcacactgtcaa

SEQ ID NO: 246482 - DNA, 20 bp, Artificial Sequence
  Description of Artificial Sequence: Synthetic oligonucleotide
  Target: ATXN1; (+) strand; PAM type: YTN; PAM sequence: CTG
aatgaggcacactgtcaaat

SEQ ID NO: 246483 - DNA, 20 bp, Artificial Sequence
  Description of Artificial Sequence: Synthetic oligonucleotide
  Target: ATXN1; (+) strand; PAM type: YTN; PAM sequence: CTG
tcaaattgactgcatccggc

SEQ ID NO: 246484 - DNA, 20 bp, Artificial Sequence
  Description of Artificial Sequence: Synthetic oligonucleotide
  Target: ATXN1; (+) strand; PAM type: YTN; PAM sequence: TTG
actgcatccggcaggaagtg

SEQ ID NO: 246485 - DNA, 20 bp, Artificial Sequence
  Description of Artificial Sequence: Synthetic oligonucleotide
  Target: ATXN1; (+) strand; PAM type: YTN; PAM sequence: CTG
catccggcaggaagtgtgag

SEQ ID NO: 246486 - DNA, 20 bp, Artificial Sequence
  Description of Artificial Sequence: Synthetic oligonucleotide
  Target: ATXN1; (+) strand; PAM type: YTN; PAM sequence: TTC
tatattcttttaattattta

SEQ ID NO: 246487 - DNA, 20 bp, Artificial Sequence
  Description of Artificial Sequence: Synthetic oligonucleotide
  Target: ATXN1; (+) strand; PAM type: YTN; PAM sequence: CTA
tattcttttaattatttatt

SEQ ID NO: 246488 - DNA, 20 bp, Artificial Sequence
  Description of Artificial Sequence: Synthetic oligonucleotide
  Target: ATXN1; (+) strand; PAM type: YTN; PAM sequence: TTC
ttttaattatttatttattt

SEQ ID NO: 246489 - DNA, 20 bp, Artificial Sequence
  Description of Artificial Sequence: Synthetic oligonucleotide
  Target: ATXN1; (+) strand; PAM type: YTN; PAM sequence: CTT
ttaattatttatttatttat

SEQ ID NO: 246490 - DNA, 20 bp, Artificial Sequence
  Description of Artificial Sequence: Synthetic oligonucleotide
  Target: ATXN1; (+) strand; PAM type: YTN; PAM sequence: TTT
taattatttatttatttatt

SEQ ID NO: 246491 - DNA, 20 bp, Artificial Sequence
  Description of Artificial Sequence: Synthetic oligonucleotide
  Target: ATXN1; (+) strand; PAM type: YTN; PAM sequence: TTT
aattatttatttatttattt

SEQ ID NO: 246492 - DNA, 20 bp, Artificial Sequence
  Description of Artificial Sequence: Synthetic oligonucleotide
  Target: ATXN1; (+) strand; PAM type: YTN; PAM sequence: TTA
attatttatttatttattta

SEQ ID NO: 246493 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttatttt

SEQ ID NO: 246494 - DNA, 20 bp, Artificial Sequence
  Description of Artificial Sequence: Synthetic oligonucleotide
  Target: ATXN1; (+) strand; PAM type: YTN; PAM sequence: TTT
atttatttatttattttgag

SEQ ID NO: 246495 - DNA, 20 bp, Artificial Sequence
  Description of Artificial Sequence: Synthetic oligonucleotide
  Target: ATXN1; (+) strand; PAM type: YTN; PAM sequence: TTA
tttatttatttattttgaga

SEQ ID NO: 246496 - DNA, 20 bp, Artificial Sequence
  Description of Artificial Sequence: Synthetic oligonucleotide
  Target: ATXN1; (+) strand; PAM type: YTN; PAM sequence: TTT
atttatttattttgagacag

SEQ ID NO: 246497 - DNA, 20 bp, Artificial Sequence
  Description of Artificial Sequence: Synthetic oligonucleotide
  Target: ATXN1; (+) strand; PAM type: YTN; PAM sequence: TTA
tttatttattttgagacagt

SEQ ID NO: 246498 - DNA, 20 bp, Artificial Sequence
  Description of Artificial Sequence: Synthetic oligonucleotide
  Target: ATXN1; (+) strand; PAM type: YTN; PAM sequence: TTT
atttattttgagacagtagc

SEQ ID NO: 246499 - DNA, 20 bp, Artificial Sequence
  Description of Artificial Sequence: Synthetic oligonucleotide
  Target: ATXN1; (+) strand; PAM type: YTN; PAM sequence: TTA
tttattttgagacagtagcc

SEQ ID NO: 246500 - DNA, 20 bp, Artificial Sequence
  Description of Artificial Sequence: Synthetic oligonucleotide
  Target: ATXN1; (+) strand; PAM type: YTN; PAM sequence: TTT
attttgagacagtagccaga

SEQ ID NO: 246501 - DNA, 20 bp, Artificial Sequence
  Description of Artificial Sequence: Synthetic oligonucleotide
  Target: ATXN1; (+) strand; PAM type: YTN; PAM sequence: TTA
ttttgagacagtagccagag

SEQ ID NO: 246502 - DNA, 20 bp, Artificial Sequence
  Description of Artificial Sequence: Synthetic oligonucleotide
  Target: ATXN1; (+) strand; PAM type: YTN; PAM sequence: TTT
tgagacagtagccagagctg

SEQ ID NO: 246503 - DNA, 20 bp, Artificial Sequence
  Description of Artificial Sequence: Synthetic oligonucleotide
  Target: ATXN1; (+) strand; PAM type: YTN; PAM sequence: TTT
gagacagtagccagagctgg

SEQ ID NO: 246504 - DNA, 20 bp, Artificial Sequence
  Description of Artificial Sequence: Synthetic oligonucleotide
  Target: ATXN1; (+) strand; PAM type: YTN; PAM sequence: TTG
agacagtagccagagctgga

SEQ ID NO: 246505 - DNA, 20 bp, Artificial Sequence
  Description of Artificial Sequence: Synthetic oligonucleotide
  Target: ATXN1; (+) strand; PAM type: YTN; PAM sequence: CTG
gagcgcagtcacgtgatccc

SEQ ID NO: 246506 - DNA, 20 bp, Artificial Sequence
  Description of Artificial Sequence: Synthetic oligonucleotide
  Target: ATXN1; (+) strand; PAM type: YTN; PAM sequence: CTC
actgcaacctccgcctcctg

SEQ ID NO: 246507 - DNA, 20 bp, Artificial Sequence
  Description of Artificial Sequence: Synthetic oligonucleotide
  Target: ATXN1; (+) strand; PAM type: YTN; PAM sequence: CTG
caacctccgcctcctgggtt

SEQ ID NO: 246508 - DNA, 20 bp, Artificial Sequence
  Description of Artificial Sequence: Synthetic oligonucleotide
  Target: ATXN1; (+) strand; PAM type: YTN; PAM sequence: CTC
cgcctcctgggttcaagcga

SEQ ID NO: 246509 - DNA, 20 bp, Artificial Sequence
  Description of Artificial Sequence: Synthetic oligonucleotide
  Target: ATXN1; (+) strand; PAM type: YTN; PAM sequence: CTC
ctgggttcaagcgattctca

SEQ ID NO: 246510 - DNA, 20 bp, Artificial Sequence
  Description of Artificial Sequence: Synthetic oligonucleotide
  Target: ATXN1; (+) strand; PAM type: YTN; PAM sequence: CTG
ggttcaagcgattctcatgc

SEQ ID NO: 246511 - DNA, 20 bp, Artificial Sequence
  Description of Artificial Sequence: Synthetic oligonucleotide
  Target: ATXN1; (+) strand; PAM type: YTN; PAM sequence: TTC
aagcgattctcatgcctcag

SEQ ID NO: 246512 - DNA, 20 bp, Artificial Sequence
  Description of Artificial Sequence: Synthetic oligonucleotide
  Target: ATXN1; (+) strand; PAM type: YTN; PAM sequence: TTC
tcatgcctcagcctcctgag

SEQ ID NO: 246513 - DNA, 20 bp, Artificial Sequence
  Description of Artificial Sequence: Synthetic oligonucleotide
  Target: ATXN1; (+) strand; PAM type: YTN; PAM sequence: CTC
atgcctcagcctcctgagta

SEQ ID NO: 246514 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagtagctggga

SEQ ID NO: 246515 - DNA, 20 bp, Artificial Sequence
  Description of Artificial Sequence: Synthetic oligonucleotide
  Target: ATXN1; (+) strand; PAM type: YTN; PAM sequence: CTC
ctgagtagctgggattacag

SEQ ID NO: 246516 - DNA, 20 bp, Artificial Sequence
  Description of Artificial Sequence: Synthetic oligonucleotide
  Target: ATXN1; (+) strand; PAM type: YTN; PAM sequence: CTG
agtagctgggattacaggcg

SEQ ID NO: 246517 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgcctgccac

SEQ ID NO: 246518 - DNA, 20 bp, Artificial Sequence
  Description of Artificial Sequence: Synthetic oligonucleotide
  Target: ATXN1; (+) strand; PAM type: YTN; PAM sequence: TTA
caggcgcctgccaccatgcc

SEQ ID NO: 246519 - DNA, 20 bp, Artificial Sequence
  Description of Artificial Sequence: Synthetic oligonucleotide
  Target: ATXN1; (+) strand; PAM type: YTN; PAM sequence: CTG
ccaccatgcctggctagttt

SEQ ID NO: 246520 - DNA, 20 bp, Artificial Sequence
  Description of Artificial Sequence: Synthetic oligonucleotide
  Target: ATXN1; (+) strand; PAM type: YTN; PAM sequence: CTG
gctagtttttgtactttttt

SEQ ID NO: 246521 - DNA, 20 bp, Artificial Sequence
  Description of Artificial Sequence: Synthetic oligonucleotide
  Target: ATXN1; (+) strand; PAM type: YTN; PAM sequence: CTA
gtttttgtacttttttcaga

SEQ ID NO: 246522 - DNA, 20 bp, Artificial Sequence
  Description of Artificial Sequence: Synthetic oligonucleotide
  Target: ATXN1; (+) strand; PAM type: YTN; PAM sequence: TTT
ttgtacttttttcagacagg

SEQ ID NO: 246523 - DNA, 20 bp, Artificial Sequence
  Description of Artificial Sequence: Synthetic oligonucleotide
  Target: ATXN1; (+) strand; PAM type: YTN; PAM sequence: TTT
tgtacttttttcagacaggg

SEQ ID NO: 246524 - DNA, 20 bp, Artificial Sequence
  Description of Artificial Sequence: Synthetic oligonucleotide
  Target: ATXN1; (+) strand; PAM type: YTN; PAM sequence: TTT
gtacttttttcagacagggt

SEQ ID NO: 246525 - DNA, 20 bp, Artificial Sequence
  Description of Artificial Sequence: Synthetic oligonucleotide
  Target: ATXN1; (+) strand; PAM type: YTN; PAM sequence: TTG
tacttttttcagacagggtt

SEQ ID NO: 246526 - DNA, 20 bp, Artificial Sequence
  Description of Artificial Sequence: Synthetic oligonucleotide
  Target: ATXN1; (+) strand; PAM type: YTN; PAM sequence: CTT
ttttcagacagggttatatc

SEQ ID NO: 246527 - DNA, 20 bp, Artificial Sequence
  Description of Artificial Sequence: Synthetic oligonucleotide
  Target: ATXN1; (+) strand; PAM type: YTN; PAM sequence: TTT
tttcagacagggttatatca

SEQ ID NO: 246528 - DNA, 20 bp, Artificial Sequence
  Description of Artificial Sequence: Synthetic oligonucleotide
  Target: ATXN1; (+) strand; PAM type: YTN; PAM sequence: TTT
ttcagacagggttatatcat

SEQ ID NO: 246529 - DNA, 20 bp, Artificial Sequence
  Description of Artificial Sequence: Synthetic oligonucleotide
  Target: ATXN1; (+) strand; PAM type: YTN; PAM sequence: TTT
tcagacagggttatatcatg

SEQ ID NO: 246530 - DNA, 20 bp, Artificial Sequence
  Description of Artificial Sequence: Synthetic oligonucleotide
  Target: ATXN1; (+) strand; PAM type: YTN; PAM sequence: TTT
cagacagggttatatcatgt

SEQ ID NO: 246531 - DNA, 20 bp, Artificial Sequence
  Description of Artificial Sequence: Synthetic oligonucleotide
  Target: ATXN1; (+) strand; PAM type: YTN; PAM sequence: TTC
agacagggttatatcatgtt

SEQ ID NO: 246532 - DNA, 20 bp, Artificial Sequence
  Description of Artificial Sequence: Synthetic oligonucleotide
  Target: ATXN1; (+) strand; PAM type: YTN; PAM sequence: TTA
tatcatgttggccaggctgg

SEQ ID NO: 246533 - DNA, 20 bp, Artificial Sequence
  Description of Artificial Sequence: Synthetic oligonucleotide
  Target: ATXN1; (+) strand; PAM type: YTN; PAM sequence: TTG
gccaggctggtctcaaactc

SEQ ID NO: 246534 - DNA, 20 bp, Artificial Sequence
  Description of Artificial Sequence: Synthetic oligonucleotide
  Target: ATXN1; (+) strand; PAM type: YTN; PAM sequence: CTG
gtctcaaactcctgacctca

SEQ ID NO: 246535 - DNA, 20 bp, Artificial Sequence
  Description of Artificial Sequence: Synthetic oligonucleotide
  Target: ATXN1; (+) strand; PAM type: YTN; PAM sequence: CTC
aaactcctgacctcaggtga

SEQ ID NO: 246536 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggtgatccgcc

SEQ ID NO: 246537 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatccgcccat

SEQ ID NO: 246538 - DNA, 20 bp, Artificial Sequence
  Description of Artificial Sequence: Synthetic oligonucleotide
  Target: ATXN1; (+) strand; PAM type: YTN; PAM sequence: CTC
aggtgatccgcccatctcgg

SEQ ID NO: 246539 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaagtgggagtg

SEQ ID NO: 246540 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgggagtgagccac

SEQ ID NO: 246541 - DNA, 20 bp, Artificial Sequence
  Description of Artificial Sequence: Synthetic oligonucleotide
  Target: ATXN1; (+) strand; PAM type: YTN; PAM sequence: CTT
gggattacagccctgagcca

SEQ ID NO: 246542 - DNA, 20 bp, Artificial Sequence
  Description of Artificial Sequence: Synthetic oligonucleotide
  Target: ATXN1; (+) strand; PAM type: YTN; PAM sequence: TTG
ggattacagccctgagccac

SEQ ID NO: 246543 - DNA, 20 bp, Artificial Sequence
  Description of Artificial Sequence: Synthetic oligonucleotide
  Target: ATXN1; (+) strand; PAM type: YTN; PAM sequence: TTA
cagccctgagccaccacgct

SEQ ID NO: 246544 - DNA, 20 bp, Artificial Sequence
  Description of Artificial Sequence: Synthetic oligonucleotide
  Target: ATXN1; (+) strand; PAM type: YTN; PAM sequence: CTG
agccaccacgctcagcctat

SEQ ID NO: 246545 - DNA, 20 bp, Artificial Sequence
  Description of Artificial Sequence: Synthetic oligonucleotide
  Target: ATXN1; (+) strand; PAM type: YTN; PAM sequence: CTC
agcctatttaatttattttt

SEQ ID NO: 246546 - DNA, 20 bp, Artificial Sequence
  Description of Artificial Sequence: Synthetic oligonucleotide
  Target: ATXN1; (+) strand; PAM type: YTN; PAM sequence: CTA
tttaatttatttttaaattt

SEQ ID NO: 246547 - DNA, 20 bp, Artificial Sequence
  Description of Artificial Sequence: Synthetic oligonucleotide
  Target: ATXN1; (+) strand; PAM type: YTN; PAM sequence: TTT
aatttatttttaaatttagg

SEQ ID NO: 246548 - DNA, 20 bp, Artificial Sequence
  Description of Artificial Sequence: Synthetic oligonucleotide
  Target: ATXN1; (+) strand; PAM type: YTN; PAM sequence: TTA
atttatttttaaatttaggg

SEQ ID NO: 246549 - DNA, 20 bp, Artificial Sequence
  Description of Artificial Sequence: Synthetic oligonucleotide
  Target: ATXN1; (+) strand; PAM type: YTN; PAM sequence: TTT
atttttaaatttaggggctg

SEQ ID NO: 246550 - DNA, 20 bp, Artificial Sequence
  Description of Artificial Sequence: Synthetic oligonucleotide
  Target: ATXN1; (+) strand; PAM type: YTN; PAM sequence: TTA
tttttaaatttaggggctgg

SEQ ID NO: 246551 - DNA, 20 bp, Artificial Sequence
  Description of Artificial Sequence: Synthetic oligonucleotide
  Target: ATXN1; (+) strand; PAM type: YTN; PAM sequence: TTT
ttaaatttaggggctgggaa

SEQ ID NO: 246552 - DNA, 20 bp, Artificial Sequence
  Description of Artificial Sequence: Synthetic oligonucleotide
  Target: ATXN1; (+) strand; PAM type: YTN; PAM sequence: TTT
taaatttaggggctgggaag

SEQ ID NO: 246553 - DNA, 20 bp, Artificial Sequence
  Description of Artificial Sequence: Synthetic oligonucleotide
  Target: ATXN1; (+) strand; PAM type: YTN; PAM sequence: TTT
aaatttaggggctgggaaga

SEQ ID NO: 246554 - DNA, 20 bp, Artificial Sequence
  Description of Artificial Sequence: Synthetic oligonucleotide
  Target: ATXN1; (+) strand; PAM type: YTN; PAM sequence: TTA
aatttaggggctgggaagat

SEQ ID NO: 246555 - DNA, 20 bp, Artificial Sequence
  Description of Artificial Sequence: Synthetic oligonucleotide
  Target: ATXN1; (+) strand; PAM type: YTN; PAM sequence: TTT
aggggctgggaagatgggaa

SEQ ID NO: 246556 - DNA, 20 bp, Artificial Sequence
  Description of Artificial Sequence: Synthetic oligonucleotide
  Target: ATXN1; (+) strand; PAM type: YTN; PAM sequence: TTA
ggggctgggaagatgggaat

SEQ ID NO: 246557 - DNA, 20 bp, Artificial Sequence
  Description of Artificial Sequence: Synthetic oligonucleotide
  Target: ATXN1; (+) strand; PAM type: YTN; PAM sequence: CTG
ggaagatgggaatcctcctc

SEQ ID NO: 246558 - DNA, 20 bp, Artificial Sequence
  Description of Artificial Sequence: Synthetic oligonucleotide
  Target: ATXN1; (+) strand; PAM type: YTN; PAM sequence: CTC
ctctatgcagtaatccttgg

SEQ ID NO: 246559 - DNA, 20 bp, Artificial Sequence
  Description of Artificial Sequence: Synthetic oligonucleotide
  Target: ATXN1; (+) strand; PAM type: YTN; PAM sequence: CTC
tatgcagtaatccttggaca

SEQ ID NO: 246560 - DNA, 20 bp, Artificial Sequence
  Description of Artificial Sequence: Synthetic oligonucleotide
  Target: ATXN1; (+) strand; PAM type: YTN; PAM sequence: CTA
tgcagtaatccttggacatg

SEQ ID NO: 246561 - DNA, 20 bp, Artificial Sequence
  Description of Artificial Sequence: Synthetic oligonucleotide
  Target: ATXN1; (+) strand; PAM type: YTN; PAM sequence: CTT
ggacatgcagtggaagagag

SEQ ID NO: 246562 - DNA, 20 bp, Artificial Sequence
  Description of Artificial Sequence: Synthetic oligonucleotide
  Target: ATXN1; (+) strand; PAM type: YTN; PAM sequence: TTG
gacatgcagtggaagagagg

SEQ ID NO: 246563 - DNA, 20 bp, Artificial Sequence
  Description of Artificial Sequence: Synthetic oligonucleotide
  Target: ATXN1; (+) strand; PAM type: YTN; PAM sequence: TTA
tagtgagcagctgctggtca

SEQ ID NO: 246564 - DNA, 20 bp, Artificial Sequence
  Description of Artificial Sequence: Synthetic oligonucleotide
  Target: ATXN1; (+) strand; PAM type: YTN; PAM sequence: CTG
ctggtcacagactaaagaga

SEQ ID NO: 246565 - DNA, 20 bp, Artificial Sequence
  Description of Artificial Sequence: Synthetic oligonucleotide
  Target: ATXN1; (+) strand; PAM type: YTN; PAM sequence: CTG
gtcacagactaaagagaaga

SEQ ID NO: 246566 - DNA, 20 bp, Artificial Sequence
  Description of Artificial Sequence: Synthetic oligonucleotide
  Target: ATXN1; (+) strand; PAM type: YTN; PAM sequence: CTA
aagagaagaaacaccttgct

SEQ ID NO: 246567 - DNA, 20 bp, Artificial Sequence
  Description of Artificial Sequence: Synthetic oligonucleotide
  Target: ATXN1; (+) strand; PAM type: YTN; PAM sequence: CTT
gctccctctttgcatttaga

SEQ ID NO: 246568 - DNA, 20 bp, Artificial Sequence
  Description of Artificial Sequence: Synthetic oligonucleotide
  Target: ATXN1; (+) strand; PAM type: YTN; PAM sequence: TTG
ctccctctttgcatttagaa

SEQ ID NO: 246569 - DNA, 20 bp, Artificial Sequence
  Description of Artificial Sequence: Synthetic oligonucleotide
  Target: ATXN1; (+) strand; PAM type: YTN; PAM sequence: CTC
cctctttgcatttagaagca

SEQ ID NO: 246570 - DNA, 20 bp, Artificial Sequence
  Description of Artificial Sequence: Synthetic oligonucleotide
  Target: ATXN1; (+) strand; PAM type: YTN; PAM sequence: CTC
tttgcatttagaagcattaa

SEQ ID NO: 246571 - DNA, 20 bp, Artificial Sequence
  Description of Artificial Sequence: Synthetic oligonucleotide
  Target: ATXN1; (+) strand; PAM type: YTN; PAM sequence: CTT
tgcatttagaagcattaaca

SEQ ID NO: 246572 - DNA, 20 bp, Artificial Sequence
  Description of Artificial Sequence: Synthetic oligonucleotide
  Target: ATXN1; (+) strand; PAM type: YTN; PAM sequence: TTT
gcatttagaagcattaacac

SEQ ID NO: 246573 - DNA, 20 bp, Artificial Sequence
  Description of Artificial Sequence: Synthetic oligonucleotide
  Target: ATXN1; (+) strand; PAM type: YTN; PAM sequence: TTG
catttagaagcattaacact

SEQ ID NO: 246574 - DNA, 20 bp, Artificial Sequence
  Description of Artificial Sequence: Synthetic oligonucleotide
  Target: ATXN1; (+) strand; PAM type: YTN; PAM sequence: TTT
agaagcattaacacttgata

SEQ ID NO: 246575 - DNA, 20 bp, Artificial Sequence
  Description of Artificial Sequence: Synthetic oligonucleotide
  Target: ATXN1; (+) strand; PAM type: YTN; PAM sequence: TTA
gaagcattaacacttgataa

SEQ ID NO: 246576 - DNA, 20 bp, Artificial Sequence
  Description of Artificial Sequence: Synthetic oligonucleotide
  Target: ATXN1; (+) strand; PAM type: YTN; PAM sequence: TTA
acacttgataatatcgttct

SEQ ID NO: 246577 - DNA, 20 bp, Artificial Sequence
  Description of Artificial Sequence: Synthetic oligonucleotide
  Target: ATXN1; (+) strand; PAM type: YTN; PAM sequence: CTT
gataatatcgttctgactcc

SEQ ID NO: 246578 - DNA, 20 bp, Artificial Sequence
  Description of Artificial Sequence: Synthetic oligonucleotide
  Target: ATXN1; (+) strand; PAM type: YTN; PAM sequence: TTG
ataatatcgttctgactcct

SEQ ID NO: 246579 - DNA, 20 bp, Artificial Sequence
  Description of Artificial Sequence: Synthetic oligonucleotide
  Target: ATXN1; (+) strand; PAM type: YTN; PAM sequence: TTC
tgactcctgagcaggaagca

SEQ ID NO: 246580 - DNA, 20 bp, Artificial Sequence
  Description of Artificial Sequence: Synthetic oligonucleotide
  Target: ATXN1; (+) strand; PAM type: YTN; PAM sequence: CTG
actcctgagcaggaagcaca

SEQ ID NO: 246581 - DNA, 20 bp, Artificial Sequence
  Description of Artificial Sequence: Synthetic oligonucleotide
  Target: ATXN1; (+) strand; PAM type: YTN; PAM sequence: CTC
ctgagcaggaagcacatagt

SEQ ID NO: 246582 - DNA, 20 bp, Artificial Sequence
  Description of Artificial Sequence: Synthetic oligonucleotide
  Target: ATXN1; (+) strand; PAM type: YTN; PAM sequence: CTG
agcaggaagcacatagttga

SEQ ID NO: 246583 - DNA, 20 bp, Artificial Sequence
  Description of Artificial Sequence: Synthetic oligonucleotide
  Target: ATXN1; (+) strand; PAM type: YTN; PAM sequence: TTG
attcagtgtcatgttagacc

SEQ ID NO: 246584 - DNA, 20 bp, Artificial Sequence
  Description of Artificial Sequence: Synthetic oligonucleotide
  Target: ATXN1; (+) strand; PAM type: YTN; PAM sequence: TTC
agtgtcatgttagaccgggc

SEQ ID NO: 246585 - DNA, 20 bp, Artificial Sequence
  Description of Artificial Sequence: Synthetic oligonucleotide
  Target: ATXN1; (+) strand; PAM type: YTN; PAM sequence: TTA
gaccgggctaactggcattt

SEQ ID NO: 246586 - DNA, 20 bp, Artificial Sequence
  Description of Artificial Sequence: Synthetic oligonucleotide
  Target: ATXN1; (+) strand; PAM type: YTN; PAM sequence: CTA
actggcatttgataactcgt

SEQ ID NO: 246587 - DNA, 20 bp, Artificial Sequence
  Description of Artificial Sequence: Synthetic oligonucleotide
  Target: ATXN1; (+) strand; PAM type: YTN; PAM sequence: CTG
gcatttgataactcgtgact

SEQ ID NO: 246588 - DNA, 20 bp, Artificial Sequence
  Description of Artificial Sequence: Synthetic oligonucleotide
  Target: ATXN1; (+) strand; PAM type: YTN; PAM sequence: TTT
gataactcgtgactttagga

SEQ ID NO: 246589 - DNA, 20 bp, Artificial Sequence
  Description of Artificial Sequence: Synthetic oligonucleotide
  Target: ATXN1; (+) strand; PAM type: YTN; PAM sequence: TTG
ataactcgtgactttaggaa

SEQ ID NO: 246590 - DNA, 20 bp, Artificial Sequence
  Description of Artificial Sequence: Synthetic oligonucleotide
  Target: ATXN1; (+) strand; PAM type: YTN; PAM sequence: CTC
gtgactttaggaaagtcttt

SEQ ID NO: 246591 - DNA, 20 bp, Artificial Sequence
  Description of Artificial Sequence: Synthetic oligonucleotide
  Target: ATXN1; (+) strand; PAM type: YTN; PAM sequence: CTT
taggaaagtctttcaatttt

SEQ ID NO: 246592 - DNA, 20 bp, Artificial Sequence
  Description of Artificial Sequence: Synthetic oligonucleotide
  Target: ATXN1; (+) strand; PAM type: YTN; PAM sequence: TTT
aggaaagtctttcaattttc

SEQ ID NO: 246593 - DNA, 20 bp, Artificial Sequence
  Description of Artificial Sequence: Synthetic oligonucleotide
  Target: ATXN1; (+) strand; PAM type: YTN; PAM sequence: TTA
ggaaagtctttcaattttct

SEQ ID NO: 246594 - DNA, 20 bp, Artificial Sequence
  Description of Artificial Sequence: Synthetic oligonucleotide
  Target: ATXN1; (+) strand; PAM type: YTN; PAM sequence: CTT
tcaattttctctccctcttt

SEQ ID NO: 246595 - DNA, 20 bp, Artificial Sequence
  Description of Artificial Sequence: Synthetic oligonucleotide
  Target: ATXN1; (+) strand; PAM type: YTN; PAM sequence: TTT
caattttctctccctctttt

SEQ ID NO: 246596 - DNA, 20 bp, Artificial Sequence
  Description of Artificial Sequence: Synthetic oligonucleotide
  Target: ATXN1; (+) strand; PAM type: YTN; PAM sequence: TTC
aattttctctccctcttttt

SEQ ID NO: 246597 - DNA, 20 bp, Artificial Sequence
  Description of Artificial Sequence: Synthetic oligonucleotide
  Target: ATXN1; (+) strand; PAM type: YTN; PAM sequence: TTT
tctctccctcttttttgtcg

SEQ ID NO: 246598 - DNA, 20 bp, Artificial Sequence
  Description of Artificial Sequence: Synthetic oligonucleotide
  Target: ATXN1; (+) strand; PAM type: YTN; PAM sequence: TTT
ctctccctcttttttgtcgc

SEQ ID NO: 246599 - DNA, 20 bp, Artificial Sequence
  Description of Artificial Sequence: Synthetic oligonucleotide
  Target: ATXN1; (+) strand; PAM type: YTN; PAM sequence: TTC
tctccctcttttttgtcgcc

SEQ ID NO: 246600 - DNA, 20 bp, Artificial Sequence
  Description of Artificial Sequence: Synthetic oligonucleotide
  Target: ATXN1; (+) strand; PAM type: YTN; PAM sequence: CTC
tccctcttttttgtcgccgg

SEQ ID NO: 246601 - DNA, 20 bp, Artificial Sequence
  Description of Artificial Sequence: Synthetic oligonucleotide
  Target: ATXN1; (+) strand; PAM type: YTN; PAM sequence: CTC
cctcttttttgtcgccgggt

SEQ ID NO: 246602 - DNA, 20 bp, Artificial Sequence
  Description of Artificial Sequence: Synthetic oligonucleotide
  Target: ATXN1; (+) strand; PAM type: YTN; PAM sequence: CTC
ttttttgtcgccgggtctca

SEQ ID NO: 246603 - DNA, 20 bp, Artificial Sequence
  Description of Artificial Sequence: Synthetic oligonucleotide
  Target: ATXN1; (+) strand; PAM type: YTN; PAM sequence: CTT
ttttgtcgccgggtctcact

SEQ ID NO: 246604 - DNA, 20 bp, Artificial Sequence
  Description of Artificial Sequence: Synthetic oligonucleotide
  Target: ATXN1; (+) strand; PAM type: YTN; PAM sequence: TTT
tttgtcgccgggtctcactc

SEQ ID NO: 246605 - DNA, 20 bp, Artificial Sequence
  Description of Artificial Sequence: Synthetic oligonucleotide
  Target: ATXN1; (+) strand; PAM type: YTN; PAM sequence: TTT
ttgtcgccgggtctcactct

SEQ ID NO: 246606 - DNA, 20 bp, Artificial Sequence
  Description of Artificial Sequence: Synthetic oligonucleotide
  Target: ATXN1; (+) strand; PAM type: YTN; PAM sequence: TTT
tgtcgccgggtctcactctg

SEQ ID NO: 246607 - DNA, 20 bp, Artificial Sequence
  Description of Artificial Sequence: Synthetic oligonucleotide
  Target: ATXN1; (+) strand; PAM type: YTN; PAM sequence: TTT
gtcgccgggtctcactctgt

SEQ ID NO: 246608 - DNA, 20 bp, Artificial Sequence
  Description of Artificial Sequence: Synthetic oligonucleotide
  Target: ATXN1; (+) strand; PAM type: YTN; PAM sequence: TTG
tcgccgggtctcactctgtc

SEQ ID NO: 246609 - DNA, 20 bp, Artificial Sequence
  Description of Artificial Sequence: Synthetic oligonucleotide
  Target: ATXN1; (+) strand; PAM type: YTN; PAM sequence: CTC
actctgtcacccaggctgga

SEQ ID NO: 246610 - DNA, 20 bp, Artificial Sequence
  Description of Artificial Sequence: Synthetic oligonucleotide
  Target: ATXN1; (+) strand; PAM type: YTN; PAM sequence: CTC
tgtcacccaggctggagtgt

SEQ ID NO: 246611 - DNA, 20 bp, Artificial Sequence
  Description of Artificial Sequence: Synthetic oligonucleotide
  Target: ATXN1; (+) strand; PAM type: YTN; PAM sequence: CTG
tcacccaggctggagtgtag

SEQ ID NO: 246612 - DNA, 20 bp, Artificial Sequence
  Description of Artificial Sequence: Synthetic oligonucleotide
  Target: ATXN1; (+) strand; PAM type: YTN; PAM sequence: CTG
gagtgtagtgagaggtgaca

SEQ ID NO: 246613 - DNA, 20 bp, Artificial Sequence
  Description of Artificial Sequence: Synthetic oligonucleotide
  Target: ATXN1; (+) strand; PAM type: YTN; PAM sequence: CTG
gcagccctcacagccctcac

SEQ ID NO: 246614 - DNA, 20 bp, Artificial Sequence
  Description of Artificial Sequence: Synthetic oligonucleotide
  Target: ATXN1; (+) strand; PAM type: YTN; PAM sequence: CTC
acagccctcacttgctctct

SEQ ID NO: 246615 - DNA, 20 bp, Artificial Sequence
  Description of Artificial Sequence: Synthetic oligonucleotide
  Target: ATXN1; (+) strand; PAM type: YTN; PAM sequence: CTC
acttgctctctgcgcctcct

SEQ ID NO: 246616 - DNA, 20 bp, Artificial Sequence
  Description of Artificial Sequence: Synthetic oligonucleotide
  Target: ATXN1; (+) strand; PAM type: YTN; PAM sequence: CTT
gctctctgcgcctcctctgc

SEQ ID NO: 246617 - DNA, 20 bp, Artificial Sequence
  Description of Artificial Sequence: Synthetic oligonucleotide
  Target: ATXN1; (+) strand; PAM type: YTN; PAM sequence: TTG
ctctctgcgcctcctctgcc

SEQ ID NO: 246618 - DNA, 20 bp, Artificial Sequence
  Description of Artificial Sequence: Synthetic oligonucleotide
  Target: ATXN1; (+) strand; PAM type: YTN; PAM sequence: CTC
tctgcgcctcctctgcctgg

SEQ ID NO: 246619 - DNA, 20 bp, Artificial Sequence
  Description of Artificial Sequence: Synthetic oligonucleotide
  Target: ATXN1; (+) strand; PAM type: YTN; PAM sequence: CTC
tgcgcctcctctgcctgggc

SEQ ID NO: 246620 - DNA, 20 bp, Artificial Sequence
  Description of Artificial Sequence: Synthetic oligonucleotide
  Target: ATXN1; (+) strand; PAM type: YTN; PAM sequence: CTG
cgcctcctctgcctgggctc

SEQ ID NO: 246621 - DNA, 20 bp, Artificial Sequence
  Description of Artificial Sequence: Synthetic oligonucleotide
  Target: ATXN1; (+) strand; PAM type: YTN; PAM sequence: CTC
ctctgcctgggctcccactt

SEQ ID NO: 246622 - DNA, 20 bp, Artificial Sequence
  Description of Artificial Sequence: Synthetic oligonucleotide
  Target: ATXN1; (+) strand; PAM type: YTN; PAM sequence: CTC
tgcctgggctcccactttgg

SEQ ID NO: 246623 - DNA, 20 bp, Artificial Sequence
  Description of Artificial Sequence: Synthetic oligonucleotide
  Target: ATXN1; (+) strand; PAM type: YTN; PAM sequence: CTG
cctgggctcccactttggcg

SEQ ID NO: 246624 - DNA, 20 bp, Artificial Sequence
  Description of Artificial Sequence: Synthetic oligonucleotide
  Target: ATXN1; (+) strand; PAM type: YTN; PAM sequence: CTG
ggctcccactttggcggctc

SEQ ID NO: 246625 - DNA, 20 bp, Artificial Sequence
  Description of Artificial Sequence: Synthetic oligonucleotide
  Target: ATXN1; (+) strand; PAM type: YTN; PAM sequence: CTC
ccactttggcggctcttgag

SEQ ID NO: 246626 - DNA, 20 bp, Artificial Sequence
  Description of Artificial Sequence: Synthetic oligonucleotide
  Target: ATXN1; (+) strand; PAM type: YTN; PAM sequence: CTT
tggcggctcttgaggagccc

SEQ ID NO: 246627 - DNA, 20 bp, Artificial Sequence
  Description of Artificial Sequence: Synthetic oligonucleotide
  Target: ATXN1; (+) strand; PAM type: YTN; PAM sequence: TTT
ggcggctcttgaggagccct

SEQ ID NO: 246628 - DNA, 20 bp, Artificial Sequence
  Description of Artificial Sequence: Synthetic oligonucleotide
  Target: ATXN1; (+) strand; PAM type: YTN; PAM sequence: TTG
gcggctcttgaggagccctt

SEQ ID NO: 246629 - DNA, 20 bp, Artificial Sequence
  Description of Artificial Sequence: Synthetic oligonucleotide
  Target: ATXN1; (+) strand; PAM type: YTN; PAM sequence: CTC
ttgaggagcccttcaccccg

SEQ ID NO: 246630 - DNA, 20 bp, Artificial Sequence
  Description of Artificial Sequence: Synthetic oligonucleotide
  Target: ATXN1; (+) strand; PAM type: YTN; PAM sequence: CTT
gaggagcccttcaccccgcc

SEQ ID NO: 246631 - DNA, 20 bp, Artificial Sequence
  Description of Artificial Sequence: Synthetic oligonucleotide
  Target: ATXN1; (+) strand; PAM type: YTN; PAM sequence: TTG
aggagcccttcaccccgccg

SEQ ID NO: 246632 - DNA, 20 bp, Artificial Sequence
  Description of Artificial Sequence: Synthetic oligonucleotide
  Target: ATXN1; (+) strand; PAM type: YTN; PAM sequence: CTT
caccccgccgctgcactgtg

SEQ ID NO: 246633 - DNA, 20 bp, Artificial Sequence
  Description of Artificial Sequence: Synthetic oligonucleotide
  Target: ATXN1; (+) strand; PAM type: YTN; PAM sequence: TTC
accccgccgctgcactgtgg

SEQ ID NO: 246634 - DNA, 20 bp, Artificial Sequence
  Description of Artificial Sequence: Synthetic oligonucleotide
  Target: ATXN1; (+) strand; PAM type: YTN; PAM sequence: CTG
cactgtgggacctctttctg

SEQ ID NO: 246635 - DNA, 20 bp, Artificial Sequence
  Description of Artificial Sequence: Synthetic oligonucleotide
  Target: ATXN1; (+) strand; PAM type: YTN; PAM sequence: CTG
tgggacctctttctgggctg

SEQ ID NO: 246636 - DNA, 20 bp, Artificial Sequence
  Description of Artificial Sequence: Synthetic oligonucleotide
  Target: ATXN1; (+) strand; PAM type: YTN; PAM sequence: CTC
tttctgggctggccaaggcc

SEQ ID NO: 246637 - DNA, 20 bp, Artificial Sequence
  Description of Artificial Sequence: Synthetic oligonucleotide
  Target: ATXN1; (+) strand; PAM type: YTN; PAM sequence: CTT
tctgggctggccaaggccag

SEQ ID NO: 246638 - DNA, 20 bp, Artificial Sequence
  Description of Artificial Sequence: Synthetic oligonucleotide
  Target: ATXN1; (+) strand; PAM type: YTN; PAM sequence: TTT
ctgggctggccaaggccaga

SEQ ID NO: 246639 - DNA, 20 bp, Artificial Sequence
  Description of Artificial Sequence: Synthetic oligonucleotide
  Target: ATXN1; (+) strand; PAM type: YTN; PAM sequence: TTC
tgggctggccaaggccagag

SEQ ID NO: 246640 - DNA, 20 bp, Artificial Sequence
  Description of Artificial Sequence: Synthetic oligonucleotide
  Target: ATXN1; (+) strand; PAM type: YTN; PAM sequence: CTG
ggctggccaaggccagagcc

SEQ ID NO: 246641 - DNA, 20 bp, Artificial Sequence
  Description of Artificial Sequence: Synthetic oligonucleotide
  Target: ATXN1; (+) strand; PAM type: YTN; PAM sequence: CTG
gccaaggccagagccggctc

SEQ ID NO: 246642 - DNA, 20 bp, Artificial Sequence
  Description of Artificial Sequence: Synthetic oligonucleotide
  Target: ATXN1; (+) strand; PAM type: YTN; PAM sequence: CTC
cctcagcttgcgcggaggtg

SEQ ID NO: 246643 - DNA, 20 bp, Artificial Sequence
  Description of Artificial Sequence: Synthetic oligonucleotide
  Target: ATXN1; (+) strand; PAM type: YTN; PAM sequence: CTC
agcttgcgcggaggtgtgga

SEQ ID NO: 246644 - DNA, 20 bp, Artificial Sequence
  Description of Artificial Sequence: Synthetic oligonucleotide
  Target: ATXN1; (+) strand; PAM type: YTN; PAM sequence: CTT
gcgcggaggtgtggaaggag

SEQ ID NO: 246645 - DNA, 20 bp, Artificial Sequence
  Description of Artificial Sequence: Synthetic oligonucleotide
  Target: ATXN1; (+) strand; PAM type: YTN; PAM sequence: TTG
cgcggaggtgtggaaggaga

SEQ ID NO: 246646 - DNA, 20 bp, Artificial Sequence
  Description of Artificial Sequence: Synthetic oligonucleotide
  Target: ATXN1; (+) strand; PAM type: YTN; PAM sequence: CTG
cgcgcgttgcttgtgggcca

SEQ ID NO: 246647 - DNA, 20 bp, Artificial Sequence
  Description of Artificial Sequence: Synthetic oligonucleotide
  Target: ATXN1; (+) strand; PAM type: YTN; PAM sequence: TTG
cttgtgggccagcgcgcgtt

SEQ ID NO: 246648 - DNA, 20 bp, Artificial Sequence
  Description of Artificial Sequence: Synthetic oligonucleotide
  Target: ATXN1; (+) strand; PAM type: YTN; PAM sequence: CTT
gtgggccagcgcgcgttcca

SEQ ID NO: 246649 - DNA, 20 bp, Artificial Sequence
  Description of Artificial Sequence: Synthetic oligonucleotide
  Target: ATXN1; (+) strand; PAM type: YTN; PAM sequence: TTG
tgggccagcgcgcgttccag

SEQ ID NO: 246650 - DNA, 20 bp, Artificial Sequence
  Description of Artificial Sequence: Synthetic oligonucleotide
  Target: ATXN1; (+) strand; PAM type: YTN; PAM sequence: TTC
caggtggctgtgggctccgt

SEQ ID NO: 246651 - DNA, 20 bp, Artificial Sequence
  Description of Artificial Sequence: Synthetic oligonucleotide
  Target: ATXN1; (+) strand; PAM type: YTN; PAM sequence: CTG
tgggctccgtgggccccgca

SEQ ID NO: 246652 - DNA, 20 bp, Artificial Sequence
  Description of Artificial Sequence: Synthetic oligonucleotide
  Target: ATXN1; (+) strand; PAM type: YTN; PAM sequence: CTC
cgtgggccccgcactcggag

SEQ ID NO: 246653 - DNA, 20 bp, Artificial Sequence
  Description of Artificial Sequence: Synthetic oligonucleotide
  Target: ATXN1; (+) strand; PAM type: YTN; PAM sequence: CTC
ggagcagcggcggaccccgc

SEQ ID NO: 246654 - DNA, 20 bp, Artificial Sequence
  Description of Artificial Sequence: Synthetic oligonucleotide
  Target: ATXN1; (+) strand; PAM type: YTN; PAM sequence: CTA
gggcagtgaggggcttagca

SEQ ID NO: 246655 - DNA, 20 bp, Artificial Sequence
  Description of Artificial Sequence: Synthetic oligonucleotide
  Target: ATXN1; (+) strand; PAM type: YTN; PAM sequence: CTT
agcagttgggccagcagccg

SEQ ID NO: 246656 - DNA, 20 bp, Artificial Sequence
  Description of Artificial Sequence: Synthetic oligonucleotide
  Target: ATXN1; (+) strand; PAM type: YTN; PAM sequence: TTA
gcagttgggccagcagccgc

SEQ ID NO: 246657 - DNA, 20 bp, Artificial Sequence
  Description of Artificial Sequence: Synthetic oligonucleotide
  Target: ATXN1; (+) strand; PAM type: YTN; PAM sequence: TTG
ggccagcagccgctgtgctc

SEQ ID NO: 246658 - DNA, 20 bp, Artificial Sequence
  Description of Artificial Sequence: Synthetic oligonucleotide
  Target: ATXN1; (+) strand; PAM type: YTN; PAM sequence: CTG
tgctcaatttctcgccaggc

SEQ ID NO: 246659 - DNA, 20 bp, Artificial Sequence
  Description of Artificial Sequence: Synthetic oligonucleotide
  Target: ATXN1; (+) strand; PAM type: YTN; PAM sequence: CTC
aatttctcgccaggccttag

SEQ ID NO: 246660 - DNA, 20 bp, Artificial Sequence
  Description of Artificial Sequence: Synthetic oligonucleotide
  Target: ATXN1; (+) strand; PAM type: YTN; PAM sequence: TTT
ctcgccaggccttagctgcc

SEQ ID NO: 246661 - DNA, 20 bp, Artificial Sequence
  Description of Artificial Sequence: Synthetic oligonucleotide
  Target: ATXN1; (+) strand; PAM type: YTN; PAM sequence: TTC
tcgccaggccttagctgcct

SEQ ID NO: 246662 - DNA, 20 bp, Artificial Sequence
  Description of Artificial Sequence: Synthetic oligonucleotide
  Target: ATXN1; (+) strand; PAM type: YTN; PAM sequence: CTC
gccaggccttagctgccttc

SEQ ID NO: 246663 - DNA, 20 bp, Artificial Sequence
  Description of Artificial Sequence: Synthetic oligonucleotide
  Target: ATXN1; (+) strand; PAM type: YTN; PAM sequence: CTT
agctgccttctggcgggcag

SEQ ID NO: 246664 - DNA, 20 bp, Artificial Sequence
  Description of Artificial Sequence: Synthetic oligonucleotide
  Target: ATXN1; (+) strand; PAM type: YTN; PAM sequence: TTA
gctgccttctggcgggcagg

SEQ ID NO: 246665 - DNA, 20 bp, Artificial Sequence
  Description of Artificial Sequence: Synthetic oligonucleotide
  Target: ATXN1; (+) strand; PAM type: YTN; PAM sequence: CTG
ccttctggcgggcagggctc

SEQ ID NO: 246666 - DNA, 20 bp, Artificial Sequence
  Description of Artificial Sequence: Synthetic oligonucleotide
  Target: ATXN1; (+) strand; PAM type: YTN; PAM sequence: CTT
ctggcgggcagggctcggga

SEQ ID NO: 246667 - DNA, 20 bp, Artificial Sequence
  Description of Artificial Sequence: Synthetic oligonucleotide
  Target: ATXN1; (+) strand; PAM type: YTN; PAM sequence: TTC
tggcgggcagggctcgggac

SEQ ID NO: 246668 - DNA, 20 bp, Artificial Sequence
  Description of Artificial Sequence: Synthetic oligonucleotide
  Target: ATXN1; (+) strand; PAM type: YTN; PAM sequence: CTG
gcgggcagggctcgggacct

SEQ ID NO: 246669 - DNA, 20 bp, Artificial Sequence
  Description of Artificial Sequence: Synthetic oligonucleotide
  Target: ATXN1; (+) strand; PAM type: YTN; PAM sequence: CTC
gggacctgcagcccgccatg

SEQ ID NO: 246670 - DNA, 20 bp, Artificial Sequence
  Description of Artificial Sequence: Synthetic oligonucleotide
  Target: ATXN1; (+) strand; PAM type: YTN; PAM sequence: CTG
cagcccgccatgcctgaacc

SEQ ID NO: 246671 - DNA, 20 bp, Artificial Sequence
  Description of Artificial Sequence: Synthetic oligonucleotide
  Target: ATXN1; (+) strand; PAM type: YTN; PAM sequence: CTG
aacctccccctgcccctccg

SEQ ID NO: 246672 - DNA, 20 bp, Artificial Sequence
  Description of Artificial Sequence: Synthetic oligonucleotide
  Target: ATXN1; (+) strand; PAM type: YTN; PAM sequence: CTC
cccctgcccctccgtgggct

SEQ ID NO: 246673 - DNA, 20 bp, Artificial Sequence
  Description of Artificial Sequence: Synthetic oligonucleotide
  Target: ATXN1; (+) strand; PAM type: YTN; PAM sequence: CTG
cccctccgtgggctcctgtg

SEQ ID NO: 246674 - DNA, 20 bp, Artificial Sequence
  Description of Artificial Sequence: Synthetic oligonucleotide
  Target: ATXN1; (+) strand; PAM type: YTN; PAM sequence: CTC
cgtgggctcctgtgcagcca

SEQ ID NO: 246675 - DNA, 20 bp, Artificial Sequence
  Description of Artificial Sequence: Synthetic oligonucleotide
  Target: ATXN1; (+) strand; PAM type: YTN; PAM sequence: CTC
ctgtgcagccagagcctccc

SEQ ID NO: 246676 - DNA, 20 bp, Artificial Sequence
  Description of Artificial Sequence: Synthetic oligonucleotide
  Target: ATXN1; (+) strand; PAM type: YTN; PAM sequence: CTG
tgcagccagagcctccccga

SEQ ID NO: 246677 - DNA, 20 bp, Artificial Sequence
  Description of Artificial Sequence: Synthetic oligonucleotide
  Target: ATXN1; (+) strand; PAM type: YTN; PAM sequence: CTC
cccgacgagcgccgccccct

SEQ ID NO: 246678 - DNA, 20 bp, Artificial Sequence
  Description of Artificial Sequence: Synthetic oligonucleotide
  Target: ATXN1; (+) strand; PAM type: YTN; PAM sequence: CTG
ctccacagcgcccagtccca

SEQ ID NO: 246679 - DNA, 20 bp, Artificial Sequence
  Description of Artificial Sequence: Synthetic oligonucleotide
  Target: ATXN1; (+) strand; PAM type: YTN; PAM sequence: CTC
cacagcgcccagtcccatcg

SEQ ID NO: 246680 - DNA, 20 bp, Artificial Sequence
  Description of Artificial Sequence: Synthetic oligonucleotide
  Target: ATXN1; (+) strand; PAM type: YTN; PAM sequence: CTG
aggagtgcgggcgcacggca

SEQ ID NO: 246681 - DNA, 20 bp, Artificial Sequence
  Description of Artificial Sequence: Synthetic oligonucleotide
  Target: ATXN1; (+) strand; PAM type: YTN; PAM sequence: CTG
gcaggcagctccacctactg

SEQ ID NO: 246682 - DNA, 20 bp, Artificial Sequence
  Description of Artificial Sequence: Synthetic oligonucleotide
  Target: ATXN1; (+) strand; PAM type: YTN; PAM sequence: CTC
cacctactgcctctgtgaag

SEQ ID NO: 246683 - DNA, 20 bp, Artificial Sequence
  Description of Artificial Sequence: Synthetic oligonucleotide
  Target: ATXN1; (+) strand; PAM type: YTN; PAM sequence: CTA
ctgcctctgtgaagatccac

SEQ ID NO: 246684 - DNA, 20 bp, Artificial Sequence
  Description of Artificial Sequence: Synthetic oligonucleotide
  Target: ATXN1; (+) strand; PAM type: YTN; PAM sequence: CTG
cctctgtgaagatccactag

SEQ ID NO: 246685 - DNA, 20 bp, Artificial Sequence
  Description of Artificial Sequence: Synthetic oligonucleotide
  Target: ATXN1; (+) strand; PAM type: YTN; PAM sequence: CTC
tgtgaagatccactaggtga

SEQ ID NO: 246686 - DNA, 20 bp, Artificial Sequence
  Description of Artificial Sequence: Synthetic oligonucleotide
  Target: ATXN1; (+) strand; PAM type: YTN; PAM sequence: CTG
tgaagatccactaggtgaag

SEQ ID NO: 246687 - DNA, 20 bp, Artificial Sequence
  Description of Artificial Sequence: Synthetic oligonucleotide
  Target: ATXN1; (+) strand; PAM type: YTN; PAM sequence: CTA
ggtgaagccagctgggctcc

SEQ ID NO: 246688 - DNA, 20 bp, Artificial Sequence
  Description of Artificial Sequence: Synthetic oligonucleotide
  Target: ATXN1; (+) strand; PAM type: YTN; PAM sequence: CTG
ggctcctgagtctggtgggg

SEQ ID NO: 246689 - DNA, 20 bp, Artificial Sequence
  Description of Artificial Sequence: Synthetic oligonucleotide
  Target: ATXN1; (+) strand; PAM type: YTN; PAM sequence: CTC
ctgagtctggtggggccttg

SEQ ID NO: 246690 - DNA, 20 bp, Artificial Sequence
  Description of Artificial Sequence: Synthetic oligonucleotide
  Target: ATXN1; (+) strand; PAM type: YTN; PAM sequence: CTG
agtctggtggggccttggag

SEQ ID NO: 246691 - DNA, 20 bp, Artificial Sequence
  Description of Artificial Sequence: Synthetic oligonucleotide
  Target: ATXN1; (+) strand; PAM type: YTN; PAM sequence: CTG
gtggggccttggagaacctt

SEQ ID NO: 246692 - DNA, 20 bp, Artificial Sequence
  Description of Artificial Sequence: Synthetic oligonucleotide
  Target: ATXN1; (+) strand; PAM type: YTN; PAM sequence: CTT
ggagaacctttatgtctagc

SEQ ID NO: 246693 - DNA, 20 bp, Artificial Sequence
  Description of Artificial Sequence: Synthetic oligonucleotide
  Target: ATXN1; (+) strand; PAM type: YTN; PAM sequence: TTG
gagaacctttatgtctagct

SEQ ID NO: 246694 - DNA, 20 bp, Artificial Sequence
  Description of Artificial Sequence: Synthetic oligonucleotide
  Target: ATXN1; (+) strand; PAM type: YTN; PAM sequence: CTT
tatgtctagctaagggattt

SEQ ID NO: 246695 - DNA, 20 bp, Artificial Sequence
  Description of Artificial Sequence: Synthetic oligonucleotide
  Target: ATXN1; (+) strand; PAM type: YTN; PAM sequence: TTT
atgtctagctaagggatttt

SEQ ID NO: 246696 - DNA, 20 bp, Artificial Sequence
  Description of Artificial Sequence: Synthetic oligonucleotide
  Target: ATXN1; (+) strand; PAM type: YTN; PAM sequence: TTA
tgtctagctaagggatttta

SEQ ID NO: 246697 - DNA, 20 bp, Artificial Sequence
  Description of Artificial Sequence: Synthetic oligonucleotide
  Target: ATXN1; (+) strand; PAM type: YTN; PAM sequence: CTA
gctaagggattttaaataca

SEQ ID NO: 246698 - DNA, 20 bp, Artificial Sequence
  Description of Artificial Sequence: Synthetic oligonucleotide
  Target: ATXN1; (+) strand; PAM type: YTN; PAM sequence: CTA
agggattttaaatacaccaa

SEQ ID NO: 246699 - DNA, 20 bp, Artificial Sequence
  Description of Artificial Sequence: Synthetic oligonucleotide
  Target: ATXN1; (+) strand; PAM type: YTN; PAM sequence: TTT
taaatacaccaatcagcact

SEQ ID NO: 246700 - DNA, 20 bp, Artificial Sequence
  Description of Artificial Sequence: Synthetic oligonucleotide
  Target: ATXN1; (+) strand; PAM type: YTN; PAM sequence: TTT
aaatacaccaatcagcactc

SEQ ID NO: 246701 - DNA, 20 bp, Artificial Sequence
  Description of Artificial Sequence: Synthetic oligonucleotide
  Target: ATXN1; (+) strand; PAM type: YTN; PAM sequence: TTA
aatacaccaatcagcactct

SEQ ID NO: 246702 - DNA, 20 bp, Artificial Sequence
  Description of Artificial Sequence: Synthetic oligonucleotide
  Target: ATXN1; (+) strand; PAM type: YTN; PAM sequence: CTC
tatatctagctcaaggtttg

SEQ ID NO: 246703 - DNA, 20 bp, Artificial Sequence
  Description of Artificial Sequence: Synthetic oligonucleotide
  Target: ATXN1; (+) strand; PAM type: YTN; PAM sequence: CTA
tatctagctcaaggtttgta

SEQ ID NO: 246704 - DNA, 20 bp, Artificial Sequence
  Description of Artificial Sequence: Synthetic oligonucleotide
  Target: ATXN1; (+) strand; PAM type: YTN; PAM sequence: CTA
gctcaaggtttgtaaacaca

SEQ ID NO: 246705 - DNA, 20 bp, Artificial Sequence
  Description of Artificial Sequence: Synthetic oligonucleotide
  Target: ATXN1; (+) strand; PAM type: YTN; PAM sequence: CTC
aaggtttgtaaacacaccaa

SEQ ID NO: 246706 - DNA, 20 bp, Artificial Sequence
  Description of Artificial Sequence: Synthetic oligonucleotide
  Target: ATXN1; (+) strand; PAM type: YTN; PAM sequence: TTT
gtaaacacaccaatcagcac

SEQ ID NO: 246707 - DNA, 20 bp, Artificial Sequence
  Description of Artificial Sequence: Synthetic oligonucleotide
  Target: ATXN1; (+) strand; PAM type: YTN; PAM sequence: TTG
taaacacaccaatcagcacc

SEQ ID NO: 246708 - DNA, 20 bp, Artificial Sequence
  Description of Artificial Sequence: Synthetic oligonucleotide
  Target: ATXN1; (+) strand; PAM type: YTN; PAM sequence: CTG
tgtctagctcagggtttgtg

SEQ ID NO: 246709 - DNA, 20 bp, Artificial Sequence
  Description of Artificial Sequence: Synthetic oligonucleotide
  Target: ATXN1; (+) strand; PAM type: YTN; PAM sequence: CTA
gctcagggtttgtgaatgca

SEQ ID NO: 246710 - DNA, 20 bp, Artificial Sequence
  Description of Artificial Sequence: Synthetic oligonucleotide
  Target: ATXN1; (+) strand; PAM type: YTN; PAM sequence: CTC
agggtttgtgaatgcaccaa

SEQ ID NO: 246711 - DNA, 20 bp, Artificial Sequence
  Description of Artificial Sequence: Synthetic oligonucleotide
  Target: ATXN1; (+) strand; PAM type: YTN; PAM sequence: TTT
gtgaatgcaccaatccacac

SEQ ID NO: 246712 - DNA, 20 bp, Artificial Sequence
  Description of Artificial Sequence: Synthetic oligonucleotide
  Target: ATXN1; (+) strand; PAM type: YTN; PAM sequence: TTG
tgaatgcaccaatccacact

SEQ ID NO: 246713 - DNA, 20 bp, Artificial Sequence
  Description of Artificial Sequence: Synthetic oligonucleotide
  Target: ATXN1; (+) strand; PAM type: YTN; PAM sequence: CTC
tgtaactagctactctggtg

SEQ ID NO: 246714 - DNA, 20 bp, Artificial Sequence
  Description of Artificial Sequence: Synthetic oligonucleotide
  Target: ATXN1; (+) strand; PAM type: YTN; PAM sequence: CTG
taactagctactctggtggg

SEQ ID NO: 246715 - DNA, 20 bp, Artificial Sequence
  Description of Artificial Sequence: Synthetic oligonucleotide
  Target: ATXN1; (+) strand; PAM type: YTN; PAM sequence: CTA
gctactctggtggggacttg

SEQ ID NO: 246716 - DNA, 20 bp, Artificial Sequence
  Description of Artificial Sequence: Synthetic oligonucleotide
  Target: ATXN1; (+) strand; PAM type: YTN; PAM sequence: CTA
ctctggtggggacttggaga

SEQ ID NO: 246717 - DNA, 20 bp, Artificial Sequence
  Description of Artificial Sequence: Synthetic oligonucleotide
  Target: ATXN1; (+) strand; PAM type: YTN; PAM sequence: CTC
tggtggggacttggagaacc

SEQ ID NO: 246718 - DNA, 20 bp, Artificial Sequence
  Description of Artificial Sequence: Synthetic oligonucleotide
  Target: ATXN1; (+) strand; PAM type: YTN; PAM sequence: CTG
gtggggacttggagaacctt

SEQ ID NO: 246719 - DNA, 20 bp, Artificial Sequence
  Description of Artificial Sequence: Synthetic oligonucleotide
  Target: ATXN1; (+) strand; PAM type: YTN; PAM sequence: CTT
ggagaacctttatgtctagc

SEQ ID NO: 246720 - DNA, 20 bp, Artificial Sequence
  Description of Artificial Sequence: Synthetic oligonucleotide
  Target: ATXN1; (+) strand; PAM type: YTN; PAM sequence: TTG
gagaacctttatgtctagct

SEQ ID NO: 246721 - DNA, 20 bp, Artificial Sequence
  Description of Artificial Sequence: Synthetic oligonucleotide
  Target: ATXN1; (+) strand; PAM type: YTN; PAM sequence: CTT
tatgtctagctaagggattg

SEQ ID NO: 246722 - DNA, 20 bp, Artificial Sequence
  Description of Artificial Sequence: Synthetic oligonucleotide
  Target: ATXN1; (+) strand; PAM type: YTN; PAM sequence: TTT
atgtctagctaagggattgt

SEQ ID NO: 246723 - DNA, 20 bp, Artificial Sequence
  Description of Artificial Sequence: Synthetic oligonucleotide
  Target: ATXN1; (+) strand; PAM type: YTN; PAM sequence: TTA
tgtctagctaagggattgta

SEQ ID NO: 246724 - DNA, 20 bp, Artificial Sequence
  Description of Artificial Sequence: Synthetic oligonucleotide
  Target: ATXN1; (+) strand; PAM type: YTN; PAM sequence: CTA
gctaagggattgtaaataca

SEQ ID NO: 246725 - DNA, 20 bp, Artificial Sequence
  Description of Artificial Sequence: Synthetic oligonucleotide
  Target: ATXN1; (+) strand; PAM type: YTN; PAM sequence: CTA
agggattgtaaatacaccaa

SEQ ID NO: 246726 - DNA, 20 bp, Artificial Sequence
  Description of Artificial Sequence: Synthetic oligonucleotide
  Target: ATXN1; (+) strand; PAM type: YTN; PAM sequence: TTG
taaatacaccaatcggcact

SEQ ID NO: 246727 - DNA, 20 bp, Artificial Sequence
  Description of Artificial Sequence: Synthetic oligonucleotide
  Target: ATXN1; (+) strand; PAM type: YTN; PAM sequence: CTC
tgtatctagctcaaggtttg

SEQ ID NO: 246728 - DNA, 20 bp, Artificial Sequence
  Description of Artificial Sequence: Synthetic oligonucleotide
  Target: ATXN1; (+) strand; PAM type: YTN; PAM sequence: CTG
tatctagctcaaggtttgta

SEQ ID NO: 246729 - DNA, 20 bp, Artificial Sequence
  Description of Artificial Sequence: Synthetic oligonucleotide
  Target: ATXN1; (+) strand; PAM type: YTN; PAM sequence: CTA
gctcaaggtttgtaaacaca

SEQ ID NO: 246730 - DNA, 20 bp, Artificial Sequence
  Description of Artificial Sequence: Synthetic oligonucleotide
  Target: ATXN1; (+) strand; PAM type: YTN; PAM sequence: CTC
aaggtttgtaaacacaccaa

SEQ ID NO: 246731 - DNA, 20 bp, Artificial Sequence
  Description of Artificial Sequence: Synthetic oligonucleotide
  Target: ATXN1; (+) strand; PAM type: YTN; PAM sequence: TTT
gtaaacacaccaatcagcac

SEQ ID NO: 246732 - DNA, 20 bp, Artificial Sequence
  Description of Artificial Sequence: Synthetic oligonucleotide
  Target: ATXN1; (+) strand; PAM type: YTN; PAM sequence: TTG
taaacacaccaatcagcacc

SEQ ID NO: 246733 - DNA, 20 bp, Artificial Sequence
  Description of Artificial Sequence: Synthetic oligonucleotide
  Target: ATXN1; (+) strand; PAM type: YTN; PAM sequence: CTG
tgtctagctcagggtttgtg

SEQ ID NO: 246734 - DNA, 20 bp, Artificial Sequence
  Description of Artificial Sequence: Synthetic oligonucleotide
  Target: ATXN1; (+) strand; PAM type: YTN; PAM sequence: CTA
gctcagggtttgtgaatgca

SEQ ID NO: 246735 - DNA, 20 bp, Artificial Sequence
  Description of Artificial Sequence: Synthetic oligonucleotide
  Target: ATXN1; (+) strand; PAM type: YTN; PAM sequence: CTC
agggtttgtgaatgcaccaa

SEQ ID NO: 246736 - DNA, 20 bp, Artificial Sequence
  Description of Artificial Sequence: Synthetic oligonucleotide
  Target: ATXN1; (+) strand; PAM type: YTN; PAM sequence: TTT
gtgaatgcaccaatccacac

SEQ ID NO: 246737 - DNA, 20 bp, Artificial Sequence
  Description of Artificial Sequence: Synthetic oligonucleotide
  Target: ATXN1; (+) strand; PAM type: YTN; PAM sequence: TTG
tgaatgcaccaatccacact

SEQ ID NO: 246738 - DNA, 20 bp, Artificial Sequence
  Description of Artificial Sequence: Synthetic oligonucleotide
  Target: ATXN1; (+) strand; PAM type: YTN; PAM sequence: CTC
tgtatctagctactctggtg

SEQ ID NO: 246739 - DNA, 20 bp, Artificial Sequence
  Description of Artificial Sequence: Synthetic oligonucleotide
  Target: ATXN1; (+) strand; PAM type: YTN; PAM sequence: CTG
tatctagctactctggtggg

SEQ ID NO: 246740 - DNA, 20 bp, Artificial Sequence
  Description of Artificial Sequence: Synthetic oligonucleotide
  Target: ATXN1; (+) strand; PAM type: YTN; PAM sequence: CTA
gctactctggtggggacttg

SEQ ID NO: 246741 - DNA, 20 bp, Artificial Sequence
  Description of Artificial Sequence: Synthetic oligonucleotide
  Target: ATXN1; (+) strand; PAM type: YTN; PAM sequence: CTA
ctctggtggggacttggaga

SEQ ID NO: 246742 - DNA, 20 bp, Artificial Sequence
  Description of Artificial Sequence: Synthetic oligonucleotide
  Target: ATXN1; (+) strand; PAM type: YTN; PAM sequence: CTC
tggtggggacttggagaacc

SEQ ID NO: 246743 - DNA, 20 bp, Artificial Sequence
  Description of Artificial Sequence: Synthetic oligonucleotide
  Target: ATXN1; (+) strand; PAM type: YTN; PAM sequence: CTG
gtggggacttggagaacctt

SEQ ID NO: 246744 - DNA, 20 bp, Artificial Sequence
  Description of Artificial Sequence: Synthetic oligonucleotide
  Target: ATXN1; (+) strand; PAM type: YTN; PAM sequence: CTT
ggagaacctttgtgtcgaca

SEQ ID NO: 246745 - DNA, 20 bp, Artificial Sequence
  Description of Artificial Sequence: Synthetic oligonucleotide
  Target: ATXN1; (+) strand; PAM type: YTN; PAM sequence: TTG
gagaacctttgtgtcgacac

SEQ ID NO: 246746 - DNA, 20 bp, Artificial Sequence
  Description of Artificial Sequence: Synthetic oligonucleotide
  Target: ATXN1; (+) strand; PAM type: YTN; PAM sequence: CTT
tgtgtcgacactctttattt

SEQ ID NO: 246747 - DNA, 20 bp, Artificial Sequence
  Description of Artificial Sequence: Synthetic oligonucleotide
  Target: ATXN1; (+) strand; PAM type: YTN; PAM sequence: TTT
gtgtcgacactctttattta

SEQ ID NO: 246748 - DNA, 20 bp, Artificial Sequence
  Description of Artificial Sequence: Synthetic oligonucleotide
  Target: ATXN1; (+) strand; PAM type: YTN; PAM sequence: TTG
tgtcgacactctttatttag

SEQ ID NO: 246749 - DNA, 20 bp, Artificial Sequence
  Description of Artificial Sequence: Synthetic oligonucleotide
  Target: ATXN1; (+) strand; PAM type: YTN; PAM sequence: CTC
tttatttagctaatctagtg

SEQ ID NO: 246750 - DNA, 20 bp, Artificial Sequence
  Description of Artificial Sequence: Synthetic oligonucleotide
  Target: ATXN1; (+) strand; PAM type: YTN; PAM sequence: CTT
tatttagctaatctagtggg

SEQ ID NO: 246751 - DNA, 20 bp, Artificial Sequence
  Description of Artificial Sequence: Synthetic oligonucleotide
  Target: ATXN1; (+) strand; PAM type: YTN; PAM sequence: TTT
atttagctaatctagtgggg

SEQ ID NO: 246752 - DNA, 20 bp, Artificial Sequence
  Description of Artificial Sequence: Synthetic oligonucleotide
  Target: ATXN1; (+) strand; PAM type: YTN; PAM sequence: TTA
tttagctaatctagtggggc

SEQ ID NO: 246753 - DNA, 20 bp, Artificial Sequence
  Description of Artificial Sequence: Synthetic oligonucleotide
  Target: ATXN1; (+) strand; PAM type: YTN; PAM sequence: TTT
agctaatctagtggggccct

SEQ ID NO: 246754 - DNA, 20 bp, Artificial Sequence
  Description of Artificial Sequence: Synthetic oligonucleotide
  Target: ATXN1; (+) strand; PAM type: YTN; PAM sequence: TTA
gctaatctagtggggccctg

SEQ ID NO: 246755 - DNA, 20 bp, Artificial Sequence
  Description of Artificial Sequence: Synthetic oligonucleotide
  Target: ATXN1; (+) strand; PAM type: YTN; PAM sequence: CTA
atctagtggggccctggaga

SEQ ID NO: 246756 - DNA, 20 bp, Artificial Sequence
  Description of Artificial Sequence: Synthetic oligonucleotide
  Target: ATXN1; (+) strand; PAM type: YTN; PAM sequence: CTA
gtggggccctggagaacctt

SEQ ID NO: 246757 - DNA, 20 bp, Artificial Sequence
  Description of Artificial Sequence: Synthetic oligonucleotide
  Target: ATXN1; (+) strand; PAM type: YTN; PAM sequence: CTG
gagaacctttgtgtctagct

SEQ ID NO: 246758 - DNA, 20 bp, Artificial Sequence
  Description of Artificial Sequence: Synthetic oligonucleotide
  Target: ATXN1; (+) strand; PAM type: YTN; PAM sequence: CTT
tgtgtctagctcagggattg

SEQ ID NO: 246759 - DNA, 20 bp, Artificial Sequence
  Description of Artificial Sequence: Synthetic oligonucleotide
  Target: ATXN1; (+) strand; PAM type: YTN; PAM sequence: TTT
gtgtctagctcagggattgt

SEQ ID NO: 246760 - DNA, 20 bp, Artificial Sequence
  Description of Artificial Sequence: Synthetic oligonucleotide
  Target: ATXN1; (+) strand; PAM type: YTN; PAM sequence: TTG
tgtctagctcagggattgta

SEQ ID NO: 246761 - DNA, 20 bp, Artificial Sequence
  Description of Artificial Sequence: Synthetic oligonucleotide
  Target: ATXN1; (+) strand; PAM type: YTN; PAM sequence: CTA
gctcagggattgtaaatgca

SEQ ID NO: 246762 - DNA, 20 bp, Artificial Sequence
  Description of Artificial Sequence: Synthetic oligonucleotide
  Target: ATXN1; (+) strand; PAM type: YTN; PAM sequence: CTC
agggattgtaaatgcaccaa

SEQ ID NO: 246763 - DNA, 20 bp, Artificial Sequence
  Description of Artificial Sequence: Synthetic oligonucleotide
  Target: ATXN1; (+) strand; PAM type: YTN; PAM sequence: TTG
taaatgcaccaatcagtacc

SEQ ID NO: 246764 - DNA, 20 bp, Artificial Sequence
  Description of Artificial Sequence: Synthetic oligonucleotide
  Target: ATXN1; (+) strand; PAM type: YTN; PAM sequence: CTG
tcaaaacagaccactgggct

SEQ ID NO: 246765 - DNA, 20 bp, Artificial Sequence
  Description of Artificial Sequence: Synthetic oligonucleotide
  Target: ATXN1; (+) strand; PAM type: YTN; PAM sequence: CTG
ggctctctgtaaaatggacc

SEQ ID NO: 246766 - DNA, 20 bp, Artificial Sequence
  Description of Artificial Sequence: Synthetic oligonucleotide
  Target: ATXN1; (+) strand; PAM type: YTN; PAM sequence: CTC
tctgtaaaatggaccaatca

SEQ ID NO: 246767 - DNA, 20 bp, Artificial Sequence
  Description of Artificial Sequence: Synthetic oligonucleotide
  Target: ATXN1; (+) strand; PAM type: YTN; PAM sequence: CTC
tgtaaaatggaccaatcagc

SEQ ID NO: 246768 - DNA, 20 bp, Artificial Sequence
  Description of Artificial Sequence: Synthetic oligonucleotide
  Target: ATXN1; (+) strand; PAM type: YTN; PAM sequence: CTG
taaaatggaccaatcagcag

SEQ ID NO: 246769 - DNA, 20 bp, Artificial Sequence
  Description of Artificial Sequence: Synthetic oligonucleotide
  Target: ATXN1; (+) strand; PAM type: YTN; PAM sequence: CTG
cccgagccagcagtggtaac

SEQ ID NO: 246770 - DNA, 20 bp, Artificial Sequence
  Description of Artificial Sequence: Synthetic oligonucleotide
  Target: ATXN1; (+) strand; PAM type: YTN; PAM sequence: CTT
ctccgatccctttccacact

SEQ ID NO: 246771 - DNA, 20 bp, Artificial Sequence
  Description of Artificial Sequence: Synthetic oligonucleotide
  Target: ATXN1; (+) strand; PAM type: YTN; PAM sequence: TTC
tccgatccctttccacactg

SEQ ID NO: 246772 - DNA, 20 bp, Artificial Sequence
  Description of Artificial Sequence: Synthetic oligonucleotide
  Target: ATXN1; (+) strand; PAM type: YTN; PAM sequence: CTC
cgatccctttccacactgtg

SEQ ID NO: 246773 - DNA, 20 bp, Artificial Sequence
  Description of Artificial Sequence: Synthetic oligonucleotide
  Target: ATXN1; (+) strand; PAM type: YTN; PAM sequence: CTT
tccacactgtggaagctttg

SEQ ID NO: 246774 - DNA, 20 bp, Artificial Sequence
  Description of Artificial Sequence: Synthetic oligonucleotide
  Target: ATXN1; (+) strand; PAM type: YTN; PAM sequence: TTT
ccacactgtggaagctttgt

SEQ ID NO: 246775 - DNA, 20 bp, Artificial Sequence
  Description of Artificial Sequence: Synthetic oligonucleotide
  Target: ATXN1; (+) strand; PAM type: YTN; PAM sequence: TTC
cacactgtggaagctttgtt

SEQ ID NO: 246776 - DNA, 20 bp, Artificial Sequence
  Description of Artificial Sequence: Synthetic oligonucleotide
  Target: ATXN1; (+) strand; PAM type: YTN; PAM sequence: CTG
tggaagctttgttctttttg

SEQ ID NO: 246777 - DNA, 20 bp, Artificial Sequence
  Description of Artificial Sequence: Synthetic oligonucleotide
  Target: ATXN1; (+) strand; PAM type: YTN; PAM sequence: CTT
tgttctttttgtctttgcaa

SEQ ID NO: 246778 - DNA, 20 bp, Artificial Sequence
  Description of Artificial Sequence: Synthetic oligonucleotide
  Target: ATXN1; (+) strand; PAM type: YTN; PAM sequence: TTT
gttctttttgtctttgcaat

SEQ ID NO: 246779 - DNA, 20 bp, Artificial Sequence
  Description of Artificial Sequence: Synthetic oligonucleotide
  Target: ATXN1; (+) strand; PAM type: YTN; PAM sequence: TTG
ttctttttgtctttgcaata

SEQ ID NO: 246780 - DNA, 20 bp, Artificial Sequence
  Description of Artificial Sequence: Synthetic oligonucleotide
  Target: ATXN1; (+) strand; PAM type: YTN; PAM sequence: TTC
tttttgtctttgcaataaat

SEQ ID NO: 246781 - DNA, 20 bp, Artificial Sequence
  Description of Artificial Sequence: Synthetic oligonucleotide
  Target: ATXN1; (+) strand; PAM type: YTN; PAM sequence: CTT
tttgtctttgcaataaatct

SEQ ID NO: 246782 - DNA, 20 bp, Artificial Sequence
  Description of Artificial Sequence: Synthetic oligonucleotide
  Target: ATXN1; (+) strand; PAM type: YTN; PAM sequence: TTT
ttgtctttgcaataaatctt

SEQ ID NO: 246783 - DNA, 20 bp, Artificial Sequence
  Description of Artificial Sequence: Synthetic oligonucleotide
  Target: ATXN1; (+) strand; PAM type: YTN; PAM sequence: TTT
tgtctttgcaataaatcttg

SEQ ID NO: 246784 - DNA, 20 bp, Artificial Sequence
  Description of Artificial Sequence: Synthetic oligonucleotide
  Target: ATXN1; (+) strand; PAM type: YTN; PAM sequence: TTT
gtctttgcaataaatcttgc

SEQ ID NO: 246785 - DNA, 20 bp, Artificial Sequence
  Description of Artificial Sequence: Synthetic oligonucleotide
  Target: ATXN1; (+) strand; PAM type: YTN; PAM sequence: TTG
tctttgcaataaatcttgct

SEQ ID NO: 246786 - DNA, 20 bp, Artificial Sequence
  Description of Artificial Sequence: Synthetic oligonucleotide
  Target: ATXN1; (+) strand; PAM type: YTN; PAM sequence: CTT
tgcaataaatcttgctgctg

SEQ ID NO: 246787 - DNA, 20 bp, Artificial Sequence
  Description of Artificial Sequence: Synthetic oligonucleotide
  Target: ATXN1; (+) strand; PAM type: YTN; PAM sequence: TTT
gcaataaatcttgctgctgc

SEQ ID NO: 246788 - DNA, 20 bp, Artificial Sequence
  Description of Artificial Sequence: Synthetic oligonucleotide
  Target: ATXN1; (+) strand; PAM type: YTN; PAM sequence: TTG
caataaatcttgctgctgct

SEQ ID NO: 246789 - DNA, 20 bp, Artificial Sequence
  Description of Artificial Sequence: Synthetic oligonucleotide
  Target: ATXN1; (+) strand; PAM type: YTN; PAM sequence: CTT
gctgctgctgttcactcttt

SEQ ID NO: 246790 - DNA, 20 bp, Artificial Sequence
  Description of Artificial Sequence: Synthetic oligonucleotide
  Target: ATXN1; (+) strand; PAM type: YTN; PAM sequence: TTG
ctgctgctgttcactctttg

SEQ ID NO: 246791 - DNA, 20 bp, Artificial Sequence
  Description of Artificial Sequence: Synthetic oligonucleotide
  Target: ATXN1; (+) strand; PAM type: YTN; PAM sequence: CTG
ctgctgttcactctttggat

SEQ ID NO: 246792 - DNA, 20 bp, Artificial Sequence
  Description of Artificial Sequence: Synthetic oligonucleotide
  Target: ATXN1; (+) strand; PAM type: YTN; PAM sequence: CTG
ctgttcactctttggatcta

SEQ ID NO: 246793 - DNA, 20 bp, Artificial Sequence
  Description of Artificial Sequence: Synthetic oligonucleotide
  Target: ATXN1; (+) strand; PAM type: YTN; PAM sequence: CTG
ttcactctttggatctatac

SEQ ID NO: 246794 - DNA, 20 bp, Artificial Sequence
  Description of Artificial Sequence: Synthetic oligonucleotide
  Target: ATXN1; (+) strand; PAM type: YTN; PAM sequence: TTC
actctttggatctatactgc

SEQ ID NO: 246795 - DNA, 20 bp, Artificial Sequence
  Description of Artificial Sequence: Synthetic oligonucleotide
  Target: ATXN1; (+) strand; PAM type: YTN; PAM sequence: CTC
tttggatctatactgcctgt

SEQ ID NO: 246796 - DNA, 20 bp, Artificial Sequence
  Description of Artificial Sequence: Synthetic oligonucleotide
  Target: ATXN1; (+) strand; PAM type: YTN; PAM sequence: CTT
tggatctatactgcctgtat

SEQ ID NO: 246797 - DNA, 20 bp, Artificial Sequence
  Description of Artificial Sequence: Synthetic oligonucleotide
  Target: ATXN1; (+) strand; PAM type: YTN; PAM sequence: TTT
ggatctatactgcctgtatg

SEQ ID NO: 246798 - DNA, 20 bp, Artificial Sequence
  Description of Artificial Sequence: Synthetic oligonucleotide
  Target: ATXN1; (+) strand; PAM type: YTN; PAM sequence: TTG
gatctatactgcctgtatga

SEQ ID NO: 246799 - DNA, 20 bp, Artificial Sequence
  Description of Artificial Sequence: Synthetic oligonucleotide
  Target: ATXN1; (+) strand; PAM type: YTN; PAM sequence: CTA
tactgcctgtatgagctata

SEQ ID NO: 246800 - DNA, 20 bp, Artificial Sequence
  Description of Artificial Sequence: Synthetic oligonucleotide
  Target: ATXN1; (+) strand; PAM type: YTN; PAM sequence: CTG
cctgtatgagctataacact

SEQ ID NO: 246801 - DNA, 20 bp, Artificial Sequence
  Description of Artificial Sequence: Synthetic oligonucleotide
  Target: ATXN1; (+) strand; PAM type: YTN; PAM sequence: CTG
tatgagctataacactcacc

SEQ ID NO: 246802 - DNA, 20 bp, Artificial Sequence
  Description of Artificial Sequence: Synthetic oligonucleotide
  Target: ATXN1; (+) strand; PAM type: YTN; PAM sequence: CTA
taacactcaccggaaaggtc

SEQ ID NO: 246803 - DNA, 20 bp, Artificial Sequence
  Description of Artificial Sequence: Synthetic oligonucleotide
  Target: ATXN1; (+) strand; PAM type: YTN; PAM sequence: CTC
accggaaaggtctgcagctt

SEQ ID NO: 246804 - DNA, 20 bp, Artificial Sequence
  Description of Artificial Sequence: Synthetic oligonucleotide
  Target: ATXN1; (+) strand; PAM type: YTN; PAM sequence: CTG
cagcttcattcctgaagcca

SEQ ID NO: 246805 - DNA, 20 bp, Artificial Sequence
  Description of Artificial Sequence: Synthetic oligonucleotide
  Target: ATXN1; (+) strand; PAM type: YTN; PAM sequence: CTT
cattcctgaagccagtgaga

SEQ ID NO: 246806 - DNA, 20 bp, Artificial Sequence
  Description of Artificial Sequence: Synthetic oligonucleotide
  Target: ATXN1; (+) strand; PAM type: YTN; PAM sequence: TTC
attcctgaagccagtgagac

SEQ ID NO: 246807 - DNA, 20 bp, Artificial Sequence
  Description of Artificial Sequence: Synthetic oligonucleotide
  Target: ATXN1; (+) strand; PAM type: YTN; PAM sequence: TTC
ctgaagccagtgagaccatg

SEQ ID NO: 246808 - DNA, 20 bp, Artificial Sequence
  Description of Artificial Sequence: Synthetic oligonucleotide
  Target: ATXN1; (+) strand; PAM type: YTN; PAM sequence: CTG
aagccagtgagaccatgaac

SEQ ID NO: 246809 - DNA, 20 bp, Artificial Sequence
  Description of Artificial Sequence: Synthetic oligonucleotide
  Target: ATXN1; (+) strand; PAM type: YTN; PAM sequence: CTC
cagacatgccgctttaagaa

SEQ ID NO: 246810 - DNA, 20 bp, Artificial Sequence
  Description of Artificial Sequence: Synthetic oligonucleotide
  Target: ATXN1; (+) strand; PAM type: YTN; PAM sequence: CTT
taagaactgtaacactcacc

SEQ ID NO: 246811 - DNA, 20 bp, Artificial Sequence
  Description of Artificial Sequence: Synthetic oligonucleotide
  Target: ATXN1; (+) strand; PAM type: YTN; PAM sequence: TTT
aagaactgtaacactcaccg

SEQ ID NO: 246812 - DNA, 20 bp, Artificial Sequence
  Description of Artificial Sequence: Synthetic oligonucleotide
  Target: ATXN1; (+) strand; PAM type: YTN; PAM sequence: TTA
agaactgtaacactcaccgc

SEQ ID NO: 246813 - DNA, 20 bp, Artificial Sequence
  Description of Artificial Sequence: Synthetic oligonucleotide
  Target: ATXN1; (+) strand; PAM type: YTN; PAM sequence: CTG
taacactcaccgcaagggtc

SEQ ID NO: 246814 - DNA, 20 bp, Artificial Sequence
  Description of Artificial Sequence: Synthetic oligonucleotide
  Target: ATXN1; (+) strand; PAM type: YTN; PAM sequence: CTC
accgcaagggtccacggctt

SEQ ID NO: 246815 - DNA, 20 bp, Artificial Sequence
  Description of Artificial Sequence: Synthetic oligonucleotide
  Target: ATXN1; (+) strand; PAM type: YTN; PAM sequence: CTT
aattcttgaagtcagtgaga

SEQ ID NO: 246816 - DNA, 20 bp, Artificial Sequence
  Description of Artificial Sequence: Synthetic oligonucleotide
  Target: ATXN1; (+) strand; PAM type: YTN; PAM sequence: TTA
attcttgaagtcagtgagac

SEQ ID NO: 246817 - DNA, 20 bp, Artificial Sequence
  Description of Artificial Sequence: Synthetic oligonucleotide
  Target: ATXN1; (+) strand; PAM type: YTN; PAM sequence: TTC
ttgaagtcagtgagaccaag

SEQ ID NO: 246818 - DNA, 20 bp, Artificial Sequence
  Description of Artificial Sequence: Synthetic oligonucleotide
  Target: ATXN1; (+) strand; PAM type: YTN; PAM sequence: CTT
gaagtcagtgagaccaagaa

SEQ ID NO: 246819 - DNA, 20 bp, Artificial Sequence
  Description of Artificial Sequence: Synthetic oligonucleotide
  Target: ATXN1; (+) strand; PAM type: YTN; PAM sequence: TTG
aagtcagtgagaccaagaac

SEQ ID NO: 246820 - DNA, 20 bp, Artificial Sequence
  Description of Artificial Sequence: Synthetic oligonucleotide
  Target: ATXN1; (+) strand; PAM type: YTN; PAM sequence: CTA
attctggacacagtagcaca

SEQ ID NO: 246821 - DNA, 20 bp, Artificial Sequence
  Description of Artificial Sequence: Synthetic oligonucleotide
  Target: ATXN1; (+) strand; PAM type: YTN; PAM sequence: TTC
tggacacagtagcacaacca

SEQ ID NO: 246822 - DNA, 20 bp, Artificial Sequence
  Description of Artificial Sequence: Synthetic oligonucleotide
  Target: ATXN1; (+) strand; PAM type: YTN; PAM sequence: CTG
gacacagtagcacaaccata

SEQ ID NO: 246823 - DNA, 20 bp, Artificial Sequence
  Description of Artificial Sequence: Synthetic oligonucleotide
  Target: ATXN1; (+) strand; PAM type: YTN; PAM sequence: TTT
actgtagcctcgacctccct

SEQ ID NO: 246824 - DNA, 20 bp, Artificial Sequence
  Description of Artificial Sequence: Synthetic oligonucleotide
  Target: ATXN1; (+) strand; PAM type: YTN; PAM sequence: TTA
ctgtagcctcgacctccctg

SEQ ID NO: 246825 - DNA, 20 bp, Artificial Sequence
  Description of Artificial Sequence: Synthetic oligonucleotide
  Target: ATXN1; (+) strand; PAM type: YTN; PAM sequence: CTG
tagcctcgacctccctgtgc

SEQ ID NO: 246826 - DNA, 20 bp, Artificial Sequence
  Description of Artificial Sequence: Synthetic oligonucleotide
  Target: ATXN1; (+) strand; PAM type: YTN; PAM sequence: CTC
gacctccctgtgctcaagtg

SEQ ID NO: 246827 - DNA, 20 bp, Artificial Sequence
  Description of Artificial Sequence: Synthetic oligonucleotide
  Target: ATXN1; (+) strand; PAM type: YTN; PAM sequence: CTC
cctgtgctcaagtgatcctc

SEQ ID NO: 246828 - DNA, 20 bp, Artificial Sequence
  Description of Artificial Sequence: Synthetic oligonucleotide
  Target: ATXN1; (+) strand; PAM type: YTN; PAM sequence: CTG
tgctcaagtgatcctcagct

SEQ ID NO: 246829 - DNA, 20 bp, Artificial Sequence
  Description of Artificial Sequence: Synthetic oligonucleotide
  Target: ATXN1; (+) strand; PAM type: YTN; PAM sequence: CTC
aagtgatcctcagcttcctt

SEQ ID NO: 246830 - DNA, 20 bp, Artificial Sequence
  Description of Artificial Sequence: Synthetic oligonucleotide
  Target: ATXN1; (+) strand; PAM type: YTN; PAM sequence: CTC
agcttccttagtagctggga

SEQ ID NO: 246831 - DNA, 20 bp, Artificial Sequence
  Description of Artificial Sequence: Synthetic oligonucleotide
  Target: ATXN1; (+) strand; PAM type: YTN; PAM sequence: CTT
ccttagtagctgggattaca

SEQ ID NO: 246832 - DNA, 20 bp, Artificial Sequence
  Description of Artificial Sequence: Synthetic oligonucleotide
  Target: ATXN1; (+) strand; PAM type: YTN; PAM sequence: TTC
cttagtagctgggattacag

SEQ ID NO: 246833 - DNA, 20 bp, Artificial Sequence
  Description of Artificial Sequence: Synthetic oligonucleotide
  Target: ATXN1; (+) strand; PAM type: YTN; PAM sequence: CTT
agtagctgggattacagact

SEQ ID NO: 246834 - DNA, 20 bp, Artificial Sequence
  Description of Artificial Sequence: Synthetic oligonucleotide
  Target: ATXN1; (+) strand; PAM type: YTN; PAM sequence: TTA
gtagctgggattacagactt

SEQ ID NO: 246835 - DNA, 20 bp, Artificial Sequence
  Description of Artificial Sequence: Synthetic oligonucleotide
  Target: ATXN1; (+) strand; PAM type: YTN; PAM sequence: CTG
ggattacagacttgtgccgc

SEQ ID NO: 246836 - DNA, 20 bp, Artificial Sequence
  Description of Artificial Sequence: Synthetic oligonucleotide
  Target: ATXN1; (+) strand; PAM type: YTN; PAM sequence: TTA
cagacttgtgccgccacatc

SEQ ID NO: 246837 - DNA, 20 bp, Artificial Sequence
  Description of Artificial Sequence: Synthetic oligonucleotide
  Target: ATXN1; (+) strand; PAM type: YTN; PAM sequence: CTT
gtgccgccacatctagctac

SEQ ID NO: 246838 - DNA, 20 bp, Artificial Sequence
  Description of Artificial Sequence: Synthetic oligonucleotide
  Target: ATXN1; (+) strand; PAM type: YTN; PAM sequence: TTG
tgccgccacatctagctaca

SEQ ID NO: 246839 - DNA, 20 bp, Artificial Sequence
  Description of Artificial Sequence: Synthetic oligonucleotide
  Target: ATXN1; (+) strand; PAM type: YTN; PAM sequence: CTA
gctacattttaaactttttt

SEQ ID NO: 246840 - DNA, 20 bp, Artificial Sequence
  Description of Artificial Sequence: Synthetic oligonucleotide
  Target: ATXN1; (+) strand; PAM type: YTN; PAM sequence: CTA
cattttaaacttttttattc

SEQ ID NO: 246841 - DNA, 20 bp, Artificial Sequence
  Description of Artificial Sequence: Synthetic oligonucleotide
  Target: ATXN1; (+) strand; PAM type: YTN; PAM sequence: TTT
taaacttttttattcagata

SEQ ID NO: 246842 - DNA, 20 bp, Artificial Sequence
  Description of Artificial Sequence: Synthetic oligonucleotide
  Target: ATXN1; (+) strand; PAM type: YTN; PAM sequence: TTT
aaacttttttattcagatag

SEQ ID NO: 246843 - DNA, 20 bp, Artificial Sequence
  Description of Artificial Sequence: Synthetic oligonucleotide
  Target: ATXN1; (+) strand; PAM type: YTN; PAM sequence: TTA
aacttttttattcagatagg

SEQ ID NO: 246844 - DNA, 20 bp, Artificial Sequence
  Description of Artificial Sequence: Synthetic oligonucleotide
  Target: ATXN1; (+) strand; PAM type: YTN; PAM sequence: CTT
ttttattcagatagggtttc

SEQ ID NO: 246845 - DNA, 20 bp, Artificial Sequence
  Description of Artificial Sequence: Synthetic oligonucleotide
  Target: ATXN1; (+) strand; PAM type: YTN; PAM sequence: TTT
tttattcagatagggtttca

SEQ ID NO: 246846 - DNA, 20 bp, Artificial Sequence
  Description of Artificial Sequence: Synthetic oligonucleotide
  Target: ATXN1; (+) strand; PAM type: YTN; PAM sequence: TTT
ttattcagatagggtttcat

SEQ ID NO: 246847 - DNA, 20 bp, Artificial Sequence
  Description of Artificial Sequence: Synthetic oligonucleotide
  Target: ATXN1; (+) strand; PAM type: YTN; PAM sequence: TTT
tattcagatagggtttcatc

SEQ ID NO: 246848 - DNA, 20 bp, Artificial Sequence
  Description of Artificial Sequence: Synthetic oligonucleotide
  Target: ATXN1; (+) strand; PAM type: YTN; PAM sequence: TTT
attcagatagggtttcatca

SEQ ID NO: 246849 - DNA, 20 bp, Artificial Sequence
  Description of Artificial Sequence: Synthetic oligonucleotide
  Target: ATXN1; (+) strand; PAM type: YTN; PAM sequence: TTA
ttcagatagggtttcatcac

SEQ ID NO: 246850 - DNA, 20 bp, Artificial Sequence
  Description of Artificial Sequence: Synthetic oligonucleotide
  Target: ATXN1; (+) strand; PAM type: YTN; PAM sequence: TTC
agatagggtttcatcacgct

SEQ ID NO: 246851 - DNA, 20 bp, Artificial Sequence
  Description of Artificial Sequence: Synthetic oligonucleotide
  Target: ATXN1; (+) strand; PAM type: YTN; PAM sequence: TTT
catcacgctgtgcaggctgg

SEQ ID NO: 246852 - DNA, 20 bp, Artificial Sequence
  Description of Artificial Sequence: Synthetic oligonucleotide
  Target: ATXN1; (+) strand; PAM type: YTN; PAM sequence: TTC
atcacgctgtgcaggctggt

SEQ ID NO: 246853 - DNA, 20 bp, Artificial Sequence
  Description of Artificial Sequence: Synthetic oligonucleotide
  Target: ATXN1; (+) strand; PAM type: YTN; PAM sequence: CTG
tgcaggctggtctcaaactc

SEQ ID NO: 246854 - DNA, 20 bp, Artificial Sequence
  Description of Artificial Sequence: Synthetic oligonucleotide
  Target: ATXN1; (+) strand; PAM type: YTN; PAM sequence: CTG
gtctcaaactcctgggctta

SEQ ID NO: 246855 - DNA, 20 bp, Artificial Sequence
  Description of Artificial Sequence: Synthetic oligonucleotide
  Target: ATXN1; (+) strand; PAM type: YTN; PAM sequence: CTC
aaactcctgggcttaagcga

SEQ ID NO: 246856 - DNA, 20 bp, Artificial Sequence
  Description of Artificial Sequence: Synthetic oligonucleotide
  Target: ATXN1; (+) strand; PAM type: YTN; PAM sequence: CTC
ctgggcttaagcgatcctcc

SEQ ID NO: 246857 - DNA, 20 bp, Artificial Sequence
  Description of Artificial Sequence: Synthetic oligonucleotide
  Target: ATXN1; (+) strand; PAM type: YTN; PAM sequence: CTG
ggcttaagcgatcctcccat

SEQ ID NO: 246858 - DNA, 20 bp, Artificial Sequence
  Description of Artificial Sequence: Synthetic oligonucleotide
  Target: ATXN1; (+) strand; PAM type: YTN; PAM sequence: CTT
aagcgatcctcccattttgg

SEQ ID NO: 246859 - DNA, 20 bp, Artificial Sequence
  Description of Artificial Sequence: Synthetic oligonucleotide
  Target: ATXN1; (+) strand; PAM type: YTN; PAM sequence: TTA
agcgatcctcccattttggc

SEQ ID NO: 246860 - DNA, 20 bp, Artificial Sequence
  Description of Artificial Sequence: Synthetic oligonucleotide
  Target: ATXN1; (+) strand; PAM type: YTN; PAM sequence: CTC
ccattttggctttccatagt

SEQ ID NO: 246861 - DNA, 20 bp, Artificial Sequence
  Description of Artificial Sequence: Synthetic oligonucleotide
  Target: ATXN1; (+) strand; PAM type: YTN; PAM sequence: TTT
tggctttccatagtgttaga

SEQ ID NO: 246862 - DNA, 20 bp, Artificial Sequence
  Description of Artificial Sequence: Synthetic oligonucleotide
  Target: ATXN1; (+) strand; PAM type: YTN; PAM sequence: TTT
ggctttccatagtgttagaa

SEQ ID NO: 246863 - DNA, 20 bp, Artificial Sequence
  Description of Artificial Sequence: Synthetic oligonucleotide
  Target: ATXN1; (+) strand; PAM type: YTN; PAM sequence: TTG
gctttccatagtgttagaat

SEQ ID NO: 246864 - DNA, 20 bp, Artificial Sequence
  Description of Artificial Sequence: Synthetic oligonucleotide
  Target: ATXN1; (+) strand; PAM type: YTN; PAM sequence: CTT
tccatagtgttagaattaca

SEQ ID NO: 246865 - DNA, 20 bp, Artificial Sequence
  Description of Artificial Sequence: Synthetic oligonucleotide
  Target: ATXN1; (+) strand; PAM type: YTN; PAM sequence: TTT
ccatagtgttagaattacag

SEQ ID NO: 246866 - DNA, 20 bp, Artificial Sequence
  Description of Artificial Sequence: Synthetic oligonucleotide
  Target: ATXN1; (+) strand; PAM type: YTN; PAM sequence: TTC
catagtgttagaattacaga

SEQ ID NO: 246867 - DNA, 20 bp, Artificial Sequence
  Description of Artificial Sequence: Synthetic oligonucleotide
  Target: ATXN1; (+) strand; PAM type: YTN; PAM sequence: TTA
gaattacagatatgagccac

SEQ ID NO: 246868 - DNA, 20 bp, Artificial Sequence
  Description of Artificial Sequence: Synthetic oligonucleotide
  Target: ATXN1; (+) strand; PAM type: YTN; PAM sequence: TTA
cagatatgagccacagcacc

SEQ ID NO: 246869 - DNA, 20 bp, Artificial Sequence
  Description of Artificial Sequence: Synthetic oligonucleotide
  Target: ATXN1; (+) strand; PAM type: YTN; PAM sequence: TTC
aactttctaagctttgattt

SEQ ID NO: 246870 - DNA, 20 bp, Artificial Sequence
  Description of Artificial Sequence: Synthetic oligonucleotide
  Target: ATXN1; (+) strand; PAM type: YTN; PAM sequence: CTT
tctaagctttgatttcctct

SEQ ID NO: 246871 - DNA, 20 bp, Artificial Sequence
  Description of Artificial Sequence: Synthetic oligonucleotide
  Target: ATXN1; (+) strand; PAM type: YTN; PAM sequence: TTT
ctaagctttgatttcctctt

SEQ ID NO: 246872 - DNA, 20 bp, Artificial Sequence
  Description of Artificial Sequence: Synthetic oligonucleotide
  Target: ATXN1; (+) strand; PAM type: YTN; PAM sequence: TTC
taagctttgatttcctcttt

SEQ ID NO: 246873 - DNA, 20 bp, Artificial Sequence
  Description of Artificial Sequence: Synthetic oligonucleotide
  Target: ATXN1; (+) strand; PAM type: YTN; PAM sequence: CTA
agctttgatttcctctttaa

SEQ ID NO: 246874 - DNA, 20 bp, Artificial Sequence
  Description of Artificial Sequence: Synthetic oligonucleotide
  Target: ATXN1; (+) strand; PAM type: YTN; PAM sequence: CTT
tgatttcctctttaagaaaa

SEQ ID NO: 246875 - DNA, 20 bp, Artificial Sequence
  Description of Artificial Sequence: Synthetic oligonucleotide
  Target: ATXN1; (+) strand; PAM type: YTN; PAM sequence: TTT
gatttcctctttaagaaaat

SEQ ID NO: 246876 - DNA, 20 bp, Artificial Sequence
  Description of Artificial Sequence: Synthetic oligonucleotide
  Target: ATXN1; (+) strand; PAM type: YTN; PAM sequence: TTG
atttcctctttaagaaaatg

SEQ ID NO: 246877 - DNA, 20 bp, Artificial Sequence
  Description of Artificial Sequence: Synthetic oligonucleotide
  Target: ATXN1; (+) strand; PAM type: YTN; PAM sequence: TTT
cctctttaagaaaatgaaga

SEQ ID NO: 246878 - DNA, 20 bp, Artificial Sequence
  Description of Artificial Sequence: Synthetic oligonucleotide
  Target: ATXN1; (+) strand; PAM type: YTN; PAM sequence: TTC
ctctttaagaaaatgaagat

SEQ ID NO: 246879 - DNA, 20 bp, Artificial Sequence
  Description of Artificial Sequence: Synthetic oligonucleotide
  Target: ATXN1; (+) strand; PAM type: YTN; PAM sequence: CTC
tttaagaaaatgaagatagt

SEQ ID NO: 246880 - DNA, 20 bp, Artificial Sequence
  Description of Artificial Sequence: Synthetic oligonucleotide
  Target: ATXN1; (+) strand; PAM type: YTN; PAM sequence: CTT
taagaaaatgaagatagtat

SEQ ID NO: 246881 - DNA, 20 bp, Artificial Sequence
  Description of Artificial Sequence: Synthetic oligonucleotide
  Target: ATXN1; (+) strand; PAM type: YTN; PAM sequence: TTT
aagaaaatgaagatagtatg

SEQ ID NO: 246882 - DNA, 20 bp, Artificial Sequence
  Description of Artificial Sequence: Synthetic oligonucleotide
  Target: ATXN1; (+) strand; PAM type: YTN; PAM sequence: TTA
agaaaatgaagatagtatgg

SEQ ID NO: 246883 - DNA, 20 bp, Artificial Sequence
  Description of Artificial Sequence: Synthetic oligonucleotide
  Target: ATXN1; (+) strand; PAM type: YTN; PAM sequence: CTC
acacatataatcccagcact

SEQ ID NO: 246884 - DNA, 20 bp, Artificial Sequence
  Description of Artificial Sequence: Synthetic oligonucleotide
  Target: ATXN1; (+) strand; PAM type: YTN; PAM sequence: CTT
tcagaggccgagggggggca

SEQ ID NO: 246885 - DNA, 20 bp, Artificial Sequence
  Description of Artificial Sequence: Synthetic oligonucleotide
  Target: ATXN1; (+) strand; PAM type: YTN; PAM sequence: TTT
cagaggccgagggggggcag

SEQ ID NO: 246886 - DNA, 20 bp, Artificial Sequence
  Description of Artificial Sequence: Synthetic oligonucleotide
  Target: ATXN1; (+) strand; PAM type: YTN; PAM sequence: TTC
agaggccgagggggggcaga

SEQ ID NO: 246887 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctggtcaatgt

SEQ ID NO: 246888 - DNA, 20 bp, Artificial Sequence
  Description of Artificial Sequence: Synthetic oligonucleotide
  Target: ATXN1; (+) strand; PAM type: YTN; PAM sequence: CTG
gtcaatgtggcaaagccccg

SEQ ID NO: 246889 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaaaaa

SEQ ID NO: 246890 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaaaaatt

SEQ ID NO: 246891 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaaaaattagc

SEQ ID NO: 246892 - DNA, 20 bp, Artificial Sequence
  Description of Artificial Sequence: Synthetic oligonucleotide
  Target: ATXN1; (+) strand; PAM type: YTN; PAM sequence: TTA
gccgggcttggtggtgagtg

SEQ ID NO: 246893 - DNA, 20 bp, Artificial Sequence
  Description of Artificial Sequence: Synthetic oligonucleotide
  Target: ATXN1; (+) strand; PAM type: YTN; PAM sequence: CTT
ggtggtgagtgcctgtaatt

SEQ ID NO: 246894 - DNA, 20 bp, Artificial Sequence
  Description of Artificial Sequence: Synthetic oligonucleotide
  Target: ATXN1; (+) strand; PAM type: YTN; PAM sequence: TTG
gtggtgagtgcctgtaattc

SEQ ID NO: 246895 - DNA, 20 bp, Artificial Sequence
  Description of Artificial Sequence: Synthetic oligonucleotide
  Target: ATXN1; (+) strand; PAM type: YTN; PAM sequence: CTG
taattccagggaggctgagg

SEQ ID NO: 246896 - DNA, 20 bp, Artificial Sequence
  Description of Artificial Sequence: Synthetic oligonucleotide
  Target: ATXN1; (+) strand; PAM type: YTN; PAM sequence: TTC
cagggaggctgaggcagaag

SEQ ID NO: 246897 - DNA, 20 bp, Artificial Sequence
  Description of Artificial Sequence: Synthetic oligonucleotide
  Target: ATXN1; (+) strand; PAM type: YTN; PAM sequence: CTG
aggcagaagaatcacttgaa

SEQ ID NO: 246898 - DNA, 20 bp, Artificial Sequence
  Description of Artificial Sequence: Synthetic oligonucleotide
  Target: ATXN1; (+) strand; PAM type: YTN; PAM sequence: CTT
gaacccgcgaggtggaggtt

SEQ ID NO: 246899 - DNA, 20 bp, Artificial Sequence
  Description of Artificial Sequence: Synthetic oligonucleotide
  Target: ATXN1; (+) strand; PAM type: YTN; PAM sequence: TTG
aacccgcgaggtggaggttg

SEQ ID NO: 246900 - DNA, 20 bp, Artificial Sequence
  Description of Artificial Sequence: Synthetic oligonucleotide
  Target: ATXN1; (+) strand; PAM type: YTN; PAM sequence: TTG
cagcgaaccaagattgtacc

SEQ ID NO: 246901 - DNA, 20 bp, Artificial Sequence
  Description of Artificial Sequence: Synthetic oligonucleotide
  Target: ATXN1; (+) strand; PAM type: YTN; PAM sequence: TTG
taccattgcactctagcctg

SEQ ID NO: 246902 - DNA, 20 bp, Artificial Sequence
  Description of Artificial Sequence: Synthetic oligonucleotide
  Target: ATXN1; (+) strand; PAM type: YTN; PAM sequence: TTG
cactctagcctgggcgacag

SEQ ID NO: 246903 - DNA, 20 bp, Artificial Sequence
  Description of Artificial Sequence: Synthetic oligonucleotide
  Target: ATXN1; (+) strand; PAM type: YTN; PAM sequence: CTC
tagcctgggcgacaggagtg

SEQ ID NO: 246904 - DNA, 20 bp, Artificial Sequence
  Description of Artificial Sequence: Synthetic oligonucleotide
  Target: ATXN1; (+) strand; PAM type: YTN; PAM sequence: CTA
gcctgggcgacaggagtgaa

SEQ ID NO: 246905 - DNA, 20 bp, Artificial Sequence
  Description of Artificial Sequence: Synthetic oligonucleotide
  Target: ATXN1; (+) strand; PAM type: YTN; PAM sequence: CTG
ggcgacaggagtgaaactct

SEQ ID NO: 246906 - DNA, 20 bp, Artificial Sequence
  Description of Artificial Sequence: Synthetic oligonucleotide
  Target: ATXN1; (+) strand; PAM type: YTN; PAM sequence: CTC
tgccttagaaaaaaaaaaat

SEQ ID NO: 246907 - DNA, 20 bp, Artificial Sequence
  Description of Artificial Sequence: Synthetic oligonucleotide
  Target: ATXN1; (+) strand; PAM type: YTN; PAM sequence: CTG
ccttagaaaaaaaaaaatga

SEQ ID NO: 246908 - DNA, 20 bp, Artificial Sequence
  Description of Artificial Sequence: Synthetic oligonucleotide
  Target: ATXN1; (+) strand; PAM type: YTN; PAM sequence: CTT
agaaaaaaaaaaatgaagat

SEQ ID NO: 246909 - DNA, 20 bp, Artificial Sequence
  Description of Artificial Sequence: Synthetic oligonucleotide
  Target: ATXN1; (+) strand; PAM type: YTN; PAM sequence: TTA
gaaaaaaaaaaatgaagata

SEQ ID NO: 246910 - DNA, 20 bp, Artificial Sequence
  Description of Artificial Sequence: Synthetic oligonucleotide
  Target: ATXN1; (+) strand; PAM type: YTN; PAM sequence: CTT
atttcatgaagttgttatga

SEQ ID NO: 246911 - DNA, 20 bp, Artificial Sequence
  Description of Artificial Sequence: Synthetic oligonucleotide
  Target: ATXN1; (+) strand; PAM type: YTN; PAM sequence: TTA
tttcatgaagttgttatgag

SEQ ID NO: 246912 - DNA, 20 bp, Artificial Sequence
  Description of Artificial Sequence: Synthetic oligonucleotide
  Target: ATXN1; (+) strand; PAM type: YTN; PAM sequence: TTT
catgaagttgttatgagaat

SEQ ID NO: 246913 - DNA, 20 bp, Artificial Sequence
  Description of Artificial Sequence: Synthetic oligonucleotide
  Target: ATXN1; (+) strand; PAM type: YTN; PAM sequence: TTC
atgaagttgttatgagaatt

SEQ ID NO: 246914 - DNA, 20 bp, Artificial Sequence
  Description of Artificial Sequence: Synthetic oligonucleotide
  Target: ATXN1; (+) strand; PAM type: YTN; PAM sequence: TTG
ttatgagaattgcatgggac

SEQ ID NO: 246915 - DNA, 20 bp, Artificial Sequence
  Description of Artificial Sequence: Synthetic oligonucleotide
  Target: ATXN1; (+) strand; PAM type: YTN; PAM sequence: TTA
tgagaattgcatgggacaat

SEQ ID NO: 246916 - DNA, 20 bp, Artificial Sequence
  Description of Artificial Sequence: Synthetic oligonucleotide
  Target: ATXN1; (+) strand; PAM type: YTN; PAM sequence: TTG
catgggacaattcagtgcct

SEQ ID NO: 246917 - DNA, 20 bp, Artificial Sequence
  Description of Artificial Sequence: Synthetic oligonucleotide
  Target: ATXN1; (+) strand; PAM type: YTN; PAM sequence: TTC
agtgcctagcatgcaagcag

SEQ ID NO: 246918 - DNA, 20 bp, Artificial Sequence
  Description of Artificial Sequence: Synthetic oligonucleotide
  Target: ATXN1; (+) strand; PAM type: YTN; PAM sequence: CTA
gcatgcaagcaggcagtagt

SEQ ID NO: 246919 - DNA, 20 bp, Artificial Sequence
  Description of Artificial Sequence: Synthetic oligonucleotide
  Target: ATXN1; (+) strand; PAM type: YTN; PAM sequence: CTC
aaaaaatgctacctctcatg

SEQ ID NO: 246920 - DNA, 20 bp, Artificial Sequence
  Description of Artificial Sequence: Synthetic oligonucleotide
  Target: ATXN1; (+) strand; PAM type: YTN; PAM sequence: CTA
cctctcatgatgaactgctt

SEQ ID NO: 246921 - DNA, 20 bp, Artificial Sequence
  Description of Artificial Sequence: Synthetic oligonucleotide
  Target: ATXN1; (+) strand; PAM type: YTN; PAM sequence: CTC
tcatgatgaactgctttcca

SEQ ID NO: 246922 - DNA, 20 bp, Artificial Sequence
  Description of Artificial Sequence: Synthetic oligonucleotide
  Target: ATXN1; (+) strand; PAM type: YTN; PAM sequence: CTC
atgatgaactgctttccagt

SEQ ID NO: 246923 - DNA, 20 bp, Artificial Sequence
  Description of Artificial Sequence: Synthetic oligonucleotide
  Target: ATXN1; (+) strand; PAM type: YTN; PAM sequence: CTG
ctttccagttcaaactacct

SEQ ID NO: 246924 - DNA, 20 bp, Artificial Sequence
  Description of Artificial Sequence: Synthetic oligonucleotide
  Target: ATXN1; (+) strand; PAM type: YTN; PAM sequence: CTT
tccagttcaaactacctcct

SEQ ID NO: 246925 - DNA, 20 bp, Artificial Sequence
  Description of Artificial Sequence: Synthetic oligonucleotide
  Target: ATXN1; (+) strand; PAM type: YTN; PAM sequence: TTT
ccagttcaaactacctccta

SEQ ID NO: 246926 - DNA, 20 bp, Artificial Sequence
  Description of Artificial Sequence: Synthetic oligonucleotide
  Target: ATXN1; (+) strand; PAM type: YTN; PAM sequence: TTC
cagttcaaactacctcctat

SEQ ID NO: 246927 - DNA, 20 bp, Artificial Sequence
  Description of Artificial Sequence: Synthetic oligonucleotide
  Target: ATXN1; (+) strand; PAM type: YTN; PAM sequence: TTC
aaactacctcctatgactgc

SEQ ID NO: 246928 - DNA, 20 bp, Artificial Sequence
  Description of Artificial Sequence: Synthetic oligonucleotide
  Target: ATXN1; (+) strand; PAM type: YTN; PAM sequence: CTA
cctcctatgactgctgcagc

SEQ ID NO: 246929 - DNA, 20 bp, Artificial Sequence
  Description of Artificial Sequence: Synthetic oligonucleotide
  Target: ATXN1; (+) strand; PAM type: YTN; PAM sequence: CTC
ctatgactgctgcagcaaac

SEQ ID NO: 246930 - DNA, 20 bp, Artificial Sequence
  Description of Artificial Sequence: Synthetic oligonucleotide
  Target: ATXN1; (+) strand; PAM type: YTN; PAM sequence: CTA
tgactgctgcagcaaacagc

SEQ ID NO: 246931 - DNA, 20 bp, Artificial Sequence
  Description of Artificial Sequence: Synthetic oligonucleotide
  Target: ATXN1; (+) strand; PAM type: YTN; PAM sequence: CTG
ctgcagcaaacagcacaggc

SEQ ID NO: 246932 - DNA, 20 bp, Artificial Sequence
  Description of Artificial Sequence: Synthetic oligonucleotide
  Target: ATXN1; (+) strand; PAM type: YTN; PAM sequence: CTG
cagcaaacagcacaggcctg

SEQ ID NO: 246933 - DNA, 20 bp, Artificial Sequence
  Description of Artificial Sequence: Synthetic oligonucleotide
  Target: ATXN1; (+) strand; PAM type: YTN; PAM sequence: CTG
ggatctaggccacctgattt

SEQ ID NO: 246934 - DNA, 20 bp, Artificial Sequence
  Description of Artificial Sequence: Synthetic oligonucleotide
  Target: ATXN1; (+) strand; PAM type: YTN; PAM sequence: CTA
ggccacctgatttggaatcc

SEQ ID NO: 246935 - DNA, 20 bp, Artificial Sequence
  Description of Artificial Sequence: Synthetic oligonucleotide
  Target: ATXN1; (+) strand; PAM type: YTN; PAM sequence: CTG
atttggaatcctggtggcct

SEQ ID NO: 246936 - DNA, 20 bp, Artificial Sequence
  Description of Artificial Sequence: Synthetic oligonucleotide
  Target: ATXN1; (+) strand; PAM type: YTN; PAM sequence: TTT
ggaatcctggtggccttact

SEQ ID NO: 246937 - DNA, 20 bp, Artificial Sequence
  Description of Artificial Sequence: Synthetic oligonucleotide
  Target: ATXN1; (+) strand; PAM type: YTN; PAM sequence: TTG
gaatcctggtggccttactc

SEQ ID NO: 246938 - DNA, 20 bp, Artificial Sequence
  Description of Artificial Sequence: Synthetic oligonucleotide
  Target: ATXN1; (+) strand; PAM type: YTN; PAM sequence: CTG
gtggccttactcctcagctg

SEQ ID NO: 246939 - DNA, 20 bp, Artificial Sequence
  Description of Artificial Sequence: Synthetic oligonucleotide
  Target: ATXN1; (+) strand; PAM type: YTN; PAM sequence: CTT
actcctcagctgtgtatatc

SEQ ID NO: 246940 - DNA, 20 bp, Artificial Sequence
  Description of Artificial Sequence: Synthetic oligonucleotide
  Target: ATXN1; (+) strand; PAM type: YTN; PAM sequence: TTA
ctcctcagctgtgtatatct

SEQ ID NO: 246941 - DNA, 20 bp, Artificial Sequence
  Description of Artificial Sequence: Synthetic oligonucleotide
  Target: ATXN1; (+) strand; PAM type: YTN; PAM sequence: CTC
ctcagctgtgtatatctgat

SEQ ID NO: 246942 - DNA, 20 bp, Artificial Sequence
  Description of Artificial Sequence: Synthetic oligonucleotide
  Target: ATXN1; (+) strand; PAM type: YTN; PAM sequence: CTC
agctgtgtatatctgatgca

SEQ ID NO: 246943 - DNA, 20 bp, Artificial Sequence
  Description of Artificial Sequence: Synthetic oligonucleotide
  Target: ATXN1; (+) strand; PAM type: YTN; PAM sequence: CTG
tgtatatctgatgcaagtta

SEQ ID NO: 246944 - DNA, 20 bp, Artificial Sequence
  Description of Artificial Sequence: Synthetic oligonucleotide
  Target: ATXN1; (+) strand; PAM type: YTN; PAM sequence: CTG
atgcaagttaattaatttct

SEQ ID NO: 246945 - DNA, 20 bp, Artificial Sequence
  Description of Artificial Sequence: Synthetic oligonucleotide
  Target: ATXN1; (+) strand; PAM type: YTN; PAM sequence: TTA
attaatttctctgatctaag

SEQ ID NO: 246946 - DNA, 20 bp, Artificial Sequence
  Description of Artificial Sequence: Synthetic oligonucleotide
  Target: ATXN1; (+) strand; PAM type: YTN; PAM sequence: TTA
atttctctgatctaagtact

SEQ ID NO: 246947 - DNA, 20 bp, Artificial Sequence
  Description of Artificial Sequence: Synthetic oligonucleotide
  Target: ATXN1; (+) strand; PAM type: YTN; PAM sequence: TTT
ctctgatctaagtactaacc

SEQ ID NO: 246948 - DNA, 20 bp, Artificial Sequence
  Description of Artificial Sequence: Synthetic oligonucleotide
  Target: ATXN1; (+) strand; PAM type: YTN; PAM sequence: TTC
tctgatctaagtactaacca

SEQ ID NO: 246949 - DNA, 20 bp, Artificial Sequence
  Description of Artificial Sequence: Synthetic oligonucleotide
  Target: ATXN1; (+) strand; PAM type: YTN; PAM sequence: CTC
tgatctaagtactaaccagg

SEQ ID NO: 246950 - DNA, 20 bp, Artificial Sequence
  Description of Artificial Sequence: Synthetic oligonucleotide
  Target: ATXN1; (+) strand; PAM type: YTN; PAM sequence: CTG
atctaagtactaaccaggcc

SEQ ID NO: 246951 - DNA, 20 bp, Artificial Sequence
  Description of Artificial Sequence: Synthetic oligonucleotide
  Target: ATXN1; (+) strand; PAM type: YTN; PAM sequence: CTA
agtactaaccaggcctaact

SEQ ID NO: 246952 - DNA, 20 bp, Artificial Sequence
  Description of Artificial Sequence: Synthetic oligonucleotide
  Target: ATXN1; (+) strand; PAM type: YTN; PAM sequence: CTA
accaggcctaactaattcat

SEQ ID NO: 246953 - DNA, 20 bp, Artificial Sequence
  Description of Artificial Sequence: Synthetic oligonucleotide
  Target: ATXN1; (+) strand; PAM type: YTN; PAM sequence: CTA
actaattcatttctctgtgc

SEQ ID NO: 246954 - DNA, 20 bp, Artificial Sequence
  Description of Artificial Sequence: Synthetic oligonucleotide
  Target: ATXN1; (+) strand; PAM type: YTN; PAM sequence: CTA
attcatttctctgtgcctca

SEQ ID NO: 246955 - DNA, 20 bp, Artificial Sequence
  Description of Artificial Sequence: Synthetic oligonucleotide
  Target: ATXN1; (+) strand; PAM type: YTN; PAM sequence: TTC
atttctctgtgcctcagttt

SEQ ID NO: 246956 - DNA, 20 bp, Artificial Sequence
  Description of Artificial Sequence: Synthetic oligonucleotide
  Target: ATXN1; (+) strand; PAM type: YTN; PAM sequence: TTT
ctctgtgcctcagtttgctc

SEQ ID NO: 246957 - DNA, 20 bp, Artificial Sequence
  Description of Artificial Sequence: Synthetic oligonucleotide
  Target: ATXN1; (+) strand; PAM type: YTN; PAM sequence: TTC
tctgtgcctcagtttgctca

SEQ ID NO: 246958 - DNA, 20 bp, Artificial Sequence
  Description of Artificial Sequence: Synthetic oligonucleotide
  Target: ATXN1; (+) strand; PAM type: YTN; PAM sequence: CTC
tgtgcctcagtttgctcatc

SEQ ID NO: 246959 - DNA, 20 bp, Artificial Sequence
  Description of Artificial Sequence: Synthetic oligonucleotide
  Target: ATXN1; (+) strand; PAM type: YTN; PAM sequence: CTG
tgcctcagtttgctcatctc

SEQ ID NO: 246960 - DNA, 20 bp, Artificial Sequence
  Description of Artificial Sequence: Synthetic oligonucleotide
  Target: ATXN1; (+) strand; PAM type: YTN; PAM sequence: CTC
agtttgctcatctccaaagt

SEQ ID NO: 246961 - DNA, 20 bp, Artificial Sequence
  Description of Artificial Sequence: Synthetic oligonucleotide
  Target: ATXN1; (+) strand; PAM type: YTN; PAM sequence: TTT
gctcatctccaaagtgggaa

SEQ ID NO: 246962 - DNA, 20 bp, Artificial Sequence
  Description of Artificial Sequence: Synthetic oligonucleotide
  Target: ATXN1; (+) strand; PAM type: YTN; PAM sequence: TTG
ctcatctccaaagtgggaat

SEQ ID NO: 246963 - DNA, 20 bp, Artificial Sequence
  Description of Artificial Sequence: Synthetic oligonucleotide
  Target: ATXN1; (+) strand; PAM type: YTN; PAM sequence: CTC
atctccaaagtgggaataat

SEQ ID NO: 246964 - DNA, 20 bp, Artificial Sequence
  Description of Artificial Sequence: Synthetic oligonucleotide
  Target: ATXN1; (+) strand; PAM type: YTN; PAM sequence: CTC
caaagtgggaataatactag

SEQ ID NO: 246965 - DNA, 20 bp, Artificial Sequence
  Description of Artificial Sequence: Synthetic oligonucleotide
  Target: ATXN1; (+) strand; PAM type: YTN; PAM sequence: CTA
gttcctaccccacaggcttg

SEQ ID NO: 246966 - DNA, 20 bp, Artificial Sequence
  Description of Artificial Sequence: Synthetic oligonucleotide
  Target: ATXN1; (+) strand; PAM type: YTN; PAM sequence: TTC
ctaccccacaggcttgctgt

SEQ ID NO: 246967 - DNA, 20 bp, Artificial Sequence
  Description of Artificial Sequence: Synthetic oligonucleotide
  Target: ATXN1; (+) strand; PAM type: YTN; PAM sequence: CTA
ccccacaggcttgctgtgag

SEQ ID NO: 246968 - DNA, 20 bp, Artificial Sequence
  Description of Artificial Sequence: Synthetic oligonucleotide
  Target: ATXN1; (+) strand; PAM type: YTN; PAM sequence: CTT
gctgtgagttcacacataag

SEQ ID NO: 246969 - DNA, 20 bp, Artificial Sequence
  Description of Artificial Sequence: Synthetic oligonucleotide
  Target: ATXN1; (+) strand; PAM type: YTN; PAM sequence: TTG
ctgtgagttcacacataaga

SEQ ID NO: 246970 - DNA, 20 bp, Artificial Sequence
  Description of Artificial Sequence: Synthetic oligonucleotide
  Target: ATXN1; (+) strand; PAM type: YTN; PAM sequence: CTG
tgagttcacacataagaaga

SEQ ID NO: 246971 - DNA, 20 bp, Artificial Sequence
  Description of Artificial Sequence: Synthetic oligonucleotide
  Target: ATXN1; (+) strand; PAM type: YTN; PAM sequence: TTC
acacataagaagaatttaga

SEQ ID NO: 246972 - DNA, 20 bp, Artificial Sequence
  Description of Artificial Sequence: Synthetic oligonucleotide
  Target: ATXN1; (+) strand; PAM type: YTN; PAM sequence: TTT
agatgagggcctggcgtact

SEQ ID NO: 246973 - DNA, 20 bp, Artificial Sequence
  Description of Artificial Sequence: Synthetic oligonucleotide
  Target: ATXN1; (+) strand; PAM type: YTN; PAM sequence: TTA
gatgagggcctggcgtactc

SEQ ID NO: 246974 - DNA, 20 bp, Artificial Sequence
  Description of Artificial Sequence: Synthetic oligonucleotide
  Target: ATXN1; (+) strand; PAM type: YTN; PAM sequence: CTG
gcgtactcaagacctacaat

SEQ ID NO: 246975 - DNA, 20 bp, Artificial Sequence
  Description of Artificial Sequence: Synthetic oligonucleotide
  Target: ATXN1; (+) strand; PAM type: YTN; PAM sequence: CTC
aagacctacaattactggct

SEQ ID NO: 246976 - DNA, 20 bp, Artificial Sequence
  Description of Artificial Sequence: Synthetic oligonucleotide
  Target: ATXN1; (+) strand; PAM type: YTN; PAM sequence: CTA
caattactggctgtggttgt

SEQ ID NO: 246977 - DNA, 20 bp, Artificial Sequence
  Description of Artificial Sequence: Synthetic oligonucleotide
  Target: ATXN1; (+) strand; PAM type: YTN; PAM sequence: TTA
ctggctgtggttgttccgat

SEQ ID NO: 246978 - DNA, 20 bp, Artificial Sequence
  Description of Artificial Sequence: Synthetic oligonucleotide
  Target: ATXN1; (+) strand; PAM type: YTN; PAM sequence: CTG
gctgtggttgttccgattat

SEQ ID NO: 246979 - DNA, 20 bp, Artificial Sequence
  Description of Artificial Sequence: Synthetic oligonucleotide
  Target: ATXN1; (+) strand; PAM type: YTN; PAM sequence: CTG
tggttgttccgattattttc

SEQ ID NO: 246980 - DNA, 20 bp, Artificial Sequence
  Description of Artificial Sequence: Synthetic oligonucleotide
  Target: ATXN1; (+) strand; PAM type: YTN; PAM sequence: TTG
ttccgattattttctaagaa

SEQ ID NO: 246981 - DNA, 20 bp, Artificial Sequence
  Description of Artificial Sequence: Synthetic oligonucleotide
  Target: ATXN1; (+) strand; PAM type: YTN; PAM sequence: TTC
cgattattttctaagaaagg

SEQ ID NO: 246982 - DNA, 20 bp, Artificial Sequence
  Description of Artificial Sequence: Synthetic oligonucleotide
  Target: ATXN1; (+) strand; PAM type: YTN; PAM sequence: TTA
ttttctaagaaaggccctct

SEQ ID NO: 246983 - DNA, 20 bp, Artificial Sequence
  Description of Artificial Sequence: Synthetic oligonucleotide
  Target: ATXN1; (+) strand; PAM type: YTN; PAM sequence: TTT
tctaagaaaggccctcttct

SEQ ID NO: 246984 - DNA, 20 bp, Artificial Sequence
  Description of Artificial Sequence: Synthetic oligonucleotide
  Target: ATXN1; (+) strand; PAM type: YTN; PAM sequence: TTT
ctaagaaaggccctcttctc

SEQ ID NO: 246985 - DNA, 20 bp, Artificial Sequence
  Description of Artificial Sequence: Synthetic oligonucleotide
  Target: ATXN1; (+) strand; PAM type: YTN; PAM sequence: TTC
taagaaaggccctcttctct

SEQ ID NO: 246986 - DNA, 20 bp, Artificial Sequence
  Description of Artificial Sequence: Synthetic oligonucleotide
  Target: ATXN1; (+) strand; PAM type: YTN; PAM sequence: CTA
agaaaggccctcttctctac

SEQ ID NO: 246987 - DNA, 20 bp, Artificial Sequence
  Description of Artificial Sequence: Synthetic oligonucleotide
  Target: ATXN1; (+) strand; PAM type: YTN; PAM sequence: CTC
ttctctacctccttcactgt

SEQ ID NO: 246988 - DNA, 20 bp, Artificial Sequence
  Description of Artificial Sequence: Synthetic oligonucleotide
  Target: ATXN1; (+) strand; PAM type: YTN; PAM sequence: CTT
ctctacctccttcactgtgg

SEQ ID NO: 246989 - DNA, 20 bp, Artificial Sequence
  Description of Artificial Sequence: Synthetic oligonucleotide
  Target: ATXN1; (+) strand; PAM type: YTN; PAM sequence: TTC
tctacctccttcactgtggt

SEQ ID NO: 246990 - DNA, 20 bp, Artificial Sequence
  Description of Artificial Sequence: Synthetic oligonucleotide
  Target: ATXN1; (+) strand; PAM type: YTN; PAM sequence: CTC
tacctccttcactgtggtcc

SEQ ID NO: 246991 - DNA, 20 bp, Artificial Sequence
  Description of Artificial Sequence: Synthetic oligonucleotide
  Target: ATXN1; (+) strand; PAM type: YTN; PAM sequence: CTA
cctccttcactgtggtccta

SEQ ID NO: 246992 - DNA, 20 bp, Artificial Sequence
  Description of Artificial Sequence: Synthetic oligonucleotide
  Target: ATXN1; (+) strand; PAM type: YTN; PAM sequence: CTC
cttcactgtggtcctatttt

SEQ ID NO: 246993 - DNA, 20 bp, Artificial Sequence
  Description of Artificial Sequence: Synthetic oligonucleotide
  Target: ATXN1; (+) strand; PAM type: YTN; PAM sequence: CTT
cactgtggtcctattttcat

SEQ ID NO: 246994 - DNA, 20 bp, Artificial Sequence
  Description of Artificial Sequence: Synthetic oligonucleotide
  Target: ATXN1; (+) strand; PAM type: YTN; PAM sequence: TTC
actgtggtcctattttcatc

SEQ ID NO: 246995 - DNA, 20 bp, Artificial Sequence
  Description of Artificial Sequence: Synthetic oligonucleotide
  Target: ATXN1; (+) strand; PAM type: YTN; PAM sequence: CTG
tggtcctattttcatctgca

SEQ ID NO: 246996 - DNA, 20 bp, Artificial Sequence
  Description of Artificial Sequence: Synthetic oligonucleotide
  Target: ATXN1; (+) strand; PAM type: YTN; PAM sequence: CTA
ttttcatctgcataaaaaaa

SEQ ID NO: 246997 - DNA, 20 bp, Artificial Sequence
  Description of Artificial Sequence: Synthetic oligonucleotide
  Target: ATXN1; (+) strand; PAM type: YTN; PAM sequence: TTT
tcatctgcataaaaaaatca

SEQ ID NO: 246998 - DNA, 20 bp, Artificial Sequence
  Description of Artificial Sequence: Synthetic oligonucleotide
  Target: ATXN1; (+) strand; PAM type: YTN; PAM sequence: TTT
catctgcataaaaaaatcac

SEQ ID NO: 246999 - DNA, 20 bp, Artificial Sequence
  Description of Artificial Sequence: Synthetic oligonucleotide
  Target: ATXN1; (+) strand; PAM type: YTN; PAM sequence: TTC
atctgcataaaaaaatcaca

SEQ ID NO: 247000 - DNA, 20 bp, Artificial Sequence
  Description of Artificial Sequence: Synthetic oligonucleotide
  Target: ATXN1; (+) strand; PAM type: YTN; PAM sequence: CTG
cataaaaaaatcacattttc

SEQ ID NO: 247001 - DNA, 20 bp, Artificial Sequence
  Description of Artificial Sequence: Synthetic oligonucleotide
  Target: ATXN1; (+) strand; PAM type: YTN; PAM sequence: TTT
tcaggctgggcatggtggct

SEQ ID NO: 247002 - DNA, 20 bp, Artificial Sequence
  Description of Artificial Sequence: Synthetic oligonucleotide
  Target: ATXN1; (+) strand; PAM type: YTN; PAM sequence: TTT
caggctgggcatggtggctc

SEQ ID NO: 247003 - DNA, 20 bp, Artificial Sequence
  Description of Artificial Sequence: Synthetic oligonucleotide
  Target: ATXN1; (+) strand; PAM type: YTN; PAM sequence: TTC
aggctgggcatggtggctca

SEQ ID NO: 247004 - DNA, 20 bp, Artificial Sequence
  Description of Artificial Sequence: Synthetic oligonucleotide
  Target: ATXN1; (+) strand; PAM type: YTN; PAM sequence: CTG
ggcatggtggctcacgcctg

SEQ ID NO: 247005 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 247006 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 247007 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaggctggtgg

SEQ ID NO: 247008 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggctggtgga

SEQ ID NO: 247009 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggctggtggat

SEQ ID NO: 247010 - DNA, 20 bp, Artificial Sequence
  Description of Artificial Sequence: Synthetic oligonucleotide
  Target: ATXN1; (+) strand; PAM type: YTN; PAM sequence: CTG
aggctggtggatcacgagat

SEQ ID NO: 247011 - DNA, 20 bp, Artificial Sequence
  Description of Artificial Sequence: Synthetic oligonucleotide
  Target: ATXN1; (+) strand; PAM type: YTN; PAM sequence: CTG
gtggatcacgagatgaagag

SEQ ID NO: 247012 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgacatcttg

SEQ ID NO: 247013 - DNA, 20 bp, Artificial Sequence
  Description of Artificial Sequence: Synthetic oligonucleotide
  Target: ATXN1; (+) strand; PAM type: YTN; PAM sequence: CTT
gtttctactaaaaatacaaa

SEQ ID NO: 247014 - DNA, 20 bp, Artificial Sequence
  Description of Artificial Sequence: Synthetic oligonucleotide
  Target: ATXN1; (+) strand; PAM type: YTN; PAM sequence: TTG
tttctactaaaaatacaaaa

SEQ ID NO: 247015 - DNA, 20 bp, Artificial Sequence
  Description of Artificial Sequence: Synthetic oligonucleotide
  Target: ATXN1; (+) strand; PAM type: YTN; PAM sequence: TTT
ctactaaaaatacaaaaatt

SEQ ID NO: 247016 - DNA, 20 bp, Artificial Sequence
  Description of Artificial Sequence: Synthetic oligonucleotide
  Target: ATXN1; (+) strand; PAM type: YTN; PAM sequence: TTC
tactaaaaatacaaaaatta

SEQ ID NO: 247017 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 247018 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagctgg

SEQ ID NO: 247019 - DNA, 20 bp, Artificial Sequence
  Description of Artificial Sequence: Synthetic oligonucleotide
  Target: ATXN1; (+) strand; PAM type: YTN; PAM sequence: TTA
gctgggcatggtggcacgtg

SEQ ID NO: 247020 - DNA, 20 bp, Artificial Sequence
  Description of Artificial Sequence: Synthetic oligonucleotide
  Target: ATXN1; (+) strand; PAM type: YTN; PAM sequence: CTG
ggcatggtggcacgtgcctg

SEQ ID NO: 247021 - DNA, 20 bp, Artificial Sequence
  Description of Artificial Sequence: Synthetic oligonucleotide
  Target: ATXN1; (+) strand; PAM type: YTN; PAM sequence: CTG
tagttccagctactcgggag

SEQ ID NO: 247022 - DNA, 20 bp, Artificial Sequence
  Description of Artificial Sequence: Synthetic oligonucleotide
  Target: ATXN1; (+) strand; PAM type: YTN; PAM sequence: TTC
cagctactcgggaggctgag

SEQ ID NO: 247023 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggctgaggcagaa

SEQ ID NO: 247024 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcagaagaa

SEQ ID NO: 247025 - DNA, 20 bp, Artificial Sequence
  Description of Artificial Sequence: Synthetic oligonucleotide
  Target: ATXN1; (+) strand; PAM type: YTN; PAM sequence: CTG
aggcagaagaatcacttgaa

SEQ ID NO: 247026 - DNA, 20 bp, Artificial Sequence
  Description of Artificial Sequence: Synthetic oligonucleotide
  Target: ATXN1; (+) strand; PAM type: YTN; PAM sequence: CTT
gaacccgggaggcagaggtt

SEQ ID NO: 247027 - DNA, 20 bp, Artificial Sequence
  Description of Artificial Sequence: Synthetic oligonucleotide
  Target: ATXN1; (+) strand; PAM type: YTN; PAM sequence: TTG
aacccgggaggcagaggttg

SEQ ID NO: 247028 - DNA, 20 bp, Artificial Sequence
  Description of Artificial Sequence: Synthetic oligonucleotide
  Target: ATXN1; (+) strand; PAM type: YTN; PAM sequence: TTG
cagtgagctgagatcatgcc

SEQ ID NO: 247029 - DNA, 20 bp, Artificial Sequence
  Description of Artificial Sequence: Synthetic oligonucleotide
  Target: ATXN1; (+) strand; PAM type: YTN; PAM sequence: CTG
agatcatgccactgcactcc

SEQ ID NO: 247030 - DNA, 20 bp, Artificial Sequence
  Description of Artificial Sequence: Synthetic oligonucleotide
  Target: ATXN1; (+) strand; PAM type: YTN; PAM sequence: CTG
cactccagcctggtgacaga

SEQ ID NO: 247031 - DNA, 20 bp, Artificial Sequence
  Description of Artificial Sequence: Synthetic oligonucleotide
  Target: ATXN1; (+) strand; PAM type: YTN; PAM sequence: CTC
cagcctggtgacagagcgag

SEQ ID NO: 247032 - DNA, 20 bp, Artificial Sequence
  Description of Artificial Sequence: Synthetic oligonucleotide
  Target: ATXN1; (+) strand; PAM type: YTN; PAM sequence: CTG
gtgacagagcgagactgtgt

SEQ ID NO: 247033 - DNA, 20 bp, Artificial Sequence
  Description of Artificial Sequence: Synthetic oligonucleotide
  Target: ATXN1; (+) strand; PAM type: YTN; PAM sequence: CTG
tgtctcaaaaaagaaagaaa

SEQ ID NO: 247034 - DNA, 20 bp, Artificial Sequence
  Description of Artificial Sequence: Synthetic oligonucleotide
  Target: ATXN1; (+) strand; PAM type: YTN; PAM sequence: CTC
aaaaaagaaagaaagaaaaa

SEQ ID NO: 247035 - DNA, 20 bp, Artificial Sequence
  Description of Artificial Sequence: Synthetic oligonucleotide
  Target: ATXN1; (+) strand; PAM type: YTN; PAM sequence: TTT
tcctccctagaattctttct

SEQ ID NO: 247036 - DNA, 20 bp, Artificial Sequence
  Description of Artificial Sequence: Synthetic oligonucleotide
  Target: ATXN1; (+) strand; PAM type: YTN; PAM sequence: TTT
cctccctagaattctttctc

SEQ ID NO: 247037 - DNA, 20 bp, Artificial Sequence
  Description of Artificial Sequence: Synthetic oligonucleotide
  Target: ATXN1; (+) strand; PAM type: YTN; PAM sequence: TTC
ctccctagaattctttctca

SEQ ID NO: 247038 - DNA, 20 bp, Artificial Sequence
  Description of Artificial Sequence: Synthetic oligonucleotide
  Target: ATXN1; (+) strand; PAM type: YTN; PAM sequence: CTC
cctagaattctttctcaggt

SEQ ID NO: 247039 - DNA, 20 bp, Artificial Sequence
  Description of Artificial Sequence: Synthetic oligonucleotide
  Target: ATXN1; (+) strand; PAM type: YTN; PAM sequence: CTA
gaattctttctcaggttact

SEQ ID NO: 247040 - DNA, 20 bp, Artificial Sequence
  Description of Artificial Sequence: Synthetic oligonucleotide
  Target: ATXN1; (+) strand; PAM type: YTN; PAM sequence: TTC
tttctcaggttacttcctgc

SEQ ID NO: 247041 - DNA, 20 bp, Artificial Sequence
  Description of Artificial Sequence: Synthetic oligonucleotide
  Target: ATXN1; (+) strand; PAM type: YTN; PAM sequence: CTT
tctcaggttacttcctgcat

SEQ ID NO: 247042 - DNA, 20 bp, Artificial Sequence
  Description of Artificial Sequence: Synthetic oligonucleotide
  Target: ATXN1; (+) strand; PAM type: YTN; PAM sequence: TTT
ctcaggttacttcctgcatc

SEQ ID NO: 247043 - DNA, 20 bp, Artificial Sequence
  Description of Artificial Sequence: Synthetic oligonucleotide
  Target: ATXN1; (+) strand; PAM type: YTN; PAM sequence: TTC
tcaggttacttcctgcatca

SEQ ID NO: 247044 - DNA, 20 bp, Artificial Sequence
  Description of Artificial Sequence: Synthetic oligonucleotide
  Target: ATXN1; (+) strand; PAM type: YTN; PAM sequence: CTC
aggttacttcctgcatcata

SEQ ID NO: 247045 - DNA, 20 bp, Artificial Sequence
  Description of Artificial Sequence: Synthetic oligonucleotide
  Target: ATXN1; (+) strand; PAM type: YTN; PAM sequence: TTA
cttcctgcatcatagacacc

SEQ ID NO: 247046 - DNA, 20 bp, Artificial Sequence
  Description of Artificial Sequence: Synthetic oligonucleotide
  Target: ATXN1; (+) strand; PAM type: YTN; PAM sequence: CTT
cctgcatcatagacaccagt

SEQ ID NO: 247047 - DNA, 20 bp, Artificial Sequence
  Description of Artificial Sequence: Synthetic oligonucleotide
  Target: ATXN1; (+) strand; PAM type: YTN; PAM sequence: TTC
ctgcatcatagacaccagtc

SEQ ID NO: 247048 - DNA, 20 bp, Artificial Sequence
  Description of Artificial Sequence: Synthetic oligonucleotide
  Target: ATXN1; (+) strand; PAM type: YTN; PAM sequence: CTG
catcatagacaccagtcagc

SEQ ID NO: 247049 - DNA, 20 bp, Artificial Sequence
  Description of Artificial Sequence: Synthetic oligonucleotide
  Target: ATXN1; (+) strand; PAM type: YTN; PAM sequence: CTC
cagcaaagatggtgaatgga

SEQ ID NO: 247050 - DNA, 20 bp, Artificial Sequence
  Description of Artificial Sequence: Synthetic oligonucleotide
  Target: ATXN1; (+) strand; PAM type: YTN; PAM sequence: CTC
tcattaaaagtttccctgcc

SEQ ID NO: 247051 - DNA, 20 bp, Artificial Sequence
  Description of Artificial Sequence: Synthetic oligonucleotide
  Target: ATXN1; (+) strand; PAM type: YTN; PAM sequence: CTC
attaaaagtttccctgcctc

SEQ ID NO: 247052 - DNA, 20 bp, Artificial Sequence
  Description of Artificial Sequence: Synthetic oligonucleotide
  Target: ATXN1; (+) strand; PAM type: YTN; PAM sequence: TTA
aaagtttccctgcctcactt

SEQ ID NO: 247053 - DNA, 20 bp, Artificial Sequence
  Description of Artificial Sequence: Synthetic oligonucleotide
  Target: ATXN1; (+) strand; PAM type: YTN; PAM sequence: TTT
ccctgcctcacttcccttca

SEQ ID NO: 247054 - DNA, 20 bp, Artificial Sequence
  Description of Artificial Sequence: Synthetic oligonucleotide
  Target: ATXN1; (+) strand; PAM type: YTN; PAM sequence: TTC
cctgcctcacttcccttcat

SEQ ID NO: 247055 - DNA, 20 bp, Artificial Sequence
  Description of Artificial Sequence: Synthetic oligonucleotide
  Target: ATXN1; (+) strand; PAM type: YTN; PAM sequence: CTG
cctcacttcccttcatgagg

SEQ ID NO: 247056 - DNA, 20 bp, Artificial Sequence
  Description of Artificial Sequence: Synthetic oligonucleotide
  Target: ATXN1; (+) strand; PAM type: YTN; PAM sequence: CTC
acttcccttcatgaggcatt

SEQ ID NO: 247057 - DNA, 20 bp, Artificial Sequence
  Description of Artificial Sequence: Synthetic oligonucleotide
  Target: ATXN1; (+) strand; PAM type: YTN; PAM sequence: CTT
cccttcatgaggcatttcaa

SEQ ID NO: 247058 - DNA, 20 bp, Artificial Sequence
  Description of Artificial Sequence: Synthetic oligonucleotide
  Target: ATXN1; (+) strand; PAM type: YTN; PAM sequence: TTC
ccttcatgaggcatttcaag

SEQ ID NO: 247059 - DNA, 20 bp, Artificial Sequence
  Description of Artificial Sequence: Synthetic oligonucleotide
  Target: ATXN1; (+) strand; PAM type: YTN; PAM sequence: CTT
catgaggcatttcaagtctt

SEQ ID NO: 247060 - DNA, 20 bp, Artificial Sequence
  Description of Artificial Sequence: Synthetic oligonucleotide
  Target: ATXN1; (+) strand; PAM type: YTN; PAM sequence: TTC
atgaggcatttcaagtctta

SEQ ID NO: 247061 - DNA, 20 bp, Artificial Sequence
  Description of Artificial Sequence: Synthetic oligonucleotide
  Target: ATXN1; (+) strand; PAM type: YTN; PAM sequence: TTT
caagtcttaccggttcagaa

SEQ ID NO: 247062 - DNA, 20 bp, Artificial Sequence
  Description of Artificial Sequence: Synthetic oligonucleotide
  Target: ATXN1; (+) strand; PAM type: YTN; PAM sequence: TTC
aagtcttaccggttcagaaa

SEQ ID NO: 247063 - DNA, 20 bp, Artificial Sequence
  Description of Artificial Sequence: Synthetic oligonucleotide
  Target: ATXN1; (+) strand; PAM type: YTN; PAM sequence: CTT
accggttcagaaagtttact

SEQ ID NO: 247064 - DNA, 20 bp, Artificial Sequence
  Description of Artificial Sequence: Synthetic oligonucleotide
  Target: ATXN1; (+) strand; PAM type: YTN; PAM sequence: TTA
ccggttcagaaagtttacta

SEQ ID NO: 247065 - DNA, 20 bp, Artificial Sequence
  Description of Artificial Sequence: Synthetic oligonucleotide
  Target: ATXN1; (+) strand; PAM type: YTN; PAM sequence: TTC
agaaagtttactaagtctct

SEQ ID NO: 247066 - DNA, 20 bp, Artificial Sequence
  Description of Artificial Sequence: Synthetic oligonucleotide
  Target: ATXN1; (+) strand; PAM type: YTN; PAM sequence: TTT
actaagtctctaaaattgtc

SEQ ID NO: 247067 - DNA, 20 bp, Artificial Sequence
  Description of Artificial Sequence: Synthetic oligonucleotide
  Target: ATXN1; (+) strand; PAM type: YTN; PAM sequence: TTA
ctaagtctctaaaattgtct

SEQ ID NO: 247068 - DNA, 20 bp, Artificial Sequence
  Description of Artificial Sequence: Synthetic oligonucleotide
  Target: ATXN1; (+) strand; PAM type: YTN; PAM sequence: CTA
agtctctaaaattgtcttct

SEQ ID NO: 247069 - DNA, 20 bp, Artificial Sequence
  Description of Artificial Sequence: Synthetic oligonucleotide
  Target: ATXN1; (+) strand; PAM type: YTN; PAM sequence: CTC
taaaattgtcttcttttaga

SEQ ID NO: 247070 - DNA, 20 bp, Artificial Sequence
  Description of Artificial Sequence: Synthetic oligonucleotide
  Target: ATXN1; (+) strand; PAM type: YTN; PAM sequence: CTA
aaattgtcttcttttagaaa

SEQ ID NO: 247071 - DNA, 20 bp, Artificial Sequence
  Description of Artificial Sequence: Synthetic oligonucleotide
  Target: ATXN1; (+) strand; PAM type: YTN; PAM sequence: TTG
tcttcttttagaaaatactc

SEQ ID NO: 247072 - DNA, 20 bp, Artificial Sequence
  Description of Artificial Sequence: Synthetic oligonucleotide
  Target: ATXN1; (+) strand; PAM type: YTN; PAM sequence: CTT
cttttagaaaatactccaca

SEQ ID NO: 247073 - DNA, 20 bp, Artificial Sequence
  Description of Artificial Sequence: Synthetic oligonucleotide
  Target: ATXN1; (+) strand; PAM type: YTN; PAM sequence: TTC
ttttagaaaatactccacac

SEQ ID NO: 247074 - DNA, 20 bp, Artificial Sequence
  Description of Artificial Sequence: Synthetic oligonucleotide
  Target: ATXN1; (+) strand; PAM type: YTN; PAM sequence: CTT
ttagaaaatactccacacta

SEQ ID NO: 247075 - DNA, 20 bp, Artificial Sequence
  Description of Artificial Sequence: Synthetic oligonucleotide
  Target: ATXN1; (+) strand; PAM type: YTN; PAM sequence: TTT
tagaaaatactccacactag

SEQ ID NO: 247076 - DNA, 20 bp, Artificial Sequence
  Description of Artificial Sequence: Synthetic oligonucleotide
  Target: ATXN1; (+) strand; PAM type: YTN; PAM sequence: TTT
agaaaatactccacactagt

SEQ ID NO: 247077 - DNA, 20 bp, Artificial Sequence
  Description of Artificial Sequence: Synthetic oligonucleotide
  Target: ATXN1; (+) strand; PAM type: YTN; PAM sequence: TTA
gaaaatactccacactagtg

SEQ ID NO: 247078 - DNA, 20 bp, Artificial Sequence
  Description of Artificial Sequence: Synthetic oligonucleotide
  Target: ATXN1; (+) strand; PAM type: YTN; PAM sequence: CTC
cacactagtgcactgatttt

SEQ ID NO: 247079 - DNA, 20 bp, Artificial Sequence
  Description of Artificial Sequence: Synthetic oligonucleotide
  Target: ATXN1; (+) strand; PAM type: YTN; PAM sequence: CTA
gtgcactgatttttttttcc

SEQ ID NO: 247080 - DNA, 20 bp, Artificial Sequence
  Description of Artificial Sequence: Synthetic oligonucleotide
  Target: ATXN1; (+) strand; PAM type: YTN; PAM sequence: CTG
atttttttttccccctaaac

SEQ ID NO: 247081 - DNA, 20 bp, Artificial Sequence
  Description of Artificial Sequence: Synthetic oligonucleotide
  Target: ATXN1; (+) strand; PAM type: YTN; PAM sequence: TTT
ttttttccccctaaactgga

SEQ ID NO: 247082 - DNA, 20 bp, Artificial Sequence
  Description of Artificial Sequence: Synthetic oligonucleotide
  Target: ATXN1; (+) strand; PAM type: YTN; PAM sequence: TTT
tttttccccctaaactggac

SEQ ID NO: 247083 - DNA, 20 bp, Artificial Sequence
  Description of Artificial Sequence: Synthetic oligonucleotide
  Target: ATXN1; (+) strand; PAM type: YTN; PAM sequence: TTT
ttttccccctaaactggacc

SEQ ID NO: 247084 - DNA, 20 bp, Artificial Sequence
  Description of Artificial Sequence: Synthetic oligonucleotide
  Target: ATXN1; (+) strand; PAM type: YTN; PAM sequence: TTT
tttccccctaaactggacca

SEQ ID NO: 247085 - DNA, 20 bp, Artificial Sequence
  Description of Artificial Sequence: Synthetic oligonucleotide
  Target: ATXN1; (+) strand; PAM type: YTN; PAM sequence: TTT
ttccccctaaactggaccaa

SEQ ID NO: 247086 - DNA, 20 bp, Artificial Sequence
  Description of Artificial Sequence: Synthetic oligonucleotide
  Target: ATXN1; (+) strand; PAM type: YTN; PAM sequence: TTT
tccccctaaactggaccaaa

SEQ ID NO: 247087 - DNA, 20 bp, Artificial Sequence
  Description of Artificial Sequence: Synthetic oligonucleotide
  Target: ATXN1; (+) strand; PAM type: YTN; PAM sequence: TTT
ccccctaaactggaccaaag

SEQ ID NO: 247088 - DNA, 20 bp, Artificial Sequence
  Description of Artificial Sequence: Synthetic oligonucleotide
  Target: ATXN1; (+) strand; PAM type: YTN; PAM sequence: TTC
cccctaaactggaccaaagc

SEQ ID NO: 247089 - DNA, 20 bp, Artificial Sequence
  Description of Artificial Sequence: Synthetic oligonucleotide
  Target: ATXN1; (+) strand; PAM type: YTN; PAM sequence: CTA
aactggaccaaagccttgtt

SEQ ID NO: 247090 - DNA, 20 bp, Artificial Sequence
  Description of Artificial Sequence: Synthetic oligonucleotide
  Target: ATXN1; (+) strand; PAM type: YTN; PAM sequence: CTG
gaccaaagccttgtttgcag

SEQ ID NO: 247091 - DNA, 20 bp, Artificial Sequence
  Description of Artificial Sequence: Synthetic oligonucleotide
  Target: ATXN1; (+) strand; PAM type: YTN; PAM sequence: CTT
gtttgcagaacaaatggtca

SEQ ID NO: 247092 - DNA, 20 bp, Artificial Sequence
  Description of Artificial Sequence: Synthetic oligonucleotide
  Target: ATXN1; (+) strand; PAM type: YTN; PAM sequence: TTG
tttgcagaacaaatggtcaa

SEQ ID NO: 247093 - DNA, 20 bp, Artificial Sequence
  Description of Artificial Sequence: Synthetic oligonucleotide
  Target: ATXN1; (+) strand; PAM type: YTN; PAM sequence: TTT
gcagaacaaatggtcaatta

SEQ ID NO: 247094 - DNA, 20 bp, Artificial Sequence
  Description of Artificial Sequence: Synthetic oligonucleotide
  Target: ATXN1; (+) strand; PAM type: YTN; PAM sequence: TTG
cagaacaaatggtcaattac

SEQ ID NO: 247095 - DNA, 20 bp, Artificial Sequence
  Description of Artificial Sequence: Synthetic oligonucleotide
  Target: ATXN1; (+) strand; PAM type: YTN; PAM sequence: TTA
catctacattcaaaaataaa

SEQ ID NO: 247096 - DNA, 20 bp, Artificial Sequence
  Description of Artificial Sequence: Synthetic oligonucleotide
  Target: ATXN1; (+) strand; PAM type: YTN; PAM sequence: CTA
cattcaaaaataaaattcaa

SEQ ID NO: 247097 - DNA, 20 bp, Artificial Sequence
  Description of Artificial Sequence: Synthetic oligonucleotide
  Target: ATXN1; (+) strand; PAM type: YTN; PAM sequence: TTC
aaaaataaaattcaaatgtg

SEQ ID NO: 247098 - DNA, 20 bp, Artificial Sequence
  Description of Artificial Sequence: Synthetic oligonucleotide
  Target: ATXN1; (+) strand; PAM type: YTN; PAM sequence: TTC
aaatgtgctcatgttttcaa

SEQ ID NO: 247099 - DNA, 20 bp, Artificial Sequence
  Description of Artificial Sequence: Synthetic oligonucleotide
  Target: ATXN1; (+) strand; PAM type: YTN; PAM sequence: CTC
atgttttcaatttaagtatg

SEQ ID NO: 247100 - DNA, 20 bp, Artificial Sequence
  Description of Artificial Sequence: Synthetic oligonucleotide
  Target: ATXN1; (+) strand; PAM type: YTN; PAM sequence: TTT
tcaatttaagtatgtctgtt

SEQ ID NO: 247101 - DNA, 20 bp, Artificial Sequence
  Description of Artificial Sequence: Synthetic oligonucleotide
  Target: ATXN1; (+) strand; PAM type: YTN; PAM sequence: TTT
caatttaagtatgtctgttg

SEQ ID NO: 247102 - DNA, 20 bp, Artificial Sequence
  Description of Artificial Sequence: Synthetic oligonucleotide
  Target: ATXN1; (+) strand; PAM type: YTN; PAM sequence: TTC
aatttaagtatgtctgttgt

SEQ ID NO: 247103 - DNA, 20 bp, Artificial Sequence
  Description of Artificial Sequence: Synthetic oligonucleotide
  Target: ATXN1; (+) strand; PAM type: YTN; PAM sequence: TTT
aagtatgtctgttgtttgct

SEQ ID NO: 247104 - DNA, 20 bp, Artificial Sequence
  Description of Artificial Sequence: Synthetic oligonucleotide
  Target: ATXN1; (+) strand; PAM type: YTN; PAM sequence: TTA
agtatgtctgttgtttgctg

SEQ ID NO: 247105 - DNA, 20 bp, Artificial Sequence
  Description of Artificial Sequence: Synthetic oligonucleotide
  Target: ATXN1; (+) strand; PAM type: YTN; PAM sequence: CTG
ttgtttgctgtttattcctt

SEQ ID NO: 247106 - DNA, 20 bp, Artificial Sequence
  Description of Artificial Sequence: Synthetic oligonucleotide
  Target: ATXN1; (+) strand; PAM type: YTN; PAM sequence: TTG
tttgctgtttattcctttgg

SEQ ID NO: 247107 - DNA, 20 bp, Artificial Sequence
  Description of Artificial Sequence: Synthetic oligonucleotide
  Target: ATXN1; (+) strand; PAM type: YTN; PAM sequence: TTT
gctgtttattcctttggtat

SEQ ID NO: 247108 - DNA, 20 bp, Artificial Sequence
  Description of Artificial Sequence: Synthetic oligonucleotide
  Target: ATXN1; (+) strand; PAM type: YTN; PAM sequence: TTG
ctgtttattcctttggtata

SEQ ID NO: 247109 - DNA, 20 bp, Artificial Sequence
  Description of Artificial Sequence: Synthetic oligonucleotide
  Target: ATXN1; (+) strand; PAM type: YTN; PAM sequence: CTG
tttattcctttggtataaat

SEQ ID NO: 247110 - DNA, 20 bp, Artificial Sequence
  Description of Artificial Sequence: Synthetic oligonucleotide
  Target: ATXN1; (+) strand; PAM type: YTN; PAM sequence: TTT
attcctttggtataaataga

SEQ ID NO: 247111 - DNA, 20 bp, Artificial Sequence
  Description of Artificial Sequence: Synthetic oligonucleotide
  Target: ATXN1; (+) strand; PAM type: YTN; PAM sequence: TTA
ttcctttggtataaatagaa

SEQ ID NO: 247112 - DNA, 20 bp, Artificial Sequence
  Description of Artificial Sequence: Synthetic oligonucleotide
  Target: ATXN1; (+) strand; PAM type: YTN; PAM sequence: TTC
ctttggtataaatagaagct

SEQ ID NO: 247113 - DNA, 20 bp, Artificial Sequence
  Description of Artificial Sequence: Synthetic oligonucleotide
  Target: ATXN1; (+) strand; PAM type: YTN; PAM sequence: CTT
tggtataaatagaagctttc

SEQ ID NO: 247114 - DNA, 20 bp, Artificial Sequence
  Description of Artificial Sequence: Synthetic oligonucleotide
  Target: ATXN1; (+) strand; PAM type: YTN; PAM sequence: TTT
ggtataaatagaagctttct

SEQ ID NO: 247115 - DNA, 20 bp, Artificial Sequence
  Description of Artificial Sequence: Synthetic oligonucleotide
  Target: ATXN1; (+) strand; PAM type: YTN; PAM sequence: TTG
gtataaatagaagctttctg

SEQ ID NO: 247116 - DNA, 20 bp, Artificial Sequence
  Description of Artificial Sequence: Synthetic oligonucleotide
  Target: ATXN1; (+) strand; PAM type: YTN; PAM sequence: CTT
tctggcttatttgaacgcag

SEQ ID NO: 247117 - DNA, 20 bp, Artificial Sequence
  Description of Artificial Sequence: Synthetic oligonucleotide
  Target: ATXN1; (+) strand; PAM type: YTN; PAM sequence: TTT
ctggcttatttgaacgcaga

SEQ ID NO: 247118 - DNA, 20 bp, Artificial Sequence
  Description of Artificial Sequence: Synthetic oligonucleotide
  Target: ATXN1; (+) strand; PAM type: YTN; PAM sequence: TTC
tggcttatttgaacgcagaa

SEQ ID NO: 247119 - DNA, 20 bp, Artificial Sequence
  Description of Artificial Sequence: Synthetic oligonucleotide
  Target: ATXN1; (+) strand; PAM type: YTN; PAM sequence: CTG
gcttatttgaacgcagaaca

SEQ ID NO: 247120 - DNA, 20 bp, Artificial Sequence
  Description of Artificial Sequence: Synthetic oligonucleotide
  Target: ATXN1; (+) strand; PAM type: YTN; PAM sequence: CTT
atttgaacgcagaacacata

SEQ ID NO: 247121 - DNA, 20 bp, Artificial Sequence
  Description of Artificial Sequence: Synthetic oligonucleotide
  Target: ATXN1; (+) strand; PAM type: YTN; PAM sequence: TTA
tttgaacgcagaacacatag

SEQ ID NO: 247122 - DNA, 20 bp, Artificial Sequence
  Description of Artificial Sequence: Synthetic oligonucleotide
  Target: ATXN1; (+) strand; PAM type: YTN; PAM sequence: TTT
gaacgcagaacacatagtac

SEQ ID NO: 247123 - DNA, 20 bp, Artificial Sequence
  Description of Artificial Sequence: Synthetic oligonucleotide
  Target: ATXN1; (+) strand; PAM type: YTN; PAM sequence: TTG
aacgcagaacacatagtaca

SEQ ID NO: 247124 - DNA, 20 bp, Artificial Sequence
  Description of Artificial Sequence: Synthetic oligonucleotide
  Target: ATXN1; (+) strand; PAM type: YTN; PAM sequence: CTG
tttagatacaattattcatt

SEQ ID NO: 247125 - DNA, 20 bp, Artificial Sequence
  Description of Artificial Sequence: Synthetic oligonucleotide
  Target: ATXN1; (+) strand; PAM type: YTN; PAM sequence: TTT
agatacaattattcattata

SEQ ID NO: 247126 - DNA, 20 bp, Artificial Sequence
  Description of Artificial Sequence: Synthetic oligonucleotide
  Target: ATXN1; (+) strand; PAM type: YTN; PAM sequence: TTA
gatacaattattcattataa

SEQ ID NO: 247127 - DNA, 20 bp, Artificial Sequence
  Description of Artificial Sequence: Synthetic oligonucleotide
  Target: ATXN1; (+) strand; PAM type: YTN; PAM sequence: TTA
ttcattataaattaaatcaa

SEQ ID NO: 247128 - DNA, 20 bp, Artificial Sequence
  Description of Artificial Sequence: Synthetic oligonucleotide
  Target: ATXN1; (+) strand; PAM type: YTN; PAM sequence: TTC
attataaattaaatcaatgc

SEQ ID NO: 247129 - DNA, 20 bp, Artificial Sequence
  Description of Artificial Sequence: Synthetic oligonucleotide
  Target: ATXN1; (+) strand; PAM type: YTN; PAM sequence: TTA
taaattaaatcaatgctttt

SEQ ID NO: 247130 - DNA, 20 bp, Artificial Sequence
  Description of Artificial Sequence: Synthetic oligonucleotide
  Target: ATXN1; (+) strand; PAM type: YTN; PAM sequence: TTA
aatcaatgcttttccttttt

SEQ ID NO: 247131 - DNA, 20 bp, Artificial Sequence
  Description of Artificial Sequence: Synthetic oligonucleotide
  Target: ATXN1; (+) strand; PAM type: YTN; PAM sequence: CTT
ttcctttttagaataccatg

SEQ ID NO: 247132 - DNA, 20 bp, Artificial Sequence
  Description of Artificial Sequence: Synthetic oligonucleotide
  Target: ATXN1; (+) strand; PAM type: YTN; PAM sequence: TTT
tcctttttagaataccatgc

SEQ ID NO: 247133 - DNA, 20 bp, Artificial Sequence
  Description of Artificial Sequence: Synthetic oligonucleotide
  Target: ATXN1; (+) strand; PAM type: YTN; PAM sequence: TTT
cctttttagaataccatgcc

SEQ ID NO: 247134 - DNA, 20 bp, Artificial Sequence
  Description of Artificial Sequence: Synthetic oligonucleotide
  Target: ATXN1; (+) strand; PAM type: YTN; PAM sequence: TTC
ctttttagaataccatgccc

SEQ ID NO: 247135 - DNA, 20 bp, Artificial Sequence
  Description of Artificial Sequence: Synthetic oligonucleotide
  Target: ATXN1; (+) strand; PAM type: YTN; PAM sequence: CTT
tttagaataccatgccctaa

SEQ ID NO: 247136 - DNA, 20 bp, Artificial Sequence
  Description of Artificial Sequence: Synthetic oligonucleotide
  Target: ATXN1; (+) strand; PAM type: YTN; PAM sequence: TTT
ttagaataccatgccctaac

SEQ ID NO: 247137 - DNA, 20 bp, Artificial Sequence
  Description of Artificial Sequence: Synthetic oligonucleotide
  Target: ATXN1; (+) strand; PAM type: YTN; PAM sequence: TTT
tagaataccatgccctaact

SEQ ID NO: 247138 - DNA, 20 bp, Artificial Sequence
  Description of Artificial Sequence: Synthetic oligonucleotide
  Target: ATXN1; (+) strand; PAM type: YTN; PAM sequence: TTT
agaataccatgccctaacta

SEQ ID NO: 247139 - DNA, 20 bp, Artificial Sequence
  Description of Artificial Sequence: Synthetic oligonucleotide
  Target: ATXN1; (+) strand; PAM type: YTN; PAM sequence: TTA
gaataccatgccctaactag

SEQ ID NO: 247140 - DNA, 20 bp, Artificial Sequence
  Description of Artificial Sequence: Synthetic oligonucleotide
  Target: ATXN1; (+) strand; PAM type: YTN; PAM sequence: CTA
actagaatctctacaacatt

SEQ ID NO: 247141 - DNA, 20 bp, Artificial Sequence
  Description of Artificial Sequence: Synthetic oligonucleotide
  Target: ATXN1; (+) strand; PAM type: YTN; PAM sequence: CTA
gaatctctacaacattataa

SEQ ID NO: 247142 - DNA, 20 bp, Artificial Sequence
  Description of Artificial Sequence: Synthetic oligonucleotide
  Target: ATXN1; (+) strand; PAM type: YTN; PAM sequence: CTC
tacaacattataaaaacata

SEQ ID NO: 247143 - DNA, 20 bp, Artificial Sequence
  Description of Artificial Sequence: Synthetic oligonucleotide
  Target: ATXN1; (+) strand; PAM type: YTN; PAM sequence: CTA
caacattataaaaacataaa

SEQ ID NO: 247144 - DNA, 20 bp, Artificial Sequence
  Description of Artificial Sequence: Synthetic oligonucleotide
  Target: ATXN1; (+) strand; PAM type: YTN; PAM sequence: TTA
taaaaacataaaatatgact

SEQ ID NO: 247145 - DNA, 20 bp, Artificial Sequence
  Description of Artificial Sequence: Synthetic oligonucleotide
  Target: ATXN1; (+) strand; PAM type: YTN; PAM sequence: CTA
acgatttaatttaaggccct

SEQ ID NO: 247146 - DNA, 20 bp, Artificial Sequence
  Description of Artificial Sequence: Synthetic oligonucleotide
  Target: ATXN1; (+) strand; PAM type: YTN; PAM sequence: TTT
aatttaaggccctaattccc

SEQ ID NO: 247147 - DNA, 20 bp, Artificial Sequence
  Description of Artificial Sequence: Synthetic oligonucleotide
  Target: ATXN1; (+) strand; PAM type: YTN; PAM sequence: TTA
atttaaggccctaattccca

SEQ ID NO: 247148 - DNA, 20 bp, Artificial Sequence
  Description of Artificial Sequence: Synthetic oligonucleotide
  Target: ATXN1; (+) strand; PAM type: YTN; PAM sequence: TTT
aaggccctaattcccaatga

SEQ ID NO: 247149 - DNA, 20 bp, Artificial Sequence
  Description of Artificial Sequence: Synthetic oligonucleotide
  Target: ATXN1; (+) strand; PAM type: YTN; PAM sequence: TTA
aggccctaattcccaatgaa

SEQ ID NO: 247150 - DNA, 20 bp, Artificial Sequence
  Description of Artificial Sequence: Synthetic oligonucleotide
  Target: ATXN1; (+) strand; PAM type: YTN; PAM sequence: CTA
attcccaatgaaagataaat

SEQ ID NO: 247151 - DNA, 20 bp, Artificial Sequence
  Description of Artificial Sequence: Synthetic oligonucleotide
  Target: ATXN1; (+) strand; PAM type: YTN; PAM sequence: TTC
ccaatgaaagataaataatg

SEQ ID NO: 247152 - DNA, 20 bp, Artificial Sequence
  Description of Artificial Sequence: Synthetic oligonucleotide
  Target: ATXN1; (+) strand; PAM type: YTN; PAM sequence: CTG
ctgtaggcaccaatgactgt

SEQ ID NO: 247153 - DNA, 20 bp, Artificial Sequence
  Description of Artificial Sequence: Synthetic oligonucleotide
  Target: ATXN1; (+) strand; PAM type: YTN; PAM sequence: CTG
taggcaccaatgactgtaat

SEQ ID NO: 247154 - DNA, 20 bp, Artificial Sequence
  Description of Artificial Sequence: Synthetic oligonucleotide
  Target: ATXN1; (+) strand; PAM type: YTN; PAM sequence: CTG
taatctaaacaggcaataaa

SEQ ID NO: 247155 - DNA, 20 bp, Artificial Sequence
  Description of Artificial Sequence: Synthetic oligonucleotide
  Target: ATXN1; (+) strand; PAM type: YTN; PAM sequence: CTA
aacaggcaataaaatattta

SEQ ID NO: 247156 - DNA, 20 bp, Artificial Sequence
  Description of Artificial Sequence: Synthetic oligonucleotide
  Target: ATXN1; (+) strand; PAM type: YTN; PAM sequence: TTT
aatggacaagcggaaatgca

SEQ ID NO: 247157 - DNA, 20 bp, Artificial Sequence
  Description of Artificial Sequence: Synthetic oligonucleotide
  Target: ATXN1; (+) strand; PAM type: YTN; PAM sequence: TTA
atggacaagcggaaatgcaa

SEQ ID NO: 247158 - DNA, 20 bp, Artificial Sequence
  Description of Artificial Sequence: Synthetic oligonucleotide
  Target: ATXN1; (+) strand; PAM type: YTN; PAM sequence: CTC
ctgtttacaacaaagctcat

SEQ ID NO: 247159 - DNA, 20 bp, Artificial Sequence
  Description of Artificial Sequence: Synthetic oligonucleotide
  Target: ATXN1; (+) strand; PAM type: YTN; PAM sequence: CTG
tttacaacaaagctcatttt

SEQ ID NO: 247160 - DNA, 20 bp, Artificial Sequence
  Description of Artificial Sequence: Synthetic oligonucleotide
  Target: ATXN1; (+) strand; PAM type: YTN; PAM sequence: TTT
acaacaaagctcattttcta

SEQ ID NO: 247161 - DNA, 20 bp, Artificial Sequence
  Description of Artificial Sequence: Synthetic oligonucleotide
  Target: ATXN1; (+) strand; PAM type: YTN; PAM sequence: TTA
caacaaagctcattttctat

SEQ ID NO: 247162 - DNA, 20 bp, Artificial Sequence
  Description of Artificial Sequence: Synthetic oligonucleotide
  Target: ATXN1; (+) strand; PAM type: YTN; PAM sequence: CTC
attttctatactagcactgt

SEQ ID NO: 247163 - DNA, 20 bp, Artificial Sequence
  Description of Artificial Sequence: Synthetic oligonucleotide
  Target: ATXN1; (+) strand; PAM type: YTN; PAM sequence: TTT
tctatactagcactgtggac

SEQ ID NO: 247164 - DNA, 20 bp, Artificial Sequence
  Description of Artificial Sequence: Synthetic oligonucleotide
  Target: ATXN1; (+) strand; PAM type: YTN; PAM sequence: TTT
ctatactagcactgtggacg

SEQ ID NO: 247165 - DNA, 20 bp, Artificial Sequence
  Description of Artificial Sequence: Synthetic oligonucleotide
  Target: ATXN1; (+) strand; PAM type: YTN; PAM sequence: TTC
tatactagcactgtggacgt

SEQ ID NO: 247166 - DNA, 20 bp, Artificial Sequence
  Description of Artificial Sequence: Synthetic oligonucleotide
  Target: ATXN1; (+) strand; PAM type: YTN; PAM sequence: CTA
tactagcactgtggacgtgg

SEQ ID NO: 247167 - DNA, 20 bp, Artificial Sequence
  Description of Artificial Sequence: Synthetic oligonucleotide
  Target: ATXN1; (+) strand; PAM type: YTN; PAM sequence: CTA
gcactgtggacgtggaagat

SEQ ID NO: 247168 - DNA, 20 bp, Artificial Sequence
  Description of Artificial Sequence: Synthetic oligonucleotide
  Target: ATXN1; (+) strand; PAM type: YTN; PAM sequence: CTG
tggacgtggaagatgcagtt

SEQ ID NO: 247169 - DNA, 20 bp, Artificial Sequence
  Description of Artificial Sequence: Synthetic oligonucleotide
  Target: ATXN1; (+) strand; PAM type: YTN; PAM sequence: TTA
acctctgtaagcctcagttt

SEQ ID NO: 247170 - DNA, 20 bp, Artificial Sequence
  Description of Artificial Sequence: Synthetic oligonucleotide
  Target: ATXN1; (+) strand; PAM type: YTN; PAM sequence: CTC
tgtaagcctcagtttcctca

SEQ ID NO: 247171 - DNA, 20 bp, Artificial Sequence
  Description of Artificial Sequence: Synthetic oligonucleotide
  Target: ATXN1; (+) strand; PAM type: YTN; PAM sequence: CTG
taagcctcagtttcctcatc

SEQ ID NO: 247172 - DNA, 20 bp, Artificial Sequence
  Description of Artificial Sequence: Synthetic oligonucleotide
  Target: ATXN1; (+) strand; PAM type: YTN; PAM sequence: CTC
agtttcctcatctggaatat

SEQ ID NO: 247173 - DNA, 20 bp, Artificial Sequence
  Description of Artificial Sequence: Synthetic oligonucleotide
  Target: ATXN1; (+) strand; PAM type: YTN; PAM sequence: TTT
cctcatctggaatatgtgaa

SEQ ID NO: 247174 - DNA, 20 bp, Artificial Sequence
  Description of Artificial Sequence: Synthetic oligonucleotide
  Target: ATXN1; (+) strand; PAM type: YTN; PAM sequence: TTC
ctcatctggaatatgtgaat

SEQ ID NO: 247175 - DNA, 20 bp, Artificial Sequence
  Description of Artificial Sequence: Synthetic oligonucleotide
  Target: ATXN1; (+) strand; PAM type: YTN; PAM sequence: CTC
atctggaatatgtgaatgat

SEQ ID NO: 247176 - DNA, 20 bp, Artificial Sequence
  Description of Artificial Sequence: Synthetic oligonucleotide
  Target: ATXN1; (+) strand; PAM type: YTN; PAM sequence: CTG
gaatatgtgaatgatgataa

SEQ ID NO: 247177 - DNA, 20 bp, Artificial Sequence
  Description of Artificial Sequence: Synthetic oligonucleotide
  Target: ATXN1; (+) strand; PAM type: YTN; PAM sequence: TTT
tcaaaagattgttgagatga

SEQ ID NO: 247178 - DNA, 20 bp, Artificial Sequence
  Description of Artificial Sequence: Synthetic oligonucleotide
  Target: ATXN1; (+) strand; PAM type: YTN; PAM sequence: TTT
caaaagattgttgagatgaa

SEQ ID NO: 247179 - DNA, 20 bp, Artificial Sequence
  Description of Artificial Sequence: Synthetic oligonucleotide
  Target: ATXN1; (+) strand; PAM type: YTN; PAM sequence: TTC
aaaagattgttgagatgaaa

SEQ ID NO: 247180 - DNA, 20 bp, Artificial Sequence
  Description of Artificial Sequence: Synthetic oligonucleotide
  Target: ATXN1; (+) strand; PAM type: YTN; PAM sequence: TTG
ttgagatgaaataaaagcaa

SEQ ID NO: 247181 - DNA, 20 bp, Artificial Sequence
  Description of Artificial Sequence: Synthetic oligonucleotide
  Target: ATXN1; (+) strand; PAM type: YTN; PAM sequence: TTG
agatgaaataaaagcaacta

SEQ ID NO: 247182 - DNA, 20 bp, Artificial Sequence
  Description of Artificial Sequence: Synthetic oligonucleotide
  Target: ATXN1; (+) strand; PAM type: YTN; PAM sequence: CTA
taatgcctagcataagaaaa

SEQ ID NO: 247183 - DNA, 20 bp, Artificial Sequence
  Description of Artificial Sequence: Synthetic oligonucleotide
  Target: ATXN1; (+) strand; PAM type: YTN; PAM sequence: CTA
gcataagaaaaaaaatccag

SEQ ID NO: 247184 - DNA, 20 bp, Artificial Sequence
  Description of Artificial Sequence: Synthetic oligonucleotide
  Target: ATXN1; (+) strand; PAM type: YTN; PAM sequence: TTC
ttcttcctgaacttcagtct

SEQ ID NO: 247185 - DNA, 20 bp, Artificial Sequence
  Description of Artificial Sequence: Synthetic oligonucleotide
  Target: ATXN1; (+) strand; PAM type: YTN; PAM sequence: CTT
cttcctgaacttcagtctca

SEQ ID NO: 247186 - DNA, 20 bp, Artificial Sequence
  Description of Artificial Sequence: Synthetic oligonucleotide
  Target: ATXN1; (+) strand; PAM type: YTN; PAM sequence: TTC
ttcctgaacttcagtctcag

SEQ ID NO: 247187 - DNA, 20 bp, Artificial Sequence
  Description of Artificial Sequence: Synthetic oligonucleotide
  Target: ATXN1; (+) strand; PAM type: YTN; PAM sequence: CTT
cctgaacttcagtctcagct

SEQ ID NO: 247188 - DNA, 20 bp, Artificial Sequence
  Description of Artificial Sequence: Synthetic oligonucleotide
  Target: ATXN1; (+) strand; PAM type: YTN; PAM sequence: TTC
ctgaacttcagtctcagctc

SEQ ID NO: 247189 - DNA, 20 bp, Artificial Sequence
  Description of Artificial Sequence: Synthetic oligonucleotide
  Target: ATXN1; (+) strand; PAM type: YTN; PAM sequence: CTG
aacttcagtctcagctcaag

SEQ ID NO: 247190 - DNA, 20 bp, Artificial Sequence
  Description of Artificial Sequence: Synthetic oligonucleotide
  Target: ATXN1; (+) strand; PAM type: YTN; PAM sequence: CTT
cagtctcagctcaagagtct

SEQ ID NO: 247191 - DNA, 20 bp, Artificial Sequence
  Description of Artificial Sequence: Synthetic oligonucleotide
  Target: ATXN1; (+) strand; PAM type: YTN; PAM sequence: TTC
agtctcagctcaagagtctg

SEQ ID NO: 247192 - DNA, 20 bp, Artificial Sequence
  Description of Artificial Sequence: Synthetic oligonucleotide
  Target: ATXN1; (+) strand; PAM type: YTN; PAM sequence: CTC
agctcaagagtctgtgagga

SEQ ID NO: 247193 - DNA, 20 bp, Artificial Sequence
  Description of Artificial Sequence: Synthetic oligonucleotide
  Target: ATXN1; (+) strand; PAM type: YTN; PAM sequence: CTC
aagagtctgtgaggaatttc

SEQ ID NO: 247194 - DNA, 20 bp, Artificial Sequence
  Description of Artificial Sequence: Synthetic oligonucleotide
  Target: ATXN1; (+) strand; PAM type: YTN; PAM sequence: CTG
tgaggaatttccacttggat

SEQ ID NO: 247195 - DNA, 20 bp, Artificial Sequence
  Description of Artificial Sequence: Synthetic oligonucleotide
  Target: ATXN1; (+) strand; PAM type: YTN; PAM sequence: TTT
ccacttggatgcttaccacc

SEQ ID NO: 247196 - DNA, 20 bp, Artificial Sequence
  Description of Artificial Sequence: Synthetic oligonucleotide
  Target: ATXN1; (+) strand; PAM type: YTN; PAM sequence: TTC
cacttggatgcttaccaccc

SEQ ID NO: 247197 - DNA, 20 bp, Artificial Sequence
  Description of Artificial Sequence: Synthetic oligonucleotide
  Target: ATXN1; (+) strand; PAM type: YTN; PAM sequence: CTT
ggatgcttaccacccctctc

SEQ ID NO: 247198 - DNA, 20 bp, Artificial Sequence
  Description of Artificial Sequence: Synthetic oligonucleotide
  Target: ATXN1; (+) strand; PAM type: YTN; PAM sequence: TTG
gatgcttaccacccctctca

SEQ ID NO: 247199 - DNA, 20 bp, Artificial Sequence
  Description of Artificial Sequence: Synthetic oligonucleotide
  Target: ATXN1; (+) strand; PAM type: YTN; PAM sequence: CTT
accacccctctcaaatcagc

SEQ ID NO: 247200 - DNA, 20 bp, Artificial Sequence
  Description of Artificial Sequence: Synthetic oligonucleotide
  Target: ATXN1; (+) strand; PAM type: YTN; PAM sequence: TTA
ccacccctctcaaatcagca

SEQ ID NO: 247201 - DNA, 20 bp, Artificial Sequence
  Description of Artificial Sequence: Synthetic oligonucleotide
  Target: ATXN1; (+) strand; PAM type: YTN; PAM sequence: CTC
tcaaatcagcatgcactccg

SEQ ID NO: 247202 - DNA, 20 bp, Artificial Sequence
  Description of Artificial Sequence: Synthetic oligonucleotide
  Target: ATXN1; (+) strand; PAM type: YTN; PAM sequence: CTC
aaatcagcatgcactccggt

SEQ ID NO: 247203 - DNA, 20 bp, Artificial Sequence
  Description of Artificial Sequence: Synthetic oligonucleotide
  Target: ATXN1; (+) strand; PAM type: YTN; PAM sequence: CTC
cggttccatatttctgctaa

SEQ ID NO: 247204 - DNA, 20 bp, Artificial Sequence
  Description of Artificial Sequence: Synthetic oligonucleotide
  Target: ATXN1; (+) strand; PAM type: YTN; PAM sequence: TTC
catatttctgctaacggttt

SEQ ID NO: 247205 - DNA, 20 bp, Artificial Sequence
  Description of Artificial Sequence: Synthetic oligonucleotide
  Target: ATXN1; (+) strand; PAM type: YTN; PAM sequence: TTT
ctgctaacggttttgcacca

SEQ ID NO: 247206 - DNA, 20 bp, Artificial Sequence
  Description of Artificial Sequence: Synthetic oligonucleotide
  Target: ATXN1; (+) strand; PAM type: YTN; PAM sequence: TTC
tgctaacggttttgcaccat

SEQ ID NO: 247207 - DNA, 20 bp, Artificial Sequence
  Description of Artificial Sequence: Synthetic oligonucleotide
  Target: ATXN1; (+) strand; PAM type: YTN; PAM sequence: CTG
ctaacggttttgcaccattt

SEQ ID NO: 247208 - DNA, 20 bp, Artificial Sequence
  Description of Artificial Sequence: Synthetic oligonucleotide
  Target: ATXN1; (+) strand; PAM type: YTN; PAM sequence: CTA
acggttttgcaccatttctc

SEQ ID NO: 247209 - DNA, 20 bp, Artificial Sequence
  Description of Artificial Sequence: Synthetic oligonucleotide
  Target: ATXN1; (+) strand; PAM type: YTN; PAM sequence: TTT
tgcaccatttctccaagcat

SEQ ID NO: 247210 - DNA, 20 bp, Artificial Sequence
  Description of Artificial Sequence: Synthetic oligonucleotide
  Target: ATXN1; (+) strand; PAM type: YTN; PAM sequence: TTT
gcaccatttctccaagcata

SEQ ID NO: 247211 - DNA, 20 bp, Artificial Sequence
  Description of Artificial Sequence: Synthetic oligonucleotide
  Target: ATXN1; (+) strand; PAM type: YTN; PAM sequence: TTG
caccatttctccaagcatag

SEQ ID NO: 247212 - DNA, 20 bp, Artificial Sequence
  Description of Artificial Sequence: Synthetic oligonucleotide
  Target: ATXN1; (+) strand; PAM type: YTN; PAM sequence: TTT
ctccaagcataggccagagc

SEQ ID NO: 247213 - DNA, 20 bp, Artificial Sequence
  Description of Artificial Sequence: Synthetic oligonucleotide
  Target: ATXN1; (+) strand; PAM type: YTN; PAM sequence: TTC
tccaagcataggccagagcc

SEQ ID NO: 247214 - DNA, 20 bp, Artificial Sequence
  Description of Artificial Sequence: Synthetic oligonucleotide
  Target: ATXN1; (+) strand; PAM type: YTN; PAM sequence: CTC
caagcataggccagagcctg

SEQ ID NO: 247215 - DNA, 20 bp, Artificial Sequence
  Description of Artificial Sequence: Synthetic oligonucleotide
  Target: ATXN1; (+) strand; PAM type: YTN; PAM sequence: CTG
atatttgatacctctctcgc

SEQ ID NO: 247216 - DNA, 20 bp, Artificial Sequence
  Description of Artificial Sequence: Synthetic oligonucleotide
  Target: ATXN1; (+) strand; PAM type: YTN; PAM sequence: TTT
gatacctctctcgcacttca

SEQ ID NO: 247217 - DNA, 20 bp, Artificial Sequence
  Description of Artificial Sequence: Synthetic oligonucleotide
  Target: ATXN1; (+) strand; PAM type: YTN; PAM sequence: TTG
atacctctctcgcacttcac

SEQ ID NO: 247218 - DNA, 20 bp, Artificial Sequence
  Description of Artificial Sequence: Synthetic oligonucleotide
  Target: ATXN1; (+) strand; PAM type: YTN; PAM sequence: CTC
tctcgcacttcactcctata

SEQ ID NO: 247219 - DNA, 20 bp, Artificial Sequence
  Description of Artificial Sequence: Synthetic oligonucleotide
  Target: ATXN1; (+) strand; PAM type: YTN; PAM sequence: CTC
tcgcacttcactcctatatc

SEQ ID NO: 247220 - DNA, 20 bp, Artificial Sequence
  Description of Artificial Sequence: Synthetic oligonucleotide
  Target: ATXN1; (+) strand; PAM type: YTN; PAM sequence: CTC
gcacttcactcctatatcca

SEQ ID NO: 247221 - DNA, 20 bp, Artificial Sequence
  Description of Artificial Sequence: Synthetic oligonucleotide
  Target: ATXN1; (+) strand; PAM type: YTN; PAM sequence: CTT
cactcctatatccagcgact

SEQ ID NO: 247222 - DNA, 20 bp, Artificial Sequence
  Description of Artificial Sequence: Synthetic oligonucleotide
  Target: ATXN1; (+) strand; PAM type: YTN; PAM sequence: TTC
actcctatatccagcgactc

SEQ ID NO: 247223 - DNA, 20 bp, Artificial Sequence
  Description of Artificial Sequence: Synthetic oligonucleotide
  Target: ATXN1; (+) strand; PAM type: YTN; PAM sequence: CTC
ctatatccagcgactcccct

SEQ ID NO: 247224 - DNA, 20 bp, Artificial Sequence
  Description of Artificial Sequence: Synthetic oligonucleotide
  Target: ATXN1; (+) strand; PAM type: YTN; PAM sequence: CTA
tatccagcgactcccctaat

SEQ ID NO: 247225 - DNA, 20 bp, Artificial Sequence
  Description of Artificial Sequence: Synthetic oligonucleotide
  Target: ATXN1; (+) strand; PAM type: YTN; PAM sequence: CTC
ccctaattgtgtcagtcttt

SEQ ID NO: 247226 - DNA, 20 bp, Artificial Sequence
  Description of Artificial Sequence: Synthetic oligonucleotide
  Target: ATXN1; (+) strand; PAM type: YTN; PAM sequence: CTA
attgtgtcagtctttcttca

SEQ ID NO: 247227 - DNA, 20 bp, Artificial Sequence
  Description of Artificial Sequence: Synthetic oligonucleotide
  Target: ATXN1; (+) strand; PAM type: YTN; PAM sequence: TTG
tgtcagtctttcttcaaaat

SEQ ID NO: 247228 - DNA, 20 bp, Artificial Sequence
  Description of Artificial Sequence: Synthetic oligonucleotide
  Target: ATXN1; (+) strand; PAM type: YTN; PAM sequence: CTT
tcttcaaaatgtctcaactc

SEQ ID NO: 247229 - DNA, 20 bp, Artificial Sequence
  Description of Artificial Sequence: Synthetic oligonucleotide
  Target: ATXN1; (+) strand; PAM type: YTN; PAM sequence: TTT
cttcaaaatgtctcaactct

SEQ ID NO: 247230 - DNA, 20 bp, Artificial Sequence
  Description of Artificial Sequence: Synthetic oligonucleotide
  Target: ATXN1; (+) strand; PAM type: YTN; PAM sequence: TTC
ttcaaaatgtctcaactctt

SEQ ID NO: 247231 - DNA, 20 bp, Artificial Sequence
  Description of Artificial Sequence: Synthetic oligonucleotide
  Target: ATXN1; (+) strand; PAM type: YTN; PAM sequence: CTT
caaaatgtctcaactcttgg

SEQ ID NO: 247232 - DNA, 20 bp, Artificial Sequence
  Description of Artificial Sequence: Synthetic oligonucleotide
  Target: ATXN1; (+) strand; PAM type: YTN; PAM sequence: TTC
aaaatgtctcaactcttggg

SEQ ID NO: 247233 - DNA, 20 bp, Artificial Sequence
  Description of Artificial Sequence: Synthetic oligonucleotide
  Target: ATXN1; (+) strand; PAM type: YTN; PAM sequence: CTC
aactcttggggtgaagcttg

SEQ ID NO: 247234 - DNA, 20 bp, Artificial Sequence
  Description of Artificial Sequence: Synthetic oligonucleotide
  Target: ATXN1; (+) strand; PAM type: YTN; PAM sequence: CTC
ttggggtgaagcttgaagtc

SEQ ID NO: 247235 - DNA, 20 bp, Artificial Sequence
  Description of Artificial Sequence: Synthetic oligonucleotide
  Target: ATXN1; (+) strand; PAM type: YTN; PAM sequence: CTT
ggggtgaagcttgaagtctc

SEQ ID NO: 247236 - DNA, 20 bp, Artificial Sequence
  Description of Artificial Sequence: Synthetic oligonucleotide
  Target: ATXN1; (+) strand; PAM type: YTN; PAM sequence: TTG
gggtgaagcttgaagtctct

SEQ ID NO: 247237 - DNA, 20 bp, Artificial Sequence
  Description of Artificial Sequence: Synthetic oligonucleotide
  Target: ATXN1; (+) strand; PAM type: YTN; PAM sequence: CTT
gaagtctctctttttcccat

SEQ ID NO: 247238 - DNA, 20 bp, Artificial Sequence
  Description of Artificial Sequence: Synthetic oligonucleotide
  Target: ATXN1; (+) strand; PAM type: YTN; PAM sequence: TTG
aagtctctctttttcccata

SEQ ID NO: 247239 - DNA, 20 bp, Artificial Sequence
  Description of Artificial Sequence: Synthetic oligonucleotide
  Target: ATXN1; (+) strand; PAM type: YTN; PAM sequence: CTC
tctttttcccatatttactg

SEQ ID NO: 247240 - DNA, 20 bp, Artificial Sequence
  Description of Artificial Sequence: Synthetic oligonucleotide
  Target: ATXN1; (+) strand; PAM type: YTN; PAM sequence: CTC
tttttcccatatttactgtg

SEQ ID NO: 247241 - DNA, 20 bp, Artificial Sequence
  Description of Artificial Sequence: Synthetic oligonucleotide
  Target: ATXN1; (+) strand; PAM type: YTN; PAM sequence: CTT
tttcccatatttactgtgta

SEQ ID NO: 247242 - DNA, 20 bp, Artificial Sequence
  Description of Artificial Sequence: Synthetic oligonucleotide
  Target: ATXN1; (+) strand; PAM type: YTN; PAM sequence: TTT
ttcccatatttactgtgtag

SEQ ID NO: 247243 - DNA, 20 bp, Artificial Sequence
  Description of Artificial Sequence: Synthetic oligonucleotide
  Target: ATXN1; (+) strand; PAM type: YTN; PAM sequence: TTT
tcccatatttactgtgtagg

SEQ ID NO: 247244 - DNA, 20 bp, Artificial Sequence
  Description of Artificial Sequence: Synthetic oligonucleotide
  Target: ATXN1; (+) strand; PAM type: YTN; PAM sequence: TTT
cccatatttactgtgtagga

SEQ ID NO: 247245 - DNA, 20 bp, Artificial Sequence
  Description of Artificial Sequence: Synthetic oligonucleotide
  Target: ATXN1; (+) strand; PAM type: YTN; PAM sequence: TTC
ccatatttactgtgtaggaa

SEQ ID NO: 247246 - DNA, 20 bp, Artificial Sequence
  Description of Artificial Sequence: Synthetic oligonucleotide
  Target: ATXN1; (+) strand; PAM type: YTN; PAM sequence: TTT
actgtgtaggaaagaatttg

SEQ ID NO: 247247 - DNA, 20 bp, Artificial Sequence
  Description of Artificial Sequence: Synthetic oligonucleotide
  Target: ATXN1; (+) strand; PAM type: YTN; PAM sequence: TTA
ctgtgtaggaaagaatttgg

SEQ ID NO: 247248 - DNA, 20 bp, Artificial Sequence
  Description of Artificial Sequence: Synthetic oligonucleotide
  Target: ATXN1; (+) strand; PAM type: YTN; PAM sequence: CTG
tgtaggaaagaatttggctt

SEQ ID NO: 247249 - DNA, 20 bp, Artificial Sequence
  Description of Artificial Sequence: Synthetic oligonucleotide
  Target: ATXN1; (+) strand; PAM type: YTN; PAM sequence: TTT
ggctttggccaaagacgggt

SEQ ID NO: 247250 - DNA, 20 bp, Artificial Sequence
  Description of Artificial Sequence: Synthetic oligonucleotide
  Target: ATXN1; (+) strand; PAM type: YTN; PAM sequence: TTG
gctttggccaaagacgggtc

SEQ ID NO: 247251 - DNA, 20 bp, Artificial Sequence
  Description of Artificial Sequence: Synthetic oligonucleotide
  Target: ATXN1; (+) strand; PAM type: YTN; PAM sequence: CTT
tggccaaagacgggtctgcc

SEQ ID NO: 247252 - DNA, 20 bp, Artificial Sequence
  Description of Artificial Sequence: Synthetic oligonucleotide
  Target: ATXN1; (+) strand; PAM type: YTN; PAM sequence: TTT
ggccaaagacgggtctgccc

SEQ ID NO: 247253 - DNA, 20 bp, Artificial Sequence
  Description of Artificial Sequence: Synthetic oligonucleotide
  Target: ATXN1; (+) strand; PAM type: YTN; PAM sequence: TTG
gccaaagacgggtctgccct

SEQ ID NO: 247254 - DNA, 20 bp, Artificial Sequence
  Description of Artificial Sequence: Synthetic oligonucleotide
  Target: ATXN1; (+) strand; PAM type: YTN; PAM sequence: CTG
ccctttgcccttggctcctg

SEQ ID NO: 247255 - DNA, 20 bp, Artificial Sequence
  Description of Artificial Sequence: Synthetic oligonucleotide
  Target: ATXN1; (+) strand; PAM type: YTN; PAM sequence: CTT
tgcccttggctcctgggaaa

SEQ ID NO: 247256 - DNA, 20 bp, Artificial Sequence
  Description of Artificial Sequence: Synthetic oligonucleotide
  Target: ATXN1; (+) strand; PAM type: YTN; PAM sequence: TTT
gcccttggctcctgggaaat

SEQ ID NO: 247257 - DNA, 20 bp, Artificial Sequence
  Description of Artificial Sequence: Synthetic oligonucleotide
  Target: ATXN1; (+) strand; PAM type: YTN; PAM sequence: TTG
cccttggctcctgggaaatg

SEQ ID NO: 247258 - DNA, 20 bp, Artificial Sequence
  Description of Artificial Sequence: Synthetic oligonucleotide
  Target: ATXN1; (+) strand; PAM type: YTN; PAM sequence: CTT
ggctcctgggaaatgatcta

SEQ ID NO: 247259 - DNA, 20 bp, Artificial Sequence
  Description of Artificial Sequence: Synthetic oligonucleotide
  Target: ATXN1; (+) strand; PAM type: YTN; PAM sequence: TTG
gctcctgggaaatgatctat

SEQ ID NO: 247260 - DNA, 20 bp, Artificial Sequence
  Description of Artificial Sequence: Synthetic oligonucleotide
  Target: ATXN1; (+) strand; PAM type: YTN; PAM sequence: CTC
ctgggaaatgatctatgtga

SEQ ID NO: 247261 - DNA, 20 bp, Artificial Sequence
  Description of Artificial Sequence: Synthetic oligonucleotide
  Target: ATXN1; (+) strand; PAM type: YTN; PAM sequence: CTG
ggaaatgatctatgtgatat

SEQ ID NO: 247262 - DNA, 20 bp, Artificial Sequence
  Description of Artificial Sequence: Synthetic oligonucleotide
  Target: ATXN1; (+) strand; PAM type: YTN; PAM sequence: CTA
tgtgatatctgatagtggtg

SEQ ID NO: 247263 - DNA, 20 bp, Artificial Sequence
  Description of Artificial Sequence: Synthetic oligonucleotide
  Target: ATXN1; (+) strand; PAM type: YTN; PAM sequence: CTG
atagtggtgtccctatttgt

SEQ ID NO: 247264 - DNA, 20 bp, Artificial Sequence
  Description of Artificial Sequence: Synthetic oligonucleotide
  Target: ATXN1; (+) strand; PAM type: YTN; PAM sequence: CTA
tttgtggggagggaaggatt

SEQ ID NO: 247265 - DNA, 20 bp, Artificial Sequence
  Description of Artificial Sequence: Synthetic oligonucleotide
  Target: ATXN1; (+) strand; PAM type: YTN; PAM sequence: TTT
gtggggagggaaggattttc

SEQ ID NO: 247266 - DNA, 20 bp, Artificial Sequence
  Description of Artificial Sequence: Synthetic oligonucleotide
  Target: ATXN1; (+) strand; PAM type: YTN; PAM sequence: TTG
tggggagggaaggattttca

SEQ ID NO: 247267 - DNA, 20 bp, Artificial Sequence
  Description of Artificial Sequence: Synthetic oligonucleotide
  Target: ATXN1; (+) strand; PAM type: YTN; PAM sequence: TTT
tcagtcacagcaaatcaccg

SEQ ID NO: 247268 - DNA, 20 bp, Artificial Sequence
  Description of Artificial Sequence: Synthetic oligonucleotide
  Target: ATXN1; (+) strand; PAM type: YTN; PAM sequence: TTT
cagtcacagcaaatcaccga

SEQ ID NO: 247269 - DNA, 20 bp, Artificial Sequence
  Description of Artificial Sequence: Synthetic oligonucleotide
  Target: ATXN1; (+) strand; PAM type: YTN; PAM sequence: TTC
agtcacagcaaatcaccgaa

SEQ ID NO: 247270 - DNA, 20 bp, Artificial Sequence
  Description of Artificial Sequence: Synthetic oligonucleotide
  Target: ATXN1; (+) strand; PAM type: YTN; PAM sequence: CTT
ggtttcctcattttaaaatg

SEQ ID NO: 247271 - DNA, 20 bp, Artificial Sequence
  Description of Artificial Sequence: Synthetic oligonucleotide
  Target: ATXN1; (+) strand; PAM type: YTN; PAM sequence: TTG
gtttcctcattttaaaatgg

SEQ ID NO: 247272 - DNA, 20 bp, Artificial Sequence
  Description of Artificial Sequence: Synthetic oligonucleotide
  Target: ATXN1; (+) strand; PAM type: YTN; PAM sequence: TTT
cctcattttaaaatgggaat

SEQ ID NO: 247273 - DNA, 20 bp, Artificial Sequence
  Description of Artificial Sequence: Synthetic oligonucleotide
  Target: ATXN1; (+) strand; PAM type: YTN; PAM sequence: TTC
ctcattttaaaatgggaatt

SEQ ID NO: 247274 - DNA, 20 bp, Artificial Sequence
  Description of Artificial Sequence: Synthetic oligonucleotide
  Target: ATXN1; (+) strand; PAM type: YTN; PAM sequence: CTC
attttaaaatgggaattggc

SEQ ID NO: 247275 - DNA, 20 bp, Artificial Sequence
  Description of Artificial Sequence: Synthetic oligonucleotide
  Target: ATXN1; (+) strand; PAM type: YTN; PAM sequence: TTT
taaaatgggaattggctggg

SEQ ID NO: 247276 - DNA, 20 bp, Artificial Sequence
  Description of Artificial Sequence: Synthetic oligonucleotide
  Target: ATXN1; (+) strand; PAM type: YTN; PAM sequence: TTT
aaaatgggaattggctgggt

SEQ ID NO: 247277 - DNA, 20 bp, Artificial Sequence
  Description of Artificial Sequence: Synthetic oligonucleotide
  Target: ATXN1; (+) strand; PAM type: YTN; PAM sequence: TTA
aaatgggaattggctgggtg

SEQ ID NO: 247278 - DNA, 20 bp, Artificial Sequence
  Description of Artificial Sequence: Synthetic oligonucleotide
  Target: ATXN1; (+) strand; PAM type: YTN; PAM sequence: TTG
gctgggtgtggtggctcaca

SEQ ID NO: 247279 - DNA, 20 bp, Artificial Sequence
  Description of Artificial Sequence: Synthetic oligonucleotide
  Target: ATXN1; (+) strand; PAM type: YTN; PAM sequence: CTG
ggtgtggtggctcacacctg

SEQ ID NO: 247280 - DNA, 20 bp, Artificial Sequence
  Description of Artificial Sequence: Synthetic oligonucleotide
  Target: ATXN1; (+) strand; PAM type: YTN; PAM sequence: CTC
acacctgtaatcccagcact

SEQ ID NO: 247281 - DNA, 20 bp, Artificial Sequence
  Description of Artificial Sequence: Synthetic oligonucleotide
  Target: ATXN1; (+) strand; PAM type: YTN; PAM sequence: CTG
taatcccagcacttcaggag

SEQ ID NO: 247282 - DNA, 20 bp, Artificial Sequence
  Description of Artificial Sequence: Synthetic oligonucleotide
  Target: ATXN1; (+) strand; PAM type: YTN; PAM sequence: CTT
caggaggccgaggcaggagg

SEQ ID NO: 247283 - DNA, 20 bp, Artificial Sequence
  Description of Artificial Sequence: Synthetic oligonucleotide
  Target: ATXN1; (+) strand; PAM type: YTN; PAM sequence: TTC
aggaggccgaggcaggagga

SEQ ID NO: 247284 - DNA, 20 bp, Artificial Sequence
  Description of Artificial Sequence: Synthetic oligonucleotide
  Target: ATXN1; (+) strand; PAM type: YTN; PAM sequence: CTA
tgtgaggccaggaattcgag

SEQ ID NO: 247285 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctgggtaacaa

SEQ ID NO: 247286 - DNA, 20 bp, Artificial Sequence
  Description of Artificial Sequence: Synthetic oligonucleotide
  Target: ATXN1; (+) strand; PAM type: YTN; PAM sequence: CTG
ggtaacaaagtgaggcctgt

SEQ ID NO: 247287 - DNA, 20 bp, Artificial Sequence
  Description of Artificial Sequence: Synthetic oligonucleotide
  Target: ATXN1; (+) strand; PAM type: YTN; PAM sequence: CTG
tctctacaaaataataaaaa

SEQ ID NO: 247288 - DNA, 20 bp, Artificial Sequence
  Description of Artificial Sequence: Synthetic oligonucleotide
  Target: ATXN1; (+) strand; PAM type: YTN; PAM sequence: CTC
tacaaaataataaaaaaatt

SEQ ID NO: 247289 - DNA, 20 bp, Artificial Sequence
  Description of Artificial Sequence: Synthetic oligonucleotide
  Target: ATXN1; (+) strand; PAM type: YTN; PAM sequence: CTA
caaaataataaaaaaattta

SEQ ID NO: 247290 - DNA, 20 bp, Artificial Sequence
  Description of Artificial Sequence: Synthetic oligonucleotide
  Target: ATXN1; (+) strand; PAM type: YTN; PAM sequence: TTT
aggcaggtgtggtggtgcat

SEQ ID NO: 247291 - DNA, 20 bp, Artificial Sequence
  Description of Artificial Sequence: Synthetic oligonucleotide
  Target: ATXN1; (+) strand; PAM type: YTN; PAM sequence: TTA
ggcaggtgtggtggtgcatg

SEQ ID NO: 247292 - DNA, 20 bp, Artificial Sequence
  Description of Artificial Sequence: Synthetic oligonucleotide
  Target: ATXN1; (+) strand; PAM type: YTN; PAM sequence: CTT
gcagtcccagcaacttggga

SEQ ID NO: 247293 - DNA, 20 bp, Artificial Sequence
  Description of Artificial Sequence: Synthetic oligonucleotide
  Target: ATXN1; (+) strand; PAM type: YTN; PAM sequence: TTG
cagtcccagcaacttgggag

SEQ ID NO: 247294 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggtgggagga

SEQ ID NO: 247295 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggtgggaggat

SEQ ID NO: 247296 - DNA, 20 bp, Artificial Sequence
  Description of Artificial Sequence: Synthetic oligonucleotide
  Target: ATXN1; (+) strand; PAM type: YTN; PAM sequence: CTG
aggtgggaggattgcttgag

SEQ ID NO: 247297 - DNA, 20 bp, Artificial Sequence
  Description of Artificial Sequence: Synthetic oligonucleotide
  Target: ATXN1; (+) strand; PAM type: YTN; PAM sequence: TTG
cttgagcctagcctgggaga

SEQ ID NO: 247298 - DNA, 20 bp, Artificial Sequence
  Description of Artificial Sequence: Synthetic oligonucleotide
  Target: ATXN1; (+) strand; PAM type: YTN; PAM sequence: CTT
gagcctagcctgggagatca

SEQ ID NO: 247299 - DNA, 20 bp, Artificial Sequence
  Description of Artificial Sequence: Synthetic oligonucleotide
  Target: ATXN1; (+) strand; PAM type: YTN; PAM sequence: TTG
agcctagcctgggagatcaa

SEQ ID NO: 247300 - DNA, 20 bp, Artificial Sequence
  Description of Artificial Sequence: Synthetic oligonucleotide
  Target: ATXN1; (+) strand; PAM type: YTN; PAM sequence: CTA
gcctgggagatcaaagctgc

SEQ ID NO: 247301 - DNA, 20 bp, Artificial Sequence
  Description of Artificial Sequence: Synthetic oligonucleotide
  Target: ATXN1; (+) strand; PAM type: YTN; PAM sequence: CTG
ggagatcaaagctgcattga

SEQ ID NO: 247302 - DNA, 20 bp, Artificial Sequence
  Description of Artificial Sequence: Synthetic oligonucleotide
  Target: ATXN1; (+) strand; PAM type: YTN; PAM sequence: CTG
cattgagctgagatcgcggc

SEQ ID NO: 247303 - DNA, 20 bp, Artificial Sequence
  Description of Artificial Sequence: Synthetic oligonucleotide
  Target: ATXN1; (+) strand; PAM type: YTN; PAM sequence: TTG
agctgagatcgcggcactgc

SEQ ID NO: 247304 - DNA, 20 bp, Artificial Sequence
  Description of Artificial Sequence: Synthetic oligonucleotide
  Target: ATXN1; (+) strand; PAM type: YTN; PAM sequence: CTG
agatcgcggcactgcactcc

SEQ ID NO: 247305 - DNA, 20 bp, Artificial Sequence
  Description of Artificial Sequence: Synthetic oligonucleotide
  Target: ATXN1; (+) strand; PAM type: YTN; PAM sequence: CTG
cactccaacctgggagacag

SEQ ID NO: 247306 - DNA, 20 bp, Artificial Sequence
  Description of Artificial Sequence: Synthetic oligonucleotide
  Target: ATXN1; (+) strand; PAM type: YTN; PAM sequence: CTC
caacctgggagacagaacaa

SEQ ID NO: 247307 - DNA, 20 bp, Artificial Sequence
  Description of Artificial Sequence: Synthetic oligonucleotide
  Target: ATXN1; (+) strand; PAM type: YTN; PAM sequence: CTG
ggagacagaacaagaccctg

SEQ ID NO: 247308 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaataaagaaaat

SEQ ID NO: 247309 - DNA, 20 bp, Artificial Sequence
  Description of Artificial Sequence: Synthetic oligonucleotide
  Target: ATXN1; (+) strand; PAM type: YTN; PAM sequence: CTC
aaaaaataaagaaaatggag

SEQ ID NO: 247310 - DNA, 20 bp, Artificial Sequence
  Description of Artificial Sequence: Synthetic oligonucleotide
  Target: ATXN1; (+) strand; PAM type: YTN; PAM sequence: CTA
cagggttagggtgatgacta

SEQ ID NO: 247311 - DNA, 20 bp, Artificial Sequence
  Description of Artificial Sequence: Synthetic oligonucleotide
  Target: ATXN1; (+) strand; PAM type: YTN; PAM sequence: TTA
gggtgatgactaaatgagat

SEQ ID NO: 247312 - DNA, 20 bp, Artificial Sequence
  Description of Artificial Sequence: Synthetic oligonucleotide
  Target: ATXN1; (+) strand; PAM type: YTN; PAM sequence: CTA
aatgagatgcattcaacaaa

SEQ ID NO: 247313 - DNA, 20 bp, Artificial Sequence
  Description of Artificial Sequence: Synthetic oligonucleotide
  Target: ATXN1; (+) strand; PAM type: YTN; PAM sequence: TTC
aacaaatgtgaggtagaaaa

SEQ ID NO: 247314 - DNA, 20 bp, Artificial Sequence
  Description of Artificial Sequence: Synthetic oligonucleotide
  Target: ATXN1; (+) strand; PAM type: YTN; PAM sequence: CTT
ctcttattcagcaggaactt

SEQ ID NO: 247315 - DNA, 20 bp, Artificial Sequence
  Description of Artificial Sequence: Synthetic oligonucleotide
  Target: ATXN1; (+) strand; PAM type: YTN; PAM sequence: TTC
tcttattcagcaggaacttt

SEQ ID NO: 247316 - DNA, 20 bp, Artificial Sequence
  Description of Artificial Sequence: Synthetic oligonucleotide
  Target: ATXN1; (+) strand; PAM type: YTN; PAM sequence: CTC
ttattcagcaggaactttat

SEQ ID NO: 247317 - DNA, 20 bp, Artificial Sequence
  Description of Artificial Sequence: Synthetic oligonucleotide
  Target: ATXN1; (+) strand; PAM type: YTN; PAM sequence: CTT
attcagcaggaactttatca

SEQ ID NO: 247318 - DNA, 20 bp, Artificial Sequence
  Description of Artificial Sequence: Synthetic oligonucleotide
  Target: ATXN1; (+) strand; PAM type: YTN; PAM sequence: TTA
ttcagcaggaactttatcaa

SEQ ID NO: 247319 - DNA, 20 bp, Artificial Sequence
  Description of Artificial Sequence: Synthetic oligonucleotide
  Target: ATXN1; (+) strand; PAM type: YTN; PAM sequence: TTC
agcaggaactttatcaatgt

SEQ ID NO: 247320 - DNA, 20 bp, Artificial Sequence
  Description of Artificial Sequence: Synthetic oligonucleotide
  Target: ATXN1; (+) strand; PAM type: YTN; PAM sequence: CTT
tatcaatgttcatttctttt

SEQ ID NO: 247321 - DNA, 20 bp, Artificial Sequence
  Description of Artificial Sequence: Synthetic oligonucleotide
  Target: ATXN1; (+) strand; PAM type: YTN; PAM sequence: TTT
atcaatgttcatttcttttt

SEQ ID NO: 247322 - DNA, 20 bp, Artificial Sequence
  Description of Artificial Sequence: Synthetic oligonucleotide
  Target: ATXN1; (+) strand; PAM type: YTN; PAM sequence: TTA
tcaatgttcatttctttttc

SEQ ID NO: 247323 - DNA, 20 bp, Artificial Sequence
  Description of Artificial Sequence: Synthetic oligonucleotide
  Target: ATXN1; (+) strand; PAM type: YTN; PAM sequence: TTC
atttctttttcttttataat

SEQ ID NO: 247324 - DNA, 20 bp, Artificial Sequence
  Description of Artificial Sequence: Synthetic oligonucleotide
  Target: ATXN1; (+) strand; PAM type: YTN; PAM sequence: TTT
ctttttcttttataattatg

SEQ ID NO: 247325 - DNA, 20 bp, Artificial Sequence
  Description of Artificial Sequence: Synthetic oligonucleotide
  Target: ATXN1; (+) strand; PAM type: YTN; PAM sequence: TTC
tttttcttttataattatga

SEQ ID NO: 247326 - DNA, 20 bp, Artificial Sequence
  Description of Artificial Sequence: Synthetic oligonucleotide
  Target: ATXN1; (+) strand; PAM type: YTN; PAM sequence: CTT
tttcttttataattatgaga

SEQ ID NO: 247327 - DNA, 20 bp, Artificial Sequence
  Description of Artificial Sequence: Synthetic oligonucleotide
  Target: ATXN1; (+) strand; PAM type: YTN; PAM sequence: TTT
ttcttttataattatgagaa

SEQ ID NO: 247328 - DNA, 20 bp, Artificial Sequence
  Description of Artificial Sequence: Synthetic oligonucleotide
  Target: ATXN1; (+) strand; PAM type: YTN; PAM sequence: TTT
tcttttataattatgagaac

SEQ ID NO: 247329 - DNA, 20 bp, Artificial Sequence
  Description of Artificial Sequence: Synthetic oligonucleotide
  Target: ATXN1; (+) strand; PAM type: YTN; PAM sequence: TTT
cttttataattatgagaaca

SEQ ID NO: 247330 - DNA, 20 bp, Artificial Sequence
  Description of Artificial Sequence: Synthetic oligonucleotide
  Target: ATXN1; (+) strand; PAM type: YTN; PAM sequence: TTC
ttttataattatgagaacat

SEQ ID NO: 247331 - DNA, 20 bp, Artificial Sequence
  Description of Artificial Sequence: Synthetic oligonucleotide
  Target: ATXN1; (+) strand; PAM type: YTN; PAM sequence: CTT
ttataattatgagaacatga

SEQ ID NO: 247332 - DNA, 20 bp, Artificial Sequence
  Description of Artificial Sequence: Synthetic oligonucleotide
  Target: ATXN1; (+) strand; PAM type: YTN; PAM sequence: TTT
tataattatgagaacatgaa

SEQ ID NO: 247333 - DNA, 20 bp, Artificial Sequence
  Description of Artificial Sequence: Synthetic oligonucleotide
  Target: ATXN1; (+) strand; PAM type: YTN; PAM sequence: TTT
ataattatgagaacatgaag

SEQ ID NO: 247334 - DNA, 20 bp, Artificial Sequence
  Description of Artificial Sequence: Synthetic oligonucleotide
  Target: ATXN1; (+) strand; PAM type: YTN; PAM sequence: TTA
taattatgagaacatgaagg

SEQ ID NO: 247335 - DNA, 20 bp, Artificial Sequence
  Description of Artificial Sequence: Synthetic oligonucleotide
  Target: ATXN1; (+) strand; PAM type: YTN; PAM sequence: TTA
tgagaacatgaaggaaatgg

SEQ ID NO: 247336 - DNA, 20 bp, Artificial Sequence
  Description of Artificial Sequence: Synthetic oligonucleotide
  Target: ATXN1; (+) strand; PAM type: YTN; PAM sequence: TTC
cagcagaattctgccaagat

SEQ ID NO: 247337 - DNA, 20 bp, Artificial Sequence
  Description of Artificial Sequence: Synthetic oligonucleotide
  Target: ATXN1; (+) strand; PAM type: YTN; PAM sequence: TTC
tgccaagattttcagtcttt

SEQ ID NO: 247338 - DNA, 20 bp, Artificial Sequence
  Description of Artificial Sequence: Synthetic oligonucleotide
  Target: ATXN1; (+) strand; PAM type: YTN; PAM sequence: CTG
ccaagattttcagtcttttc

SEQ ID NO: 247339 - DNA, 20 bp, Artificial Sequence
  Description of Artificial Sequence: Synthetic oligonucleotide
  Target: ATXN1; (+) strand; PAM type: YTN; PAM sequence: TTT
tcagtcttttcctgattggc

SEQ ID NO: 247340 - DNA, 20 bp, Artificial Sequence
  Description of Artificial Sequence: Synthetic oligonucleotide
  Target: ATXN1; (+) strand; PAM type: YTN; PAM sequence: TTT
cagtcttttcctgattggca

SEQ ID NO: 247341 - DNA, 20 bp, Artificial Sequence
  Description of Artificial Sequence: Synthetic oligonucleotide
  Target: ATXN1; (+) strand; PAM type: YTN; PAM sequence: TTC
agtcttttcctgattggcag

SEQ ID NO: 247342 - DNA, 20 bp, Artificial Sequence
  Description of Artificial Sequence: Synthetic oligonucleotide
  Target: ATXN1; (+) strand; PAM type: YTN; PAM sequence: CTT
ttcctgattggcagcagagc

SEQ ID NO: 247343 - DNA, 20 bp, Artificial Sequence
  Description of Artificial Sequence: Synthetic oligonucleotide
  Target: ATXN1; (+) strand; PAM type: YTN; PAM sequence: TTT
tcctgattggcagcagagca

SEQ ID NO: 247344 - DNA, 20 bp, Artificial Sequence
  Description of Artificial Sequence: Synthetic oligonucleotide
  Target: ATXN1; (+) strand; PAM type: YTN; PAM sequence: TTT
cctgattggcagcagagcat

SEQ ID NO: 247345 - DNA, 20 bp, Artificial Sequence
  Description of Artificial Sequence: Synthetic oligonucleotide
  Target: ATXN1; (+) strand; PAM type: YTN; PAM sequence: TTC
ctgattggcagcagagcatt

SEQ ID NO: 247346 - DNA, 20 bp, Artificial Sequence
  Description of Artificial Sequence: Synthetic oligonucleotide
  Target: ATXN1; (+) strand; PAM type: YTN; PAM sequence: CTG
attggcagcagagcatttcc

SEQ ID NO: 247347 - DNA, 20 bp, Artificial Sequence
  Description of Artificial Sequence: Synthetic oligonucleotide
  Target: ATXN1; (+) strand; PAM type: YTN; PAM sequence: TTG
gcagcagagcatttccattt

SEQ ID NO: 247348 - DNA, 20 bp, Artificial Sequence
  Description of Artificial Sequence: Synthetic oligonucleotide
  Target: ATXN1; (+) strand; PAM type: YTN; PAM sequence: TTT
ccattttcattttgagtttt

SEQ ID NO: 247349 - DNA, 20 bp, Artificial Sequence
  Description of Artificial Sequence: Synthetic oligonucleotide
  Target: ATXN1; (+) strand; PAM type: YTN; PAM sequence: TTC
cattttcattttgagttttg

SEQ ID NO: 247350 - DNA, 20 bp, Artificial Sequence
  Description of Artificial Sequence: Synthetic oligonucleotide
  Target: ATXN1; (+) strand; PAM type: YTN; PAM sequence: TTT
tcattttgagttttgctggt

SEQ ID NO: 247351 - DNA, 20 bp, Artificial Sequence
  Description of Artificial Sequence: Synthetic oligonucleotide
  Target: ATXN1; (+) strand; PAM type: YTN; PAM sequence: TTT
cattttgagttttgctggta

SEQ ID NO: 247352 - DNA, 20 bp, Artificial Sequence
  Description of Artificial Sequence: Synthetic oligonucleotide
  Target: ATXN1; (+) strand; PAM type: YTN; PAM sequence: TTC
attttgagttttgctggtat

SEQ ID NO: 247353 - DNA, 20 bp, Artificial Sequence
  Description of Artificial Sequence: Synthetic oligonucleotide
  Target: ATXN1; (+) strand; PAM type: YTN; PAM sequence: TTT
tgagttttgctggtattctt

SEQ ID NO: 247354 - DNA, 20 bp, Artificial Sequence
  Description of Artificial Sequence: Synthetic oligonucleotide
  Target: ATXN1; (+) strand; PAM type: YTN; PAM sequence: TTT
gagttttgctggtattcttc

SEQ ID NO: 247355 - DNA, 20 bp, Artificial Sequence
  Description of Artificial Sequence: Synthetic oligonucleotide
  Target: ATXN1; (+) strand; PAM type: YTN; PAM sequence: TTG
agttttgctggtattcttct

SEQ ID NO: 247356 - DNA, 20 bp, Artificial Sequence
  Description of Artificial Sequence: Synthetic oligonucleotide
  Target: ATXN1; (+) strand; PAM type: YTN; PAM sequence: TTT
tgctggtattcttctactaa

SEQ ID NO: 247357 - DNA, 20 bp, Artificial Sequence
  Description of Artificial Sequence: Synthetic oligonucleotide
  Target: ATXN1; (+) strand; PAM type: YTN; PAM sequence: TTT
gctggtattcttctactaag

SEQ ID NO: 247358 - DNA, 20 bp, Artificial Sequence
  Description of Artificial Sequence: Synthetic oligonucleotide
  Target: ATXN1; (+) strand; PAM type: YTN; PAM sequence: TTG
ctggtattcttctactaaga

SEQ ID NO: 247359 - DNA, 20 bp, Artificial Sequence
  Description of Artificial Sequence: Synthetic oligonucleotide
  Target: ATXN1; (+) strand; PAM type: YTN; PAM sequence: CTG
gtattcttctactaagaaac

SEQ ID NO: 247360 - DNA, 20 bp, Artificial Sequence
  Description of Artificial Sequence: Synthetic oligonucleotide
  Target: ATXN1; (+) strand; PAM type: YTN; PAM sequence: TTC
ttctactaagaaaccaattt

SEQ ID NO: 247361 - DNA, 20 bp, Artificial Sequence
  Description of Artificial Sequence: Synthetic oligonucleotide
  Target: ATXN1; (+) strand; PAM type: YTN; PAM sequence: CTT
ctactaagaaaccaattttt

SEQ ID NO: 247362 - DNA, 20 bp, Artificial Sequence
  Description of Artificial Sequence: Synthetic oligonucleotide
  Target: ATXN1; (+) strand; PAM type: YTN; PAM sequence: TTC
tactaagaaaccaatttttc

SEQ ID NO: 247363 - DNA, 20 bp, Artificial Sequence
  Description of Artificial Sequence: Synthetic oligonucleotide
  Target: ATXN1; (+) strand; PAM type: YTN; PAM sequence: CTA
ctaagaaaccaatttttccc

SEQ ID NO: 247364 - DNA, 20 bp, Artificial Sequence
  Description of Artificial Sequence: Synthetic oligonucleotide
  Target: ATXN1; (+) strand; PAM type: YTN; PAM sequence: CTA
agaaaccaatttttccccca

SEQ ID NO: 247365 - DNA, 20 bp, Artificial Sequence
  Description of Artificial Sequence: Synthetic oligonucleotide
  Target: ATXN1; (+) strand; PAM type: YTN; PAM sequence: TTT
ttcccccagtgaatgttttt

SEQ ID NO: 247366 - DNA, 20 bp, Artificial Sequence
  Description of Artificial Sequence: Synthetic oligonucleotide
  Target: ATXN1; (+) strand; PAM type: YTN; PAM sequence: TTT
tcccccagtgaatgtttttt

SEQ ID NO: 247367 - DNA, 20 bp, Artificial Sequence
  Description of Artificial Sequence: Synthetic oligonucleotide
  Target: ATXN1; (+) strand; PAM type: YTN; PAM sequence: TTT
cccccagtgaatgttttttt

SEQ ID NO: 247368 - DNA, 20 bp, Artificial Sequence
  Description of Artificial Sequence: Synthetic oligonucleotide
  Target: ATXN1; (+) strand; PAM type: YTN; PAM sequence: TTC
ccccagtgaatgttttttta

SEQ ID NO: 247369 - DNA, 20 bp, Artificial Sequence
  Description of Artificial Sequence: Synthetic oligonucleotide
  Target: ATXN1; (+) strand; PAM type: YTN; PAM sequence: TTT
ttttaatttcagggtttttt

SEQ ID NO: 247370 - DNA, 20 bp, Artificial Sequence
  Description of Artificial Sequence: Synthetic oligonucleotide
  Target: ATXN1; (+) strand; PAM type: YTN; PAM sequence: TTT
tttaatttcagggttttttt

SEQ ID NO: 247371 - DNA, 20 bp, Artificial Sequence
  Description of Artificial Sequence: Synthetic oligonucleotide
  Target: ATXN1; (+) strand; PAM type: YTN; PAM sequence: TTT
ttaatttcagggtttttttt

SEQ ID NO: 247372 - DNA, 20 bp, Artificial Sequence
  Description of Artificial Sequence: Synthetic oligonucleotide
  Target: ATXN1; (+) strand; PAM type: YTN; PAM sequence: TTT
taatttcagggttttttttt

SEQ ID NO: 247373 - DNA, 20 bp, Artificial Sequence
  Description of Artificial Sequence: Synthetic oligonucleotide
  Target: ATXN1; (+) strand; PAM type: YTN; PAM sequence: TTT
aatttcagggtttttttttt

SEQ ID NO: 247374 - DNA, 20 bp, Artificial Sequence
  Description of Artificial Sequence: Synthetic oligonucleotide
  Target: ATXN1; (+) strand; PAM type: YTN; PAM sequence: TTA
atttcagggttttttttttt

SEQ ID NO: 247375 - DNA, 20 bp, Artificial Sequence
  Description of Artificial Sequence: Synthetic oligonucleotide
  Target: ATXN1; (+) strand; PAM type: YTN; PAM sequence: TTT
cagggttttttttttttttt

SEQ ID NO: 247376 - DNA, 20 bp, Artificial Sequence
  Description of Artificial Sequence: Synthetic oligonucleotide
  Target: ATXN1; (+) strand; PAM type: YTN; PAM sequence: TTC
agggtttttttttttttttg

SEQ ID NO: 247377 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgaaacaag

SEQ ID NO: 247378 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgaaacaagg

SEQ ID NO: 247379 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgaaacaaggt

SEQ ID NO: 247380 - DNA, 20 bp, Artificial Sequence
  Description of Artificial Sequence: Synthetic oligonucleotide
  Target: ATXN1; (+) strand; PAM type: YTN; PAM sequence: TTT
tttttttttgaaacaaggtc

SEQ ID NO: 247381 - DNA, 20 bp, Artificial Sequence
  Description of Artificial Sequence: Synthetic oligonucleotide
  Target: ATXN1; (+) strand; PAM type: YTN; PAM sequence: TTT
ttttttttgaaacaaggtct

SEQ ID NO: 247382 - DNA, 20 bp, Artificial Sequence
  Description of Artificial Sequence: Synthetic oligonucleotide
  Target: ATXN1; (+) strand; PAM type: YTN; PAM sequence: TTT
tttttttgaaacaaggtctc

SEQ ID NO: 247383 - DNA, 20 bp, Artificial Sequence
  Description of Artificial Sequence: Synthetic oligonucleotide
  Target: ATXN1; (+) strand; PAM type: YTN; PAM sequence: TTT
ttttttgaaacaaggtctca

SEQ ID NO: 247384 - DNA, 20 bp, Artificial Sequence
  Description of Artificial Sequence: Synthetic oligonucleotide
  Target: ATXN1; (+) strand; PAM type: YTN; PAM sequence: TTT
tttttgaaacaaggtctcac

SEQ ID NO: 247385 - DNA, 20 bp, Artificial Sequence
  Description of Artificial Sequence: Synthetic oligonucleotide
  Target: ATXN1; (+) strand; PAM type: YTN; PAM sequence: TTT
ttttgaaacaaggtctcact

SEQ ID NO: 247386 - DNA, 20 bp, Artificial Sequence
  Description of Artificial Sequence: Synthetic oligonucleotide
  Target: ATXN1; (+) strand; PAM type: YTN; PAM sequence: TTT
tttgaaacaaggtctcactc

SEQ ID NO: 247387 - DNA, 20 bp, Artificial Sequence
  Description of Artificial Sequence: Synthetic oligonucleotide
  Target: ATXN1; (+) strand; PAM type: YTN; PAM sequence: TTT
ttgaaacaaggtctcactct

SEQ ID NO: 247388 - DNA, 20 bp, Artificial Sequence
  Description of Artificial Sequence: Synthetic oligonucleotide
  Target: ATXN1; (+) strand; PAM type: YTN; PAM sequence: TTT
tgaaacaaggtctcactctg

SEQ ID NO: 247389 - DNA, 20 bp, Artificial Sequence
  Description of Artificial Sequence: Synthetic oligonucleotide
  Target: ATXN1; (+) strand; PAM type: YTN; PAM sequence: TTT
gaaacaaggtctcactctgt

SEQ ID NO: 247390 - DNA, 20 bp, Artificial Sequence
  Description of Artificial Sequence: Synthetic oligonucleotide
  Target: ATXN1; (+) strand; PAM type: YTN; PAM sequence: TTG
aaacaaggtctcactctgtc

SEQ ID NO: 247391 - DNA, 20 bp, Artificial Sequence
  Description of Artificial Sequence: Synthetic oligonucleotide
  Target: ATXN1; (+) strand; PAM type: YTN; PAM sequence: CTC
actctgtcatacaggctgga

SEQ ID NO: 247392 - DNA, 20 bp, Artificial Sequence
  Description of Artificial Sequence: Synthetic oligonucleotide
  Target: ATXN1; (+) strand; PAM type: YTN; PAM sequence: CTC
tgtcatacaggctggagtgc

SEQ ID NO: 247393 - DNA, 20 bp, Artificial Sequence
  Description of Artificial Sequence: Synthetic oligonucleotide
  Target: ATXN1; (+) strand; PAM type: YTN; PAM sequence: CTG
tcatacaggctggagtgcag

SEQ ID NO: 247394 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggcccaatctt

SEQ ID NO: 247395 - DNA, 20 bp, Artificial Sequence
  Description of Artificial Sequence: Synthetic oligonucleotide
  Target: ATXN1; (+) strand; PAM type: YTN; PAM sequence: CTT
ggctcactgtagcttcgacc

SEQ ID NO: 247396 - DNA, 20 bp, Artificial Sequence
  Description of Artificial Sequence: Synthetic oligonucleotide
  Target: ATXN1; (+) strand; PAM type: YTN; PAM sequence: TTG
gctcactgtagcttcgacct

SEQ ID NO: 247397 - DNA, 20 bp, Artificial Sequence
  Description of Artificial Sequence: Synthetic oligonucleotide
  Target: ATXN1; (+) strand; PAM type: YTN; PAM sequence: CTC
actgtagcttcgacctccca

SEQ ID NO: 247398 - DNA, 20 bp, Artificial Sequence
  Description of Artificial Sequence: Synthetic oligonucleotide
  Target: ATXN1; (+) strand; PAM type: YTN; PAM sequence: CTG
tagcttcgacctcccaggct

SEQ ID NO: 247399 - DNA, 20 bp, Artificial Sequence
  Description of Artificial Sequence: Synthetic oligonucleotide
  Target: ATXN1; (+) strand; PAM type: YTN; PAM sequence: CTT
cgacctcccaggctcaagcc

SEQ ID NO: 247400 - DNA, 20 bp, Artificial Sequence
  Description of Artificial Sequence: Synthetic oligonucleotide
  Target: ATXN1; (+) strand; PAM type: YTN; PAM sequence: TTC
gacctcccaggctcaagcca

SEQ ID NO: 247401 - DNA, 20 bp, Artificial Sequence
  Description of Artificial Sequence: Synthetic oligonucleotide
  Target: ATXN1; (+) strand; PAM type: YTN; PAM sequence: CTC
ccaggctcaagccatccacc

SEQ ID NO: 247402 - DNA, 20 bp, Artificial Sequence
  Description of Artificial Sequence: Synthetic oligonucleotide
  Target: ATXN1; (+) strand; PAM type: YTN; PAM sequence: CTC
aagccatccacccacctctg

SEQ ID NO: 247403 - DNA, 20 bp, Artificial Sequence
  Description of Artificial Sequence: Synthetic oligonucleotide
  Target: ATXN1; (+) strand; PAM type: YTN; PAM sequence: CTC
tgcctcttgagttgctggga

SEQ ID NO: 247404 - DNA, 20 bp, Artificial Sequence
  Description of Artificial Sequence: Synthetic oligonucleotide
  Target: ATXN1; (+) strand; PAM type: YTN; PAM sequence: CTG
cctcttgagttgctgggact

SEQ ID NO: 247405 - DNA, 20 bp, Artificial Sequence
  Description of Artificial Sequence: Synthetic oligonucleotide
  Target: ATXN1; (+) strand; PAM type: YTN; PAM sequence: CTC
ttgagttgctgggactacag

SEQ ID NO: 247406 - DNA, 20 bp, Artificial Sequence
  Description of Artificial Sequence: Synthetic oligonucleotide
  Target: ATXN1; (+) strand; PAM type: YTN; PAM sequence: CTT
gagttgctgggactacaggc

SEQ ID NO: 247407 - DNA, 20 bp, Artificial Sequence
  Description of Artificial Sequence: Synthetic oligonucleotide
  Target: ATXN1; (+) strand; PAM type: YTN; PAM sequence: TTG
agttgctgggactacaggcg

SEQ ID NO: 247408 - DNA, 20 bp, Artificial Sequence
  Description of Artificial Sequence: Synthetic oligonucleotide
  Target: ATXN1; (+) strand; PAM type: YTN; PAM sequence: TTG
ctgggactacaggcgcatgc

SEQ ID NO: 247409 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcgcatgccac

SEQ ID NO: 247410 - DNA, 20 bp, Artificial Sequence
  Description of Artificial Sequence: Synthetic oligonucleotide
  Target: ATXN1; (+) strand; PAM type: YTN; PAM sequence: CTA
caggcgcatgccaccacgcc

SEQ ID NO: 247411 - DNA, 20 bp, Artificial Sequence
  Description of Artificial Sequence: Synthetic oligonucleotide
  Target: ATXN1; (+) strand; PAM type: YTN; PAM sequence: CTA
atttttgtagtttttgtaga

SEQ ID NO: 247412 - DNA, 20 bp, Artificial Sequence
  Description of Artificial Sequence: Synthetic oligonucleotide
  Target: ATXN1; (+) strand; PAM type: YTN; PAM sequence: TTT
ttgtagtttttgtagagacg

SEQ ID NO: 247413 - DNA, 20 bp, Artificial Sequence
  Description of Artificial Sequence: Synthetic oligonucleotide
  Target: ATXN1; (+) strand; PAM type: YTN; PAM sequence: TTT
tgtagtttttgtagagacgg

SEQ ID NO: 247414 - DNA, 20 bp, Artificial Sequence
  Description of Artificial Sequence: Synthetic oligonucleotide
  Target: ATXN1; (+) strand; PAM type: YTN; PAM sequence: TTT
gtagtttttgtagagacggg

SEQ ID NO: 247415 - DNA, 20 bp, Artificial Sequence
  Description of Artificial Sequence: Synthetic oligonucleotide
  Target: ATXN1; (+) strand; PAM type: YTN; PAM sequence: TTG
tagtttttgtagagacgggg

SEQ ID NO: 247416 - DNA, 20 bp, Artificial Sequence
  Description of Artificial Sequence: Synthetic oligonucleotide
  Target: ATXN1; (+) strand; PAM type: YTN; PAM sequence: TTT
ttgtagagacggggtttcac

SEQ ID NO: 247417 - DNA, 20 bp, Artificial Sequence
  Description of Artificial Sequence: Synthetic oligonucleotide
  Target: ATXN1; (+) strand; PAM type: YTN; PAM sequence: TTT
tgtagagacggggtttcacc

SEQ ID NO: 247418 - DNA, 20 bp, Artificial Sequence
  Description of Artificial Sequence: Synthetic oligonucleotide
  Target: ATXN1; (+) strand; PAM type: YTN; PAM sequence: TTT
gtagagacggggtttcacca

SEQ ID NO: 247419 - DNA, 20 bp, Artificial Sequence
  Description of Artificial Sequence: Synthetic oligonucleotide
  Target: ATXN1; (+) strand; PAM type: YTN; PAM sequence: TTG
tagagacggggtttcaccat

SEQ ID NO: 247420 - DNA, 20 bp, Artificial Sequence
  Description of Artificial Sequence: Synthetic oligonucleotide
  Target: ATXN1; (+) strand; PAM type: YTN; PAM sequence: TTT
caccatgttgtccaggcttg

SEQ ID NO: 247421 - DNA, 20 bp, Artificial Sequence
  Description of Artificial Sequence: Synthetic oligonucleotide
  Target: ATXN1; (+) strand; PAM type: YTN; PAM sequence: TTC
accatgttgtccaggcttgt

SEQ ID NO: 247422 - DNA, 20 bp, Artificial Sequence
  Description of Artificial Sequence: Synthetic oligonucleotide
  Target: ATXN1; (+) strand; PAM type: YTN; PAM sequence: TTG
tccaggcttgtcttgaactc

SEQ ID NO: 247423 - DNA, 20 bp, Artificial Sequence
  Description of Artificial Sequence: Synthetic oligonucleotide
  Target: ATXN1; (+) strand; PAM type: YTN; PAM sequence: CTT
gtcttgaactcttgggctca

SEQ ID NO: 247424 - DNA, 20 bp, Artificial Sequence
  Description of Artificial Sequence: Synthetic oligonucleotide
  Target: ATXN1; (+) strand; PAM type: YTN; PAM sequence: TTG
tcttgaactcttgggctcaa

SEQ ID NO: 247425 - DNA, 20 bp, Artificial Sequence
  Description of Artificial Sequence: Synthetic oligonucleotide
  Target: ATXN1; (+) strand; PAM type: YTN; PAM sequence: CTT
gaactcttgggctcaagaga

SEQ ID NO: 247426 - DNA, 20 bp, Artificial Sequence
  Description of Artificial Sequence: Synthetic oligonucleotide
  Target: ATXN1; (+) strand; PAM type: YTN; PAM sequence: TTG
aactcttgggctcaagagat

SEQ ID NO: 247427 - DNA, 20 bp, Artificial Sequence
  Description of Artificial Sequence: Synthetic oligonucleotide
  Target: ATXN1; (+) strand; PAM type: YTN; PAM sequence: CTC
ttgggctcaagagatctgcc

SEQ ID NO: 247428 - DNA, 20 bp, Artificial Sequence
  Description of Artificial Sequence: Synthetic oligonucleotide
  Target: ATXN1; (+) strand; PAM type: YTN; PAM sequence: CTT
gggctcaagagatctgcctg

SEQ ID NO: 247429 - DNA, 20 bp, Artificial Sequence
  Description of Artificial Sequence: Synthetic oligonucleotide
  Target: ATXN1; (+) strand; PAM type: YTN; PAM sequence: TTG
ggctcaagagatctgcctgt

SEQ ID NO: 247430 - DNA, 20 bp, Artificial Sequence
  Description of Artificial Sequence: Synthetic oligonucleotide
  Target: ATXN1; (+) strand; PAM type: YTN; PAM sequence: CTC
aagagatctgcctgtctcag

SEQ ID NO: 247431 - DNA, 20 bp, Artificial Sequence
  Description of Artificial Sequence: Synthetic oligonucleotide
  Target: ATXN1; (+) strand; PAM type: YTN; PAM sequence: CTG
cctgtctcagcctcccaaag

SEQ ID NO: 247432 - DNA, 20 bp, Artificial Sequence
  Description of Artificial Sequence: Synthetic oligonucleotide
  Target: ATXN1; (+) strand; PAM type: YTN; PAM sequence: CTG
tctcagcctcccaaagtgtt

SEQ ID NO: 247433 - DNA, 20 bp, Artificial Sequence
  Description of Artificial Sequence: Synthetic oligonucleotide
  Target: ATXN1; (+) strand; PAM type: YTN; PAM sequence: CTC
agcctcccaaagtgttggga

SEQ ID NO: 247434 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgttgggataacag

SEQ ID NO: 247435 - DNA, 20 bp, Artificial Sequence
  Description of Artificial Sequence: Synthetic oligonucleotide
  Target: ATXN1; (+) strand; PAM type: YTN; PAM sequence: TTG
ggataacaggcatgagctac

SEQ ID NO: 247436 - DNA, 20 bp, Artificial Sequence
  Description of Artificial Sequence: Synthetic oligonucleotide
  Target: ATXN1; (+) strand; PAM type: YTN; PAM sequence: CTA
ccacacccagcccattcttg

SEQ ID NO: 247437 - DNA, 20 bp, Artificial Sequence
  Description of Artificial Sequence: Synthetic oligonucleotide
  Target: ATXN1; (+) strand; PAM type: YTN; PAM sequence: TTC
ttgagtatgctggatcaata

SEQ ID NO: 247438 - DNA, 20 bp, Artificial Sequence
  Description of Artificial Sequence: Synthetic oligonucleotide
  Target: ATXN1; (+) strand; PAM type: YTN; PAM sequence: CTT
gagtatgctggatcaatatt

SEQ ID NO: 247439 - DNA, 20 bp, Artificial Sequence
  Description of Artificial Sequence: Synthetic oligonucleotide
  Target: ATXN1; (+) strand; PAM type: YTN; PAM sequence: TTG
agtatgctggatcaatattt

SEQ ID NO: 247440 - DNA, 20 bp, Artificial Sequence
  Description of Artificial Sequence: Synthetic oligonucleotide
  Target: ATXN1; (+) strand; PAM type: YTN; PAM sequence: CTG
gatcaatatttctccttgta

SEQ ID NO: 247441 - DNA, 20 bp, Artificial Sequence
  Description of Artificial Sequence: Synthetic oligonucleotide
  Target: ATXN1; (+) strand; PAM type: YTN; PAM sequence: TTT
ctccttgtaatgtaattcca

SEQ ID NO: 247442 - DNA, 20 bp, Artificial Sequence
  Description of Artificial Sequence: Synthetic oligonucleotide
  Target: ATXN1; (+) strand; PAM type: YTN; PAM sequence: TTC
tccttgtaatgtaattccaa

SEQ ID NO: 247443 - DNA, 20 bp, Artificial Sequence
  Description of Artificial Sequence: Synthetic oligonucleotide
  Target: ATXN1; (+) strand; PAM type: YTN; PAM sequence: CTC
cttgtaatgtaattccaaca

SEQ ID NO: 247444 - DNA, 20 bp, Artificial Sequence
  Description of Artificial Sequence: Synthetic oligonucleotide
  Target: ATXN1; (+) strand; PAM type: YTN; PAM sequence: CTT
gtaatgtaattccaacagaa

SEQ ID NO: 247445 - DNA, 20 bp, Artificial Sequence
  Description of Artificial Sequence: Synthetic oligonucleotide
  Target: ATXN1; (+) strand; PAM type: YTN; PAM sequence: TTG
taatgtaattccaacagaag

SEQ ID NO: 247446 - DNA, 20 bp, Artificial Sequence
  Description of Artificial Sequence: Synthetic oligonucleotide
  Target: ATXN1; (+) strand; PAM type: YTN; PAM sequence: TTC
caacagaagggaaaccaggc

SEQ ID NO: 247447 - DNA, 20 bp, Artificial Sequence
  Description of Artificial Sequence: Synthetic oligonucleotide
  Target: ATXN1; (+) strand; PAM type: YTN; PAM sequence: CTC
ctttcagtatcgcagcttga

SEQ ID NO: 247448 - DNA, 20 bp, Artificial Sequence
  Description of Artificial Sequence: Synthetic oligonucleotide
  Target: ATXN1; (+) strand; PAM type: YTN; PAM sequence: CTT
tcagtatcgcagcttgagcc

SEQ ID NO: 247449 - DNA, 20 bp, Artificial Sequence
  Description of Artificial Sequence: Synthetic oligonucleotide
  Target: ATXN1; (+) strand; PAM type: YTN; PAM sequence: TTT
cagtatcgcagcttgagcct

SEQ ID NO: 247450 - DNA, 20 bp, Artificial Sequence
  Description of Artificial Sequence: Synthetic oligonucleotide
  Target: ATXN1; (+) strand; PAM type: YTN; PAM sequence: TTC
agtatcgcagcttgagcctg

SEQ ID NO: 247451 - DNA, 20 bp, Artificial Sequence
  Description of Artificial Sequence: Synthetic oligonucleotide
  Target: ATXN1; (+) strand; PAM type: YTN; PAM sequence: CTT
gagcctgtcagcatcccctg

SEQ ID NO: 247452 - DNA, 20 bp, Artificial Sequence
  Description of Artificial Sequence: Synthetic oligonucleotide
  Target: ATXN1; (+) strand; PAM type: YTN; PAM sequence: TTG
agcctgtcagcatcccctga

SEQ ID NO: 247453 - DNA, 20 bp, Artificial Sequence
  Description of Artificial Sequence: Synthetic oligonucleotide
  Target: ATXN1; (+) strand; PAM type: YTN; PAM sequence: CTG
tcagcatcccctgatttcag

SEQ ID NO: 247454 - DNA, 20 bp, Artificial Sequence
  Description of Artificial Sequence: Synthetic oligonucleotide
  Target: ATXN1; (+) strand; PAM type: YTN; PAM sequence: CTG
atttcagaacgtaggctaca

SEQ ID NO: 247455 - DNA, 20 bp, Artificial Sequence
  Description of Artificial Sequence: Synthetic oligonucleotide
  Target: ATXN1; (+) strand; PAM type: YTN; PAM sequence: TTT
cagaacgtaggctacaaaca

SEQ ID NO: 247456 - DNA, 20 bp, Artificial Sequence
  Description of Artificial Sequence: Synthetic oligonucleotide
  Target: ATXN1; (+) strand; PAM type: YTN; PAM sequence: TTC
agaacgtaggctacaaacag

SEQ ID NO: 247457 - DNA, 20 bp, Artificial Sequence
  Description of Artificial Sequence: Synthetic oligonucleotide
  Target: ATXN1; (+) strand; PAM type: YTN; PAM sequence: CTA
caaacagtcccagatgtgtg

SEQ ID NO: 247458 - DNA, 20 bp, Artificial Sequence
  Description of Artificial Sequence: Synthetic oligonucleotide
  Target: ATXN1; (+) strand; PAM type: YTN; PAM sequence: CTG
acggtactacattcctggtc

SEQ ID NO: 247459 - DNA, 20 bp, Artificial Sequence
  Description of Artificial Sequence: Synthetic oligonucleotide
  Target: ATXN1; (+) strand; PAM type: YTN; PAM sequence: CTA
cattcctggtctttcacagc

SEQ ID NO: 247460 - DNA, 20 bp, Artificial Sequence
  Description of Artificial Sequence: Synthetic oligonucleotide
  Target: ATXN1; (+) strand; PAM type: YTN; PAM sequence: TTC
ctggtctttcacagcattta

SEQ ID NO: 247461 - DNA, 20 bp, Artificial Sequence
  Description of Artificial Sequence: Synthetic oligonucleotide
  Target: ATXN1; (+) strand; PAM type: YTN; PAM sequence: CTG
gtctttcacagcatttactt

SEQ ID NO: 247462 - DNA, 20 bp, Artificial Sequence
  Description of Artificial Sequence: Synthetic oligonucleotide
  Target: ATXN1; (+) strand; PAM type: YTN; PAM sequence: CTT
tcacagcatttactttggat

SEQ ID NO: 247463 - DNA, 20 bp, Artificial Sequence
  Description of Artificial Sequence: Synthetic oligonucleotide
  Target: ATXN1; (+) strand; PAM type: YTN; PAM sequence: TTT
cacagcatttactttggatt

SEQ ID NO: 247464 - DNA, 20 bp, Artificial Sequence
  Description of Artificial Sequence: Synthetic oligonucleotide
  Target: ATXN1; (+) strand; PAM type: YTN; PAM sequence: TTC
acagcatttactttggattg

SEQ ID NO: 247465 - DNA, 20 bp, Artificial Sequence
  Description of Artificial Sequence: Synthetic oligonucleotide
  Target: ATXN1; (+) strand; PAM type: YTN; PAM sequence: TTT
actttggattgggaaatggg

SEQ ID NO: 247466 - DNA, 20 bp, Artificial Sequence
  Description of Artificial Sequence: Synthetic oligonucleotide
  Target: ATXN1; (+) strand; PAM type: YTN; PAM sequence: TTA
ctttggattgggaaatggga

SEQ ID NO: 247467 - DNA, 20 bp, Artificial Sequence
  Description of Artificial Sequence: Synthetic oligonucleotide
  Target: ATXN1; (+) strand; PAM type: YTN; PAM sequence: CTT
tggattgggaaatgggaagt

SEQ ID NO: 247468 - DNA, 20 bp, Artificial Sequence
  Description of Artificial Sequence: Synthetic oligonucleotide
  Target: ATXN1; (+) strand; PAM type: YTN; PAM sequence: TTT
ggattgggaaatgggaagtg

SEQ ID NO: 247469 - DNA, 20 bp, Artificial Sequence
  Description of Artificial Sequence: Synthetic oligonucleotide
  Target: ATXN1; (+) strand; PAM type: YTN; PAM sequence: TTG
gattgggaaatgggaagtga

SEQ ID NO: 247470 - DNA, 20 bp, Artificial Sequence
  Description of Artificial Sequence: Synthetic oligonucleotide
  Target: ATXN1; (+) strand; PAM type: YTN; PAM sequence: TTG
ggaaatgggaagtgaggtct

SEQ ID NO: 247471 - DNA, 20 bp, Artificial Sequence
  Description of Artificial Sequence: Synthetic oligonucleotide
  Target: ATXN1; (+) strand; PAM type: YTN; PAM sequence: CTC
tctttcagtatgagattatt

SEQ ID NO: 247472 - DNA, 20 bp, Artificial Sequence
  Description of Artificial Sequence: Synthetic oligonucleotide
  Target: ATXN1; (+) strand; PAM type: YTN; PAM sequence: CTC
tttcagtatgagattatttc

SEQ ID NO: 247473 - DNA, 20 bp, Artificial Sequence
  Description of Artificial Sequence: Synthetic oligonucleotide
  Target: ATXN1; (+) strand; PAM type: YTN; PAM sequence: CTT
tcagtatgagattatttctt

SEQ ID NO: 247474 - DNA, 20 bp, Artificial Sequence
  Description of Artificial Sequence: Synthetic oligonucleotide
  Target: ATXN1; (+) strand; PAM type: YTN; PAM sequence: TTT
cagtatgagattatttctta

SEQ ID NO: 247475 - DNA, 20 bp, Artificial Sequence
  Description of Artificial Sequence: Synthetic oligonucleotide
  Target: ATXN1; (+) strand; PAM type: YTN; PAM sequence: TTC
agtatgagattatttcttag

SEQ ID NO: 247476 - DNA, 20 bp, Artificial Sequence
  Description of Artificial Sequence: Synthetic oligonucleotide
  Target: ATXN1; (+) strand; PAM type: YTN; PAM sequence: TTA
tttcttagaacaggttagtt

SEQ ID NO: 247477 - DNA, 20 bp, Artificial Sequence
  Description of Artificial Sequence: Synthetic oligonucleotide
  Target: ATXN1; (+) strand; PAM type: YTN; PAM sequence: TTT
cttagaacaggttagtttgg

SEQ ID NO: 247478 - DNA, 20 bp, Artificial Sequence
  Description of Artificial Sequence: Synthetic oligonucleotide
  Target: ATXN1; (+) strand; PAM type: YTN; PAM sequence: TTC
ttagaacaggttagtttggc

SEQ ID NO: 247479 - DNA, 20 bp, Artificial Sequence
  Description of Artificial Sequence: Synthetic oligonucleotide
  Target: ATXN1; (+) strand; PAM type: YTN; PAM sequence: CTT
agaacaggttagtttggcct

SEQ ID NO: 247480 - DNA, 20 bp, Artificial Sequence
  Description of Artificial Sequence: Synthetic oligonucleotide
  Target: ATXN1; (+) strand; PAM type: YTN; PAM sequence: TTA
gaacaggttagtttggcctt

SEQ ID NO: 247481 - DNA, 20 bp, Artificial Sequence
  Description of Artificial Sequence: Synthetic oligonucleotide
  Target: ATXN1; (+) strand; PAM type: YTN; PAM sequence: TTA
gtttggcctttgctaaaata

SEQ ID NO: 247482 - DNA, 20 bp, Artificial Sequence
  Description of Artificial Sequence: Synthetic oligonucleotide
  Target: ATXN1; (+) strand; PAM type: YTN; PAM sequence: TTT
ggcctttgctaaaatataaa

SEQ ID NO: 247483 - DNA, 20 bp, Artificial Sequence
  Description of Artificial Sequence: Synthetic oligonucleotide
  Target: ATXN1; (+) strand; PAM type: YTN; PAM sequence: TTG
gcctttgctaaaatataaat

SEQ ID NO: 247484 - DNA, 20 bp, Artificial Sequence
  Description of Artificial Sequence: Synthetic oligonucleotide
  Target: ATXN1; (+) strand; PAM type: YTN; PAM sequence: CTT
tgctaaaatataaataagca

SEQ ID NO: 247485 - DNA, 20 bp, Artificial Sequence
  Description of Artificial Sequence: Synthetic oligonucleotide
  Target: ATXN1; (+) strand; PAM type: YTN; PAM sequence: TTT
gctaaaatataaataagcag

SEQ ID NO: 247486 - DNA, 20 bp, Artificial Sequence
  Description of Artificial Sequence: Synthetic oligonucleotide
  Target: ATXN1; (+) strand; PAM type: YTN; PAM sequence: TTG
ctaaaatataaataagcaga

SEQ ID NO: 247487 - DNA, 20 bp, Artificial Sequence
  Description of Artificial Sequence: Synthetic oligonucleotide
  Target: ATXN1; (+) strand; PAM type: YTN; PAM sequence: CTA
aaatataaataagcagaggc

SEQ ID NO: 247488 - DNA, 20 bp, Artificial Sequence
  Description of Artificial Sequence: Synthetic oligonucleotide
  Target: ATXN1; (+) strand; PAM type: YTN; PAM sequence: CTT
ccatcagaaaaacatctgag

SEQ ID NO: 247489 - DNA, 20 bp, Artificial Sequence
  Description of Artificial Sequence: Synthetic oligonucleotide
  Target: ATXN1; (+) strand; PAM type: YTN; PAM sequence: TTC
catcagaaaaacatctgagt

SEQ ID NO: 247490 - DNA, 20 bp, Artificial Sequence
  Description of Artificial Sequence: Synthetic oligonucleotide
  Target: ATXN1; (+) strand; PAM type: YTN; PAM sequence: CTG
agtgttaagtagataaatgc

SEQ ID NO: 247491 - DNA, 20 bp, Artificial Sequence
  Description of Artificial Sequence: Synthetic oligonucleotide
  Target: ATXN1; (+) strand; PAM type: YTN; PAM sequence: TTA
agtagataaatgcatccctt

SEQ ID NO: 247492 - DNA, 20 bp, Artificial Sequence
  Description of Artificial Sequence: Synthetic oligonucleotide
  Target: ATXN1; (+) strand; PAM type: YTN; PAM sequence: CTT
caacattgagacattttatc

SEQ ID NO: 247493 - DNA, 20 bp, Artificial Sequence
  Description of Artificial Sequence: Synthetic oligonucleotide
  Target: ATXN1; (+) strand; PAM type: YTN; PAM sequence: TTC
aacattgagacattttatct

SEQ ID NO: 247494 - DNA, 20 bp, Artificial Sequence
  Description of Artificial Sequence: Synthetic oligonucleotide
  Target: ATXN1; (+) strand; PAM type: YTN; PAM sequence: TTG
agacattttatctccacatc

SEQ ID NO: 247495 - DNA, 20 bp, Artificial Sequence
  Description of Artificial Sequence: Synthetic oligonucleotide
  Target: ATXN1; (+) strand; PAM type: YTN; PAM sequence: TTT
tatctccacatctgatgcac

SEQ ID NO: 247496 - DNA, 20 bp, Artificial Sequence
  Description of Artificial Sequence: Synthetic oligonucleotide
  Target: ATXN1; (+) strand; PAM type: YTN; PAM sequence: TTT
atctccacatctgatgcact

SEQ ID NO: 247497 - DNA, 20 bp, Artificial Sequence
  Description of Artificial Sequence: Synthetic oligonucleotide
  Target: ATXN1; (+) strand; PAM type: YTN; PAM sequence: TTA
tctccacatctgatgcactc

SEQ ID NO: 247498 - DNA, 20 bp, Artificial Sequence
  Description of Artificial Sequence: Synthetic oligonucleotide
  Target: ATXN1; (+) strand; PAM type: YTN; PAM sequence: CTC
cacatctgatgcactcttat

SEQ ID NO: 247499 - DNA, 20 bp, Artificial Sequence
  Description of Artificial Sequence: Synthetic oligonucleotide
  Target: ATXN1; (+) strand; PAM type: YTN; PAM sequence: CTG
atgcactcttattttttcat

SEQ ID NO: 247500 - DNA, 20 bp, Artificial Sequence
  Description of Artificial Sequence: Synthetic oligonucleotide
  Target: ATXN1; (+) strand; PAM type: YTN; PAM sequence: CTC
ttattttttcatcaggacac

SEQ ID NO: 247501 - DNA, 20 bp, Artificial Sequence
  Description of Artificial Sequence: Synthetic oligonucleotide
  Target: ATXN1; (+) strand; PAM type: YTN; PAM sequence: CTT
attttttcatcaggacacgt

SEQ ID NO: 247502 - DNA, 20 bp, Artificial Sequence
  Description of Artificial Sequence: Synthetic oligonucleotide
  Target: ATXN1; (+) strand; PAM type: YTN; PAM sequence: TTA
ttttttcatcaggacacgtt

SEQ ID NO: 247503 - DNA, 20 bp, Artificial Sequence
  Description of Artificial Sequence: Synthetic oligonucleotide
  Target: ATXN1; (+) strand; PAM type: YTN; PAM sequence: TTT
tttcatcaggacacgttcca

SEQ ID NO: 247504 - DNA, 20 bp, Artificial Sequence
  Description of Artificial Sequence: Synthetic oligonucleotide
  Target: ATXN1; (+) strand; PAM type: YTN; PAM sequence: TTT
ttcatcaggacacgttccag

SEQ ID NO: 247505 - DNA, 20 bp, Artificial Sequence
  Description of Artificial Sequence: Synthetic oligonucleotide
  Target: ATXN1; (+) strand; PAM type: YTN; PAM sequence: TTT
tcatcaggacacgttccaga

SEQ ID NO: 247506 - DNA, 20 bp, Artificial Sequence
  Description of Artificial Sequence: Synthetic oligonucleotide
  Target: ATXN1; (+) strand; PAM type: YTN; PAM sequence: TTT
catcaggacacgttccagaa

SEQ ID NO: 247507 - DNA, 20 bp, Artificial Sequence
  Description of Artificial Sequence: Synthetic oligonucleotide
  Target: ATXN1; (+) strand; PAM type: YTN; PAM sequence: TTC
atcaggacacgttccagaaa

SEQ ID NO: 247508 - DNA, 20 bp, Artificial Sequence
  Description of Artificial Sequence: Synthetic oligonucleotide
  Target: ATXN1; (+) strand; PAM type: YTN; PAM sequence: TTC
cagaaacttggatctttttc

SEQ ID NO: 247509 - DNA, 20 bp, Artificial Sequence
  Description of Artificial Sequence: Synthetic oligonucleotide
  Target: ATXN1; (+) strand; PAM type: YTN; PAM sequence: CTT
ggatctttttccctgctata

SEQ ID NO: 247510 - DNA, 20 bp, Artificial Sequence
  Description of Artificial Sequence: Synthetic oligonucleotide
  Target: ATXN1; (+) strand; PAM type: YTN; PAM sequence: TTG
gatctttttccctgctatag

SEQ ID NO: 247511 - DNA, 20 bp, Artificial Sequence
  Description of Artificial Sequence: Synthetic oligonucleotide
  Target: ATXN1; (+) strand; PAM type: YTN; PAM sequence: CTT
tttccctgctatagtttcgc

SEQ ID NO: 247512 - DNA, 20 bp, Artificial Sequence
  Description of Artificial Sequence: Synthetic oligonucleotide
  Target: ATXN1; (+) strand; PAM type: YTN; PAM sequence: TTT
ttccctgctatagtttcgcg

SEQ ID NO: 247513 - DNA, 20 bp, Artificial Sequence
  Description of Artificial Sequence: Synthetic oligonucleotide
  Target: ATXN1; (+) strand; PAM type: YTN; PAM sequence: TTT
tccctgctatagtttcgcga

SEQ ID NO: 247514 - DNA, 20 bp, Artificial Sequence
  Description of Artificial Sequence: Synthetic oligonucleotide
  Target: ATXN1; (+) strand; PAM type: YTN; PAM sequence: TTT
ccctgctatagtttcgcgaa

SEQ ID NO: 247515 - DNA, 20 bp, Artificial Sequence
  Description of Artificial Sequence: Synthetic oligonucleotide
  Target: ATXN1; (+) strand; PAM type: YTN; PAM sequence: TTC
cctgctatagtttcgcgaat

SEQ ID NO: 247516 - DNA, 20 bp, Artificial Sequence
  Description of Artificial Sequence: Synthetic oligonucleotide
  Target: ATXN1; (+) strand; PAM type: YTN; PAM sequence: CTG
ctatagtttcgcgaataata

SEQ ID NO: 247517 - DNA, 20 bp, Artificial Sequence
  Description of Artificial Sequence: Synthetic oligonucleotide
  Target: ATXN1; (+) strand; PAM type: YTN; PAM sequence: CTA
tagtttcgcgaataatatag

SEQ ID NO: 247518 - DNA, 20 bp, Artificial Sequence
  Description of Artificial Sequence: Synthetic oligonucleotide
  Target: ATXN1; (+) strand; PAM type: YTN; PAM sequence: TTT
cgcgaataatatagtttgct

SEQ ID NO: 247519 - DNA, 20 bp, Artificial Sequence
  Description of Artificial Sequence: Synthetic oligonucleotide
  Target: ATXN1; (+) strand; PAM type: YTN; PAM sequence: TTC
gcgaataatatagtttgctt

SEQ ID NO: 247520 - DNA, 20 bp, Artificial Sequence
  Description of Artificial Sequence: Synthetic oligonucleotide
  Target: ATXN1; (+) strand; PAM type: YTN; PAM sequence: TTT
gcttctattttgctctggtt

SEQ ID NO: 247521 - DNA, 20 bp, Artificial Sequence
  Description of Artificial Sequence: Synthetic oligonucleotide
  Target: ATXN1; (+) strand; PAM type: YTN; PAM sequence: TTG
cttctattttgctctggtta

SEQ ID NO: 247522 - DNA, 20 bp, Artificial Sequence
  Description of Artificial Sequence: Synthetic oligonucleotide
  Target: ATXN1; (+) strand; PAM type: YTN; PAM sequence: CTT
ctattttgctctggttaacc

SEQ ID NO: 247523 - DNA, 20 bp, Artificial Sequence
  Description of Artificial Sequence: Synthetic oligonucleotide
  Target: ATXN1; (+) strand; PAM type: YTN; PAM sequence: TTC
tattttgctctggttaaccc

SEQ ID NO: 247524 - DNA, 20 bp, Artificial Sequence
  Description of Artificial Sequence: Synthetic oligonucleotide
  Target: ATXN1; (+) strand; PAM type: YTN; PAM sequence: CTA
ttttgctctggttaacccaa

SEQ ID NO: 247525 - DNA, 20 bp, Artificial Sequence
  Description of Artificial Sequence: Synthetic oligonucleotide
  Target: ATXN1; (+) strand; PAM type: YTN; PAM sequence: TTT
tgctctggttaacccaaggg

SEQ ID NO: 247526 - DNA, 20 bp, Artificial Sequence
  Description of Artificial Sequence: Synthetic oligonucleotide
  Target: ATXN1; (+) strand; PAM type: YTN; PAM sequence: TTT
gctctggttaacccaaggga

SEQ ID NO: 247527 - DNA, 20 bp, Artificial Sequence
  Description of Artificial Sequence: Synthetic oligonucleotide
  Target: ATXN1; (+) strand; PAM type: YTN; PAM sequence: TTG
ctctggttaacccaagggat

SEQ ID NO: 247528 - DNA, 20 bp, Artificial Sequence
  Description of Artificial Sequence: Synthetic oligonucleotide
  Target: ATXN1; (+) strand; PAM type: YTN; PAM sequence: CTC
tggttaacccaagggatggt

SEQ ID NO: 247529 - DNA, 20 bp, Artificial Sequence
  Description of Artificial Sequence: Synthetic oligonucleotide
  Target: ATXN1; (+) strand; PAM type: YTN; PAM sequence: CTG
gttaacccaagggatggtgg

SEQ ID NO: 247530 - DNA, 20 bp, Artificial Sequence
  Description of Artificial Sequence: Synthetic oligonucleotide
  Target: ATXN1; (+) strand; PAM type: YTN; PAM sequence: TTA
acccaagggatggtgggtgg

SEQ ID NO: 247531 - DNA, 20 bp, Artificial Sequence
  Description of Artificial Sequence: Synthetic oligonucleotide
  Target: ATXN1; (+) strand; PAM type: YTN; PAM sequence: CTG
agtctcaatctataacgttt

SEQ ID NO: 247532 - DNA, 20 bp, Artificial Sequence
  Description of Artificial Sequence: Synthetic oligonucleotide
  Target: ATXN1; (+) strand; PAM type: YTN; PAM sequence: CTC
aatctataacgtttccaacg

SEQ ID NO: 247533 - DNA, 20 bp, Artificial Sequence
  Description of Artificial Sequence: Synthetic oligonucleotide
  Target: ATXN1; (+) strand; PAM type: YTN; PAM sequence: CTA
taacgtttccaacgtagaag

SEQ ID NO: 247534 - DNA, 20 bp, Artificial Sequence
  Description of Artificial Sequence: Synthetic oligonucleotide
  Target: ATXN1; (+) strand; PAM type: YTN; PAM sequence: TTT
ccaacgtagaagataaaatg

SEQ ID NO: 247535 - DNA, 20 bp, Artificial Sequence
  Description of Artificial Sequence: Synthetic oligonucleotide
  Target: ATXN1; (+) strand; PAM type: YTN; PAM sequence: TTC
caacgtagaagataaaatga

SEQ ID NO: 247536 - DNA, 20 bp, Artificial Sequence
  Description of Artificial Sequence: Synthetic oligonucleotide
  Target: ATXN1; (+) strand; PAM type: YTN; PAM sequence: TTT
gggaaaatatacaaagaact

SEQ ID NO: 247537 - DNA, 20 bp, Artificial Sequence
  Description of Artificial Sequence: Synthetic oligonucleotide
  Target: ATXN1; (+) strand; PAM type: YTN; PAM sequence: TTG
ggaaaatatacaaagaactt

SEQ ID NO: 247538 - DNA, 20 bp, Artificial Sequence
  Description of Artificial Sequence: Synthetic oligonucleotide
  Target: ATXN1; (+) strand; PAM type: YTN; PAM sequence: CTT
cacagaaagctctcaacgga

SEQ ID NO: 247539 - DNA, 20 bp, Artificial Sequence
  Description of Artificial Sequence: Synthetic oligonucleotide
  Target: ATXN1; (+) strand; PAM type: YTN; PAM sequence: TTC
acagaaagctctcaacggag

SEQ ID NO: 247540 - DNA, 20 bp, Artificial Sequence
  Description of Artificial Sequence: Synthetic oligonucleotide
  Target: ATXN1; (+) strand; PAM type: YTN; PAM sequence: CTC
tcaacggagagcctgaaggg

SEQ ID NO: 247541 - DNA, 20 bp, Artificial Sequence
  Description of Artificial Sequence: Synthetic oligonucleotide
  Target: ATXN1; (+) strand; PAM type: YTN; PAM sequence: CTC
aacggagagcctgaagggac

SEQ ID NO: 247542 - DNA, 20 bp, Artificial Sequence
  Description of Artificial Sequence: Synthetic oligonucleotide
  Target: ATXN1; (+) strand; PAM type: YTN; PAM sequence: CTG
aagggaccagccagggagtc

SEQ ID NO: 247543 - DNA, 20 bp, Artificial Sequence
  Description of Artificial Sequence: Synthetic oligonucleotide
  Target: ATXN1; (+) strand; PAM type: YTN; PAM sequence: CTA
atgcaagccaggaacagcca

SEQ ID NO: 247544 - DNA, 20 bp, Artificial Sequence
  Description of Artificial Sequence: Synthetic oligonucleotide
  Target: ATXN1; (+) strand; PAM type: YTN; PAM sequence: CTT
agatgggtgggttttgtttt

SEQ ID NO: 247545 - DNA, 20 bp, Artificial Sequence
  Description of Artificial Sequence: Synthetic oligonucleotide
  Target: ATXN1; (+) strand; PAM type: YTN; PAM sequence: TTA
gatgggtgggttttgttttc

SEQ ID NO: 247546 - DNA, 20 bp, Artificial Sequence
  Description of Artificial Sequence: Synthetic oligonucleotide
  Target: ATXN1; (+) strand; PAM type: YTN; PAM sequence: TTT
tgttttctttcacagctgat

SEQ ID NO: 247547 - DNA, 20 bp, Artificial Sequence
  Description of Artificial Sequence: Synthetic oligonucleotide
  Target: ATXN1; (+) strand; PAM type: YTN; PAM sequence: TTT
gttttctttcacagctgatt

SEQ ID NO: 247548 - DNA, 20 bp, Artificial Sequence
  Description of Artificial Sequence: Synthetic oligonucleotide
  Target: ATXN1; (+) strand; PAM type: YTN; PAM sequence: TTG
ttttctttcacagctgattt

SEQ ID NO: 247549 - DNA, 20 bp, Artificial Sequence
  Description of Artificial Sequence: Synthetic oligonucleotide
  Target: ATXN1; (+) strand; PAM type: YTN; PAM sequence: TTT
tctttcacagctgatttgaa

SEQ ID NO: 247550 - DNA, 20 bp, Artificial Sequence
  Description of Artificial Sequence: Synthetic oligonucleotide
  Target: ATXN1; (+) strand; PAM type: YTN; PAM sequence: TTT
ctttcacagctgatttgaaa

SEQ ID NO: 247551 - DNA, 20 bp, Artificial Sequence
  Description of Artificial Sequence: Synthetic oligonucleotide
  Target: ATXN1; (+) strand; PAM type: YTN; PAM sequence: TTC
tttcacagctgatttgaaac

SEQ ID NO: 247552 - DNA, 20 bp, Artificial Sequence
  Description of Artificial Sequence: Synthetic oligonucleotide
  Target: ATXN1; (+) strand; PAM type: YTN; PAM sequence: CTT
tcacagctgatttgaaactt

SEQ ID NO: 247553 - DNA, 20 bp, Artificial Sequence
  Description of Artificial Sequence: Synthetic oligonucleotide
  Target: ATXN1; (+) strand; PAM type: YTN; PAM sequence: TTT
cacagctgatttgaaacttc

SEQ ID NO: 247554 - DNA, 20 bp, Artificial Sequence
  Description of Artificial Sequence: Synthetic oligonucleotide
  Target: ATXN1; (+) strand; PAM type: YTN; PAM sequence: TTC
acagctgatttgaaacttcc

SEQ ID NO: 247555 - DNA, 20 bp, Artificial Sequence
  Description of Artificial Sequence: Synthetic oligonucleotide
  Target: ATXN1; (+) strand; PAM type: YTN; PAM sequence: CTG
atttgaaacttccctcaatg

SEQ ID NO: 247556 - DNA, 20 bp, Artificial Sequence
  Description of Artificial Sequence: Synthetic oligonucleotide
  Target: ATXN1; (+) strand; PAM type: YTN; PAM sequence: TTT
gaaacttccctcaatgacac

SEQ ID NO: 247557 - DNA, 20 bp, Artificial Sequence
  Description of Artificial Sequence: Synthetic oligonucleotide
  Target: ATXN1; (+) strand; PAM type: YTN; PAM sequence: TTG
aaacttccctcaatgacact

SEQ ID NO: 247558 - DNA, 20 bp, Artificial Sequence
  Description of Artificial Sequence: Synthetic oligonucleotide
  Target: ATXN1; (+) strand; PAM type: YTN; PAM sequence: CTT
ccctcaatgacactgtagaa

SEQ ID NO: 247559 - DNA, 20 bp, Artificial Sequence
  Description of Artificial Sequence: Synthetic oligonucleotide
  Target: ATXN1; (+) strand; PAM type: YTN; PAM sequence: TTC
cctcaatgacactgtagaag

SEQ ID NO: 247560 - DNA, 20 bp, Artificial Sequence
  Description of Artificial Sequence: Synthetic oligonucleotide
  Target: ATXN1; (+) strand; PAM type: YTN; PAM sequence: CTC
aatgacactgtagaagataa

SEQ ID NO: 247561 - DNA, 20 bp, Artificial Sequence
  Description of Artificial Sequence: Synthetic oligonucleotide
  Target: ATXN1; (+) strand; PAM type: YTN; PAM sequence: CTG
tagaagataatgttttaaca

SEQ ID NO: 247562 - DNA, 20 bp, Artificial Sequence
  Description of Artificial Sequence: Synthetic oligonucleotide
  Target: ATXN1; (+) strand; PAM type: YTN; PAM sequence: TTT
taacaaaacgcatggattta

SEQ ID NO: 247563 - DNA, 20 bp, Artificial Sequence
  Description of Artificial Sequence: Synthetic oligonucleotide
  Target: ATXN1; (+) strand; PAM type: YTN; PAM sequence: TTT
aacaaaacgcatggatttac

SEQ ID NO: 247564 - DNA, 20 bp, Artificial Sequence
  Description of Artificial Sequence: Synthetic oligonucleotide
  Target: ATXN1; (+) strand; PAM type: YTN; PAM sequence: TTA
acaaaacgcatggatttaca

SEQ ID NO: 247565 - DNA, 20 bp, Artificial Sequence
  Description of Artificial Sequence: Synthetic oligonucleotide
  Target: ATXN1; (+) strand; PAM type: YTN; PAM sequence: TTT
acaagcttcctcacactcaa

SEQ ID NO: 247566 - DNA, 20 bp, Artificial Sequence
  Description of Artificial Sequence: Synthetic oligonucleotide
  Target: ATXN1; (+) strand; PAM type: YTN; PAM sequence: TTA
caagcttcctcacactcaag

SEQ ID NO: 247567 - DNA, 20 bp, Artificial Sequence
  Description of Artificial Sequence: Synthetic oligonucleotide
  Target: ATXN1; (+) strand; PAM type: YTN; PAM sequence: CTT
cctcacactcaagccgacag

SEQ ID NO: 247568 - DNA, 20 bp, Artificial Sequence
  Description of Artificial Sequence: Synthetic oligonucleotide
  Target: ATXN1; (+) strand; PAM type: YTN; PAM sequence: TTC
ctcacactcaagccgacaga

SEQ ID NO: 247569 - DNA, 20 bp, Artificial Sequence
  Description of Artificial Sequence: Synthetic oligonucleotide
  Target: ATXN1; (+) strand; PAM type: YTN; PAM sequence: CTC
acactcaagccgacagagca

SEQ ID NO: 247570 - DNA, 20 bp, Artificial Sequence
  Description of Artificial Sequence: Synthetic oligonucleotide
  Target: ATXN1; (+) strand; PAM type: YTN; PAM sequence: CTC
aagccgacagagcatcacac

SEQ ID NO: 247571 - DNA, 20 bp, Artificial Sequence
  Description of Artificial Sequence: Synthetic oligonucleotide
  Target: ATXN1; (+) strand; PAM type: YTN; PAM sequence: CTC
tgtctggtagtctccacatc

SEQ ID NO: 247572 - DNA, 20 bp, Artificial Sequence
  Description of Artificial Sequence: Synthetic oligonucleotide
  Target: ATXN1; (+) strand; PAM type: YTN; PAM sequence: CTG
tctggtagtctccacatctc

SEQ ID NO: 247573 - DNA, 20 bp, Artificial Sequence
  Description of Artificial Sequence: Synthetic oligonucleotide
  Target: ATXN1; (+) strand; PAM type: YTN; PAM sequence: CTG
gtagtctccacatctcaggc

SEQ ID NO: 247574 - DNA, 20 bp, Artificial Sequence
  Description of Artificial Sequence: Synthetic oligonucleotide
  Target: ATXN1; (+) strand; PAM type: YTN; PAM sequence: CTC
cacatctcaggctgggctgg

SEQ ID NO: 247575 - DNA, 20 bp, Artificial Sequence
  Description of Artificial Sequence: Synthetic oligonucleotide
  Target: ATXN1; (+) strand; PAM type: YTN; PAM sequence: CTC
aggctgggctggatggaagg

SEQ ID NO: 247576 - DNA, 20 bp, Artificial Sequence
  Description of Artificial Sequence: Synthetic oligonucleotide
  Target: ATXN1; (+) strand; PAM type: YTN; PAM sequence: CTG
ggctggatggaaggaaatga

SEQ ID NO: 247577 - DNA, 20 bp, Artificial Sequence
  Description of Artificial Sequence: Synthetic oligonucleotide
  Target: ATXN1; (+) strand; PAM type: YTN; PAM sequence: CTG
gatggaaggaaatgatcaca

SEQ ID NO: 247578 - DNA, 20 bp, Artificial Sequence
  Description of Artificial Sequence: Synthetic oligonucleotide
  Target: ATXN1; (+) strand; PAM type: YTN; PAM sequence: TTT
aaaggaaatgaccacagcaa

SEQ ID NO: 247579 - DNA, 20 bp, Artificial Sequence
  Description of Artificial Sequence: Synthetic oligonucleotide
  Target: ATXN1; (+) strand; PAM type: YTN; PAM sequence: TTA
aaggaaatgaccacagcaag

SEQ ID NO: 247580 - DNA, 20 bp, Artificial Sequence
  Description of Artificial Sequence: Synthetic oligonucleotide
  Target: ATXN1; (+) strand; PAM type: YTN; PAM sequence: CTC
cctttgtggctcaaaagaag

SEQ ID NO: 247581 - DNA, 20 bp, Artificial Sequence
  Description of Artificial Sequence: Synthetic oligonucleotide
  Target: ATXN1; (+) strand; PAM type: YTN; PAM sequence: CTT
tgtggctcaaaagaagcatc

SEQ ID NO: 247582 - DNA, 20 bp, Artificial Sequence
  Description of Artificial Sequence: Synthetic oligonucleotide
  Target: ATXN1; (+) strand; PAM type: YTN; PAM sequence: TTT
gtggctcaaaagaagcatca

SEQ ID NO: 247583 - DNA, 20 bp, Artificial Sequence
  Description of Artificial Sequence: Synthetic oligonucleotide
  Target: ATXN1; (+) strand; PAM type: YTN; PAM sequence: TTG
tggctcaaaagaagcatcat

SEQ ID NO: 247584 - DNA, 20 bp, Artificial Sequence
  Description of Artificial Sequence: Synthetic oligonucleotide
  Target: ATXN1; (+) strand; PAM type: YTN; PAM sequence: CTC
aaaagaagcatcatggcaga

SEQ ID NO: 247585 - DNA, 20 bp, Artificial Sequence
  Description of Artificial Sequence: Synthetic oligonucleotide
  Target: ATXN1; (+) strand; PAM type: YTN; PAM sequence: TTA
ttgtcagatttcagtacaat

SEQ ID NO: 247586 - DNA, 20 bp, Artificial Sequence
  Description of Artificial Sequence: Synthetic oligonucleotide
  Target: ATXN1; (+) strand; PAM type: YTN; PAM sequence: TTG
tcagatttcagtacaatagt

SEQ ID NO: 247587 - DNA, 20 bp, Artificial Sequence
  Description of Artificial Sequence: Synthetic oligonucleotide
  Target: ATXN1; (+) strand; PAM type: YTN; PAM sequence: TTT
cagtacaatagtccccgcct

SEQ ID NO: 247588 - DNA, 20 bp, Artificial Sequence
  Description of Artificial Sequence: Synthetic oligonucleotide
  Target: ATXN1; (+) strand; PAM type: YTN; PAM sequence: TTC
agtacaatagtccccgcctt

SEQ ID NO: 247589 - DNA, 20 bp, Artificial Sequence
  Description of Artificial Sequence: Synthetic oligonucleotide
  Target: ATXN1; (+) strand; PAM type: YTN; PAM sequence: CTT
atccatgaggaataggttcc

SEQ ID NO: 247590 - DNA, 20 bp, Artificial Sequence
  Description of Artificial Sequence: Synthetic oligonucleotide
  Target: ATXN1; (+) strand; PAM type: YTN; PAM sequence: TTA
tccatgaggaataggttcca

SEQ ID NO: 247591 - DNA, 20 bp, Artificial Sequence
  Description of Artificial Sequence: Synthetic oligonucleotide
  Target: ATXN1; (+) strand; PAM type: YTN; PAM sequence: TTC
caagacccccagtgggttcc

SEQ ID NO: 247592 - DNA, 20 bp, Artificial Sequence
  Description of Artificial Sequence: Synthetic oligonucleotide
  Target: ATXN1; (+) strand; PAM type: YTN; PAM sequence: TTC
ctgaaacccactggatagta

SEQ ID NO: 247593 - DNA, 20 bp, Artificial Sequence
  Description of Artificial Sequence: Synthetic oligonucleotide
  Target: ATXN1; (+) strand; PAM type: YTN; PAM sequence: CTG
aaacccactggatagtacca

SEQ ID NO: 247594 - DNA, 20 bp, Artificial Sequence
  Description of Artificial Sequence: Synthetic oligonucleotide
  Target: ATXN1; (+) strand; PAM type: YTN; PAM sequence: CTG
gatagtaccaaaccctatgt

SEQ ID NO: 247595 - DNA, 20 bp, Artificial Sequence
  Description of Artificial Sequence: Synthetic oligonucleotide
  Target: ATXN1; (+) strand; PAM type: YTN; PAM sequence: CTA
tgtacgctatgtttttttcc

SEQ ID NO: 247596 - DNA, 20 bp, Artificial Sequence
  Description of Artificial Sequence: Synthetic oligonucleotide
  Target: ATXN1; (+) strand; PAM type: YTN; PAM sequence: CTA
tgtttttttcctatatatac

SEQ ID NO: 247597 - DNA, 20 bp, Artificial Sequence
  Description of Artificial Sequence: Synthetic oligonucleotide
  Target: ATXN1; (+) strand; PAM type: YTN; PAM sequence: TTT
ttttcctatatatacatacc

SEQ ID NO: 247598 - DNA, 20 bp, Artificial Sequence
  Description of Artificial Sequence: Synthetic oligonucleotide
  Target: ATXN1; (+) strand; PAM type: YTN; PAM sequence: TTT
tttcctatatatacatacct

SEQ ID NO: 247599 - DNA, 20 bp, Artificial Sequence
  Description of Artificial Sequence: Synthetic oligonucleotide
  Target: ATXN1; (+) strand; PAM type: YTN; PAM sequence: TTT
ttcctatatatacataccta

SEQ ID NO: 247600 - DNA, 20 bp, Artificial Sequence
  Description of Artificial Sequence: Synthetic oligonucleotide
  Target: ATXN1; (+) strand; PAM type: YTN; PAM sequence: TTT
tcctatatatacatacctac

SEQ ID NO: 247601 - DNA, 20 bp, Artificial Sequence
  Description of Artificial Sequence: Synthetic oligonucleotide
  Target: ATXN1; (+) strand; PAM type: YTN; PAM sequence: TTT
cctatatatacatacctacg

SEQ ID NO: 247602 - DNA, 20 bp, Artificial Sequence
  Description of Artificial Sequence: Synthetic oligonucleotide
  Target: ATXN1; (+) strand; PAM type: YTN; PAM sequence: TTC
ctatatatacatacctacga

SEQ ID NO: 247603 - DNA, 20 bp, Artificial Sequence
  Description of Artificial Sequence: Synthetic oligonucleotide
  Target: ATXN1; (+) strand; PAM type: YTN; PAM sequence: CTA
tatatacatacctacgataa

SEQ ID NO: 247604 - DNA, 20 bp, Artificial Sequence
  Description of Artificial Sequence: Synthetic oligonucleotide
  Target: ATXN1; (+) strand; PAM type: YTN; PAM sequence: CTA
cgataaagtttgatttatac

SEQ ID NO: 247605 - DNA, 20 bp, Artificial Sequence
  Description of Artificial Sequence: Synthetic oligonucleotide
  Target: ATXN1; (+) strand; PAM type: YTN; PAM sequence: TTT
gatttatacattaggcacag

SEQ ID NO: 247606 - DNA, 20 bp, Artificial Sequence
  Description of Artificial Sequence: Synthetic oligonucleotide
  Target: ATXN1; (+) strand; PAM type: YTN; PAM sequence: TTG
atttatacattaggcacagt

SEQ ID NO: 247607 - DNA, 20 bp, Artificial Sequence
  Description of Artificial Sequence: Synthetic oligonucleotide
  Target: ATXN1; (+) strand; PAM type: YTN; PAM sequence: TTT
atacattaggcacagtatga

SEQ ID NO: 247608 - DNA, 20 bp, Artificial Sequence
  Description of Artificial Sequence: Synthetic oligonucleotide
  Target: ATXN1; (+) strand; PAM type: YTN; PAM sequence: TTA
tacattaggcacagtatgag

SEQ ID NO: 247609 - DNA, 20 bp, Artificial Sequence
  Description of Artificial Sequence: Synthetic oligonucleotide
  Target: ATXN1; (+) strand; PAM type: YTN; PAM sequence: TTA
ggcacagtatgagattaatg

SEQ ID NO: 247610 - DNA, 20 bp, Artificial Sequence
  Description of Artificial Sequence: Synthetic oligonucleotide
  Target: ATXN1; (+) strand; PAM type: YTN; PAM sequence: TTA
atgataatagctaataataa

SEQ ID NO: 247611 - DNA, 20 bp, Artificial Sequence
  Description of Artificial Sequence: Synthetic oligonucleotide
  Target: ATXN1; (+) strand; PAM type: YTN; PAM sequence: CTA
ataataaaatagaacgattg

SEQ ID NO: 247612 - DNA, 20 bp, Artificial Sequence
  Description of Artificial Sequence: Synthetic oligonucleotide
  Target: ATXN1; (+) strand; PAM type: YTN; PAM sequence: TTG
taacagtatgccagcatcac

SEQ ID NO: 247613 - DNA, 20 bp, Artificial Sequence
  Description of Artificial Sequence: Synthetic oligonucleotide
  Target: ATXN1; (+) strand; PAM type: YTN; PAM sequence: CTA
agtgctttgggaccatcatt

SEQ ID NO: 247614 - DNA, 20 bp, Artificial Sequence
  Description of Artificial Sequence: Synthetic oligonucleotide
  Target: ATXN1; (+) strand; PAM type: YTN; PAM sequence: CTT
tgggaccatcattaagtaaa

SEQ ID NO: 247615 - DNA, 20 bp, Artificial Sequence
  Description of Artificial Sequence: Synthetic oligonucleotide
  Target: ATXN1; (+) strand; PAM type: YTN; PAM sequence: TTT
gggaccatcattaagtaaaa

SEQ ID NO: 247616 - DNA, 20 bp, Artificial Sequence
  Description of Artificial Sequence: Synthetic oligonucleotide
  Target: ATXN1; (+) strand; PAM type: YTN; PAM sequence: TTG
ggaccatcattaagtaaaat

SEQ ID NO: 247617 - DNA, 20 bp, Artificial Sequence
  Description of Artificial Sequence: Synthetic oligonucleotide
  Target: ATXN1; (+) strand; PAM type: YTN; PAM sequence: TTA
agtaaaataaaggtgacttg

SEQ ID NO: 247618 - DNA, 20 bp, Artificial Sequence
  Description of Artificial Sequence: Synthetic oligonucleotide
  Target: ATXN1; (+) strand; PAM type: YTN; PAM sequence: CTT
gaacacaagcacttccatcc

SEQ ID NO: 247619 - DNA, 20 bp, Artificial Sequence
  Description of Artificial Sequence: Synthetic oligonucleotide
  Target: ATXN1; (+) strand; PAM type: YTN; PAM sequence: TTG
aacacaagcacttccatccc

SEQ ID NO: 247620 - DNA, 20 bp, Artificial Sequence
  Description of Artificial Sequence: Synthetic oligonucleotide
  Target: ATXN1; (+) strand; PAM type: YTN; PAM sequence: CTT
ccatcccaccacagtggatc

SEQ ID NO: 247621 - DNA, 20 bp, Artificial Sequence
  Description of Artificial Sequence: Synthetic oligonucleotide
  Target: ATXN1; (+) strand; PAM type: YTN; PAM sequence: TTC
catcccaccacagtggatct

SEQ ID NO: 247622 - DNA, 20 bp, Artificial Sequence
  Description of Artificial Sequence: Synthetic oligonucleotide
  Target: ATXN1; (+) strand; PAM type: YTN; PAM sequence: CTA
agcaccaagatggccgctag

SEQ ID NO: 247623 - DNA, 20 bp, Artificial Sequence
  Description of Artificial Sequence: Synthetic oligonucleotide
  Target: ATXN1; (+) strand; PAM type: YTN; PAM sequence: CTA
ggtgactcaccggcggggag

SEQ ID NO: 247624 - DNA, 20 bp, Artificial Sequence
  Description of Artificial Sequence: Synthetic oligonucleotide
  Target: ATXN1; (+) strand; PAM type: YTN; PAM sequence: CTC
accggcggggagcgctgcgc

SEQ ID NO: 247625 - DNA, 20 bp, Artificial Sequence
  Description of Artificial Sequence: Synthetic oligonucleotide
  Target: ATXN1; (+) strand; PAM type: YTN; PAM sequence: CTG
cgcagcggacaagctggaga

SEQ ID NO: 247626 - DNA, 20 bp, Artificial Sequence
  Description of Artificial Sequence: Synthetic oligonucleotide
  Target: ATXN1; (+) strand; PAM type: YTN; PAM sequence: CTG
gagaaagggacgattcacgt

SEQ ID NO: 247627 - DNA, 20 bp, Artificial Sequence
  Description of Artificial Sequence: Synthetic oligonucleotide
  Target: ATXN1; (+) strand; PAM type: YTN; PAM sequence: TTC
acgtctgcgttaggatgggg

SEQ ID NO: 247628 - DNA, 20 bp, Artificial Sequence
  Description of Artificial Sequence: Synthetic oligonucleotide
  Target: ATXN1; (+) strand; PAM type: YTN; PAM sequence: CTG
cgttaggatggggtaaggcg

SEQ ID NO: 247629 - DNA, 20 bp, Artificial Sequence
  Description of Artificial Sequence: Synthetic oligonucleotide
  Target: ATXN1; (+) strand; PAM type: YTN; PAM sequence: TTA
ggatggggtaaggcgtgaga

SEQ ID NO: 247630 - DNA, 20 bp, Artificial Sequence
  Description of Artificial Sequence: Synthetic oligonucleotide
  Target: ATXN1; (+) strand; PAM type: YTN; PAM sequence: TTT
tatcatgctactgagaacag

SEQ ID NO: 247631 - DNA, 20 bp, Artificial Sequence
  Description of Artificial Sequence: Synthetic oligonucleotide
  Target: ATXN1; (+) strand; PAM type: YTN; PAM sequence: TTT
atcatgctactgagaacagc

SEQ ID NO: 247632 - DNA, 20 bp, Artificial Sequence
  Description of Artificial Sequence: Synthetic oligonucleotide
  Target: ATXN1; (+) strand; PAM type: YTN; PAM sequence: TTA
tcatgctactgagaacagca

SEQ ID NO: 247633 - DNA, 20 bp, Artificial Sequence
  Description of Artificial Sequence: Synthetic oligonucleotide
  Target: ATXN1; (+) strand; PAM type: YTN; PAM sequence: CTA
ctgagaacagcacgcaactt

SEQ ID NO: 247634 - DNA, 20 bp, Artificial Sequence
  Description of Artificial Sequence: Synthetic oligonucleotide
  Target: ATXN1; (+) strand; PAM type: YTN; PAM sequence: CTG
agaacagcacgcaacttaaa

SEQ ID NO: 247635 - DNA, 20 bp, Artificial Sequence
  Description of Artificial Sequence: Synthetic oligonucleotide
  Target: ATXN1; (+) strand; PAM type: YTN; PAM sequence: CTT
aaaacttaggaactgtttat

SEQ ID NO: 247636 - DNA, 20 bp, Artificial Sequence
  Description of Artificial Sequence: Synthetic oligonucleotide
  Target: ATXN1; (+) strand; PAM type: YTN; PAM sequence: TTA
aaacttaggaactgtttatt

SEQ ID NO: 247637 - DNA, 20 bp, Artificial Sequence
  Description of Artificial Sequence: Synthetic oligonucleotide
  Target: ATXN1; (+) strand; PAM type: YTN; PAM sequence: CTT
aggaactgtttatttctgga

SEQ ID NO: 247638 - DNA, 20 bp, Artificial Sequence
  Description of Artificial Sequence: Synthetic oligonucleotide
  Target: ATXN1; (+) strand; PAM type: YTN; PAM sequence: TTA
ggaactgtttatttctggaa

SEQ ID NO: 247639 - DNA, 20 bp, Artificial Sequence
  Description of Artificial Sequence: Synthetic oligonucleotide
  Target: ATXN1; (+) strand; PAM type: YTN; PAM sequence: CTG
tttatttctggaattttcca

SEQ ID NO: 247640 - DNA, 20 bp, Artificial Sequence
  Description of Artificial Sequence: Synthetic oligonucleotide
  Target: ATXN1; (+) strand; PAM type: YTN; PAM sequence: TTT
atttctggaattttccattt

SEQ ID NO: 247641 - DNA, 20 bp, Artificial Sequence
  Description of Artificial Sequence: Synthetic oligonucleotide
  Target: ATXN1; (+) strand; PAM type: YTN; PAM sequence: TTA
tttctggaattttccatttc

SEQ ID NO: 247642 - DNA, 20 bp, Artificial Sequence
  Description of Artificial Sequence: Synthetic oligonucleotide
  Target: ATXN1; (+) strand; PAM type: YTN; PAM sequence: TTT
ctggaattttccatttcata

SEQ ID NO: 247643 - DNA, 20 bp, Artificial Sequence
  Description of Artificial Sequence: Synthetic oligonucleotide
  Target: ATXN1; (+) strand; PAM type: YTN; PAM sequence: TTC
tggaattttccatttcatac

SEQ ID NO: 247644 - DNA, 20 bp, Artificial Sequence
  Description of Artificial Sequence: Synthetic oligonucleotide
  Target: ATXN1; (+) strand; PAM type: YTN; PAM sequence: CTG
gaattttccatttcatactt

SEQ ID NO: 247645 - DNA, 20 bp, Artificial Sequence
  Description of Artificial Sequence: Synthetic oligonucleotide
  Target: ATXN1; (+) strand; PAM type: YTN; PAM sequence: TTT
tccatttcatactttcagtc

SEQ ID NO: 247646 - DNA, 20 bp, Artificial Sequence
  Description of Artificial Sequence: Synthetic oligonucleotide
  Target: ATXN1; (+) strand; PAM type: YTN; PAM sequence: TTT
ccatttcatactttcagtct

SEQ ID NO: 247647 - DNA, 20 bp, Artificial Sequence
  Description of Artificial Sequence: Synthetic oligonucleotide
  Target: ATXN1; (+) strand; PAM type: YTN; PAM sequence: TTC
catttcatactttcagtctg

SEQ ID NO: 247648 - DNA, 20 bp, Artificial Sequence
  Description of Artificial Sequence: Synthetic oligonucleotide
  Target: ATXN1; (+) strand; PAM type: YTN; PAM sequence: TTT
catactttcagtctgcagtt

SEQ ID NO: 247649 - DNA, 20 bp, Artificial Sequence
  Description of Artificial Sequence: Synthetic oligonucleotide
  Target: ATXN1; (+) strand; PAM type: YTN; PAM sequence: TTC
atactttcagtctgcagttg

SEQ ID NO: 247650 - DNA, 20 bp, Artificial Sequence
  Description of Artificial Sequence: Synthetic oligonucleotide
  Target: ATXN1; (+) strand; PAM type: YTN; PAM sequence: CTT
tcagtctgcagttggcctca

SEQ ID NO: 247651 - DNA, 20 bp, Artificial Sequence
  Description of Artificial Sequence: Synthetic oligonucleotide
  Target: ATXN1; (+) strand; PAM type: YTN; PAM sequence: TTT
cagtctgcagttggcctcag

SEQ ID NO: 247652 - DNA, 20 bp, Artificial Sequence
  Description of Artificial Sequence: Synthetic oligonucleotide
  Target: ATXN1; (+) strand; PAM type: YTN; PAM sequence: TTC
agtctgcagttggcctcaga

SEQ ID NO: 247653 - DNA, 20 bp, Artificial Sequence
  Description of Artificial Sequence: Synthetic oligonucleotide
  Target: ATXN1; (+) strand; PAM type: YTN; PAM sequence: CTG
cagttggcctcagaaatcaa

SEQ ID NO: 247654 - DNA, 20 bp, Artificial Sequence
  Description of Artificial Sequence: Synthetic oligonucleotide
  Target: ATXN1; (+) strand; PAM type: YTN; PAM sequence: TTG
gcctcagaaatcaacctgcg

SEQ ID NO: 247655 - DNA, 20 bp, Artificial Sequence
  Description of Artificial Sequence: Synthetic oligonucleotide
  Target: ATXN1; (+) strand; PAM type: YTN; PAM sequence: CTC
agaaatcaacctgcggataa

SEQ ID NO: 247656 - DNA, 20 bp, Artificial Sequence
  Description of Artificial Sequence: Synthetic oligonucleotide
  Target: ATXN1; (+) strand; PAM type: YTN; PAM sequence: CTG
cggataacgggggacgtctg

SEQ ID NO: 247657 - DNA, 20 bp, Artificial Sequence
  Description of Artificial Sequence: Synthetic oligonucleotide
  Target: ATXN1; (+) strand; PAM type: YTN; PAM sequence: CTG
gctgcggtgttctaggaaaa

SEQ ID NO: 247658 - DNA, 20 bp, Artificial Sequence
  Description of Artificial Sequence: Synthetic oligonucleotide
  Target: ATXN1; (+) strand; PAM type: YTN; PAM sequence: CTG
cggtgttctaggaaaatact

SEQ ID NO: 247659 - DNA, 20 bp, Artificial Sequence
  Description of Artificial Sequence: Synthetic oligonucleotide
  Target: ATXN1; (+) strand; PAM type: YTN; PAM sequence: TTC
taggaaaatactccacacta

SEQ ID NO: 247660 - DNA, 20 bp, Artificial Sequence
  Description of Artificial Sequence: Synthetic oligonucleotide
  Target: ATXN1; (+) strand; PAM type: YTN; PAM sequence: CTA
ggaaaatactccacactaaa

SEQ ID NO: 247661 - DNA, 20 bp, Artificial Sequence
  Description of Artificial Sequence: Synthetic oligonucleotide
  Target: ATXN1; (+) strand; PAM type: YTN; PAM sequence: CTC
cacactaaactaaaggaggt

SEQ ID NO: 247662 - DNA, 20 bp, Artificial Sequence
  Description of Artificial Sequence: Synthetic oligonucleotide
  Target: ATXN1; (+) strand; PAM type: YTN; PAM sequence: CTA
aactaaaggaggtgtctcaa

SEQ ID NO: 247663 - DNA, 20 bp, Artificial Sequence
  Description of Artificial Sequence: Synthetic oligonucleotide
  Target: ATXN1; (+) strand; PAM type: YTN; PAM sequence: CTA
aaggaggtgtctcaacaagg

SEQ ID NO: 247664 - DNA, 20 bp, Artificial Sequence
  Description of Artificial Sequence: Synthetic oligonucleotide
  Target: ATXN1; (+) strand; PAM type: YTN; PAM sequence: CTC
aacaaggctgagaacgaggt

SEQ ID NO: 247665 - DNA, 20 bp, Artificial Sequence
  Description of Artificial Sequence: Synthetic oligonucleotide
  Target: ATXN1; (+) strand; PAM type: YTN; PAM sequence: CTG
agaacgaggtctatgacaga

SEQ ID NO: 247666 - DNA, 20 bp, Artificial Sequence
  Description of Artificial Sequence: Synthetic oligonucleotide
  Target: ATXN1; (+) strand; PAM type: YTN; PAM sequence: CTA
tgacagaaatgtgccaagaa

SEQ ID NO: 247667 - DNA, 20 bp, Artificial Sequence
  Description of Artificial Sequence: Synthetic oligonucleotide
  Target: ATXN1; (+) strand; PAM type: YTN; PAM sequence: CTC
atagaatggggaatgctgct

SEQ ID NO: 247668 - DNA, 20 bp, Artificial Sequence
  Description of Artificial Sequence: Synthetic oligonucleotide
  Target: ATXN1; (+) strand; PAM type: YTN; PAM sequence: CTG
ctggttggttagtggcttca

SEQ ID NO: 247669 - DNA, 20 bp, Artificial Sequence
  Description of Artificial Sequence: Synthetic oligonucleotide
  Target: ATXN1; (+) strand; PAM type: YTN; PAM sequence: CTG
gttggttagtggcttcagaa

SEQ ID NO: 247670 - DNA, 20 bp, Artificial Sequence
  Description of Artificial Sequence: Synthetic oligonucleotide
  Target: ATXN1; (+) strand; PAM type: YTN; PAM sequence: TTG
gttagtggcttcagaaaggt

SEQ ID NO: 247671 - DNA, 20 bp, Artificial Sequence
  Description of Artificial Sequence: Synthetic oligonucleotide
  Target: ATXN1; (+) strand; PAM type: YTN; PAM sequence: TTA
gtggcttcagaaaggtgtct

SEQ ID NO: 247672 - DNA, 20 bp, Artificial Sequence
  Description of Artificial Sequence: Synthetic oligonucleotide
  Target: ATXN1; (+) strand; PAM type: YTN; PAM sequence: CTT
cagaaaggtgtctgattctc

SEQ ID NO: 247673 - DNA, 20 bp, Artificial Sequence
  Description of Artificial Sequence: Synthetic oligonucleotide
  Target: ATXN1; (+) strand; PAM type: YTN; PAM sequence: TTC
agaaaggtgtctgattctct

SEQ ID NO: 247674 - DNA, 20 bp, Artificial Sequence
  Description of Artificial Sequence: Synthetic oligonucleotide
  Target: ATXN1; (+) strand; PAM type: YTN; PAM sequence: CTG
attctcttaacaagcaatta

SEQ ID NO: 247675 - DNA, 20 bp, Artificial Sequence
  Description of Artificial Sequence: Synthetic oligonucleotide
  Target: ATXN1; (+) strand; PAM type: YTN; PAM sequence: TTC
tcttaacaagcaattacagg

SEQ ID NO: 247676 - DNA, 20 bp, Artificial Sequence
  Description of Artificial Sequence: Synthetic oligonucleotide
  Target: ATXN1; (+) strand; PAM type: YTN; PAM sequence: CTC
ttaacaagcaattacaggag

SEQ ID NO: 247677 - DNA, 20 bp, Artificial Sequence
  Description of Artificial Sequence: Synthetic oligonucleotide
  Target: ATXN1; (+) strand; PAM type: YTN; PAM sequence: CTT
aacaagcaattacaggaggc

SEQ ID NO: 247678 - DNA, 20 bp, Artificial Sequence
  Description of Artificial Sequence: Synthetic oligonucleotide
  Target: ATXN1; (+) strand; PAM type: YTN; PAM sequence: TTA
acaagcaattacaggaggcc

SEQ ID NO: 247679 - DNA, 20 bp, Artificial Sequence
  Description of Artificial Sequence: Synthetic oligonucleotide
  Target: ATXN1; (+) strand; PAM type: YTN; PAM sequence: TTA
caggaggcccggcatggtgg

SEQ ID NO: 247680 - DNA, 20 bp, Artificial Sequence
  Description of Artificial Sequence: Synthetic oligonucleotide
  Target: ATXN1; (+) strand; PAM type: YTN; PAM sequence: CTC
acacctgtagtcccagcact

SEQ ID NO: 247681 - DNA, 20 bp, Artificial Sequence
  Description of Artificial Sequence: Synthetic oligonucleotide
  Target: ATXN1; (+) strand; PAM type: YTN; PAM sequence: CTG
tagtcccagcactttgggag

SEQ ID NO: 247682 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaggtgggcgg

SEQ ID NO: 247683 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggtgggcgga

SEQ ID NO: 247684 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggtgggcggat

SEQ ID NO: 247685 - DNA, 20 bp, Artificial Sequence
  Description of Artificial Sequence: Synthetic oligonucleotide
  Target: ATXN1; (+) strand; PAM type: YTN; PAM sequence: CTG
aggtgggcggatcttggggt

SEQ ID NO: 247686 - DNA, 20 bp, Artificial Sequence
  Description of Artificial Sequence: Synthetic oligonucleotide
  Target: ATXN1; (+) strand; PAM type: YTN; PAM sequence: CTT
ggggtcaggagttcgagacc

SEQ ID NO: 247687 - DNA, 20 bp, Artificial Sequence
  Description of Artificial Sequence: Synthetic oligonucleotide
  Target: ATXN1; (+) strand; PAM type: YTN; PAM sequence: TTG
gggtcaggagttcgagacca

SEQ ID NO: 247688 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctggccaacat

SEQ ID NO: 247689 - DNA, 20 bp, Artificial Sequence
  Description of Artificial Sequence: Synthetic oligonucleotide
  Target: ATXN1; (+) strand; PAM type: YTN; PAM sequence: CTG
gccaacatgccaaaaccccc

SEQ ID NO: 247690 - DNA, 20 bp, Artificial Sequence
  Description of Artificial Sequence: Synthetic oligonucleotide
  Target: ATXN1; (+) strand; PAM type: YTN; PAM sequence: CTC
tactaaaactacaaaaatta

SEQ ID NO: 247691 - DNA, 20 bp, Artificial Sequence
  Description of Artificial Sequence: Synthetic oligonucleotide
  Target: ATXN1; (+) strand; PAM type: YTN; PAM sequence: CTA
ctaaaactacaaaaattagc

SEQ ID NO: 247692 - DNA, 20 bp, Artificial Sequence
  Description of Artificial Sequence: Synthetic oligonucleotide
  Target: ATXN1; (+) strand; PAM type: YTN; PAM sequence: CTA
aaactacaaaaattagccag

SEQ ID NO: 247693 - DNA, 20 bp, Artificial Sequence
  Description of Artificial Sequence: Synthetic oligonucleotide
  Target: ATXN1; (+) strand; PAM type: YTN; PAM sequence: CTA
caaaaattagccaggcatgg

SEQ ID NO: 247694 - DNA, 20 bp, Artificial Sequence
  Description of Artificial Sequence: Synthetic oligonucleotide
  Target: ATXN1; (+) strand; PAM type: YTN; PAM sequence: TTA
gccaggcatggtggcttgtg

SEQ ID NO: 247695 - DNA, 20 bp, Artificial Sequence
  Description of Artificial Sequence: Synthetic oligonucleotide
  Target: ATXN1; (+) strand; PAM type: YTN; PAM sequence: CTT
gtgcctgtaatccctgctac

SEQ ID NO: 247696 - DNA, 20 bp, Artificial Sequence
  Description of Artificial Sequence: Synthetic oligonucleotide
  Target: ATXN1; (+) strand; PAM type: YTN; PAM sequence: TTG
tgcctgtaatccctgctact

SEQ ID NO: 247697 - DNA, 20 bp, Artificial Sequence
  Description of Artificial Sequence: Synthetic oligonucleotide
  Target: ATXN1; (+) strand; PAM type: YTN; PAM sequence: CTG
taatccctgctactcaggag

SEQ ID NO: 247698 - DNA, 20 bp, Artificial Sequence
  Description of Artificial Sequence: Synthetic oligonucleotide
  Target: ATXN1; (+) strand; PAM type: YTN; PAM sequence: CTG
ctactcaggaggctgaggca

SEQ ID NO: 247699 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctgaggcatga

SEQ ID NO: 247700 - DNA, 20 bp, Artificial Sequence
  Description of Artificial Sequence: Synthetic oligonucleotide
  Target: ATXN1; (+) strand; PAM type: YTN; PAM sequence: CTC
aggaggctgaggcatgagaa

SEQ ID NO: 247701 - DNA, 20 bp, Artificial Sequence
  Description of Artificial Sequence: Synthetic oligonucleotide
  Target: ATXN1; (+) strand; PAM type: YTN; PAM sequence: CTG
aggcatgagaatcacttgaa

SEQ ID NO: 247702 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggcggaggtt

SEQ ID NO: 247703 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggcggaggttg

SEQ ID NO: 247704 - DNA, 20 bp, Artificial Sequence
  Description of Artificial Sequence: Synthetic oligonucleotide
  Target: ATXN1; (+) strand; PAM type: YTN; PAM sequence: CTG
ggaggcggaggttgcaatga

SEQ ID NO: 247705 - DNA, 20 bp, Artificial Sequence
  Description of Artificial Sequence: Synthetic oligonucleotide
  Target: ATXN1; (+) strand; PAM type: YTN; PAM sequence: TTG
caatgagctgagattgcacc

SEQ ID NO: 247706 - DNA, 20 bp, Artificial Sequence
  Description of Artificial Sequence: Synthetic oligonucleotide
  Target: ATXN1; (+) strand; PAM type: YTN; PAM sequence: CTG
agattgcaccactgcactcc

SEQ ID NO: 247707 - DNA, 20 bp, Artificial Sequence
  Description of Artificial Sequence: Synthetic oligonucleotide
  Target: ATXN1; (+) strand; PAM type: YTN; PAM sequence: TTG
caccactgcactccagcctg

SEQ ID NO: 247708 - DNA, 20 bp, Artificial Sequence
  Description of Artificial Sequence: Synthetic oligonucleotide
  Target: ATXN1; (+) strand; PAM type: YTN; PAM sequence: CTG
cactccagcctggacgacag

SEQ ID NO: 247709 - DNA, 20 bp, Artificial Sequence
  Description of Artificial Sequence: Synthetic oligonucleotide
  Target: ATXN1; (+) strand; PAM type: YTN; PAM sequence: CTC
cagcctggacgacagagcaa

SEQ ID NO: 247710 - DNA, 20 bp, Artificial Sequence
  Description of Artificial Sequence: Synthetic oligonucleotide
  Target: ATXN1; (+) strand; PAM type: YTN; PAM sequence: CTG
gacgacagagcaagaccttg

SEQ ID NO: 247711 - DNA, 20 bp, Artificial Sequence
  Description of Artificial Sequence: Synthetic oligonucleotide
  Target: ATXN1; (+) strand; PAM type: YTN; PAM sequence: CTT
gtctcaaaaaaagcaaaaaa

SEQ ID NO: 247712 - DNA, 20 bp, Artificial Sequence
  Description of Artificial Sequence: Synthetic oligonucleotide
  Target: ATXN1; (+) strand; PAM type: YTN; PAM sequence: TTG
tctcaaaaaaagcaaaaaac

SEQ ID NO: 247713 - DNA, 20 bp, Artificial Sequence
  Description of Artificial Sequence: Synthetic oligonucleotide
  Target: ATXN1; (+) strand; PAM type: YTN; PAM sequence: CTC
aaaaaaagcaaaaaacaaaa

SEQ ID NO: 247714 - DNA, 20 bp, Artificial Sequence
  Description of Artificial Sequence: Synthetic oligonucleotide
  Target: ATXN1; (+) strand; PAM type: YTN; PAM sequence: TTA
caaacacacttggccattaa

SEQ ID NO: 247715 - DNA, 20 bp, Artificial Sequence
  Description of Artificial Sequence: Synthetic oligonucleotide
  Target: ATXN1; (+) strand; PAM type: YTN; PAM sequence: CTT
ggccattaaacttgaagcag

SEQ ID NO: 247716 - DNA, 20 bp, Artificial Sequence
  Description of Artificial Sequence: Synthetic oligonucleotide
  Target: ATXN1; (+) strand; PAM type: YTN; PAM sequence: TTG
gccattaaacttgaagcagt

SEQ ID NO: 247717 - DNA, 20 bp, Artificial Sequence
  Description of Artificial Sequence: Synthetic oligonucleotide
  Target: ATXN1; (+) strand; PAM type: YTN; PAM sequence: TTA
aacttgaagcagtgaaaaac

SEQ ID NO: 247718 - DNA, 20 bp, Artificial Sequence
  Description of Artificial Sequence: Synthetic oligonucleotide
  Target: ATXN1; (+) strand; PAM type: YTN; PAM sequence: CTT
gaagcagtgaaaaacagctt

SEQ ID NO: 247719 - DNA, 20 bp, Artificial Sequence
  Description of Artificial Sequence: Synthetic oligonucleotide
  Target: ATXN1; (+) strand; PAM type: YTN; PAM sequence: TTG
aagcagtgaaaaacagcttc

SEQ ID NO: 247720 - DNA, 20 bp, Artificial Sequence
  Description of Artificial Sequence: Synthetic oligonucleotide
  Target: ATXN1; (+) strand; PAM type: YTN; PAM sequence: CTT
cgtctacgagaataaataaa

SEQ ID NO: 247721 - DNA, 20 bp, Artificial Sequence
  Description of Artificial Sequence: Synthetic oligonucleotide
  Target: ATXN1; (+) strand; PAM type: YTN; PAM sequence: TTC
gtctacgagaataaataaat

SEQ ID NO: 247722 - DNA, 20 bp, Artificial Sequence
  Description of Artificial Sequence: Synthetic oligonucleotide
  Target: ATXN1; (+) strand; PAM type: YTN; PAM sequence: CTA
cgagaataaataaataaaaa

SEQ ID NO: 247723 - DNA, 20 bp, Artificial Sequence
  Description of Artificial Sequence: Synthetic oligonucleotide
  Target: ATXN1; (+) strand; PAM type: YTN; PAM sequence: CTG
ctacaggcattatgctttaa

SEQ ID NO: 247724 - DNA, 20 bp, Artificial Sequence
  Description of Artificial Sequence: Synthetic oligonucleotide
  Target: ATXN1; (+) strand; PAM type: YTN; PAM sequence: CTA
caggcattatgctttaagat

SEQ ID NO: 247725 - DNA, 20 bp, Artificial Sequence
  Description of Artificial Sequence: Synthetic oligonucleotide
  Target: ATXN1; (+) strand; PAM type: YTN; PAM sequence: TTA
tgctttaagatcacaatcgt

SEQ ID NO: 247726 - DNA, 20 bp, Artificial Sequence
  Description of Artificial Sequence: Synthetic oligonucleotide
  Target: ATXN1; (+) strand; PAM type: YTN; PAM sequence: CTT
taagatcacaatcgtgcatg

SEQ ID NO: 247727 - DNA, 20 bp, Artificial Sequence
  Description of Artificial Sequence: Synthetic oligonucleotide
  Target: ATXN1; (+) strand; PAM type: YTN; PAM sequence: TTT
aagatcacaatcgtgcatga

SEQ ID NO: 247728 - DNA, 20 bp, Artificial Sequence
  Description of Artificial Sequence: Synthetic oligonucleotide
  Target: ATXN1; (+) strand; PAM type: YTN; PAM sequence: TTA
agatcacaatcgtgcatgag

SEQ ID NO: 247729 - DNA, 20 bp, Artificial Sequence
  Description of Artificial Sequence: Synthetic oligonucleotide
  Target: ATXN1; (+) strand; PAM type: YTN; PAM sequence: TTA
cagtgagggtcccctgagtc

SEQ ID NO: 247730 - DNA, 20 bp, Artificial Sequence
  Description of Artificial Sequence: Synthetic oligonucleotide
  Target: ATXN1; (+) strand; PAM type: YTN; PAM sequence: CTG
agtcgataatcagaaataca

SEQ ID NO: 247731 - DNA, 20 bp, Artificial Sequence
  Description of Artificial Sequence: Synthetic oligonucleotide
  Target: ATXN1; (+) strand; PAM type: YTN; PAM sequence: CTG
taaaaatacacatcctctgt

SEQ ID NO: 247732 - DNA, 20 bp, Artificial Sequence
  Description of Artificial Sequence: Synthetic oligonucleotide
  Target: ATXN1; (+) strand; PAM type: YTN; PAM sequence: CTC
tgtagtttcccaagattgtg

SEQ ID NO: 247733 - DNA, 20 bp, Artificial Sequence
  Description of Artificial Sequence: Synthetic oligonucleotide
  Target: ATXN1; (+) strand; PAM type: YTN; PAM sequence: CTG
tagtttcccaagattgtgta

SEQ ID NO: 247734 - DNA, 20 bp, Artificial Sequence
  Description of Artificial Sequence: Synthetic oligonucleotide
  Target: ATXN1; (+) strand; PAM type: YTN; PAM sequence: TTT
cccaagattgtgtaggtctg

SEQ ID NO: 247735 - DNA, 20 bp, Artificial Sequence
  Description of Artificial Sequence: Synthetic oligonucleotide
  Target: ATXN1; (+) strand; PAM type: YTN; PAM sequence: TTC
ccaagattgtgtaggtctgg

SEQ ID NO: 247736 - DNA, 20 bp, Artificial Sequence
  Description of Artificial Sequence: Synthetic oligonucleotide
  Target: ATXN1; (+) strand; PAM type: YTN; PAM sequence: TTG
tgtaggtctgggctgggacc

SEQ ID NO: 247737 - DNA, 20 bp, Artificial Sequence
  Description of Artificial Sequence: Synthetic oligonucleotide
  Target: ATXN1; (+) strand; PAM type: YTN; PAM sequence: CTG
ggctgggacctaggaatctg

SEQ ID NO: 247738 - DNA, 20 bp, Artificial Sequence
  Description of Artificial Sequence: Synthetic oligonucleotide
  Target: ATXN1; (+) strand; PAM type: YTN; PAM sequence: CTG
ggacctaggaatctgtattt

SEQ ID NO: 247739 - DNA, 20 bp, Artificial Sequence
  Description of Artificial Sequence: Synthetic oligonucleotide
  Target: ATXN1; (+) strand; PAM type: YTN; PAM sequence: CTA
ggaatctgtattttaaaaat

SEQ ID NO: 247740 - DNA, 20 bp, Artificial Sequence
  Description of Artificial Sequence: Synthetic oligonucleotide
  Target: ATXN1; (+) strand; PAM type: YTN; PAM sequence: CTG
tattttaaaaatctcttttg

SEQ ID NO: 247741 - DNA, 20 bp, Artificial Sequence
  Description of Artificial Sequence: Synthetic oligonucleotide
  Target: ATXN1; (+) strand; PAM type: YTN; PAM sequence: TTT
taaaaatctcttttggtgat

SEQ ID NO: 247742 - DNA, 20 bp, Artificial Sequence
  Description of Artificial Sequence: Synthetic oligonucleotide
  Target: ATXN1; (+) strand; PAM type: YTN; PAM sequence: TTT
aaaaatctcttttggtgatt

SEQ ID NO: 247743 - DNA, 20 bp, Artificial Sequence
  Description of Artificial Sequence: Synthetic oligonucleotide
  Target: ATXN1; (+) strand; PAM type: YTN; PAM sequence: TTA
aaaatctcttttggtgattc

SEQ ID NO: 247744 - DNA, 20 bp, Artificial Sequence
  Description of Artificial Sequence: Synthetic oligonucleotide
  Target: ATXN1; (+) strand; PAM type: YTN; PAM sequence: CTC
ttttggtgattctgattggc

SEQ ID NO: 247745 - DNA, 20 bp, Artificial Sequence
  Description of Artificial Sequence: Synthetic oligonucleotide
  Target: ATXN1; (+) strand; PAM type: YTN; PAM sequence: CTT
ttggtgattctgattggcag

SEQ ID NO: 247746 - DNA, 20 bp, Artificial Sequence
  Description of Artificial Sequence: Synthetic oligonucleotide
  Target: ATXN1; (+) strand; PAM type: YTN; PAM sequence: TTT
tggtgattctgattggcagc

SEQ ID NO: 247747 - DNA, 20 bp, Artificial Sequence
  Description of Artificial Sequence: Synthetic oligonucleotide
  Target: ATXN1; (+) strand; PAM type: YTN; PAM sequence: TTT
ggtgattctgattggcagct

SEQ ID NO: 247748 - DNA, 20 bp, Artificial Sequence
  Description of Artificial Sequence: Synthetic oligonucleotide
  Target: ATXN1; (+) strand; PAM type: YTN; PAM sequence: TTG
gtgattctgattggcagcta

SEQ ID NO: 247749 - DNA, 20 bp, Artificial Sequence
  Description of Artificial Sequence: Synthetic oligonucleotide
  Target: ATXN1; (+) strand; PAM type: YTN; PAM sequence: TTC
tgattggcagctaggttggg

SEQ ID NO: 247750 - DNA, 20 bp, Artificial Sequence
  Description of Artificial Sequence: Synthetic oligonucleotide
  Target: ATXN1; (+) strand; PAM type: YTN; PAM sequence: CTG
attggcagctaggttgggga

SEQ ID NO: 247751 - DNA, 20 bp, Artificial Sequence
  Description of Artificial Sequence: Synthetic oligonucleotide
  Target: ATXN1; (+) strand; PAM type: YTN; PAM sequence: TTG
gcagctaggttggggaacta

SEQ ID NO: 247752 - DNA, 20 bp, Artificial Sequence
  Description of Artificial Sequence: Synthetic oligonucleotide
  Target: ATXN1; (+) strand; PAM type: YTN; PAM sequence: CTA
ggttggggaactactacact

SEQ ID NO: 247753 - DNA, 20 bp, Artificial Sequence
  Description of Artificial Sequence: Synthetic oligonucleotide
  Target: ATXN1; (+) strand; PAM type: YTN; PAM sequence: TTG
gggaactactacactagacc

SEQ ID NO: 247754 - DNA, 20 bp, Artificial Sequence
  Description of Artificial Sequence: Synthetic oligonucleotide
  Target: ATXN1; (+) strand; PAM type: YTN; PAM sequence: CTA
ctacactagacctgtgcttc

SEQ ID NO: 247755 - DNA, 20 bp, Artificial Sequence
  Description of Artificial Sequence: Synthetic oligonucleotide
  Target: ATXN1; (+) strand; PAM type: YTN; PAM sequence: CTA
cactagacctgtgcttctta

SEQ ID NO: 247756 - DNA, 20 bp, Artificial Sequence
  Description of Artificial Sequence: Synthetic oligonucleotide
  Target: ATXN1; (+) strand; PAM type: YTN; PAM sequence: CTA
gacctgtgcttcttaacctt

SEQ ID NO: 247757 - DNA, 20 bp, Artificial Sequence
  Description of Artificial Sequence: Synthetic oligonucleotide
  Target: ATXN1; (+) strand; PAM type: YTN; PAM sequence: CTG
tgcttcttaaccttggcagc

SEQ ID NO: 247758 - DNA, 20 bp, Artificial Sequence
  Description of Artificial Sequence: Synthetic oligonucleotide
  Target: ATXN1; (+) strand; PAM type: YTN; PAM sequence: CTT
cttaaccttggcagcacagg

SEQ ID NO: 247759 - DNA, 20 bp, Artificial Sequence
  Description of Artificial Sequence: Synthetic oligonucleotide
  Target: ATXN1; (+) strand; PAM type: YTN; PAM sequence: TTC
ttaaccttggcagcacagga

SEQ ID NO: 247760 - DNA, 20 bp, Artificial Sequence
  Description of Artificial Sequence: Synthetic oligonucleotide
  Target: ATXN1; (+) strand; PAM type: YTN; PAM sequence: CTT
aaccttggcagcacaggaga

SEQ ID NO: 247761 - DNA, 20 bp, Artificial Sequence
  Description of Artificial Sequence: Synthetic oligonucleotide
  Target: ATXN1; (+) strand; PAM type: YTN; PAM sequence: TTA
accttggcagcacaggagaa

SEQ ID NO: 247762 - DNA, 20 bp, Artificial Sequence
  Description of Artificial Sequence: Synthetic oligonucleotide
  Target: ATXN1; (+) strand; PAM type: YTN; PAM sequence: CTT
ggcagcacaggagaatcacc

SEQ ID NO: 247763 - DNA, 20 bp, Artificial Sequence
  Description of Artificial Sequence: Synthetic oligonucleotide
  Target: ATXN1; (+) strand; PAM type: YTN; PAM sequence: TTG
gcagcacaggagaatcacct

SEQ ID NO: 247764 - DNA, 20 bp, Artificial Sequence
  Description of Artificial Sequence: Synthetic oligonucleotide
  Target: ATXN1; (+) strand; PAM type: YTN; PAM sequence: CTG
gaaagattttgaaaagtctt

SEQ ID NO: 247765 - DNA, 20 bp, Artificial Sequence
  Description of Artificial Sequence: Synthetic oligonucleotide
  Target: ATXN1; (+) strand; PAM type: YTN; PAM sequence: TTT
tgaaaagtcttgccggtcac

SEQ ID NO: 247766 - DNA, 20 bp, Artificial Sequence
  Description of Artificial Sequence: Synthetic oligonucleotide
  Target: ATXN1; (+) strand; PAM type: YTN; PAM sequence: TTT
gaaaagtcttgccggtcaca

SEQ ID NO: 247767 - DNA, 20 bp, Artificial Sequence
  Description of Artificial Sequence: Synthetic oligonucleotide
  Target: ATXN1; (+) strand; PAM type: YTN; PAM sequence: TTG
aaaagtcttgccggtcacac

SEQ ID NO: 247768 - DNA, 20 bp, Artificial Sequence
  Description of Artificial Sequence: Synthetic oligonucleotide
  Target: ATXN1; (+) strand; PAM type: YTN; PAM sequence: CTT
gccggtcacaccacactcca

SEQ ID NO: 247769 - DNA, 20 bp, Artificial Sequence
  Description of Artificial Sequence: Synthetic oligonucleotide
  Target: ATXN1; (+) strand; PAM type: YTN; PAM sequence: TTG
ccggtcacaccacactccag

SEQ ID NO: 247770 - DNA, 20 bp, Artificial Sequence
  Description of Artificial Sequence: Synthetic oligonucleotide
  Target: ATXN1; (+) strand; PAM type: YTN; PAM sequence: CTC
caggccactgaactcagaac

SEQ ID NO: 247771 - DNA, 20 bp, Artificial Sequence
  Description of Artificial Sequence: Synthetic oligonucleotide
  Target: ATXN1; (+) strand; PAM type: YTN; PAM sequence: CTG
aactcagaacctatagggtc

SEQ ID NO: 247772 - DNA, 20 bp, Artificial Sequence
  Description of Artificial Sequence: Synthetic oligonucleotide
  Target: ATXN1; (+) strand; PAM type: YTN; PAM sequence: CTC
agaacctatagggtcggagt

SEQ ID NO: 247773 - DNA, 20 bp, Artificial Sequence
  Description of Artificial Sequence: Synthetic oligonucleotide
  Target: ATXN1; (+) strand; PAM type: YTN; PAM sequence: CTA
tagggtcggagtgggtatca

SEQ ID NO: 247774 - DNA, 20 bp, Artificial Sequence
  Description of Artificial Sequence: Synthetic oligonucleotide
  Target: ATXN1; (+) strand; PAM type: YTN; PAM sequence: TTT
caatgtgcagccatggttga

SEQ ID NO: 247775 - DNA, 20 bp, Artificial Sequence
  Description of Artificial Sequence: Synthetic oligonucleotide
  Target: ATXN1; (+) strand; PAM type: YTN; PAM sequence: TTC
aatgtgcagccatggttgag

SEQ ID NO: 247776 - DNA, 20 bp, Artificial Sequence
  Description of Artificial Sequence: Synthetic oligonucleotide
  Target: ATXN1; (+) strand; PAM type: YTN; PAM sequence: TTG
agaatcagtgcagtggaccc

SEQ ID NO: 247777 - DNA, 20 bp, Artificial Sequence
  Description of Artificial Sequence: Synthetic oligonucleotide
  Target: ATXN1; (+) strand; PAM type: YTN; PAM sequence: CTC
agttccctgacggaggaaca

SEQ ID NO: 247778 - DNA, 20 bp, Artificial Sequence
  Description of Artificial Sequence: Synthetic oligonucleotide
  Target: ATXN1; (+) strand; PAM type: YTN; PAM sequence: TTC
cctgacggaggaacatattc

SEQ ID NO: 247779 - DNA, 20 bp, Artificial Sequence
  Description of Artificial Sequence: Synthetic oligonucleotide
  Target: ATXN1; (+) strand; PAM type: YTN; PAM sequence: CTG
acggaggaacatattcatgt

SEQ ID NO: 247780 - DNA, 20 bp, Artificial Sequence
  Description of Artificial Sequence: Synthetic oligonucleotide
  Target: ATXN1; (+) strand; PAM type: YTN; PAM sequence: TTC
atgtatgtacctccctaaaa

SEQ ID NO: 247781 - DNA, 20 bp, Artificial Sequence
  Description of Artificial Sequence: Synthetic oligonucleotide
  Target: ATXN1; (+) strand; PAM type: YTN; PAM sequence: CTC
cctaaaacagtgccctccac

SEQ ID NO: 247782 - DNA, 20 bp, Artificial Sequence
  Description of Artificial Sequence: Synthetic oligonucleotide
  Target: ATXN1; (+) strand; PAM type: YTN; PAM sequence: CTA
aaacagtgccctccacaata

SEQ ID NO: 247783 - DNA, 20 bp, Artificial Sequence
  Description of Artificial Sequence: Synthetic oligonucleotide
  Target: ATXN1; (+) strand; PAM type: YTN; PAM sequence: CTC
cacaataaagccagaccccc

SEQ ID NO: 247784 - DNA, 20 bp, Artificial Sequence
  Description of Artificial Sequence: Synthetic oligonucleotide
  Target: ATXN1; (+) strand; PAM type: YTN; PAM sequence: CTT
ccttctatcttatttcactt

SEQ ID NO: 247785 - DNA, 20 bp, Artificial Sequence
  Description of Artificial Sequence: Synthetic oligonucleotide
  Target: ATXN1; (+) strand; PAM type: YTN; PAM sequence: TTC
cttctatcttatttcactta

SEQ ID NO: 247786 - DNA, 20 bp, Artificial Sequence
  Description of Artificial Sequence: Synthetic oligonucleotide
  Target: ATXN1; (+) strand; PAM type: YTN; PAM sequence: CTT
ctatcttatttcacttattt

SEQ ID NO: 247787 - DNA, 20 bp, Artificial Sequence
  Description of Artificial Sequence: Synthetic oligonucleotide
  Target: ATXN1; (+) strand; PAM type: YTN; PAM sequence: TTC
tatcttatttcacttatttt

SEQ ID NO: 247788 - DNA, 20 bp, Artificial Sequence
  Description of Artificial Sequence: Synthetic oligonucleotide
  Target: ATXN1; (+) strand; PAM type: YTN; PAM sequence: CTA
tcttatttcacttatttttt

SEQ ID NO: 247789 - DNA, 20 bp, Artificial Sequence
  Description of Artificial Sequence: Synthetic oligonucleotide
  Target: ATXN1; (+) strand; PAM type: YTN; PAM sequence: CTT
atttcacttatttttttttt

SEQ ID NO: 247790 - DNA, 20 bp, Artificial Sequence
  Description of Artificial Sequence: Synthetic oligonucleotide
  Target: ATXN1; (+) strand; PAM type: YTN; PAM sequence: TTA
tttcacttattttttttttt

SEQ ID NO: 247791 - DNA, 20 bp, Artificial Sequence
  Description of Artificial Sequence: Synthetic oligonucleotide
  Target: ATXN1; (+) strand; PAM type: YTN; PAM sequence: TTT
cacttatttttttttttgag

SEQ ID NO: 247792 - DNA, 20 bp, Artificial Sequence
  Description of Artificial Sequence: Synthetic oligonucleotide
  Target: ATXN1; (+) strand; PAM type: YTN; PAM sequence: TTC
acttatttttttttttgaga

SEQ ID NO: 247793 - DNA, 20 bp, Artificial Sequence
  Description of Artificial Sequence: Synthetic oligonucleotide
  Target: ATXN1; (+) strand; PAM type: YTN; PAM sequence: CTT
atttttttttttgagatgga

SEQ ID NO: 247794 - DNA, 20 bp, Artificial Sequence
  Description of Artificial Sequence: Synthetic oligonucleotide
  Target: ATXN1; (+) strand; PAM type: YTN; PAM sequence: TTA
tttttttttttgagatggag

SEQ ID NO: 247795 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagatggagtct

SEQ ID NO: 247796 - DNA, 20 bp, Artificial Sequence
  Description of Artificial Sequence: Synthetic oligonucleotide
  Target: ATXN1; (+) strand; PAM type: YTN; PAM sequence: TTT
tttttttgagatggagtctc

SEQ ID NO: 247797 - DNA, 20 bp, Artificial Sequence
  Description of Artificial Sequence: Synthetic oligonucleotide
  Target: ATXN1; (+) strand; PAM type: YTN; PAM sequence: TTT
ttttttgagatggagtctcg

SEQ ID NO: 247798 - DNA, 20 bp, Artificial Sequence
  Description of Artificial Sequence: Synthetic oligonucleotide
  Target: ATXN1; (+) strand; PAM type: YTN; PAM sequence: TTT
tttttgagatggagtctcgc

SEQ ID NO: 247799 - DNA, 20 bp, Artificial Sequence
  Description of Artificial Sequence: Synthetic oligonucleotide
  Target: ATXN1; (+) strand; PAM type: YTN; PAM sequence: TTT
ttttgagatggagtctcgct

SEQ ID NO: 247800 - DNA, 20 bp, Artificial Sequence
  Description of Artificial Sequence: Synthetic oligonucleotide
  Target: ATXN1; (+) strand; PAM type: YTN; PAM sequence: TTT
tttgagatggagtctcgctc

SEQ ID NO: 247801 - DNA, 20 bp, Artificial Sequence
  Description of Artificial Sequence: Synthetic oligonucleotide
  Target: ATXN1; (+) strand; PAM type: YTN; PAM sequence: TTT
ttgagatggagtctcgctct

SEQ ID NO: 247802 - DNA, 20 bp, Artificial Sequence
  Description of Artificial Sequence: Synthetic oligonucleotide
  Target: ATXN1; (+) strand; PAM type: YTN; PAM sequence: TTT
tgagatggagtctcgctctg

SEQ ID NO: 247803 - DNA, 20 bp, Artificial Sequence
  Description of Artificial Sequence: Synthetic oligonucleotide
  Target: ATXN1; (+) strand; PAM type: YTN; PAM sequence: TTT
gagatggagtctcgctctgt

SEQ ID NO: 247804 - DNA, 20 bp, Artificial Sequence
  Description of Artificial Sequence: Synthetic oligonucleotide
  Target: ATXN1; (+) strand; PAM type: YTN; PAM sequence: TTG
agatggagtctcgctctgtc

SEQ ID NO: 247805 - DNA, 20 bp, Artificial Sequence
  Description of Artificial Sequence: Synthetic oligonucleotide
  Target: ATXN1; (+) strand; PAM type: YTN; PAM sequence: CTC
gctctgtcgcccaggctgga

SEQ ID NO: 247806 - DNA, 20 bp, Artificial Sequence
  Description of Artificial Sequence: Synthetic oligonucleotide
  Target: ATXN1; (+) strand; PAM type: YTN; PAM sequence: CTC
tgtcgcccaggctggagtgc

SEQ ID NO: 247807 - DNA, 20 bp, Artificial Sequence
  Description of Artificial Sequence: Synthetic oligonucleotide
  Target: ATXN1; (+) strand; PAM type: YTN; PAM sequence: CTG
tcgcccaggctggagtgcag

SEQ ID NO: 247808 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggtgcaatctc

SEQ ID NO: 247809 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcaacctctgcc

SEQ ID NO: 247810 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctgcctcctg

SEQ ID NO: 247811 - DNA, 20 bp, Artificial Sequence
  Description of Artificial Sequence: Synthetic oligonucleotide
  Target: ATXN1; (+) strand; PAM type: YTN; PAM sequence: CTG
caacctctgcctcctgggtt

SEQ ID NO: 247812 - DNA, 20 bp, Artificial Sequence
  Description of Artificial Sequence: Synthetic oligonucleotide
  Target: ATXN1; (+) strand; PAM type: YTN; PAM sequence: CTC
tgcctcctgggttcaagcga

SEQ ID NO: 247813 - DNA, 20 bp, Artificial Sequence
  Description of Artificial Sequence: Synthetic oligonucleotide
  Target: ATXN1; (+) strand; PAM type: YTN; PAM sequence: CTG
cctcctgggttcaagcgatt

SEQ ID NO: 247814 - DNA, 20 bp, Artificial Sequence
  Description of Artificial Sequence: Synthetic oligonucleotide
  Target: ATXN1; (+) strand; PAM type: YTN; PAM sequence: CTC
ctgggttcaagcgattctcc

SEQ ID NO: 247815 - DNA, 20 bp, Artificial Sequence
  Description of Artificial Sequence: Synthetic oligonucleotide
  Target: ATXN1; (+) strand; PAM type: YTN; PAM sequence: CTG
ggttcaagcgattctcctgc

SEQ ID NO: 247816 - DNA, 20 bp, Artificial Sequence
  Description of Artificial Sequence: Synthetic oligonucleotide
  Target: ATXN1; (+) strand; PAM type: YTN; PAM sequence: TTC
aagcgattctcctgcctcag

SEQ ID NO: 247817 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctctctag

SEQ ID NO: 247818 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctctctagta

SEQ ID NO: 247819 - DNA, 20 bp, Artificial Sequence
  Description of Artificial Sequence: Synthetic oligonucleotide
  Target: ATXN1; (+) strand; PAM type: YTN; PAM sequence: CTG
cctcagcctctctagtagct

SEQ ID NO: 247820 - DNA, 20 bp, Artificial Sequence
  Description of Artificial Sequence: Synthetic oligonucleotide
  Target: ATXN1; (+) strand; PAM type: YTN; PAM sequence: CTC
agcctctctagtagctggga

SEQ ID NO: 247821 - DNA, 20 bp, Artificial Sequence
  Description of Artificial Sequence: Synthetic oligonucleotide
  Target: ATXN1; (+) strand; PAM type: YTN; PAM sequence: CTC
tctagtagctgggactacag

SEQ ID NO: 247822 - DNA, 20 bp, Artificial Sequence
  Description of Artificial Sequence: Synthetic oligonucleotide
  Target: ATXN1; (+) strand; PAM type: YTN; PAM sequence: CTC
tagtagctgggactacaggt

SEQ ID NO: 247823 - DNA, 20 bp, Artificial Sequence
  Description of Artificial Sequence: Synthetic oligonucleotide
  Target: ATXN1; (+) strand; PAM type: YTN; PAM sequence: CTA
gtagctgggactacaggtgt

SEQ ID NO: 247824 - DNA, 20 bp, Artificial Sequence
  Description of Artificial Sequence: Synthetic oligonucleotide
  Target: ATXN1; (+) strand; PAM type: YTN; PAM sequence: CTG
ggactacaggtgtgcgccac

SEQ ID NO: 247825 - DNA, 20 bp, Artificial Sequence
  Description of Artificial Sequence: Synthetic oligonucleotide
  Target: ATXN1; (+) strand; PAM type: YTN; PAM sequence: CTA
caggtgtgcgccaccatgcc

SEQ ID NO: 247826 - DNA, 20 bp, Artificial Sequence
  Description of Artificial Sequence: Synthetic oligonucleotide
  Target: ATXN1; (+) strand; PAM type: YTN; PAM sequence: CTG
gctaattttttgtattttta

SEQ ID NO: 247827 - DNA, 20 bp, Artificial Sequence
  Description of Artificial Sequence: Synthetic oligonucleotide
  Target: ATXN1; (+) strand; PAM type: YTN; PAM sequence: CTA
attttttgtatttttagtag

SEQ ID NO: 247828 - DNA, 20 bp, Artificial Sequence
  Description of Artificial Sequence: Synthetic oligonucleotide
  Target: ATXN1; (+) strand; PAM type: YTN; PAM sequence: TTT
tttgtatttttagtagagac

SEQ ID NO: 247829 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagacg

SEQ ID NO: 247830 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagacgg

SEQ ID NO: 247831 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagacggg

SEQ ID NO: 247832 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagacggga

SEQ ID NO: 247833 - DNA, 20 bp, Artificial Sequence
  Description of Artificial Sequence: Synthetic oligonucleotide
  Target: ATXN1; (+) strand; PAM type: YTN; PAM sequence: TTT
ttagtagagacgggatttca

SEQ ID NO: 247834 - DNA, 20 bp, Artificial Sequence
  Description of Artificial Sequence: Synthetic oligonucleotide
  Target: ATXN1; (+) strand; PAM type: YTN; PAM sequence: TTT
tagtagagacgggatttcac

SEQ ID NO: 247835 - DNA, 20 bp, Artificial Sequence
  Description of Artificial Sequence: Synthetic oligonucleotide
  Target: ATXN1; (+) strand; PAM type: YTN; PAM sequence: TTT
agtagagacgggatttcact

SEQ ID NO: 247836 - DNA, 20 bp, Artificial Sequence
  Description of Artificial Sequence: Synthetic oligonucleotide
  Target: ATXN1; (+) strand; PAM type: YTN; PAM sequence: TTA
gtagagacgggatttcactg

SEQ ID NO: 247837 - DNA, 20 bp, Artificial Sequence
  Description of Artificial Sequence: Synthetic oligonucleotide
  Target: ATXN1; (+) strand; PAM type: YTN; PAM sequence: TTT
cactgtgttagccaggatgg

SEQ ID NO: 247838 - DNA, 20 bp, Artificial Sequence
  Description of Artificial Sequence: Synthetic oligonucleotide
  Target: ATXN1; (+) strand; PAM type: YTN; PAM sequence: TTC
actgtgttagccaggatggt

SEQ ID NO: 247839 - DNA, 20 bp, Artificial Sequence
  Description of Artificial Sequence: Synthetic oligonucleotide
  Target: ATXN1; (+) strand; PAM type: YTN; PAM sequence: CTG
tgttagccaggatggtctca

SEQ ID NO: 247840 - DNA, 20 bp, Artificial Sequence
  Description of Artificial Sequence: Synthetic oligonucleotide
  Target: ATXN1; (+) strand; PAM type: YTN; PAM sequence: TTA
gccaggatggtctcaatctc

SEQ ID NO: 247841 - DNA, 20 bp, Artificial Sequence
  Description of Artificial Sequence: Synthetic oligonucleotide
  Target: ATXN1; (+) strand; PAM type: YTN; PAM sequence: CTC
aatctcctgacctcctgatc

SEQ ID NO: 247842 - DNA, 20 bp, Artificial Sequence
  Description of Artificial Sequence: Synthetic oligonucleotide
  Target: ATXN1; (+) strand; PAM type: YTN; PAM sequence: CTC
ctgacctcctgatctacctg

SEQ ID NO: 247843 - DNA, 20 bp, Artificial Sequence
  Description of Artificial Sequence: Synthetic oligonucleotide
  Target: ATXN1; (+) strand; PAM type: YTN; PAM sequence: CTG
acctcctgatctacctgcct

SEQ ID NO: 247844 - DNA, 20 bp, Artificial Sequence
  Description of Artificial Sequence: Synthetic oligonucleotide
  Target: ATXN1; (+) strand; PAM type: YTN; PAM sequence: CTC
ctgatctacctgcctcagcc

SEQ ID NO: 247845 - DNA, 20 bp, Artificial Sequence
  Description of Artificial Sequence: Synthetic oligonucleotide
  Target: ATXN1; (+) strand; PAM type: YTN; PAM sequence: CTG
atctacctgcctcagcctcc

SEQ ID NO: 247846 - DNA, 20 bp, Artificial Sequence
  Description of Artificial Sequence: Synthetic oligonucleotide
  Target: ATXN1; (+) strand; PAM type: YTN; PAM sequence: CTA
cctgcctcagcctcccaaag

SEQ ID NO: 247847 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaaagtgtg

SEQ ID NO: 247848 - DNA, 20 bp, Artificial Sequence
  Description of Artificial Sequence: Synthetic oligonucleotide
  Target: ATXN1; (+) strand; PAM type: YTN; PAM sequence: CTC
agcctcccaaagtgtgggga

SEQ ID NO: 247849 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgtggggattacag

SEQ ID NO: 247850 - DNA, 20 bp, Artificial Sequence
  Description of Artificial Sequence: Synthetic oligonucleotide
  Target: ATXN1; (+) strand; PAM type: YTN; PAM sequence: TTA
cagccaccgcactcggaccc

SEQ ID NO: 247851 - DNA, 20 bp, Artificial Sequence
  Description of Artificial Sequence: Synthetic oligonucleotide
  Target: ATXN1; (+) strand; PAM type: YTN; PAM sequence: CTC
ggacccttctattttataaa

SEQ ID NO: 247852 - DNA, 20 bp, Artificial Sequence
  Description of Artificial Sequence: Synthetic oligonucleotide
  Target: ATXN1; (+) strand; PAM type: YTN; PAM sequence: CTT
ctattttataaagctgggtt

SEQ ID NO: 247853 - DNA, 20 bp, Artificial Sequence
  Description of Artificial Sequence: Synthetic oligonucleotide
  Target: ATXN1; (+) strand; PAM type: YTN; PAM sequence: TTC
tattttataaagctgggtta

SEQ ID NO: 247854 - DNA, 20 bp, Artificial Sequence
  Description of Artificial Sequence: Synthetic oligonucleotide
  Target: ATXN1; (+) strand; PAM type: YTN; PAM sequence: CTA
ttttataaagctgggttaca

SEQ ID NO: 247855 - DNA, 20 bp, Artificial Sequence
  Description of Artificial Sequence: Synthetic oligonucleotide
  Target: ATXN1; (+) strand; PAM type: YTN; PAM sequence: TTT
tataaagctgggttacacat

SEQ ID NO: 247856 - DNA, 20 bp, Artificial Sequence
  Description of Artificial Sequence: Synthetic oligonucleotide
  Target: ATXN1; (+) strand; PAM type: YTN; PAM sequence: TTT
ataaagctgggttacacatg

SEQ ID NO: 247857 - DNA, 20 bp, Artificial Sequence
  Description of Artificial Sequence: Synthetic oligonucleotide
  Target: ATXN1; (+) strand; PAM type: YTN; PAM sequence: TTA
taaagctgggttacacatgg

SEQ ID NO: 247858 - DNA, 20 bp, Artificial Sequence
  Description of Artificial Sequence: Synthetic oligonucleotide
  Target: ATXN1; (+) strand; PAM type: YTN; PAM sequence: CTG
ggttacacatggaatttgtt

SEQ ID NO: 247859 - DNA, 20 bp, Artificial Sequence
  Description of Artificial Sequence: Synthetic oligonucleotide
  Target: ATXN1; (+) strand; PAM type: YTN; PAM sequence: TTA
cacatggaatttgtttgtat

SEQ ID NO: 247860 - DNA, 20 bp, Artificial Sequence
  Description of Artificial Sequence: Synthetic oligonucleotide
  Target: ATXN1; (+) strand; PAM type: YTN; PAM sequence: TTT
gtttgtattaaaccaagctt

SEQ ID NO: 247861 - DNA, 20 bp, Artificial Sequence
  Description of Artificial Sequence: Synthetic oligonucleotide
  Target: ATXN1; (+) strand; PAM type: YTN; PAM sequence: TTG
tttgtattaaaccaagcttt

SEQ ID NO: 247862 - DNA, 20 bp, Artificial Sequence
  Description of Artificial Sequence: Synthetic oligonucleotide
  Target: ATXN1; (+) strand; PAM type: YTN; PAM sequence: TTT
gtattaaaccaagcttttcc

SEQ ID NO: 247863 - DNA, 20 bp, Artificial Sequence
  Description of Artificial Sequence: Synthetic oligonucleotide
  Target: ATXN1; (+) strand; PAM type: YTN; PAM sequence: TTG
tattaaaccaagcttttccc

SEQ ID NO: 247864 - DNA, 20 bp, Artificial Sequence
  Description of Artificial Sequence: Synthetic oligonucleotide
  Target: ATXN1; (+) strand; PAM type: YTN; PAM sequence: TTA
aaccaagcttttcccagaaa

SEQ ID NO: 247865 - DNA, 20 bp, Artificial Sequence
  Description of Artificial Sequence: Synthetic oligonucleotide
  Target: ATXN1; (+) strand; PAM type: YTN; PAM sequence: CTT
ttcccagaaaacaaaatcga

SEQ ID NO: 247866 - DNA, 20 bp, Artificial Sequence
  Description of Artificial Sequence: Synthetic oligonucleotide
  Target: ATXN1; (+) strand; PAM type: YTN; PAM sequence: TTT
tcccagaaaacaaaatcgag

SEQ ID NO: 247867 - DNA, 20 bp, Artificial Sequence
  Description of Artificial Sequence: Synthetic oligonucleotide
  Target: ATXN1; (+) strand; PAM type: YTN; PAM sequence: TTT
cccagaaaacaaaatcgagt

SEQ ID NO: 247868 - DNA, 20 bp, Artificial Sequence
  Description of Artificial Sequence: Synthetic oligonucleotide
  Target: ATXN1; (+) strand; PAM type: YTN; PAM sequence: TTC
ccagaaaacaaaatcgagtc

SEQ ID NO: 247869 - DNA, 20 bp, Artificial Sequence
  Description of Artificial Sequence: Synthetic oligonucleotide
  Target: ATXN1; (+) strand; PAM type: YTN; PAM sequence: CTT
ttaaacaaagtttttagata

SEQ ID NO: 247870 - DNA, 20 bp, Artificial Sequence
  Description of Artificial Sequence: Synthetic oligonucleotide
  Target: ATXN1; (+) strand; PAM type: YTN; PAM sequence: TTT
taaacaaagtttttagatat

SEQ ID NO: 247871 - DNA, 20 bp, Artificial Sequence
  Description of Artificial Sequence: Synthetic oligonucleotide
  Target: ATXN1; (+) strand; PAM type: YTN; PAM sequence: TTT
aaacaaagtttttagatatt

SEQ ID NO: 247872 - DNA, 20 bp, Artificial Sequence
  Description of Artificial Sequence: Synthetic oligonucleotide
  Target: ATXN1; (+) strand; PAM type: YTN; PAM sequence: TTA
aacaaagtttttagatattt

SEQ ID NO: 247873 - DNA, 20 bp, Artificial Sequence
  Description of Artificial Sequence: Synthetic oligonucleotide
  Target: ATXN1; (+) strand; PAM type: YTN; PAM sequence: TTT
ttagatatttagaggataat

SEQ ID NO: 247874 - DNA, 20 bp, Artificial Sequence
  Description of Artificial Sequence: Synthetic oligonucleotide
  Target: ATXN1; (+) strand; PAM type: YTN; PAM sequence: TTT
tagatatttagaggataata

SEQ ID NO: 247875 - DNA, 20 bp, Artificial Sequence
  Description of Artificial Sequence: Synthetic oligonucleotide
  Target: ATXN1; (+) strand; PAM type: YTN; PAM sequence: TTT
agatatttagaggataatat

SEQ ID NO: 247876 - DNA, 20 bp, Artificial Sequence
  Description of Artificial Sequence: Synthetic oligonucleotide
  Target: ATXN1; (+) strand; PAM type: YTN; PAM sequence: TTA
gatatttagaggataatata

SEQ ID NO: 247877 - DNA, 20 bp, Artificial Sequence
  Description of Artificial Sequence: Synthetic oligonucleotide
  Target: ATXN1; (+) strand; PAM type: YTN; PAM sequence: TTT
agaggataatataattatct

SEQ ID NO: 247878 - DNA, 20 bp, Artificial Sequence
  Description of Artificial Sequence: Synthetic oligonucleotide
  Target: ATXN1; (+) strand; PAM type: YTN; PAM sequence: TTA
gaggataatataattatcta

SEQ ID NO: 247879 - DNA, 20 bp, Artificial Sequence
  Description of Artificial Sequence: Synthetic oligonucleotide
  Target: ATXN1; (+) strand; PAM type: YTN; PAM sequence: TTA
tctacactttgaggggtgag

SEQ ID NO: 247880 - DNA, 20 bp, Artificial Sequence
  Description of Artificial Sequence: Synthetic oligonucleotide
  Target: ATXN1; (+) strand; PAM type: YTN; PAM sequence: CTA
cactttgaggggtgagagct

SEQ ID NO: 247881 - DNA, 20 bp, Artificial Sequence
  Description of Artificial Sequence: Synthetic oligonucleotide
  Target: ATXN1; (+) strand; PAM type: YTN; PAM sequence: CTT
tgaggggtgagagctctaaa

SEQ ID NO: 247882 - DNA, 20 bp, Artificial Sequence
  Description of Artificial Sequence: Synthetic oligonucleotide
  Target: ATXN1; (+) strand; PAM type: YTN; PAM sequence: TTT
gaggggtgagagctctaaaa

SEQ ID NO: 247883 - DNA, 20 bp, Artificial Sequence
  Description of Artificial Sequence: Synthetic oligonucleotide
  Target: ATXN1; (+) strand; PAM type: YTN; PAM sequence: TTG
aggggtgagagctctaaaaa

SEQ ID NO: 247884 - DNA, 20 bp, Artificial Sequence
  Description of Artificial Sequence: Synthetic oligonucleotide
  Target: ATXN1; (+) strand; PAM type: YTN; PAM sequence: CTC
taaaaagaaccttagttgct

SEQ ID NO: 247885 - DNA, 20 bp, Artificial Sequence
  Description of Artificial Sequence: Synthetic oligonucleotide
  Target: ATXN1; (+) strand; PAM type: YTN; PAM sequence: CTA
aaaagaaccttagttgcttg

SEQ ID NO: 247886 - DNA, 20 bp, Artificial Sequence
  Description of Artificial Sequence: Synthetic oligonucleotide
  Target: ATXN1; (+) strand; PAM type: YTN; PAM sequence: CTT
agttgcttggaggcaacaag

SEQ ID NO: 247887 - DNA, 20 bp, Artificial Sequence
  Description of Artificial Sequence: Synthetic oligonucleotide
  Target: ATXN1; (+) strand; PAM type: YTN; PAM sequence: TTA
gttgcttggaggcaacaagt

SEQ ID NO: 247888 - DNA, 20 bp, Artificial Sequence
  Description of Artificial Sequence: Synthetic oligonucleotide
  Target: ATXN1; (+) strand; PAM type: YTN; PAM sequence: TTG
cttggaggcaacaagtagat

SEQ ID NO: 247889 - DNA, 20 bp, Artificial Sequence
  Description of Artificial Sequence: Synthetic oligonucleotide
  Target: ATXN1; (+) strand; PAM type: YTN; PAM sequence: CTT
ggaggcaacaagtagatcaa

SEQ ID NO: 247890 - DNA, 20 bp, Artificial Sequence
  Description of Artificial Sequence: Synthetic oligonucleotide
  Target: ATXN1; (+) strand; PAM type: YTN; PAM sequence: TTG
gaggcaacaagtagatcaag

SEQ ID NO: 247891 - DNA, 20 bp, Artificial Sequence
  Description of Artificial Sequence: Synthetic oligonucleotide
  Target: ATXN1; (+) strand; PAM type: YTN; PAM sequence: CTG
acatcctctctgggttgttc

SEQ ID NO: 247892 - DNA, 20 bp, Artificial Sequence
  Description of Artificial Sequence: Synthetic oligonucleotide
  Target: ATXN1; (+) strand; PAM type: YTN; PAM sequence: CTC
tctgggttgttcttctgatt

SEQ ID NO: 247893 - DNA, 20 bp, Artificial Sequence
  Description of Artificial Sequence: Synthetic oligonucleotide
  Target: ATXN1; (+) strand; PAM type: YTN; PAM sequence: CTC
tgggttgttcttctgatttg

SEQ ID NO: 247894 - DNA, 20 bp, Artificial Sequence
  Description of Artificial Sequence: Synthetic oligonucleotide
  Target: ATXN1; (+) strand; PAM type: YTN; PAM sequence: CTG
ggttgttcttctgatttgtg

SEQ ID NO: 247895 - DNA, 20 bp, Artificial Sequence
  Description of Artificial Sequence: Synthetic oligonucleotide
  Target: ATXN1; (+) strand; PAM type: YTN; PAM sequence: TTG
ttcttctgatttgtgatggg

SEQ ID NO: 247896 - DNA, 20 bp, Artificial Sequence
  Description of Artificial Sequence: Synthetic oligonucleotide
  Target: ATXN1; (+) strand; PAM type: YTN; PAM sequence: TTC
ttctgatttgtgatgggtac

SEQ ID NO: 247897 - DNA, 20 bp, Artificial Sequence
  Description of Artificial Sequence: Synthetic oligonucleotide
  Target: ATXN1; (+) strand; PAM type: YTN; PAM sequence: CTT
ctgatttgtgatgggtacaa

SEQ ID NO: 247898 - DNA, 20 bp, Artificial Sequence
  Description of Artificial Sequence: Synthetic oligonucleotide
  Target: ATXN1; (+) strand; PAM type: YTN; PAM sequence: TTC
tgatttgtgatgggtacaag

SEQ ID NO: 247899 - DNA, 20 bp, Artificial Sequence
  Description of Artificial Sequence: Synthetic oligonucleotide
  Target: ATXN1; (+) strand; PAM type: YTN; PAM sequence: CTG
atttgtgatgggtacaagaa

SEQ ID NO: 247900 - DNA, 20 bp, Artificial Sequence
  Description of Artificial Sequence: Synthetic oligonucleotide
  Target: ATXN1; (+) strand; PAM type: YTN; PAM sequence: TTT
gtgatgggtacaagaaatat

SEQ ID NO: 247901 - DNA, 20 bp, Artificial Sequence
  Description of Artificial Sequence: Synthetic oligonucleotide
  Target: ATXN1; (+) strand; PAM type: YTN; PAM sequence: TTG
tgatgggtacaagaaatatt

SEQ ID NO: 247902 - DNA, 20 bp, Artificial Sequence
  Description of Artificial Sequence: Synthetic oligonucleotide
  Target: ATXN1; (+) strand; PAM type: YTN; PAM sequence: TTC
atcacaaatgtcaggtctca

SEQ ID NO: 247903 - DNA, 20 bp, Artificial Sequence
  Description of Artificial Sequence: Synthetic oligonucleotide
  Target: ATXN1; (+) strand; PAM type: YTN; PAM sequence: CTC
agattttctgatatgcaaga

SEQ ID NO: 247904 - DNA, 20 bp, Artificial Sequence
  Description of Artificial Sequence: Synthetic oligonucleotide
  Target: ATXN1; (+) strand; PAM type: YTN; PAM sequence: TTT
tctgatatgcaagaaactct

SEQ ID NO: 247905 - DNA, 20 bp, Artificial Sequence
  Description of Artificial Sequence: Synthetic oligonucleotide
  Target: ATXN1; (+) strand; PAM type: YTN; PAM sequence: TTT
ctgatatgcaagaaactcta

SEQ ID NO: 247906 - DNA, 20 bp, Artificial Sequence
  Description of Artificial Sequence: Synthetic oligonucleotide
  Target: ATXN1; (+) strand; PAM type: YTN; PAM sequence: TTC
tgatatgcaagaaactctac

SEQ ID NO: 247907 - DNA, 20 bp, Artificial Sequence
  Description of Artificial Sequence: Synthetic oligonucleotide
  Target: ATXN1; (+) strand; PAM type: YTN; PAM sequence: CTG
atatgcaagaaactctacag

SEQ ID NO: 247908 - DNA, 20 bp, Artificial Sequence
  Description of Artificial Sequence: Synthetic oligonucleotide
  Target: ATXN1; (+) strand; PAM type: YTN; PAM sequence: CTC
tacagagtggagcagcagcc

SEQ ID NO: 247909 - DNA, 20 bp, Artificial Sequence
  Description of Artificial Sequence: Synthetic oligonucleotide
  Target: ATXN1; (+) strand; PAM type: YTN; PAM sequence: CTA
cagagtggagcagcagccat

SEQ ID NO: 247910 - DNA, 20 bp, Artificial Sequence
  Description of Artificial Sequence: Synthetic oligonucleotide
  Target: ATXN1; (+) strand; PAM type: YTN; PAM sequence: CTT
gtagcctatggtcagagcac

SEQ ID NO: 247911 - DNA, 20 bp, Artificial Sequence
  Description of Artificial Sequence: Synthetic oligonucleotide
  Target: ATXN1; (+) strand; PAM type: YTN; PAM sequence: TTG
tagcctatggtcagagcaca

SEQ ID NO: 247912 - DNA, 20 bp, Artificial Sequence
  Description of Artificial Sequence: Synthetic oligonucleotide
  Target: ATXN1; (+) strand; PAM type: YTN; PAM sequence: CTA
tggtcagagcacagaaaata

SEQ ID NO: 247913 - DNA, 20 bp, Artificial Sequence
  Description of Artificial Sequence: Synthetic oligonucleotide
  Target: ATXN1; (+) strand; PAM type: YTN; PAM sequence: CTC
cagcatagctggagactggc

SEQ ID NO: 247914 - DNA, 20 bp, Artificial Sequence
  Description of Artificial Sequence: Synthetic oligonucleotide
  Target: ATXN1; (+) strand; PAM type: YTN; PAM sequence: CTG
gagactggccagaggccctg

SEQ ID NO: 247915 - DNA, 20 bp, Artificial Sequence
  Description of Artificial Sequence: Synthetic oligonucleotide
  Target: ATXN1; (+) strand; PAM type: YTN; PAM sequence: CTG
gccagaggccctgacagctg

SEQ ID NO: 247916 - DNA, 20 bp, Artificial Sequence
  Description of Artificial Sequence: Synthetic oligonucleotide
  Target: ATXN1; (+) strand; PAM type: YTN; PAM sequence: CTG
acagctgcacactgtgtcct

SEQ ID NO: 247917 - DNA, 20 bp, Artificial Sequence
  Description of Artificial Sequence: Synthetic oligonucleotide
  Target: ATXN1; (+) strand; PAM type: YTN; PAM sequence: CTG
cacactgtgtcctgtaacat

SEQ ID NO: 247918 - DNA, 20 bp, Artificial Sequence
  Description of Artificial Sequence: Synthetic oligonucleotide
  Target: ATXN1; (+) strand; PAM type: YTN; PAM sequence: CTG
tgtcctgtaacatatttgac

SEQ ID NO: 247919 - DNA, 20 bp, Artificial Sequence
  Description of Artificial Sequence: Synthetic oligonucleotide
  Target: ATXN1; (+) strand; PAM type: YTN; PAM sequence: CTG
taacatatttgactttaggg

SEQ ID NO: 247920 - DNA, 20 bp, Artificial Sequence
  Description of Artificial Sequence: Synthetic oligonucleotide
  Target: ATXN1; (+) strand; PAM type: YTN; PAM sequence: TTT
gactttagggcaccttgcat

SEQ ID NO: 247921 - DNA, 20 bp, Artificial Sequence
  Description of Artificial Sequence: Synthetic oligonucleotide
  Target: ATXN1; (+) strand; PAM type: YTN; PAM sequence: TTG
actttagggcaccttgcatt

SEQ ID NO: 247922 - DNA, 20 bp, Artificial Sequence
  Description of Artificial Sequence: Synthetic oligonucleotide
  Target: ATXN1; (+) strand; PAM type: YTN; PAM sequence: CTT
tagggcaccttgcatttctg

SEQ ID NO: 247923 - DNA, 20 bp, Artificial Sequence
  Description of Artificial Sequence: Synthetic oligonucleotide
  Target: ATXN1; (+) strand; PAM type: YTN; PAM sequence: TTT
agggcaccttgcatttctgc

SEQ ID NO: 247924 - DNA, 20 bp, Artificial Sequence
  Description of Artificial Sequence: Synthetic oligonucleotide
  Target: ATXN1; (+) strand; PAM type: YTN; PAM sequence: TTA
gggcaccttgcatttctgca

SEQ ID NO: 247925 - DNA, 20 bp, Artificial Sequence
  Description of Artificial Sequence: Synthetic oligonucleotide
  Target: ATXN1; (+) strand; PAM type: YTN; PAM sequence: CTT
gcatttctgcatcacactgt

SEQ ID NO: 247926 - DNA, 20 bp, Artificial Sequence
  Description of Artificial Sequence: Synthetic oligonucleotide
  Target: ATXN1; (+) strand; PAM type: YTN; PAM sequence: TTG
catttctgcatcacactgtg

SEQ ID NO: 247927 - DNA, 20 bp, Artificial Sequence
  Description of Artificial Sequence: Synthetic oligonucleotide
  Target: ATXN1; (+) strand; PAM type: YTN; PAM sequence: TTT
ctgcatcacactgtgcacat

SEQ ID NO: 247928 - DNA, 20 bp, Artificial Sequence
  Description of Artificial Sequence: Synthetic oligonucleotide
  Target: ATXN1; (+) strand; PAM type: YTN; PAM sequence: TTC
tgcatcacactgtgcacatc

SEQ ID NO: 247929 - DNA, 20 bp, Artificial Sequence
  Description of Artificial Sequence: Synthetic oligonucleotide
  Target: ATXN1; (+) strand; PAM type: YTN; PAM sequence: CTG
catcacactgtgcacatctt

SEQ ID NO: 247930 - DNA, 20 bp, Artificial Sequence
  Description of Artificial Sequence: Synthetic oligonucleotide
  Target: ATXN1; (+) strand; PAM type: YTN; PAM sequence: CTG
tgcacatctttctttttctc

SEQ ID NO: 247931 - DNA, 20 bp, Artificial Sequence
  Description of Artificial Sequence: Synthetic oligonucleotide
  Target: ATXN1; (+) strand; PAM type: YTN; PAM sequence: CTT
tctttttctcctctcttggt

SEQ ID NO: 247932 - DNA, 20 bp, Artificial Sequence
  Description of Artificial Sequence: Synthetic oligonucleotide
  Target: ATXN1; (+) strand; PAM type: YTN; PAM sequence: TTT
ctttttctcctctcttggtg

SEQ ID NO: 247933 - DNA, 20 bp, Artificial Sequence
  Description of Artificial Sequence: Synthetic oligonucleotide
  Target: ATXN1; (+) strand; PAM type: YTN; PAM sequence: TTC
tttttctcctctcttggtgg

SEQ ID NO: 247934 - DNA, 20 bp, Artificial Sequence
  Description of Artificial Sequence: Synthetic oligonucleotide
  Target: ATXN1; (+) strand; PAM type: YTN; PAM sequence: CTT
tttctcctctcttggtggag

SEQ ID NO: 247935 - DNA, 20 bp, Artificial Sequence
  Description of Artificial Sequence: Synthetic oligonucleotide
  Target: ATXN1; (+) strand; PAM type: YTN; PAM sequence: TTT
ttctcctctcttggtggaga

SEQ ID NO: 247936 - DNA, 20 bp, Artificial Sequence
  Description of Artificial Sequence: Synthetic oligonucleotide
  Target: ATXN1; (+) strand; PAM type: YTN; PAM sequence: TTT
tctcctctcttggtggagag

SEQ ID NO: 247937 - DNA, 20 bp, Artificial Sequence
  Description of Artificial Sequence: Synthetic oligonucleotide
  Target: ATXN1; (+) strand; PAM type: YTN; PAM sequence: TTT
ctcctctcttggtggagagg

SEQ ID NO: 247938 - DNA, 20 bp, Artificial Sequence
  Description of Artificial Sequence: Synthetic oligonucleotide
  Target: ATXN1; (+) strand; PAM type: YTN; PAM sequence: TTC
tcctctcttggtggagaggt

SEQ ID NO: 247939 - DNA, 20 bp, Artificial Sequence
  Description of Artificial Sequence: Synthetic oligonucleotide
  Target: ATXN1; (+) strand; PAM type: YTN; PAM sequence: CTC
ctctcttggtggagaggtat

SEQ ID NO: 247940 - DNA, 20 bp, Artificial Sequence
  Description of Artificial Sequence: Synthetic oligonucleotide
  Target: ATXN1; (+) strand; PAM type: YTN; PAM sequence: CTC
tcttggtggagaggtattta

SEQ ID NO: 247941 - DNA, 20 bp, Artificial Sequence
  Description of Artificial Sequence: Synthetic oligonucleotide
  Target: ATXN1; (+) strand; PAM type: YTN; PAM sequence: CTC
ttggtggagaggtatttatt

SEQ ID NO: 247942 - DNA, 20 bp, Artificial Sequence
  Description of Artificial Sequence: Synthetic oligonucleotide
  Target: ATXN1; (+) strand; PAM type: YTN; PAM sequence: CTT
ggtggagaggtatttatttt

SEQ ID NO: 247943 - DNA, 20 bp, Artificial Sequence
  Description of Artificial Sequence: Synthetic oligonucleotide
  Target: ATXN1; (+) strand; PAM type: YTN; PAM sequence: TTG
gtggagaggtatttatttta

SEQ ID NO: 247944 - DNA, 20 bp, Artificial Sequence
  Description of Artificial Sequence: Synthetic oligonucleotide
  Target: ATXN1; (+) strand; PAM type: YTN; PAM sequence: TTT
attttaattacgaagtcctc

SEQ ID NO: 247945 - DNA, 20 bp, Artificial Sequence
  Description of Artificial Sequence: Synthetic oligonucleotide
  Target: ATXN1; (+) strand; PAM type: YTN; PAM sequence: TTA
ttttaattacgaagtcctct

SEQ ID NO: 247946 - DNA, 20 bp, Artificial Sequence
  Description of Artificial Sequence: Synthetic oligonucleotide
  Target: ATXN1; (+) strand; PAM type: YTN; PAM sequence: TTT
taattacgaagtcctctatt

SEQ ID NO: 247947 - DNA, 20 bp, Artificial Sequence
  Description of Artificial Sequence: Synthetic oligonucleotide
  Target: ATXN1; (+) strand; PAM type: YTN; PAM sequence: TTT
aattacgaagtcctctatta

SEQ ID NO: 247948 - DNA, 20 bp, Artificial Sequence
  Description of Artificial Sequence: Synthetic oligonucleotide
  Target: ATXN1; (+) strand; PAM type: YTN; PAM sequence: TTA
attacgaagtcctctattat

SEQ ID NO: 247949 - DNA, 20 bp, Artificial Sequence
  Description of Artificial Sequence: Synthetic oligonucleotide
  Target: ATXN1; (+) strand; PAM type: YTN; PAM sequence: TTA
cgaagtcctctattatgtat

SEQ ID NO: 247950 - DNA, 20 bp, Artificial Sequence
  Description of Artificial Sequence: Synthetic oligonucleotide
  Target: ATXN1; (+) strand; PAM type: YTN; PAM sequence: CTC
tattatgtatggtgaactgt

SEQ ID NO: 247951 - DNA, 20 bp, Artificial Sequence
  Description of Artificial Sequence: Synthetic oligonucleotide
  Target: ATXN1; (+) strand; PAM type: YTN; PAM sequence: CTA
ttatgtatggtgaactgttt

SEQ ID NO: 247952 - DNA, 20 bp, Artificial Sequence
  Description of Artificial Sequence: Synthetic oligonucleotide
  Target: ATXN1; (+) strand; PAM type: YTN; PAM sequence: TTA
tgtatggtgaactgtttaac

SEQ ID NO: 247953 - DNA, 20 bp, Artificial Sequence
  Description of Artificial Sequence: Synthetic oligonucleotide
  Target: ATXN1; (+) strand; PAM type: YTN; PAM sequence: CTG
tttaactctggggcagttga

SEQ ID NO: 247954 - DNA, 20 bp, Artificial Sequence
  Description of Artificial Sequence: Synthetic oligonucleotide
  Target: ATXN1; (+) strand; PAM type: YTN; PAM sequence: TTT
aactctggggcagttgaact

SEQ ID NO: 247955 - DNA, 20 bp, Artificial Sequence
  Description of Artificial Sequence: Synthetic oligonucleotide
  Target: ATXN1; (+) strand; PAM type: YTN; PAM sequence: TTA
actctggggcagttgaactg

SEQ ID NO: 247956 - DNA, 20 bp, Artificial Sequence
  Description of Artificial Sequence: Synthetic oligonucleotide
  Target: ATXN1; (+) strand; PAM type: YTN; PAM sequence: CTC
tggggcagttgaactgcctc

SEQ ID NO: 247957 - DNA, 20 bp, Artificial Sequence
  Description of Artificial Sequence: Synthetic oligonucleotide
  Target: ATXN1; (+) strand; PAM type: YTN; PAM sequence: CTG
gggcagttgaactgcctcaa

SEQ ID NO: 247958 - DNA, 20 bp, Artificial Sequence
  Description of Artificial Sequence: Synthetic oligonucleotide
  Target: ATXN1; (+) strand; PAM type: YTN; PAM sequence: TTG
aactgcctcaaactaggctg

SEQ ID NO: 247959 - DNA, 20 bp, Artificial Sequence
  Description of Artificial Sequence: Synthetic oligonucleotide
  Target: ATXN1; (+) strand; PAM type: YTN; PAM sequence: CTG
cctcaaactaggctgcataa

SEQ ID NO: 247960 - DNA, 20 bp, Artificial Sequence
  Description of Artificial Sequence: Synthetic oligonucleotide
  Target: ATXN1; (+) strand; PAM type: YTN; PAM sequence: CTC
aaactaggctgcataaaaca

SEQ ID NO: 247961 - DNA, 20 bp, Artificial Sequence
  Description of Artificial Sequence: Synthetic oligonucleotide
  Target: ATXN1; (+) strand; PAM type: YTN; PAM sequence: CTA
ggctgcataaaacagaagga

SEQ ID NO: 247962 - DNA, 20 bp, Artificial Sequence
  Description of Artificial Sequence: Synthetic oligonucleotide
  Target: ATXN1; (+) strand; PAM type: YTN; PAM sequence: CTG
cataaaacagaaggaaggtc

SEQ ID NO: 247963 - DNA, 20 bp, Artificial Sequence
  Description of Artificial Sequence: Synthetic oligonucleotide
  Target: ATXN1; (+) strand; PAM type: YTN; PAM sequence: CTT
cccttggactggcctgggct

SEQ ID NO: 247964 - DNA, 20 bp, Artificial Sequence
  Description of Artificial Sequence: Synthetic oligonucleotide
  Target: ATXN1; (+) strand; PAM type: YTN; PAM sequence: TTC
ccttggactggcctgggctt

SEQ ID NO: 247965 - DNA, 20 bp, Artificial Sequence
  Description of Artificial Sequence: Synthetic oligonucleotide
  Target: ATXN1; (+) strand; PAM type: YTN; PAM sequence: CTT
ggactggcctgggcttgctt

SEQ ID NO: 247966 - DNA, 20 bp, Artificial Sequence
  Description of Artificial Sequence: Synthetic oligonucleotide
  Target: ATXN1; (+) strand; PAM type: YTN; PAM sequence: TTG
gactggcctgggcttgcttc

SEQ ID NO: 247967 - DNA, 20 bp, Artificial Sequence
  Description of Artificial Sequence: Synthetic oligonucleotide
  Target: ATXN1; (+) strand; PAM type: YTN; PAM sequence: CTG
gcctgggcttgcttcagttt

SEQ ID NO: 247968 - DNA, 20 bp, Artificial Sequence
  Description of Artificial Sequence: Synthetic oligonucleotide
  Target: ATXN1; (+) strand; PAM type: YTN; PAM sequence: CTG
ggcttgcttcagtttgctga

SEQ ID NO: 247969 - DNA, 20 bp, Artificial Sequence
  Description of Artificial Sequence: Synthetic oligonucleotide
  Target: ATXN1; (+) strand; PAM type: YTN; PAM sequence: CTT
gcttcagtttgctgagagca

SEQ ID NO: 247970 - DNA, 20 bp, Artificial Sequence
  Description of Artificial Sequence: Synthetic oligonucleotide
  Target: ATXN1; (+) strand; PAM type: YTN; PAM sequence: TTG
cttcagtttgctgagagcag

SEQ ID NO: 247971 - DNA, 20 bp, Artificial Sequence
  Description of Artificial Sequence: Synthetic oligonucleotide
  Target: ATXN1; (+) strand; PAM type: YTN; PAM sequence: CTT
cagtttgctgagagcagaac

SEQ ID NO: 247972 - DNA, 20 bp, Artificial Sequence
  Description of Artificial Sequence: Synthetic oligonucleotide
  Target: ATXN1; (+) strand; PAM type: YTN; PAM sequence: TTC
agtttgctgagagcagaacc

SEQ ID NO: 247973 - DNA, 20 bp, Artificial Sequence
  Description of Artificial Sequence: Synthetic oligonucleotide
  Target: ATXN1; (+) strand; PAM type: YTN; PAM sequence: TTT
gctgagagcagaacccagct

SEQ ID NO: 247974 - DNA, 20 bp, Artificial Sequence
  Description of Artificial Sequence: Synthetic oligonucleotide
  Target: ATXN1; (+) strand; PAM type: YTN; PAM sequence: TTG
ctgagagcagaacccagctt

SEQ ID NO: 247975 - DNA, 20 bp, Artificial Sequence
  Description of Artificial Sequence: Synthetic oligonucleotide
  Target: ATXN1; (+) strand; PAM type: YTN; PAM sequence: CTG
agagcagaacccagcttgga

SEQ ID NO: 247976 - DNA, 20 bp, Artificial Sequence
  Description of Artificial Sequence: Synthetic oligonucleotide
  Target: ATXN1; (+) strand; PAM type: YTN; PAM sequence: CTT
ggatgcccacagatgccgct

SEQ ID NO: 247977 - DNA, 20 bp, Artificial Sequence
  Description of Artificial Sequence: Synthetic oligonucleotide
  Target: ATXN1; (+) strand; PAM type: YTN; PAM sequence: TTG
gatgcccacagatgccgctg

SEQ ID NO: 247978 - DNA, 20 bp, Artificial Sequence
  Description of Artificial Sequence: Synthetic oligonucleotide
  Target: ATXN1; (+) strand; PAM type: YTN; PAM sequence: CTG
tacttttgcacaaacttaca

SEQ ID NO: 247979 - DNA, 20 bp, Artificial Sequence
  Description of Artificial Sequence: Synthetic oligonucleotide
  Target: ATXN1; (+) strand; PAM type: YTN; PAM sequence: CTT
ttgcacaaacttacatacag

SEQ ID NO: 247980 - DNA, 20 bp, Artificial Sequence
  Description of Artificial Sequence: Synthetic oligonucleotide
  Target: ATXN1; (+) strand; PAM type: YTN; PAM sequence: TTT
tgcacaaacttacatacaga

SEQ ID NO: 247981 - DNA, 20 bp, Artificial Sequence
  Description of Artificial Sequence: Synthetic oligonucleotide
  Target: ATXN1; (+) strand; PAM type: YTN; PAM sequence: TTT
gcacaaacttacatacagag

SEQ ID NO: 247982 - DNA, 20 bp, Artificial Sequence
  Description of Artificial Sequence: Synthetic oligonucleotide
  Target: ATXN1; (+) strand; PAM type: YTN; PAM sequence: TTG
cacaaacttacatacagagc

SEQ ID NO: 247983 - DNA, 20 bp, Artificial Sequence
  Description of Artificial Sequence: Synthetic oligonucleotide
  Target: ATXN1; (+) strand; PAM type: YTN; PAM sequence: CTT
acatacagagcacctaaaac

SEQ ID NO: 247984 - DNA, 20 bp, Artificial Sequence
  Description of Artificial Sequence: Synthetic oligonucleotide
  Target: ATXN1; (+) strand; PAM type: YTN; PAM sequence: TTA
catacagagcacctaaaacc

SEQ ID NO: 247985 - DNA, 20 bp, Artificial Sequence
  Description of Artificial Sequence: Synthetic oligonucleotide
  Target: ATXN1; (+) strand; PAM type: YTN; PAM sequence: CTA
aaaccaggggcacctaaaac

SEQ ID NO: 247986 - DNA, 20 bp, Artificial Sequence
  Description of Artificial Sequence: Synthetic oligonucleotide
  Target: ATXN1; (+) strand; PAM type: YTN; PAM sequence: CTA
aaaccagtagtggtaatcca

SEQ ID NO: 247987 - DNA, 20 bp, Artificial Sequence
  Description of Artificial Sequence: Synthetic oligonucleotide
  Target: ATXN1; (+) strand; PAM type: YTN; PAM sequence: TTT
tacggaaaactgcagcagga

SEQ ID NO: 247988 - DNA, 20 bp, Artificial Sequence
  Description of Artificial Sequence: Synthetic oligonucleotide
  Target: ATXN1; (+) strand; PAM type: YTN; PAM sequence: TTT
acggaaaactgcagcaggaa

SEQ ID NO: 247989 - DNA, 20 bp, Artificial Sequence
  Description of Artificial Sequence: Synthetic oligonucleotide
  Target: ATXN1; (+) strand; PAM type: YTN; PAM sequence: TTA
cggaaaactgcagcaggaat

SEQ ID NO: 247990 - DNA, 20 bp, Artificial Sequence
  Description of Artificial Sequence: Synthetic oligonucleotide
  Target: ATXN1; (+) strand; PAM type: YTN; PAM sequence: CTG
cagcaggaatttgctgccac

SEQ ID NO: 247991 - DNA, 20 bp, Artificial Sequence
  Description of Artificial Sequence: Synthetic oligonucleotide
  Target: ATXN1; (+) strand; PAM type: YTN; PAM sequence: TTT
gctgccaccttccattttcc

SEQ ID NO: 247992 - DNA, 20 bp, Artificial Sequence
  Description of Artificial Sequence: Synthetic oligonucleotide
  Target: ATXN1; (+) strand; PAM type: YTN; PAM sequence: TTG
ctgccaccttccattttccc

SEQ ID NO: 247993 - DNA, 20 bp, Artificial Sequence
  Description of Artificial Sequence: Synthetic oligonucleotide
  Target: ATXN1; (+) strand; PAM type: YTN; PAM sequence: CTG
ccaccttccattttccccag

SEQ ID NO: 247994 - DNA, 20 bp, Artificial Sequence
  Description of Artificial Sequence: Synthetic oligonucleotide
  Target: ATXN1; (+) strand; PAM type: YTN; PAM sequence: CTT
ccattttccccagcactaag

SEQ ID NO: 247995 - DNA, 20 bp, Artificial Sequence
  Description of Artificial Sequence: Synthetic oligonucleotide
  Target: ATXN1; (+) strand; PAM type: YTN; PAM sequence: TTC
cattttccccagcactaaga

SEQ ID NO: 247996 - DNA, 20 bp, Artificial Sequence
  Description of Artificial Sequence: Synthetic oligonucleotide
  Target: ATXN1; (+) strand; PAM type: YTN; PAM sequence: TTT
tccccagcactaagaacacc

SEQ ID NO: 247997 - DNA, 20 bp, Artificial Sequence
  Description of Artificial Sequence: Synthetic oligonucleotide
  Target: ATXN1; (+) strand; PAM type: YTN; PAM sequence: TTT
ccccagcactaagaacacct

SEQ ID NO: 247998 - DNA, 20 bp, Artificial Sequence
  Description of Artificial Sequence: Synthetic oligonucleotide
  Target: ATXN1; (+) strand; PAM type: YTN; PAM sequence: TTC
cccagcactaagaacaccta

SEQ ID NO: 247999 - DNA, 20 bp, Artificial Sequence
  Description of Artificial Sequence: Synthetic oligonucleotide
  Target: ATXN1; (+) strand; PAM type: YTN; PAM sequence: CTA
agaacacctacttttagtga

SEQ ID NO: 248000 - DNA, 20 bp, Artificial Sequence
  Description of Artificial Sequence: Synthetic oligonucleotide
  Target: ATXN1; (+) strand; PAM type: YTN; PAM sequence: CTA
cttttagtgacaggtgactc

SEQ ID NO: 248001 - DNA, 20 bp, Artificial Sequence
  Description of Artificial Sequence: Synthetic oligonucleotide
  Target: ATXN1; (+) strand; PAM type: YTN; PAM sequence: CTT
ttagtgacaggtgactcatc

SEQ ID NO: 248002 - DNA, 20 bp, Artificial Sequence
  Description of Artificial Sequence: Synthetic oligonucleotide
  Target: ATXN1; (+) strand; PAM type: YTN; PAM sequence: TTT
tagtgacaggtgactcatct

SEQ ID NO: 248003 - DNA, 20 bp, Artificial Sequence
  Description of Artificial Sequence: Synthetic oligonucleotide
  Target: ATXN1; (+) strand; PAM type: YTN; PAM sequence: TTT
agtgacaggtgactcatctg

SEQ ID NO: 248004 - DNA, 20 bp, Artificial Sequence
  Description of Artificial Sequence: Synthetic oligonucleotide
  Target: ATXN1; (+) strand; PAM type: YTN; PAM sequence: TTA
gtgacaggtgactcatctgc

SEQ ID NO: 248005 - DNA, 20 bp, Artificial Sequence
  Description of Artificial Sequence: Synthetic oligonucleotide
  Target: ATXN1; (+) strand; PAM type: YTN; PAM sequence: CTC
atctgccactcttctagcag

SEQ ID NO: 248006 - DNA, 20 bp, Artificial Sequence
  Description of Artificial Sequence: Synthetic oligonucleotide
  Target: ATXN1; (+) strand; PAM type: YTN; PAM sequence: CTG
ccactcttctagcaggctct

SEQ ID NO: 248007 - DNA, 20 bp, Artificial Sequence
  Description of Artificial Sequence: Synthetic oligonucleotide
  Target: ATXN1; (+) strand; PAM type: YTN; PAM sequence: CTC
ttctagcaggctcttctaag

SEQ ID NO: 248008 - DNA, 20 bp, Artificial Sequence
  Description of Artificial Sequence: Synthetic oligonucleotide
  Target: ATXN1; (+) strand; PAM type: YTN; PAM sequence: CTT
ctagcaggctcttctaagcg

SEQ ID NO: 248009 - DNA, 20 bp, Artificial Sequence
  Description of Artificial Sequence: Synthetic oligonucleotide
  Target: ATXN1; (+) strand; PAM type: YTN; PAM sequence: TTC
tagcaggctcttctaagcga

SEQ ID NO: 248010 - DNA, 20 bp, Artificial Sequence
  Description of Artificial Sequence: Synthetic oligonucleotide
  Target: ATXN1; (+) strand; PAM type: YTN; PAM sequence: CTA
gcaggctcttctaagcgaag

SEQ ID NO: 248011 - DNA, 20 bp, Artificial Sequence
  Description of Artificial Sequence: Synthetic oligonucleotide
  Target: ATXN1; (+) strand; PAM type: YTN; PAM sequence: CTC
ttctaagcgaagacacaaac

SEQ ID NO: 248012 - DNA, 20 bp, Artificial Sequence
  Description of Artificial Sequence: Synthetic oligonucleotide
  Target: ATXN1; (+) strand; PAM type: YTN; PAM sequence: CTT
ctaagcgaagacacaaacaa

SEQ ID NO: 248013 - DNA, 20 bp, Artificial Sequence
  Description of Artificial Sequence: Synthetic oligonucleotide
  Target: ATXN1; (+) strand; PAM type: YTN; PAM sequence: TTC
taagcgaagacacaaacaag

SEQ ID NO: 248014 - DNA, 20 bp, Artificial Sequence
  Description of Artificial Sequence: Synthetic oligonucleotide
  Target: ATXN1; (+) strand; PAM type: YTN; PAM sequence: CTA
agcgaagacacaaacaagag

SEQ ID NO: 248015 - DNA, 20 bp, Artificial Sequence
  Description of Artificial Sequence: Synthetic oligonucleotide
  Target: ATXN1; (+) strand; PAM type: YTN; PAM sequence: CTG
atggatgagcttggtggggg

SEQ ID NO: 248016 - DNA, 20 bp, Artificial Sequence
  Description of Artificial Sequence: Synthetic oligonucleotide
  Target: ATXN1; (+) strand; PAM type: YTN; PAM sequence: CTT
ggtgggggaggagaagcccc

SEQ ID NO: 248017 - DNA, 20 bp, Artificial Sequence
  Description of Artificial Sequence: Synthetic oligonucleotide
  Target: ATXN1; (+) strand; PAM type: YTN; PAM sequence: TTG
gtgggggaggagaagcccca

SEQ ID NO: 248018 - DNA, 20 bp, Artificial Sequence
  Description of Artificial Sequence: Synthetic oligonucleotide
  Target: ATXN1; (+) strand; PAM type: YTN; PAM sequence: TTT
ttctctgctcaatcttcccc

SEQ ID NO: 248019 - DNA, 20 bp, Artificial Sequence
  Description of Artificial Sequence: Synthetic oligonucleotide
  Target: ATXN1; (+) strand; PAM type: YTN; PAM sequence: TTT
tctctgctcaatcttcccct

SEQ ID NO: 248020 - DNA, 20 bp, Artificial Sequence
  Description of Artificial Sequence: Synthetic oligonucleotide
  Target: ATXN1; (+) strand; PAM type: YTN; PAM sequence: TTT
ctctgctcaatcttcccctt

SEQ ID NO: 248021 - DNA, 20 bp, Artificial Sequence
  Description of Artificial Sequence: Synthetic oligonucleotide
  Target: ATXN1; (+) strand; PAM type: YTN; PAM sequence: TTC
tctgctcaatcttccccttc

SEQ ID NO: 248022 - DNA, 20 bp, Artificial Sequence
  Description of Artificial Sequence: Synthetic oligonucleotide
  Target: ATXN1; (+) strand; PAM type: YTN; PAM sequence: CTC
tgctcaatcttccccttcct

SEQ ID NO: 248023 - DNA, 20 bp, Artificial Sequence
  Description of Artificial Sequence: Synthetic oligonucleotide
  Target: ATXN1; (+) strand; PAM type: YTN; PAM sequence: CTG
ctcaatcttccccttcctgc

SEQ ID NO: 248024 - DNA, 20 bp, Artificial Sequence
  Description of Artificial Sequence: Synthetic oligonucleotide
  Target: ATXN1; (+) strand; PAM type: YTN; PAM sequence: CTC
aatcttccccttcctgcagg

SEQ ID NO: 248025 - DNA, 20 bp, Artificial Sequence
  Description of Artificial Sequence: Synthetic oligonucleotide
  Target: ATXN1; (+) strand; PAM type: YTN; PAM sequence: CTT
ccccttcctgcaggaatact

SEQ ID NO: 248026 - DNA, 20 bp, Artificial Sequence
  Description of Artificial Sequence: Synthetic oligonucleotide
  Target: ATXN1; (+) strand; PAM type: YTN; PAM sequence: TTC
cccttcctgcaggaatactc

SEQ ID NO: 248027 - DNA, 20 bp, Artificial Sequence
  Description of Artificial Sequence: Synthetic oligonucleotide
  Target: ATXN1; (+) strand; PAM type: YTN; PAM sequence: CTT
cctgcaggaatactcaccca

SEQ ID NO: 248028 - DNA, 20 bp, Artificial Sequence
  Description of Artificial Sequence: Synthetic oligonucleotide
  Target: ATXN1; (+) strand; PAM type: YTN; PAM sequence: TTC
ctgcaggaatactcacccac

SEQ ID NO: 248029 - DNA, 20 bp, Artificial Sequence
  Description of Artificial Sequence: Synthetic oligonucleotide
  Target: ATXN1; (+) strand; PAM type: YTN; PAM sequence: CTG
caggaatactcacccaccct

SEQ ID NO: 248030 - DNA, 20 bp, Artificial Sequence
  Description of Artificial Sequence: Synthetic oligonucleotide
  Target: ATXN1; (+) strand; PAM type: YTN; PAM sequence: CTC
acccaccctttttttttttt

SEQ ID NO: 248031 - DNA, 20 bp, Artificial Sequence
  Description of Artificial Sequence: Synthetic oligonucleotide
  Target: ATXN1; (+) strand; PAM type: YTN; PAM sequence: CTT
ttttttttttcttttttgag

SEQ ID NO: 248032 - DNA, 20 bp, Artificial Sequence
  Description of Artificial Sequence: Synthetic oligonucleotide
  Target: ATXN1; (+) strand; PAM type: YTN; PAM sequence: TTT
tttttttttcttttttgaga

SEQ ID NO: 248033 - DNA, 20 bp, Artificial Sequence
  Description of Artificial Sequence: Synthetic oligonucleotide
  Target: ATXN1; (+) strand; PAM type: YTN; PAM sequence: TTT
ttttttttcttttttgagac

SEQ ID NO: 248034 - DNA, 20 bp, Artificial Sequence
  Description of Artificial Sequence: Synthetic oligonucleotide
  Target: ATXN1; (+) strand; PAM type: YTN; PAM sequence: TTT
tttttttcttttttgagacg

SEQ ID NO: 248035 - DNA, 20 bp, Artificial Sequence
  Description of Artificial Sequence: Synthetic oligonucleotide
  Target: ATXN1; (+) strand; PAM type: YTN; PAM sequence: TTT
ttttttcttttttgagacgg

SEQ ID NO: 248036 - DNA, 20 bp, Artificial Sequence
  Description of Artificial Sequence: Synthetic oligonucleotide
  Target: ATXN1; (+) strand; PAM type: YTN; PAM sequence: TTT
tttttcttttttgagacgga

SEQ ID NO: 248037 - DNA, 20 bp, Artificial Sequence
  Description of Artificial Sequence: Synthetic oligonucleotide
  Target: ATXN1; (+) strand; PAM type: YTN; PAM sequence: TTT
ttttcttttttgagacggag

SEQ ID NO: 248038 - DNA, 20 bp, Artificial Sequence
  Description of Artificial Sequence: Synthetic oligonucleotide
  Target: ATXN1; (+) strand; PAM type: YTN; PAM sequence: TTT
tttcttttttgagacggagt

SEQ ID NO: 248039 - DNA, 20 bp, Artificial Sequence
  Description of Artificial Sequence: Synthetic oligonucleotide
  Target: ATXN1; (+) strand; PAM type: YTN; PAM sequence: TTT
ttcttttttgagacggagtc

SEQ ID NO: 248040 - DNA, 20 bp, Artificial Sequence
  Description of Artificial Sequence: Synthetic oligonucleotide
  Target: ATXN1; (+) strand; PAM type: YTN; PAM sequence: TTT
tcttttttgagacggagtct

SEQ ID NO: 248041 - DNA, 20 bp, Artificial Sequence
  Description of Artificial Sequence: Synthetic oligonucleotide
  Target: ATXN1; (+) strand; PAM type: YTN; PAM sequence: TTT
cttttttgagacggagtctc

SEQ ID NO: 248042 - DNA, 20 bp, Artificial Sequence
  Description of Artificial Sequence: Synthetic oligonucleotide
  Target: ATXN1; (+) strand; PAM type: YTN; PAM sequence: TTC
ttttttgagacggagtctcg

SEQ ID NO: 248043 - DNA, 20 bp, Artificial Sequence
  Description of Artificial Sequence: Synthetic oligonucleotide
  Target: ATXN1; (+) strand; PAM type: YTN; PAM sequence: CTT
ttttgagacggagtctcgct

SEQ ID NO: 248044 - DNA, 20 bp, Artificial Sequence
  Description of Artificial Sequence: Synthetic oligonucleotide
  Target: ATXN1; (+) strand; PAM type: YTN; PAM sequence: TTT
tttgagacggagtctcgctc

SEQ ID NO: 248045 - DNA, 20 bp, Artificial Sequence
  Description of Artificial Sequence: Synthetic oligonucleotide
  Target: ATXN1; (+) strand; PAM type: YTN; PAM sequence: TTT
ttgagacggagtctcgctct

SEQ ID NO: 248046 - DNA, 20 bp, Artificial Sequence
  Description of Artificial Sequence: Synthetic oligonucleotide
  Target: ATXN1; (+) strand; PAM type: YTN; PAM sequence: TTT
tgagacggagtctcgctctg

SEQ ID NO: 248047 - DNA, 20 bp, Artificial Sequence
  Description of Artificial Sequence: Synthetic oligonucleotide
  Target: ATXN1; (+) strand; PAM type: YTN; PAM sequence: TTT
gagacggagtctcgctctgt

SEQ ID NO: 248048 - DNA, 20 bp, Artificial Sequence
  Description of Artificial Sequence: Synthetic oligonucleotide
  Target: ATXN1; (+) strand; PAM type: YTN; PAM sequence: TTG
agacggagtctcgctctgtc

SEQ ID NO: 248049 - DNA, 20 bp, Artificial Sequence
  Description of Artificial Sequence: Synthetic oligonucleotide
  Target: ATXN1; (+) strand; PAM type: YTN; PAM sequence: CTC
gctctgtcgcccaggccggt

SEQ ID NO: 248050 - DNA, 20 bp, Artificial Sequence
  Description of Artificial Sequence: Synthetic oligonucleotide
  Target: ATXN1; (+) strand; PAM type: YTN; PAM sequence: CTC
tgtcgcccaggccggtgtga

SEQ ID NO: 248051 - DNA, 20 bp, Artificial Sequence
  Description of Artificial Sequence: Synthetic oligonucleotide
  Target: ATXN1; (+) strand; PAM type: YTN; PAM sequence: CTG
tcgcccaggccggtgtgaag

SEQ ID NO: 248052 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcaacctctgcc

SEQ ID NO: 248053 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctgcctccca

SEQ ID NO: 248054 - DNA, 20 bp, Artificial Sequence
  Description of Artificial Sequence: Synthetic oligonucleotide
  Target: ATXN1; (+) strand; PAM type: YTN; PAM sequence: CTG
caacctctgcctcccaggtt

SEQ ID NO: 248055 - DNA, 20 bp, Artificial Sequence
  Description of Artificial Sequence: Synthetic oligonucleotide
  Target: ATXN1; (+) strand; PAM type: YTN; PAM sequence: CTC
tgcctcccaggttcaaacaa

SEQ ID NO: 248056 - DNA, 20 bp, Artificial Sequence
  Description of Artificial Sequence: Synthetic oligonucleotide
  Target: ATXN1; (+) strand; PAM type: YTN; PAM sequence: CTG
cctcccaggttcaaacaatt

SEQ ID NO: 248057 - DNA, 20 bp, Artificial Sequence
  Description of Artificial Sequence: Synthetic oligonucleotide
  Target: ATXN1; (+) strand; PAM type: YTN; PAM sequence: CTC
ccaggttcaaacaattctcc

SEQ ID NO: 248058 - DNA, 20 bp, Artificial Sequence
  Description of Artificial Sequence: Synthetic oligonucleotide
  Target: ATXN1; (+) strand; PAM type: YTN; PAM sequence: TTC
aaacaattctcctgcctcag

SEQ ID NO: 248059 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcctgag

SEQ ID NO: 248060 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcctgagta

SEQ ID NO: 248061 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcctgagtagct

SEQ ID NO: 248062 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagtagctggga

SEQ ID NO: 248063 - DNA, 20 bp, Artificial Sequence
  Description of Artificial Sequence: Synthetic oligonucleotide
  Target: ATXN1; (+) strand; PAM type: YTN; PAM sequence: CTC
ctgagtagctgggattatag

SEQ ID NO: 248064 - DNA, 20 bp, Artificial Sequence
  Description of Artificial Sequence: Synthetic oligonucleotide
  Target: ATXN1; (+) strand; PAM type: YTN; PAM sequence: CTG
agtagctgggattataggca

SEQ ID NO: 248065 - DNA, 20 bp, Artificial Sequence
  Description of Artificial Sequence: Synthetic oligonucleotide
  Target: ATXN1; (+) strand; PAM type: YTN; PAM sequence: CTG
ggattataggcatgcgccac

SEQ ID NO: 248066 - DNA, 20 bp, Artificial Sequence
  Description of Artificial Sequence: Synthetic oligonucleotide
  Target: ATXN1; (+) strand; PAM type: YTN; PAM sequence: TTA
taggcatgcgccaccacgcc

SEQ ID NO: 248067 - DNA, 20 bp, Artificial Sequence
  Description of Artificial Sequence: Synthetic oligonucleotide
  Target: ATXN1; (+) strand; PAM type: YTN; PAM sequence: CTA
atttttttctatttttagta

SEQ ID NO: 248068 - DNA, 20 bp, Artificial Sequence
  Description of Artificial Sequence: Synthetic oligonucleotide
  Target: ATXN1; (+) strand; PAM type: YTN; PAM sequence: TTT
ttttctatttttagtagaga

SEQ ID NO: 248069 - DNA, 20 bp, Artificial Sequence
  Description of Artificial Sequence: Synthetic oligonucleotide
  Target: ATXN1; (+) strand; PAM type: YTN; PAM sequence: TTT
tttctatttttagtagagac

SEQ ID NO: 248070 - DNA, 20 bp, Artificial Sequence
  Description of Artificial Sequence: Synthetic oligonucleotide
  Target: ATXN1; (+) strand; PAM type: YTN; PAM sequence: TTT
ttctatttttagtagagacg

SEQ ID NO: 248071 - DNA, 20 bp, Artificial Sequence
  Description of Artificial Sequence: Synthetic oligonucleotide
  Target: ATXN1; (+) strand; PAM type: YTN; PAM sequence: TTT
tctatttttagtagagacgg

SEQ ID NO: 248072 - DNA, 20 bp, Artificial Sequence
  Description of Artificial Sequence: Synthetic oligonucleotide
  Target: ATXN1; (+) strand; PAM type: YTN; PAM sequence: TTT
ctatttttagtagagacggg

SEQ ID NO: 248073 - DNA, 20 bp, Artificial Sequence
  Description of Artificial Sequence: Synthetic oligonucleotide
  Target: ATXN1; (+) strand; PAM type: YTN; PAM sequence: TTC
tatttttagtagagacgggg

SEQ ID NO: 248074 - DNA, 20 bp, Artificial Sequence
  Description of Artificial Sequence: Synthetic oligonucleotide
  Target: ATXN1; (+) strand; PAM type: YTN; PAM sequence: CTA
tttttagtagagacggggtt

SEQ ID NO: 248075 - DNA, 20 bp, Artificial Sequence
  Description of Artificial Sequence: Synthetic oligonucleotide
  Target: ATXN1; (+) strand; PAM type: YTN; PAM sequence: TTT
ttagtagagacggggtttca

SEQ ID NO: 248076 - DNA, 20 bp, Artificial Sequence
  Description of Artificial Sequence: Synthetic oligonucleotide
  Target: ATXN1; (+) strand; PAM type: YTN; PAM sequence: TTT
tagtagagacggggtttcac

SEQ ID NO: 248077 - DNA, 20 bp, Artificial Sequence
  Description of Artificial Sequence: Synthetic oligonucleotide
  Target: ATXN1; (+) strand; PAM type: YTN; PAM sequence: TTT
agtagagacggggtttcacc

SEQ ID NO: 248078 - DNA, 20 bp, Artificial Sequence
  Description of Artificial Sequence: Synthetic oligonucleotide
  Target: ATXN1; (+) strand; PAM type: YTN; PAM sequence: TTA
gtagagacggggtttcaccg

SEQ ID NO: 248079 - DNA, 20 bp, Artificial Sequence
  Description of Artificial Sequence: Synthetic oligonucleotide
  Target: ATXN1; (+) strand; PAM type: YTN; PAM sequence: TTT
caccgtattggcaaggctgg

SEQ ID NO: 248080 - DNA, 20 bp, Artificial Sequence
  Description of Artificial Sequence: Synthetic oligonucleotide
  Target: ATXN1; (+) strand; PAM type: YTN; PAM sequence: TTC
accgtattggcaaggctggt

SEQ ID NO: 248081 - DNA, 20 bp, Artificial Sequence
  Description of Artificial Sequence: Synthetic oligonucleotide
  Target: ATXN1; (+) strand; PAM type: YTN; PAM sequence: TTG
gcaaggctggtcttgaattc

SEQ ID NO: 248082 - DNA, 20 bp, Artificial Sequence
  Description of Artificial Sequence: Synthetic oligonucleotide
  Target: ATXN1; (+) strand; PAM type: YTN; PAM sequence: CTG
gtcttgaattcctgacctca

SEQ ID NO: 248083 - DNA, 20 bp, Artificial Sequence
  Description of Artificial Sequence: Synthetic oligonucleotide
  Target: ATXN1; (+) strand; PAM type: YTN; PAM sequence: CTT
gaattcctgacctcaggtga

SEQ ID NO: 248084 - DNA, 20 bp, Artificial Sequence
  Description of Artificial Sequence: Synthetic oligonucleotide
  Target: ATXN1; (+) strand; PAM type: YTN; PAM sequence: TTG
aattcctgacctcaggtgat

SEQ ID NO: 248085 - DNA, 20 bp, Artificial Sequence
  Description of Artificial Sequence: Synthetic oligonucleotide
  Target: ATXN1; (+) strand; PAM type: YTN; PAM sequence: TTC
ctgacctcaggtgatccacc

SEQ ID NO: 248086 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatccacccgc

SEQ ID NO: 248087 - DNA, 20 bp, Artificial Sequence
  Description of Artificial Sequence: Synthetic oligonucleotide
  Target: ATXN1; (+) strand; PAM type: YTN; PAM sequence: CTC
aggtgatccacccgccttgg

SEQ ID NO: 248088 - DNA, 20 bp, Artificial Sequence
  Description of Artificial Sequence: Synthetic oligonucleotide
  Target: ATXN1; (+) strand; PAM type: YTN; PAM sequence: CTT
ggcctcccaaagtgctggga

SEQ ID NO: 248089 - DNA, 20 bp, Artificial Sequence
  Description of Artificial Sequence: Synthetic oligonucleotide
  Target: ATXN1; (+) strand; PAM type: YTN; PAM sequence: TTG
gcctcccaaagtgctgggat

SEQ ID NO: 248090 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 248091 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgtgaggcac

SEQ ID NO: 248092 - DNA, 20 bp, Artificial Sequence
  Description of Artificial Sequence: Synthetic oligonucleotide
  Target: ATXN1; (+) strand; PAM type: YTN; PAM sequence: TTA
caggcgtgaggcaccacgcc

SEQ ID NO: 248093 - DNA, 20 bp, Artificial Sequence
  Description of Artificial Sequence: Synthetic oligonucleotide
  Target: ATXN1; (+) strand; PAM type: YTN; PAM sequence: CTC
acccacccttttgatgggca

SEQ ID NO: 248094 - DNA, 20 bp, Artificial Sequence
  Description of Artificial Sequence: Synthetic oligonucleotide
  Target: ATXN1; (+) strand; PAM type: YTN; PAM sequence: CTT
ttgatgggcaacttgagctg

SEQ ID NO: 248095 - DNA, 20 bp, Artificial Sequence
  Description of Artificial Sequence: Synthetic oligonucleotide
  Target: ATXN1; (+) strand; PAM type: YTN; PAM sequence: TTT
tgatgggcaacttgagctgc

SEQ ID NO: 248096 - DNA, 20 bp, Artificial Sequence
  Description of Artificial Sequence: Synthetic oligonucleotide
  Target: ATXN1; (+) strand; PAM type: YTN; PAM sequence: TTT
gatgggcaacttgagctgcc

SEQ ID NO: 248097 - DNA, 20 bp, Artificial Sequence
  Description of Artificial Sequence: Synthetic oligonucleotide
  Target: ATXN1; (+) strand; PAM type: YTN; PAM sequence: TTG
atgggcaacttgagctgccc

SEQ ID NO: 248098 - DNA, 20 bp, Artificial Sequence
  Description of Artificial Sequence: Synthetic oligonucleotide
  Target: ATXN1; (+) strand; PAM type: YTN; PAM sequence: CTT
gagctgccctctcctgctta

SEQ ID NO: 248099 - DNA, 20 bp, Artificial Sequence
  Description of Artificial Sequence: Synthetic oligonucleotide
  Target: ATXN1; (+) strand; PAM type: YTN; PAM sequence: TTG
agctgccctctcctgcttat

SEQ ID NO: 248100 - DNA, 20 bp, Artificial Sequence
  Description of Artificial Sequence: Synthetic oligonucleotide
  Target: ATXN1; (+) strand; PAM type: YTN; PAM sequence: CTG
ccctctcctgcttattcctg

SEQ ID NO: 248101 - DNA, 20 bp, Artificial Sequence
  Description of Artificial Sequence: Synthetic oligonucleotide
  Target: ATXN1; (+) strand; PAM type: YTN; PAM sequence: CTC
tcctgcttattcctgtaact

SEQ ID NO: 248102 - DNA, 20 bp, Artificial Sequence
  Description of Artificial Sequence: Synthetic oligonucleotide
  Target: ATXN1; (+) strand; PAM type: YTN; PAM sequence: CTC
ctgcttattcctgtaactgc

SEQ ID NO: 248103 - DNA, 20 bp, Artificial Sequence
  Description of Artificial Sequence: Synthetic oligonucleotide
  Target: ATXN1; (+) strand; PAM type: YTN; PAM sequence: CTG
cttattcctgtaactgcaaa

SEQ ID NO: 248104 - DNA, 20 bp, Artificial Sequence
  Description of Artificial Sequence: Synthetic oligonucleotide
  Target: ATXN1; (+) strand; PAM type: YTN; PAM sequence: CTT
attcctgtaactgcaaacac

SEQ ID NO: 248105 - DNA, 20 bp, Artificial Sequence
  Description of Artificial Sequence: Synthetic oligonucleotide
  Target: ATXN1; (+) strand; PAM type: YTN; PAM sequence: TTA
ttcctgtaactgcaaacacg

SEQ ID NO: 248106 - DNA, 20 bp, Artificial Sequence
  Description of Artificial Sequence: Synthetic oligonucleotide
  Target: ATXN1; (+) strand; PAM type: YTN; PAM sequence: TTC
ctgtaactgcaaacacgtct

SEQ ID NO: 248107 - DNA, 20 bp, Artificial Sequence
  Description of Artificial Sequence: Synthetic oligonucleotide
  Target: ATXN1; (+) strand; PAM type: YTN; PAM sequence: CTG
taactgcaaacacgtcttgc

SEQ ID NO: 248108 - DNA, 20 bp, Artificial Sequence
  Description of Artificial Sequence: Synthetic oligonucleotide
  Target: ATXN1; (+) strand; PAM type: YTN; PAM sequence: CTG
caaacacgtcttgctccaac

SEQ ID NO: 248109 - DNA, 20 bp, Artificial Sequence
  Description of Artificial Sequence: Synthetic oligonucleotide
  Target: ATXN1; (+) strand; PAM type: YTN; PAM sequence: CTT
gctccaaccaccacttctta

SEQ ID NO: 248110 - DNA, 20 bp, Artificial Sequence
  Description of Artificial Sequence: Synthetic oligonucleotide
  Target: ATXN1; (+) strand; PAM type: YTN; PAM sequence: TTG
ctccaaccaccacttcttaa

SEQ ID NO: 248111 - DNA, 20 bp, Artificial Sequence
  Description of Artificial Sequence: Synthetic oligonucleotide
  Target: ATXN1; (+) strand; PAM type: YTN; PAM sequence: CTC
caaccaccacttcttaaaac

SEQ ID NO: 248112 - DNA, 20 bp, Artificial Sequence
  Description of Artificial Sequence: Synthetic oligonucleotide
  Target: ATXN1; (+) strand; PAM type: YTN; PAM sequence: CTT
cttaaaactgcagatgaagg

SEQ ID NO: 248113 - DNA, 20 bp, Artificial Sequence
  Description of Artificial Sequence: Synthetic oligonucleotide
  Target: ATXN1; (+) strand; PAM type: YTN; PAM sequence: TTC
ttaaaactgcagatgaaggg

SEQ ID NO: 248114 - DNA, 20 bp, Artificial Sequence
  Description of Artificial Sequence: Synthetic oligonucleotide
  Target: ATXN1; (+) strand; PAM type: YTN; PAM sequence: CTT
aaaactgcagatgaagggct

SEQ ID NO: 248115 - DNA, 20 bp, Artificial Sequence
  Description of Artificial Sequence: Synthetic oligonucleotide
  Target: ATXN1; (+) strand; PAM type: YTN; PAM sequence: TTA
aaactgcagatgaagggctg

SEQ ID NO: 248116 - DNA, 20 bp, Artificial Sequence
  Description of Artificial Sequence: Synthetic oligonucleotide
  Target: ATXN1; (+) strand; PAM type: YTN; PAM sequence: CTG
cagatgaagggctgactctg

SEQ ID NO: 248117 - DNA, 20 bp, Artificial Sequence
  Description of Artificial Sequence: Synthetic oligonucleotide
  Target: ATXN1; (+) strand; PAM type: YTN; PAM sequence: CTG
actctgggcatgccattggt

SEQ ID NO: 248118 - DNA, 20 bp, Artificial Sequence
  Description of Artificial Sequence: Synthetic oligonucleotide
  Target: ATXN1; (+) strand; PAM type: YTN; PAM sequence: CTC
tgggcatgccattggttggg

SEQ ID NO: 248119 - DNA, 20 bp, Artificial Sequence
  Description of Artificial Sequence: Synthetic oligonucleotide
  Target: ATXN1; (+) strand; PAM type: YTN; PAM sequence: CTG
ggcatgccattggttgggct

SEQ ID NO: 248120 - DNA, 20 bp, Artificial Sequence
  Description of Artificial Sequence: Synthetic oligonucleotide
  Target: ATXN1; (+) strand; PAM type: YTN; PAM sequence: TTG
gttgggctcgttccttcccc

SEQ ID NO: 248121 - DNA, 20 bp, Artificial Sequence
  Description of Artificial Sequence: Synthetic oligonucleotide
  Target: ATXN1; (+) strand; PAM type: YTN; PAM sequence: TTG
ggctcgttccttccccgcga

SEQ ID NO: 248122 - DNA, 20 bp, Artificial Sequence
  Description of Artificial Sequence: Synthetic oligonucleotide
  Target: ATXN1; (+) strand; PAM type: YTN; PAM sequence: CTC
gttccttccccgcgaccatt

SEQ ID NO: 248123 - DNA, 20 bp, Artificial Sequence
  Description of Artificial Sequence: Synthetic oligonucleotide
  Target: ATXN1; (+) strand; PAM type: YTN; PAM sequence: TTC
cttccccgcgaccattctcc

SEQ ID NO: 248124 - DNA, 20 bp, Artificial Sequence
  Description of Artificial Sequence: Synthetic oligonucleotide
  Target: ATXN1; (+) strand; PAM type: YTN; PAM sequence: CTT
ccccgcgaccattctcctcc

SEQ ID NO: 248125 - DNA, 20 bp, Artificial Sequence
  Description of Artificial Sequence: Synthetic oligonucleotide
  Target: ATXN1; (+) strand; PAM type: YTN; PAM sequence: TTC
cccgcgaccattctcctcct

SEQ ID NO: 248126 - DNA, 20 bp, Artificial Sequence
  Description of Artificial Sequence: Synthetic oligonucleotide
  Target: ATXN1; (+) strand; PAM type: YTN; PAM sequence: TTC
tcctcctgagagctctgaag

SEQ ID NO: 248127 - DNA, 20 bp, Artificial Sequence
  Description of Artificial Sequence: Synthetic oligonucleotide
  Target: ATXN1; (+) strand; PAM type: YTN; PAM sequence: CTC
ctcctgagagctctgaagtc

SEQ ID NO: 248128 - DNA, 20 bp, Artificial Sequence
  Description of Artificial Sequence: Synthetic oligonucleotide
  Target: ATXN1; (+) strand; PAM type: YTN; PAM sequence: CTC
ctgagagctctgaagtcatt

SEQ ID NO: 248129 - DNA, 20 bp, Artificial Sequence
  Description of Artificial Sequence: Synthetic oligonucleotide
  Target: ATXN1; (+) strand; PAM type: YTN; PAM sequence: CTG
agagctctgaagtcattaca

SEQ ID NO: 248130 - DNA, 20 bp, Artificial Sequence
  Description of Artificial Sequence: Synthetic oligonucleotide
  Target: ATXN1; (+) strand; PAM type: YTN; PAM sequence: CTC
tgaagtcattacatcgaagt

SEQ ID NO: 248131 - DNA, 20 bp, Artificial Sequence
  Description of Artificial Sequence: Synthetic oligonucleotide
  Target: ATXN1; (+) strand; PAM type: YTN; PAM sequence: CTG
aagtcattacatcgaagtaa

SEQ ID NO: 248132 - DNA, 20 bp, Artificial Sequence
  Description of Artificial Sequence: Synthetic oligonucleotide
  Target: ATXN1; (+) strand; PAM type: YTN; PAM sequence: TTA
catcgaagtaagtaatttag

SEQ ID NO: 248133 - DNA, 20 bp, Artificial Sequence
  Description of Artificial Sequence: Synthetic oligonucleotide
  Target: ATXN1; (+) strand; PAM type: YTN; PAM sequence: TTT
agacacattgcctctaatat

SEQ ID NO: 248134 - DNA, 20 bp, Artificial Sequence
  Description of Artificial Sequence: Synthetic oligonucleotide
  Target: ATXN1; (+) strand; PAM type: YTN; PAM sequence: TTA
gacacattgcctctaatatt

SEQ ID NO: 248135 - DNA, 20 bp, Artificial Sequence
  Description of Artificial Sequence: Synthetic oligonucleotide
  Target: ATXN1; (+) strand; PAM type: YTN; PAM sequence: TTG
cctctaatattcctcttgct

SEQ ID NO: 248136 - DNA, 20 bp, Artificial Sequence
  Description of Artificial Sequence: Synthetic oligonucleotide
  Target: ATXN1; (+) strand; PAM type: YTN; PAM sequence: CTC
taatattcctcttgctcaca

SEQ ID NO: 248137 - DNA, 20 bp, Artificial Sequence
  Description of Artificial Sequence: Synthetic oligonucleotide
  Target: ATXN1; (+) strand; PAM type: YTN; PAM sequence: CTA
atattcctcttgctcacatc

SEQ ID NO: 248138 - DNA, 20 bp, Artificial Sequence
  Description of Artificial Sequence: Synthetic oligonucleotide
  Target: ATXN1; (+) strand; PAM type: YTN; PAM sequence: TTC
ctcttgctcacatctgtgaa

SEQ ID NO: 248139 - DNA, 20 bp, Artificial Sequence
  Description of Artificial Sequence: Synthetic oligonucleotide
  Target: ATXN1; (+) strand; PAM type: YTN; PAM sequence: CTC
ttgctcacatctgtgaagtt

SEQ ID NO: 248140 - DNA, 20 bp, Artificial Sequence
  Description of Artificial Sequence: Synthetic oligonucleotide
  Target: ATXN1; (+) strand; PAM type: YTN; PAM sequence: CTT
gctcacatctgtgaagttta

SEQ ID NO: 248141 - DNA, 20 bp, Artificial Sequence
  Description of Artificial Sequence: Synthetic oligonucleotide
  Target: ATXN1; (+) strand; PAM type: YTN; PAM sequence: TTG
ctcacatctgtgaagtttag

SEQ ID NO: 248142 - DNA, 20 bp, Artificial Sequence
  Description of Artificial Sequence: Synthetic oligonucleotide
  Target: ATXN1; (+) strand; PAM type: YTN; PAM sequence: CTC
acatctgtgaagtttagcaa

SEQ ID NO: 248143 - DNA, 20 bp, Artificial Sequence
  Description of Artificial Sequence: Synthetic oligonucleotide
  Target: ATXN1; (+) strand; PAM type: YTN; PAM sequence: CTG
tgaagtttagcaaataaagc

SEQ ID NO: 248144 - DNA, 20 bp, Artificial Sequence
  Description of Artificial Sequence: Synthetic oligonucleotide
  Target: ATXN1; (+) strand; PAM type: YTN; PAM sequence: TTT
agcaaataaagcaaatgtct

SEQ ID NO: 248145 - DNA, 20 bp, Artificial Sequence
  Description of Artificial Sequence: Synthetic oligonucleotide
  Target: ATXN1; (+) strand; PAM type: YTN; PAM sequence: TTA
gcaaataaagcaaatgtctg

SEQ ID NO: 248146 - DNA, 20 bp, Artificial Sequence
  Description of Artificial Sequence: Synthetic oligonucleotide
  Target: ATXN1; (+) strand; PAM type: YTN; PAM sequence: CTG
aatttcctatctctggacat

SEQ ID NO: 248147 - DNA, 20 bp, Artificial Sequence
  Description of Artificial Sequence: Synthetic oligonucleotide
  Target: ATXN1; (+) strand; PAM type: YTN; PAM sequence: TTT
cctatctctggacatacagg

SEQ ID NO: 248148 - DNA, 20 bp, Artificial Sequence
  Description of Artificial Sequence: Synthetic oligonucleotide
  Target: ATXN1; (+) strand; PAM type: YTN; PAM sequence: TTC
ctatctctggacatacaggg

SEQ ID NO: 248149 - DNA, 20 bp, Artificial Sequence
  Description of Artificial Sequence: Synthetic oligonucleotide
  Target: ATXN1; (+) strand; PAM type: YTN; PAM sequence: CTA
tctctggacatacagggaaa

SEQ ID NO: 248150 - DNA, 20 bp, Artificial Sequence
  Description of Artificial Sequence: Synthetic oligonucleotide
  Target: ATXN1; (+) strand; PAM type: YTN; PAM sequence: CTC
tggacatacagggaaacact

SEQ ID NO: 248151 - DNA, 20 bp, Artificial Sequence
  Description of Artificial Sequence: Synthetic oligonucleotide
  Target: ATXN1; (+) strand; PAM type: YTN; PAM sequence: CTG
gacatacagggaaacactga

SEQ ID NO: 248152 - DNA, 20 bp, Artificial Sequence
  Description of Artificial Sequence: Synthetic oligonucleotide
  Target: ATXN1; (+) strand; PAM type: YTN; PAM sequence: CTG
aagaagtgatgtcctctctt

SEQ ID NO: 248153 - DNA, 20 bp, Artificial Sequence
  Description of Artificial Sequence: Synthetic oligonucleotide
  Target: ATXN1; (+) strand; PAM type: YTN; PAM sequence: CTC
tcttcttcctacatttcctg

SEQ ID NO: 248154 - DNA, 20 bp, Artificial Sequence
  Description of Artificial Sequence: Synthetic oligonucleotide
  Target: ATXN1; (+) strand; PAM type: YTN; PAM sequence: CTC
ttcttcctacatttcctgcc

SEQ ID NO: 248155 - DNA, 20 bp, Artificial Sequence
  Description of Artificial Sequence: Synthetic oligonucleotide
  Target: ATXN1; (+) strand; PAM type: YTN; PAM sequence: CTT
cttcctacatttcctgccca

SEQ ID NO: 248156 - DNA, 20 bp, Artificial Sequence
  Description of Artificial Sequence: Synthetic oligonucleotide
  Target: ATXN1; (+) strand; PAM type: YTN; PAM sequence: TTC
ttcctacatttcctgcccac

SEQ ID NO: 248157 - DNA, 20 bp, Artificial Sequence
  Description of Artificial Sequence: Synthetic oligonucleotide
  Target: ATXN1; (+) strand; PAM type: YTN; PAM sequence: CTT
cctacatttcctgcccacgg

SEQ ID NO: 248158 - DNA, 20 bp, Artificial Sequence
  Description of Artificial Sequence: Synthetic oligonucleotide
  Target: ATXN1; (+) strand; PAM type: YTN; PAM sequence: TTC
ctacatttcctgcccacggc

SEQ ID NO: 248159 - DNA, 20 bp, Artificial Sequence
  Description of Artificial Sequence: Synthetic oligonucleotide
  Target: ATXN1; (+) strand; PAM type: YTN; PAM sequence: CTA
catttcctgcccacggcact

SEQ ID NO: 248160 - DNA, 20 bp, Artificial Sequence
  Description of Artificial Sequence: Synthetic oligonucleotide
  Target: ATXN1; (+) strand; PAM type: YTN; PAM sequence: TTT
cctgcccacggcactctttg

SEQ ID NO: 248161 - DNA, 20 bp, Artificial Sequence
  Description of Artificial Sequence: Synthetic oligonucleotide
  Target: ATXN1; (+) strand; PAM type: YTN; PAM sequence: TTC
ctgcccacggcactctttgc

SEQ ID NO: 248162 - DNA, 20 bp, Artificial Sequence
  Description of Artificial Sequence: Synthetic oligonucleotide
  Target: ATXN1; (+) strand; PAM type: YTN; PAM sequence: CTG
cccacggcactctttgcaca

SEQ ID NO: 248163 - DNA, 20 bp, Artificial Sequence
  Description of Artificial Sequence: Synthetic oligonucleotide
  Target: ATXN1; (+) strand; PAM type: YTN; PAM sequence: CTC
tttgcacaaaacctcagtaa

SEQ ID NO: 248164 - DNA, 20 bp, Artificial Sequence
  Description of Artificial Sequence: Synthetic oligonucleotide
  Target: ATXN1; (+) strand; PAM type: YTN; PAM sequence: CTT
tgcacaaaacctcagtaaaa

SEQ ID NO: 248165 - DNA, 20 bp, Artificial Sequence
  Description of Artificial Sequence: Synthetic oligonucleotide
  Target: ATXN1; (+) strand; PAM type: YTN; PAM sequence: TTT
gcacaaaacctcagtaaaaa

SEQ ID NO: 248166 - DNA, 20 bp, Artificial Sequence
  Description of Artificial Sequence: Synthetic oligonucleotide
  Target: ATXN1; (+) strand; PAM type: YTN; PAM sequence: TTG
cacaaaacctcagtaaaaaa

SEQ ID NO: 248167 - DNA, 20 bp, Artificial Sequence
  Description of Artificial Sequence: Synthetic oligonucleotide
  Target: ATXN1; (+) strand; PAM type: YTN; PAM sequence: CTC
agtaaaaaatcgtggcacag

SEQ ID NO: 248168 - DNA, 20 bp, Artificial Sequence
  Description of Artificial Sequence: Synthetic oligonucleotide
  Target: ATXN1; (+) strand; PAM type: YTN; PAM sequence: TTT
tcttcctcctccctgcttat

SEQ ID NO: 248169 - DNA, 20 bp, Artificial Sequence
  Description of Artificial Sequence: Synthetic oligonucleotide
  Target: ATXN1; (+) strand; PAM type: YTN; PAM sequence: TTT
cttcctcctccctgcttatt

SEQ ID NO: 248170 - DNA, 20 bp, Artificial Sequence
  Description of Artificial Sequence: Synthetic oligonucleotide
  Target: ATXN1; (+) strand; PAM type: YTN; PAM sequence: TTC
ttcctcctccctgcttattc

SEQ ID NO: 248171 - DNA, 20 bp, Artificial Sequence
  Description of Artificial Sequence: Synthetic oligonucleotide
  Target: ATXN1; (+) strand; PAM type: YTN; PAM sequence: CTT
cctcctccctgcttattcta

SEQ ID NO: 248172 - DNA, 20 bp, Artificial Sequence
  Description of Artificial Sequence: Synthetic oligonucleotide
  Target: ATXN1; (+) strand; PAM type: YTN; PAM sequence: TTC
ctcctccctgcttattctat

SEQ ID NO: 248173 - DNA, 20 bp, Artificial Sequence
  Description of Artificial Sequence: Synthetic oligonucleotide
  Target: ATXN1; (+) strand; PAM type: YTN; PAM sequence: CTC
ctccctgcttattctatgac

SEQ ID NO: 248174 - DNA, 20 bp, Artificial Sequence
  Description of Artificial Sequence: Synthetic oligonucleotide
  Target: ATXN1; (+) strand; PAM type: YTN; PAM sequence: CTC
cctgcttattctatgactca

SEQ ID NO: 248175 - DNA, 20 bp, Artificial Sequence
  Description of Artificial Sequence: Synthetic oligonucleotide
  Target: ATXN1; (+) strand; PAM type: YTN; PAM sequence: CTG
cttattctatgactcagaag

SEQ ID NO: 248176 - DNA, 20 bp, Artificial Sequence
  Description of Artificial Sequence: Synthetic oligonucleotide
  Target: ATXN1; (+) strand; PAM type: YTN; PAM sequence: CTT
attctatgactcagaaggtt

SEQ ID NO: 248177 - DNA, 20 bp, Artificial Sequence
  Description of Artificial Sequence: Synthetic oligonucleotide
  Target: ATXN1; (+) strand; PAM type: YTN; PAM sequence: TTA
ttctatgactcagaaggttc

SEQ ID NO: 248178 - DNA, 20 bp, Artificial Sequence
  Description of Artificial Sequence: Synthetic oligonucleotide
  Target: ATXN1; (+) strand; PAM type: YTN; PAM sequence: TTC
tatgactcagaaggttcaaa

SEQ ID NO: 248179 - DNA, 20 bp, Artificial Sequence
  Description of Artificial Sequence: Synthetic oligonucleotide
  Target: ATXN1; (+) strand; PAM type: YTN; PAM sequence: CTA
tgactcagaaggttcaaagc

SEQ ID NO: 248180 - DNA, 20 bp, Artificial Sequence
  Description of Artificial Sequence: Synthetic oligonucleotide
  Target: ATXN1; (+) strand; PAM type: YTN; PAM sequence: CTC
agaaggttcaaagcaaaggt

SEQ ID NO: 248181 - DNA, 20 bp, Artificial Sequence
  Description of Artificial Sequence: Synthetic oligonucleotide
  Target: ATXN1; (+) strand; PAM type: YTN; PAM sequence: TTC
aaagcaaaggtttttgacct

SEQ ID NO: 248182 - DNA, 20 bp, Artificial Sequence
  Description of Artificial Sequence: Synthetic oligonucleotide
  Target: ATXN1; (+) strand; PAM type: YTN; PAM sequence: TTT
ttgacctaatttggccttaa

SEQ ID NO: 248183 - DNA, 20 bp, Artificial Sequence
  Description of Artificial Sequence: Synthetic oligonucleotide
  Target: ATXN1; (+) strand; PAM type: YTN; PAM sequence: TTT
tgacctaatttggccttaag

SEQ ID NO: 248184 - DNA, 20 bp, Artificial Sequence
  Description of Artificial Sequence: Synthetic oligonucleotide
  Target: ATXN1; (+) strand; PAM type: YTN; PAM sequence: TTT
gacctaatttggccttaagt

SEQ ID NO: 248185 - DNA, 20 bp, Artificial Sequence
  Description of Artificial Sequence: Synthetic oligonucleotide
  Target: ATXN1; (+) strand; PAM type: YTN; PAM sequence: TTG
acctaatttggccttaagtc

SEQ ID NO: 248186 - DNA, 20 bp, Artificial Sequence
  Description of Artificial Sequence: Synthetic oligonucleotide
  Target: ATXN1; (+) strand; PAM type: YTN; PAM sequence: CTA
atttggccttaagtcagaaa

SEQ ID NO: 248187 - DNA, 20 bp, Artificial Sequence
  Description of Artificial Sequence: Synthetic oligonucleotide
  Target: ATXN1; (+) strand; PAM type: YTN; PAM sequence: TTT
ggccttaagtcagaaaaggt

SEQ ID NO: 248188 - DNA, 20 bp, Artificial Sequence
  Description of Artificial Sequence: Synthetic oligonucleotide
  Target: ATXN1; (+) strand; PAM type: YTN; PAM sequence: TTG
gccttaagtcagaaaaggtt

SEQ ID NO: 248189 - DNA, 20 bp, Artificial Sequence
  Description of Artificial Sequence: Synthetic oligonucleotide
  Target: ATXN1; (+) strand; PAM type: YTN; PAM sequence: CTT
aagtcagaaaaggttccact

SEQ ID NO: 248190 - DNA, 20 bp, Artificial Sequence
  Description of Artificial Sequence: Synthetic oligonucleotide
  Target: ATXN1; (+) strand; PAM type: YTN; PAM sequence: TTA
agtcagaaaaggttccactg

SEQ ID NO: 248191 - DNA, 20 bp, Artificial Sequence
  Description of Artificial Sequence: Synthetic oligonucleotide
  Target: ATXN1; (+) strand; PAM type: YTN; PAM sequence: TTC
cactgctgtctcacactgag

SEQ ID NO: 248192 - DNA, 20 bp, Artificial Sequence
  Description of Artificial Sequence: Synthetic oligonucleotide
  Target: ATXN1; (+) strand; PAM type: YTN; PAM sequence: CTG
ctgtctcacactgagtttca

SEQ ID NO: 248193 - DNA, 20 bp, Artificial Sequence
  Description of Artificial Sequence: Synthetic oligonucleotide
  Target: ATXN1; (+) strand; PAM type: YTN; PAM sequence: CTG
tctcacactgagtttcaaag

SEQ ID NO: 248194 - DNA, 20 bp, Artificial Sequence
  Description of Artificial Sequence: Synthetic oligonucleotide
  Target: ATXN1; (+) strand; PAM type: YTN; PAM sequence: CTC
acactgagtttcaaagcaaa

SEQ ID NO: 248195 - DNA, 20 bp, Artificial Sequence
  Description of Artificial Sequence: Synthetic oligonucleotide
  Target: ATXN1; (+) strand; PAM type: YTN; PAM sequence: CTG
agtttcaaagcaaagaagaa

SEQ ID NO: 248196 - DNA, 20 bp, Artificial Sequence
  Description of Artificial Sequence: Synthetic oligonucleotide
  Target: ATXN1; (+) strand; PAM type: YTN; PAM sequence: TTT
caaagcaaagaagaaatgga

SEQ ID NO: 248197 - DNA, 20 bp, Artificial Sequence
  Description of Artificial Sequence: Synthetic oligonucleotide
  Target: ATXN1; (+) strand; PAM type: YTN; PAM sequence: TTC
aaagcaaagaagaaatggaa

SEQ ID NO: 248198 - DNA, 20 bp, Artificial Sequence
  Description of Artificial Sequence: Synthetic oligonucleotide
  Target: ATXN1; (+) strand; PAM type: YTN; PAM sequence: CTG
tatttaattctgaatataat

SEQ ID NO: 248199 - DNA, 20 bp, Artificial Sequence
  Description of Artificial Sequence: Synthetic oligonucleotide
  Target: ATXN1; (+) strand; PAM type: YTN; PAM sequence: TTT
aattctgaatataatctctt

SEQ ID NO: 248200 - DNA, 20 bp, Artificial Sequence
  Description of Artificial Sequence: Synthetic oligonucleotide
  Target: ATXN1; (+) strand; PAM type: YTN; PAM sequence: TTA
attctgaatataatctcttt

SEQ ID NO: 248201 - DNA, 20 bp, Artificial Sequence
  Description of Artificial Sequence: Synthetic oligonucleotide
  Target: ATXN1; (+) strand; PAM type: YTN; PAM sequence: TTC
tgaatataatctctttgctg

SEQ ID NO: 248202 - DNA, 20 bp, Artificial Sequence
  Description of Artificial Sequence: Synthetic oligonucleotide
  Target: ATXN1; (+) strand; PAM type: YTN; PAM sequence: CTG
aatataatctctttgctgtt

SEQ ID NO: 248203 - DNA, 20 bp, Artificial Sequence
  Description of Artificial Sequence: Synthetic oligonucleotide
  Target: ATXN1; (+) strand; PAM type: YTN; PAM sequence: CTC
tttgctgttggcaatgttat

SEQ ID NO: 248204 - DNA, 20 bp, Artificial Sequence
  Description of Artificial Sequence: Synthetic oligonucleotide
  Target: ATXN1; (+) strand; PAM type: YTN; PAM sequence: CTT
tgctgttggcaatgttatgg

SEQ ID NO: 248205 - DNA, 20 bp, Artificial Sequence
  Description of Artificial Sequence: Synthetic oligonucleotide
  Target: ATXN1; (+) strand; PAM type: YTN; PAM sequence: TTT
gctgttggcaatgttatggg

SEQ ID NO: 248206 - DNA, 20 bp, Artificial Sequence
  Description of Artificial Sequence: Synthetic oligonucleotide
  Target: ATXN1; (+) strand; PAM type: YTN; PAM sequence: TTG
ctgttggcaatgttatggga

SEQ ID NO: 248207 - DNA, 20 bp, Artificial Sequence
  Description of Artificial Sequence: Synthetic oligonucleotide
  Target: ATXN1; (+) strand; PAM type: YTN; PAM sequence: CTG
ttggcaatgttatgggaata

SEQ ID NO: 248208 - DNA, 20 bp, Artificial Sequence
  Description of Artificial Sequence: Synthetic oligonucleotide
  Target: ATXN1; (+) strand; PAM type: YTN; PAM sequence: TTG
gcaatgttatgggaatagta

SEQ ID NO: 248209 - DNA, 20 bp, Artificial Sequence
  Description of Artificial Sequence: Synthetic oligonucleotide
  Target: ATXN1; (+) strand; PAM type: YTN; PAM sequence: TTA
tgggaatagtaatgaatttt

SEQ ID NO: 248210 - DNA, 20 bp, Artificial Sequence
  Description of Artificial Sequence: Synthetic oligonucleotide
  Target: ATXN1; (+) strand; PAM type: YTN; PAM sequence: TTT
ttgctttccatgaataaatt

SEQ ID NO: 248211 - DNA, 20 bp, Artificial Sequence
  Description of Artificial Sequence: Synthetic oligonucleotide
  Target: ATXN1; (+) strand; PAM type: YTN; PAM sequence: TTT
tgctttccatgaataaattt

SEQ ID NO: 248212 - DNA, 20 bp, Artificial Sequence
  Description of Artificial Sequence: Synthetic oligonucleotide
  Target: ATXN1; (+) strand; PAM type: YTN; PAM sequence: TTT
gctttccatgaataaatttt

SEQ ID NO: 248213 - DNA, 20 bp, Artificial Sequence
  Description of Artificial Sequence: Synthetic oligonucleotide
  Target: ATXN1; (+) strand; PAM type: YTN; PAM sequence: TTG
ctttccatgaataaattttt

SEQ ID NO: 248214 - DNA, 20 bp, Artificial Sequence
  Description of Artificial Sequence: Synthetic oligonucleotide
  Target: ATXN1; (+) strand; PAM type: YTN; PAM sequence: CTT
tccatgaataaatttttcag

SEQ ID NO: 248215 - DNA, 20 bp, Artificial Sequence
  Description of Artificial Sequence: Synthetic oligonucleotide
  Target: ATXN1; (+) strand; PAM type: YTN; PAM sequence: TTT
ccatgaataaatttttcaga

SEQ ID NO: 248216 - DNA, 20 bp, Artificial Sequence
  Description of Artificial Sequence: Synthetic oligonucleotide
  Target: ATXN1; (+) strand; PAM type: YTN; PAM sequence: TTC
catgaataaatttttcagaa

SEQ ID NO: 248217 - DNA, 20 bp, Artificial Sequence
  Description of Artificial Sequence: Synthetic oligonucleotide
  Target: ATXN1; (+) strand; PAM type: YTN; PAM sequence: TTT
ttcagaatctaaagttgagg

SEQ ID NO: 248218 - DNA, 20 bp, Artificial Sequence
  Description of Artificial Sequence: Synthetic oligonucleotide
  Target: ATXN1; (+) strand; PAM type: YTN; PAM sequence: TTT
tcagaatctaaagttgaggc

SEQ ID NO: 248219 - DNA, 20 bp, Artificial Sequence
  Description of Artificial Sequence: Synthetic oligonucleotide
  Target: ATXN1; (+) strand; PAM type: YTN; PAM sequence: TTT
cagaatctaaagttgaggct

SEQ ID NO: 248220 - DNA, 20 bp, Artificial Sequence
  Description of Artificial Sequence: Synthetic oligonucleotide
  Target: ATXN1; (+) strand; PAM type: YTN; PAM sequence: TTC
agaatctaaagttgaggctc

SEQ ID NO: 248221 - DNA, 20 bp, Artificial Sequence
  Description of Artificial Sequence: Synthetic oligonucleotide
  Target: ATXN1; (+) strand; PAM type: YTN; PAM sequence: CTA
aagttgaggctcacataatt

SEQ ID NO: 248222 - DNA, 20 bp, Artificial Sequence
  Description of Artificial Sequence: Synthetic oligonucleotide
  Target: ATXN1; (+) strand; PAM type: YTN; PAM sequence: TTG
aggctcacataattgttagt

SEQ ID NO: 248223 - DNA, 20 bp, Artificial Sequence
  Description of Artificial Sequence: Synthetic oligonucleotide
  Target: ATXN1; (+) strand; PAM type: YTN; PAM sequence: CTC
acataattgttagtattttc

SEQ ID NO: 248224 - DNA, 20 bp, Artificial Sequence
  Description of Artificial Sequence: Synthetic oligonucleotide
  Target: ATXN1; (+) strand; PAM type: YTN; PAM sequence: TTG
ttagtattttccccacagtg

SEQ ID NO: 248225 - DNA, 20 bp, Artificial Sequence
  Description of Artificial Sequence: Synthetic oligonucleotide
  Target: ATXN1; (+) strand; PAM type: YTN; PAM sequence: TTA
gtattttccccacagtgttt

SEQ ID NO: 248226 - DNA, 20 bp, Artificial Sequence
  Description of Artificial Sequence: Synthetic oligonucleotide
  Target: ATXN1; (+) strand; PAM type: YTN; PAM sequence: TTT
tccccacagtgtttttcaat

SEQ ID NO: 248227 - DNA, 20 bp, Artificial Sequence
  Description of Artificial Sequence: Synthetic oligonucleotide
  Target: ATXN1; (+) strand; PAM type: YTN; PAM sequence: TTT
ccccacagtgtttttcaatt

SEQ ID NO: 248228 - DNA, 20 bp, Artificial Sequence
  Description of Artificial Sequence: Synthetic oligonucleotide
  Target: ATXN1; (+) strand; PAM type: YTN; PAM sequence: TTC
cccacagtgtttttcaattt

SEQ ID NO: 248229 - DNA, 20 bp, Artificial Sequence
  Description of Artificial Sequence: Synthetic oligonucleotide
  Target: ATXN1; (+) strand; PAM type: YTN; PAM sequence: TTT
ttcaattttccttggaaggg

SEQ ID NO: 248230 - DNA, 20 bp, Artificial Sequence
  Description of Artificial Sequence: Synthetic oligonucleotide
  Target: ATXN1; (+) strand; PAM type: YTN; PAM sequence: TTT
tcaattttccttggaaggga

SEQ ID NO: 248231 - DNA, 20 bp, Artificial Sequence
  Description of Artificial Sequence: Synthetic oligonucleotide
  Target: ATXN1; (+) strand; PAM type: YTN; PAM sequence: TTT
caattttccttggaagggaa

SEQ ID NO: 248232 - DNA, 20 bp, Artificial Sequence
  Description of Artificial Sequence: Synthetic oligonucleotide
  Target: ATXN1; (+) strand; PAM type: YTN; PAM sequence: TTC
aattttccttggaagggaag

SEQ ID NO: 248233 - DNA, 20 bp, Artificial Sequence
  Description of Artificial Sequence: Synthetic oligonucleotide
  Target: ATXN1; (+) strand; PAM type: YTN; PAM sequence: TTT
tccttggaagggaagtagac

SEQ ID NO: 248234 - DNA, 20 bp, Artificial Sequence
  Description of Artificial Sequence: Synthetic oligonucleotide
  Target: ATXN1; (+) strand; PAM type: YTN; PAM sequence: TTT
ccttggaagggaagtagact

SEQ ID NO: 248235 - DNA, 20 bp, Artificial Sequence
  Description of Artificial Sequence: Synthetic oligonucleotide
  Target: ATXN1; (+) strand; PAM type: YTN; PAM sequence: TTC
cttggaagggaagtagactg

SEQ ID NO: 248236 - DNA, 20 bp, Artificial Sequence
  Description of Artificial Sequence: Synthetic oligonucleotide
  Target: ATXN1; (+) strand; PAM type: YTN; PAM sequence: CTT
ggaagggaagtagactgaat

SEQ ID NO: 248237 - DNA, 20 bp, Artificial Sequence
  Description of Artificial Sequence: Synthetic oligonucleotide
  Target: ATXN1; (+) strand; PAM type: YTN; PAM sequence: TTG
gaagggaagtagactgaatt

SEQ ID NO: 248238 - DNA, 20 bp, Artificial Sequence
  Description of Artificial Sequence: Synthetic oligonucleotide
  Target: ATXN1; (+) strand; PAM type: YTN; PAM sequence: CTG
aattacaatacctcagtttc

SEQ ID NO: 248239 - DNA, 20 bp, Artificial Sequence
  Description of Artificial Sequence: Synthetic oligonucleotide
  Target: ATXN1; (+) strand; PAM type: YTN; PAM sequence: TTA
caatacctcagtttctcatt

SEQ ID NO: 248240 - DNA, 20 bp, Artificial Sequence
  Description of Artificial Sequence: Synthetic oligonucleotide
  Target: ATXN1; (+) strand; PAM type: YTN; PAM sequence: CTC
agtttctcattttgtaagct

SEQ ID NO: 248241 - DNA, 20 bp, Artificial Sequence
  Description of Artificial Sequence: Synthetic oligonucleotide
  Target: ATXN1; (+) strand; PAM type: YTN; PAM sequence: TTT
ctcattttgtaagctgccaa

SEQ ID NO: 248242 - DNA, 20 bp, Artificial Sequence
  Description of Artificial Sequence: Synthetic oligonucleotide
  Target: ATXN1; (+) strand; PAM type: YTN; PAM sequence: TTC
tcattttgtaagctgccaag

SEQ ID NO: 248243 - DNA, 20 bp, Artificial Sequence
  Description of Artificial Sequence: Synthetic oligonucleotide
  Target: ATXN1; (+) strand; PAM type: YTN; PAM sequence: CTC
attttgtaagctgccaagaa

SEQ ID NO: 248244 - DNA, 20 bp, Artificial Sequence
  Description of Artificial Sequence: Synthetic oligonucleotide
  Target: ATXN1; (+) strand; PAM type: YTN; PAM sequence: TTT
tgtaagctgccaagaacagt

SEQ ID NO: 248245 - DNA, 20 bp, Artificial Sequence
  Description of Artificial Sequence: Synthetic oligonucleotide
  Target: ATXN1; (+) strand; PAM type: YTN; PAM sequence: TTT
gtaagctgccaagaacagta

SEQ ID NO: 248246 - DNA, 20 bp, Artificial Sequence
  Description of Artificial Sequence: Synthetic oligonucleotide
  Target: ATXN1; (+) strand; PAM type: YTN; PAM sequence: TTG
taagctgccaagaacagtat

SEQ ID NO: 248247 - DNA, 20 bp, Artificial Sequence
  Description of Artificial Sequence: Synthetic oligonucleotide
  Target: ATXN1; (+) strand; PAM type: YTN; PAM sequence: CTG
ccaagaacagtatgaactgt

SEQ ID NO: 248248 - DNA, 20 bp, Artificial Sequence
  Description of Artificial Sequence: Synthetic oligonucleotide
  Target: ATXN1; (+) strand; PAM type: YTN; PAM sequence: CTG
tcctggaactaaagaaacat

SEQ ID NO: 248249 - DNA, 20 bp, Artificial Sequence
  Description of Artificial Sequence: Synthetic oligonucleotide
  Target: ATXN1; (+) strand; PAM type: YTN; PAM sequence: CTG
gaactaaagaaacataagga

SEQ ID NO: 248250 - DNA, 20 bp, Artificial Sequence
  Description of Artificial Sequence: Synthetic oligonucleotide
  Target: ATXN1; (+) strand; PAM type: YTN; PAM sequence: CTA
aagaaacataaggacaaatg

SEQ ID NO: 248251 - DNA, 20 bp, Artificial Sequence
  Description of Artificial Sequence: Synthetic oligonucleotide
  Target: ATXN1; (+) strand; PAM type: YTN; PAM sequence: TTT
gaaattctttgggggaaaag

SEQ ID NO: 248252 - DNA, 20 bp, Artificial Sequence
  Description of Artificial Sequence: Synthetic oligonucleotide
  Target: ATXN1; (+) strand; PAM type: YTN; PAM sequence: TTG
aaattctttgggggaaaagc

SEQ ID NO: 248253 - DNA, 20 bp, Artificial Sequence
  Description of Artificial Sequence: Synthetic oligonucleotide
  Target: ATXN1; (+) strand; PAM type: YTN; PAM sequence: TTC
tttgggggaaaagcatataa

SEQ ID NO: 248254 - DNA, 20 bp, Artificial Sequence
  Description of Artificial Sequence: Synthetic oligonucleotide
  Target: ATXN1; (+) strand; PAM type: YTN; PAM sequence: CTT
tgggggaaaagcatataact

SEQ ID NO: 248255 - DNA, 20 bp, Artificial Sequence
  Description of Artificial Sequence: Synthetic oligonucleotide
  Target: ATXN1; (+) strand; PAM type: YTN; PAM sequence: TTT
gggggaaaagcatataactt

SEQ ID NO: 248256 - DNA, 20 bp, Artificial Sequence
  Description of Artificial Sequence: Synthetic oligonucleotide
  Target: ATXN1; (+) strand; PAM type: YTN; PAM sequence: TTG
ggggaaaagcatataactta

SEQ ID NO: 248257 - DNA, 20 bp, Artificial Sequence
  Description of Artificial Sequence: Synthetic oligonucleotide
  Target: ATXN1; (+) strand; PAM type: YTN; PAM sequence: CTT
atgcagaccaccctgggtta

SEQ ID NO: 248258 - DNA, 20 bp, Artificial Sequence
  Description of Artificial Sequence: Synthetic oligonucleotide
  Target: ATXN1; (+) strand; PAM type: YTN; PAM sequence: TTA
tgcagaccaccctgggttat

SEQ ID NO: 248259 - DNA, 20 bp, Artificial Sequence
  Description of Artificial Sequence: Synthetic oligonucleotide
  Target: ATXN1; (+) strand; PAM type: YTN; PAM sequence: CTG
ggttatccagtttttaaaaa

SEQ ID NO: 248260 - DNA, 20 bp, Artificial Sequence
  Description of Artificial Sequence: Synthetic oligonucleotide
  Target: ATXN1; (+) strand; PAM type: YTN; PAM sequence: TTA
tccagtttttaaaaatccct

SEQ ID NO: 248261 - DNA, 20 bp, Artificial Sequence
  Description of Artificial Sequence: Synthetic oligonucleotide
  Target: ATXN1; (+) strand; PAM type: YTN; PAM sequence: TTT
ttaaaaatccctgcatacta

SEQ ID NO: 248262 - DNA, 20 bp, Artificial Sequence
  Description of Artificial Sequence: Synthetic oligonucleotide
  Target: ATXN1; (+) strand; PAM type: YTN; PAM sequence: TTT
taaaaatccctgcatactag

SEQ ID NO: 248263 - DNA, 20 bp, Artificial Sequence
  Description of Artificial Sequence: Synthetic oligonucleotide
  Target: ATXN1; (+) strand; PAM type: YTN; PAM sequence: TTT
aaaaatccctgcatactaga

SEQ ID NO: 248264 - DNA, 20 bp, Artificial Sequence
  Description of Artificial Sequence: Synthetic oligonucleotide
  Target: ATXN1; (+) strand; PAM type: YTN; PAM sequence: TTA
aaaatccctgcatactagac

SEQ ID NO: 248265 - DNA, 20 bp, Artificial Sequence
  Description of Artificial Sequence: Synthetic oligonucleotide
  Target: ATXN1; (+) strand; PAM type: YTN; PAM sequence: CTG
catactagacaaacttcttt

SEQ ID NO: 248266 - DNA, 20 bp, Artificial Sequence
  Description of Artificial Sequence: Synthetic oligonucleotide
  Target: ATXN1; (+) strand; PAM type: YTN; PAM sequence: CTA
gacaaacttcttttggacca

SEQ ID NO: 248267 - DNA, 20 bp, Artificial Sequence
  Description of Artificial Sequence: Synthetic oligonucleotide
  Target: ATXN1; (+) strand; PAM type: YTN; PAM sequence: CTT
cttttggaccacgtttcttt

SEQ ID NO: 248268 - DNA, 20 bp, Artificial Sequence
  Description of Artificial Sequence: Synthetic oligonucleotide
  Target: ATXN1; (+) strand; PAM type: YTN; PAM sequence: TTC
ttttggaccacgtttctttc

SEQ ID NO: 248269 - DNA, 20 bp, Artificial Sequence
  Description of Artificial Sequence: Synthetic oligonucleotide
  Target: ATXN1; (+) strand; PAM type: YTN; PAM sequence: CTT
ttggaccacgtttctttcct

SEQ ID NO: 248270 - DNA, 20 bp, Artificial Sequence
  Description of Artificial Sequence: Synthetic oligonucleotide
  Target: ATXN1; (+) strand; PAM type: YTN; PAM sequence: TTT
tggaccacgtttctttccta

SEQ ID NO: 248271 - DNA, 20 bp, Artificial Sequence
  Description of Artificial Sequence: Synthetic oligonucleotide
  Target: ATXN1; (+) strand; PAM type: YTN; PAM sequence: TTT
ggaccacgtttctttcctaa

SEQ ID NO: 248272 - DNA, 20 bp, Artificial Sequence
  Description of Artificial Sequence: Synthetic oligonucleotide
  Target: ATXN1; (+) strand; PAM type: YTN; PAM sequence: TTG
gaccacgtttctttcctaag

SEQ ID NO: 248273 - DNA, 20 bp, Artificial Sequence
  Description of Artificial Sequence: Synthetic oligonucleotide
  Target: ATXN1; (+) strand; PAM type: YTN; PAM sequence: TTT
ctttcctaagagaagcttga

SEQ ID NO: 248274 - DNA, 20 bp, Artificial Sequence
  Description of Artificial Sequence: Synthetic oligonucleotide
  Target: ATXN1; (+) strand; PAM type: YTN; PAM sequence: TTC
tttcctaagagaagcttgaa

SEQ ID NO: 248275 - DNA, 20 bp, Artificial Sequence
  Description of Artificial Sequence: Synthetic oligonucleotide
  Target: ATXN1; (+) strand; PAM type: YTN; PAM sequence: CTT
tcctaagagaagcttgaaga

SEQ ID NO: 248276 - DNA, 20 bp, Artificial Sequence
  Description of Artificial Sequence: Synthetic oligonucleotide
  Target: ATXN1; (+) strand; PAM type: YTN; PAM sequence: TTT
cctaagagaagcttgaagac

SEQ ID NO: 248277 - DNA, 20 bp, Artificial Sequence
  Description of Artificial Sequence: Synthetic oligonucleotide
  Target: ATXN1; (+) strand; PAM type: YTN; PAM sequence: TTC
ctaagagaagcttgaagaca

SEQ ID NO: 248278 - DNA, 20 bp, Artificial Sequence
  Description of Artificial Sequence: Synthetic oligonucleotide
  Target: ATXN1; (+) strand; PAM type: YTN; PAM sequence: CTA
agagaagcttgaagacagca

SEQ ID NO: 248279 - DNA, 20 bp, Artificial Sequence
  Description of Artificial Sequence: Synthetic oligonucleotide
  Target: ATXN1; (+) strand; PAM type: YTN; PAM sequence: CTT
gaagacagcaaactaatttt

SEQ ID NO: 248280 - DNA, 20 bp, Artificial Sequence
  Description of Artificial Sequence: Synthetic oligonucleotide
  Target: ATXN1; (+) strand; PAM type: YTN; PAM sequence: TTG
aagacagcaaactaattttc

SEQ ID NO: 248281 - DNA, 20 bp, Artificial Sequence
  Description of Artificial Sequence: Synthetic oligonucleotide
  Target: ATXN1; (+) strand; PAM type: YTN; PAM sequence: CTA
attttcaaattaggcatttg

SEQ ID NO: 248282 - DNA, 20 bp, Artificial Sequence
  Description of Artificial Sequence: Synthetic oligonucleotide
  Target: ATXN1; (+) strand; PAM type: YTN; PAM sequence: TTT
tcaaattaggcatttgtcaa

SEQ ID NO: 248283 - DNA, 20 bp, Artificial Sequence
  Description of Artificial Sequence: Synthetic oligonucleotide
  Target: ATXN1; (+) strand; PAM type: YTN; PAM sequence: TTT
caaattaggcatttgtcaaa

SEQ ID NO: 248284 - DNA, 20 bp, Artificial Sequence
  Description of Artificial Sequence: Synthetic oligonucleotide
  Target: ATXN1; (+) strand; PAM type: YTN; PAM sequence: TTC
aaattaggcatttgtcaaac

SEQ ID NO: 248285 - DNA, 20 bp, Artificial Sequence
  Description of Artificial Sequence: Synthetic oligonucleotide
  Target: ATXN1; (+) strand; PAM type: YTN; PAM sequence: TTA
ggcatttgtcaaacattttt

SEQ ID NO: 248286 - DNA, 20 bp, Artificial Sequence
  Description of Artificial Sequence: Synthetic oligonucleotide
  Target: ATXN1; (+) strand; PAM type: YTN; PAM sequence: TTT
gtcaaacatttttaggaaga

SEQ ID NO: 248287 - DNA, 20 bp, Artificial Sequence
  Description of Artificial Sequence: Synthetic oligonucleotide
  Target: ATXN1; (+) strand; PAM type: YTN; PAM sequence: TTG
tcaaacatttttaggaagat

SEQ ID NO: 248288 - DNA, 20 bp, Artificial Sequence
  Description of Artificial Sequence: Synthetic oligonucleotide
  Target: ATXN1; (+) strand; PAM type: YTN; PAM sequence: TTT
ttaggaagatgaatcttgag

SEQ ID NO: 248289 - DNA, 20 bp, Artificial Sequence
  Description of Artificial Sequence: Synthetic oligonucleotide
  Target: ATXN1; (+) strand; PAM type: YTN; PAM sequence: TTT
taggaagatgaatcttgagc

SEQ ID NO: 248290 - DNA, 20 bp, Artificial Sequence
  Description of Artificial Sequence: Synthetic oligonucleotide
  Target: ATXN1; (+) strand; PAM type: YTN; PAM sequence: TTT
aggaagatgaatcttgagca

SEQ ID NO: 248291 - DNA, 20 bp, Artificial Sequence
  Description of Artificial Sequence: Synthetic oligonucleotide
  Target: ATXN1; (+) strand; PAM type: YTN; PAM sequence: TTA
ggaagatgaatcttgagcaa

SEQ ID NO: 248292 - DNA, 20 bp, Artificial Sequence
  Description of Artificial Sequence: Synthetic oligonucleotide
  Target: ATXN1; (+) strand; PAM type: YTN; PAM sequence: CTT
gagcaaaacaaacttttgat

SEQ ID NO: 248293 - DNA, 20 bp, Artificial Sequence
  Description of Artificial Sequence: Synthetic oligonucleotide
  Target: ATXN1; (+) strand; PAM type: YTN; PAM sequence: TTG
agcaaaacaaacttttgatt

SEQ ID NO: 248294 - DNA, 20 bp, Artificial Sequence
  Description of Artificial Sequence: Synthetic oligonucleotide
  Target: ATXN1; (+) strand; PAM type: YTN; PAM sequence: CTT
ttgattatattcaaaaaaca

SEQ ID NO: 248295 - DNA, 20 bp, Artificial Sequence
  Description of Artificial Sequence: Synthetic oligonucleotide
  Target: ATXN1; (+) strand; PAM type: YTN; PAM sequence: TTT
tgattatattcaaaaaacac

SEQ ID NO: 248296 - DNA, 20 bp, Artificial Sequence
  Description of Artificial Sequence: Synthetic oligonucleotide
  Target: ATXN1; (+) strand; PAM type: YTN; PAM sequence: TTT
gattatattcaaaaaacacc

SEQ ID NO: 248297 - DNA, 20 bp, Artificial Sequence
  Description of Artificial Sequence: Synthetic oligonucleotide
  Target: ATXN1; (+) strand; PAM type: YTN; PAM sequence: TTG
attatattcaaaaaacacca

SEQ ID NO: 248298 - DNA, 20 bp, Artificial Sequence
  Description of Artificial Sequence: Synthetic oligonucleotide
  Target: ATXN1; (+) strand; PAM type: YTN; PAM sequence: TTA
tattcaaaaaacaccaaaaa

SEQ ID NO: 248299 - DNA, 20 bp, Artificial Sequence
  Description of Artificial Sequence: Synthetic oligonucleotide
  Target: ATXN1; (+) strand; PAM type: YTN; PAM sequence: TTC
aaaaaacaccaaaaaaattc

SEQ ID NO: 248300 - DNA, 20 bp, Artificial Sequence
  Description of Artificial Sequence: Synthetic oligonucleotide
  Target: ATXN1; (+) strand; PAM type: YTN; PAM sequence: TTC
tggagatctagattgggaaa

SEQ ID NO: 248301 - DNA, 20 bp, Artificial Sequence
  Description of Artificial Sequence: Synthetic oligonucleotide
  Target: ATXN1; (+) strand; PAM type: YTN; PAM sequence: CTG
gagatctagattgggaaagc

SEQ ID NO: 248302 - DNA, 20 bp, Artificial Sequence
  Description of Artificial Sequence: Synthetic oligonucleotide
  Target: ATXN1; (+) strand; PAM type: YTN; PAM sequence: CTA
gattgggaaagcaggggtca

SEQ ID NO: 248303 - DNA, 20 bp, Artificial Sequence
  Description of Artificial Sequence: Synthetic oligonucleotide
  Target: ATXN1; (+) strand; PAM type: YTN; PAM sequence: TTG
ggaaagcaggggtcatataa

SEQ ID NO: 248304 - DNA, 20 bp, Artificial Sequence
  Description of Artificial Sequence: Synthetic oligonucleotide
  Target: ATXN1; (+) strand; PAM type: YTN; PAM sequence: CTA
atatggaggactgtggtgac

SEQ ID NO: 248305 - DNA, 20 bp, Artificial Sequence
  Description of Artificial Sequence: Synthetic oligonucleotide
  Target: ATXN1; (+) strand; PAM type: YTN; PAM sequence: CTG
tggtgacaatcagaccataa

SEQ ID NO: 248306 - DNA, 20 bp, Artificial Sequence
  Description of Artificial Sequence: Synthetic oligonucleotide
  Target: ATXN1; (+) strand; PAM type: YTN; PAM sequence: CTC
tttatattcttttcaccaac

SEQ ID NO: 248307 - DNA, 20 bp, Artificial Sequence
  Description of Artificial Sequence: Synthetic oligonucleotide
  Target: ATXN1; (+) strand; PAM type: YTN; PAM sequence: CTT
tatattcttttcaccaacag

SEQ ID NO: 248308 - DNA, 20 bp, Artificial Sequence
  Description of Artificial Sequence: Synthetic oligonucleotide
  Target: ATXN1; (+) strand; PAM type: YTN; PAM sequence: TTT
atattcttttcaccaacagt

SEQ ID NO: 248309 - DNA, 20 bp, Artificial Sequence
  Description of Artificial Sequence: Synthetic oligonucleotide
  Target: ATXN1; (+) strand; PAM type: YTN; PAM sequence: TTA
tattcttttcaccaacagtc

SEQ ID NO: 248310 - DNA, 20 bp, Artificial Sequence
  Description of Artificial Sequence: Synthetic oligonucleotide
  Target: ATXN1; (+) strand; PAM type: YTN; PAM sequence: TTC
ttttcaccaacagtctcaaa

SEQ ID NO: 248311 - DNA, 20 bp, Artificial Sequence
  Description of Artificial Sequence: Synthetic oligonucleotide
  Target: ATXN1; (+) strand; PAM type: YTN; PAM sequence: CTT
ttcaccaacagtctcaaatg

SEQ ID NO: 248312 - DNA, 20 bp, Artificial Sequence
  Description of Artificial Sequence: Synthetic oligonucleotide
  Target: ATXN1; (+) strand; PAM type: YTN; PAM sequence: TTT
tcaccaacagtctcaaatgc

SEQ ID NO: 248313 - DNA, 20 bp, Artificial Sequence
  Description of Artificial Sequence: Synthetic oligonucleotide
  Target: ATXN1; (+) strand; PAM type: YTN; PAM sequence: TTT
caccaacagtctcaaatgct

SEQ ID NO: 248314 - DNA, 20 bp, Artificial Sequence
  Description of Artificial Sequence: Synthetic oligonucleotide
  Target: ATXN1; (+) strand; PAM type: YTN; PAM sequence: TTC
accaacagtctcaaatgctg

SEQ ID NO: 248315 - DNA, 20 bp, Artificial Sequence
  Description of Artificial Sequence: Synthetic oligonucleotide
  Target: ATXN1; (+) strand; PAM type: YTN; PAM sequence: CTC
aaatgctggtttcagcataa

SEQ ID NO: 248316 - DNA, 20 bp, Artificial Sequence
  Description of Artificial Sequence: Synthetic oligonucleotide
  Target: ATXN1; (+) strand; PAM type: YTN; PAM sequence: CTG
gtttcagcataaggccaaga

SEQ ID NO: 248317 - DNA, 20 bp, Artificial Sequence
  Description of Artificial Sequence: Synthetic oligonucleotide
  Target: ATXN1; (+) strand; PAM type: YTN; PAM sequence: TTT
cagcataaggccaagaaacc

SEQ ID NO: 248318 - DNA, 20 bp, Artificial Sequence
  Description of Artificial Sequence: Synthetic oligonucleotide
  Target: ATXN1; (+) strand; PAM type: YTN; PAM sequence: TTC
agcataaggccaagaaaccc

SEQ ID NO: 248319 - DNA, 20 bp, Artificial Sequence
  Description of Artificial Sequence: Synthetic oligonucleotide
  Target: ATXN1; (+) strand; PAM type: YTN; PAM sequence: CTA
tatggaatttatgcaaattc

SEQ ID NO: 248320 - DNA, 20 bp, Artificial Sequence
  Description of Artificial Sequence: Synthetic oligonucleotide
  Target: ATXN1; (+) strand; PAM type: YTN; PAM sequence: TTT
atgcaaattccacatcgatt

SEQ ID NO: 248321 - DNA, 20 bp, Artificial Sequence
  Description of Artificial Sequence: Synthetic oligonucleotide
  Target: ATXN1; (+) strand; PAM type: YTN; PAM sequence: TTA
tgcaaattccacatcgattt

SEQ ID NO: 248322 - DNA, 20 bp, Artificial Sequence
  Description of Artificial Sequence: Synthetic oligonucleotide
  Target: ATXN1; (+) strand; PAM type: YTN; PAM sequence: TTC
cacatcgatttatattcatt

SEQ ID NO: 248323 - DNA, 20 bp, Artificial Sequence
  Description of Artificial Sequence: Synthetic oligonucleotide
  Target: ATXN1; (+) strand; PAM type: YTN; PAM sequence: TTT
atattcatttatagttattc

SEQ ID NO: 248324 - DNA, 20 bp, Artificial Sequence
  Description of Artificial Sequence: Synthetic oligonucleotide
  Target: ATXN1; (+) strand; PAM type: YTN; PAM sequence: TTA
tattcatttatagttattcc

SEQ ID NO: 248325 - DNA, 20 bp, Artificial Sequence
  Description of Artificial Sequence: Synthetic oligonucleotide
  Target: ATXN1; (+) strand; PAM type: YTN; PAM sequence: TTC
atttatagttattccattta

SEQ ID NO: 248326 - DNA, 20 bp, Artificial Sequence
  Description of Artificial Sequence: Synthetic oligonucleotide
  Target: ATXN1; (+) strand; PAM type: YTN; PAM sequence: TTT
atagttattccatttataaa

SEQ ID NO: 248327 - DNA, 20 bp, Artificial Sequence
  Description of Artificial Sequence: Synthetic oligonucleotide
  Target: ATXN1; (+) strand; PAM type: YTN; PAM sequence: TTA
tagttattccatttataaaa

SEQ ID NO: 248328 - DNA, 20 bp, Artificial Sequence
  Description of Artificial Sequence: Synthetic oligonucleotide
  Target: ATXN1; (+) strand; PAM type: YTN; PAM sequence: TTA
ttccatttataaaatgcagc

SEQ ID NO: 248329 - DNA, 20 bp, Artificial Sequence
  Description of Artificial Sequence: Synthetic oligonucleotide
  Target: ATXN1; (+) strand; PAM type: YTN; PAM sequence: TTC
catttataaaatgcagctta

SEQ ID NO: 248330 - DNA, 20 bp, Artificial Sequence
  Description of Artificial Sequence: Synthetic oligonucleotide
  Target: ATXN1; (+) strand; PAM type: YTN; PAM sequence: TTT
ataaaatgcagcttatttta

SEQ ID NO: 248331 - DNA, 20 bp, Artificial Sequence
  Description of Artificial Sequence: Synthetic oligonucleotide
  Target: ATXN1; (+) strand; PAM type: YTN; PAM sequence: TTA
taaaatgcagcttattttat

SEQ ID NO: 248332 - DNA, 20 bp, Artificial Sequence
  Description of Artificial Sequence: Synthetic oligonucleotide
  Target: ATXN1; (+) strand; PAM type: YTN; PAM sequence: CTT
attttataggtggcgaaaca

SEQ ID NO: 248333 - DNA, 20 bp, Artificial Sequence
  Description of Artificial Sequence: Synthetic oligonucleotide
  Target: ATXN1; (+) strand; PAM type: YTN; PAM sequence: TTA
ttttataggtggcgaaacag

SEQ ID NO: 248334 - DNA, 20 bp, Artificial Sequence
  Description of Artificial Sequence: Synthetic oligonucleotide
  Target: ATXN1; (+) strand; PAM type: YTN; PAM sequence: TTT
tataggtggcgaaacaggcc

SEQ ID NO: 248335 - DNA, 20 bp, Artificial Sequence
  Description of Artificial Sequence: Synthetic oligonucleotide
  Target: ATXN1; (+) strand; PAM type: YTN; PAM sequence: TTT
ataggtggcgaaacaggcct

SEQ ID NO: 248336 - DNA, 20 bp, Artificial Sequence
  Description of Artificial Sequence: Synthetic oligonucleotide
  Target: ATXN1; (+) strand; PAM type: YTN; PAM sequence: TTA
taggtggcgaaacaggccta

SEQ ID NO: 248337 - DNA, 20 bp, Artificial Sequence
  Description of Artificial Sequence: Synthetic oligonucleotide
  Target: ATXN1; (+) strand; PAM type: YTN; PAM sequence: CTA
gagacaaatatgcactacta

SEQ ID NO: 248338 - DNA, 20 bp, Artificial Sequence
  Description of Artificial Sequence: Synthetic oligonucleotide
  Target: ATXN1; (+) strand; PAM type: YTN; PAM sequence: CTA
ctaaggtcctatgggtttga

SEQ ID NO: 248339 - DNA, 20 bp, Artificial Sequence
  Description of Artificial Sequence: Synthetic oligonucleotide
  Target: ATXN1; (+) strand; PAM type: YTN; PAM sequence: CTA
aggtcctatgggtttgagac

SEQ ID NO: 248340 - DNA, 20 bp, Artificial Sequence
  Description of Artificial Sequence: Synthetic oligonucleotide
  Target: ATXN1; (+) strand; PAM type: YTN; PAM sequence: CTA
tgggtttgagacatttttat

SEQ ID NO: 248341 - DNA, 20 bp, Artificial Sequence
  Description of Artificial Sequence: Synthetic oligonucleotide
  Target: ATXN1; (+) strand; PAM type: YTN; PAM sequence: TTT
gagacatttttatttttatt

SEQ ID NO: 248342 - DNA, 20 bp, Artificial Sequence
  Description of Artificial Sequence: Synthetic oligonucleotide
  Target: ATXN1; (+) strand; PAM type: YTN; PAM sequence: TTG
agacatttttatttttattt

SEQ ID NO: 248343 - DNA, 20 bp, Artificial Sequence
  Description of Artificial Sequence: Synthetic oligonucleotide
  Target: ATXN1; (+) strand; PAM type: YTN; PAM sequence: TTT
ttatttttattttattattt

SEQ ID NO: 248344 - DNA, 20 bp, Artificial Sequence
  Description of Artificial Sequence: Synthetic oligonucleotide
  Target: ATXN1; (+) strand; PAM type: YTN; PAM sequence: TTT
tatttttattttattatttt

SEQ ID NO: 248345 - DNA, 20 bp, Artificial Sequence
  Description of Artificial Sequence: Synthetic oligonucleotide
  Target: ATXN1; (+) strand; PAM type: YTN; PAM sequence: TTT
atttttattttattattttt

SEQ ID NO: 248346 - DNA, 20 bp, Artificial Sequence
  Description of Artificial Sequence: Synthetic oligonucleotide
  Target: ATXN1; (+) strand; PAM type: YTN; PAM sequence: TTA
tttttattttattatttttt

SEQ ID NO: 248347 - DNA, 20 bp, Artificial Sequence
  Description of Artificial Sequence: Synthetic oligonucleotide
  Target: ATXN1; (+) strand; PAM type: YTN; PAM sequence: TTT
ttattttattattttttatt

SEQ ID NO: 248348 - DNA, 20 bp, Artificial Sequence
  Description of Artificial Sequence: Synthetic oligonucleotide
  Target: ATXN1; (+) strand; PAM type: YTN; PAM sequence: TTT
tattttattattttttattt

SEQ ID NO: 248349 - DNA, 20 bp, Artificial Sequence
  Description of Artificial Sequence: Synthetic oligonucleotide
  Target: ATXN1; (+) strand; PAM type: YTN; PAM sequence: TTT
attttattattttttatttt

SEQ ID NO: 248350 - DNA, 20 bp, Artificial Sequence
  Description of Artificial Sequence: Synthetic oligonucleotide
  Target: ATXN1; (+) strand; PAM type: YTN; PAM sequence: TTA
ttttattattttttatttta

SEQ ID NO: 248351 - DNA, 20 bp, Artificial Sequence
  Description of Artificial Sequence: Synthetic oligonucleotide
  Target: ATXN1; (+) strand; PAM type: YTN; PAM sequence: TTT
tattattttttattttattt

SEQ ID NO: 248352 - DNA, 20 bp, Artificial Sequence
  Description of Artificial Sequence: Synthetic oligonucleotide
  Target: ATXN1; (+) strand; PAM type: YTN; PAM sequence: TTT
attattttttattttatttt

SEQ ID NO: 248353 - DNA, 20 bp, Artificial Sequence
  Description of Artificial Sequence: Synthetic oligonucleotide
  Target: ATXN1; (+) strand; PAM type: YTN; PAM sequence: TTA
ttattttttattttatttta

SEQ ID NO: 248354 - DNA, 20 bp, Artificial Sequence
  Description of Artificial Sequence: Synthetic oligonucleotide
  Target: ATXN1; (+) strand; PAM type: YTN; PAM sequence: TTA
ttttttattttattttattt

SEQ ID NO: 248355 - DNA, 20 bp, Artificial Sequence
  Description of Artificial Sequence: Synthetic oligonucleotide
  Target: ATXN1; (+) strand; PAM type: YTN; PAM sequence: TTT
tttattttattttattttat

SEQ ID NO: 248356 - DNA, 20 bp, Artificial Sequence
  Description of Artificial Sequence: Synthetic oligonucleotide
  Target: ATXN1; (+) strand; PAM type: YTN; PAM sequence: TTT
ttattttattttattttatt

SEQ ID NO: 248357 - DNA, 20 bp, Artificial Sequence
  Description of Artificial Sequence: Synthetic oligonucleotide
  Target: ATXN1; (+) strand; PAM type: YTN; PAM sequence: TTT
tattttattttattttattt

SEQ ID NO: 248358 - DNA, 20 bp, Artificial Sequence
  Description of Artificial Sequence: Synthetic oligonucleotide
  Target: ATXN1; (+) strand; PAM type: YTN; PAM sequence: TTT
attttattttattttatttt

SEQ ID NO: 248359 - DNA, 20 bp, Artificial Sequence
  Description of Artificial Sequence: Synthetic oligonucleotide
  Target: ATXN1; (+) strand; PAM type: YTN; PAM sequence: TTA
ttttattttattttatttta

SEQ ID NO: 248360 - DNA, 20 bp, Artificial Sequence
  Description of Artificial Sequence: Synthetic oligonucleotide
  Target: ATXN1; (+) strand; PAM type: YTN; PAM sequence: TTT
tattttattttattttattt

SEQ ID NO: 248361 - DNA, 20 bp, Artificial Sequence
  Description of Artificial Sequence: Synthetic oligonucleotide
  Target: ATXN1; (+) strand; PAM type: YTN; PAM sequence: TTT
attttattttattttattta

SEQ ID NO: 248362 - DNA, 20 bp, Artificial Sequence
  Description of Artificial Sequence: Synthetic oligonucleotide
  Target: ATXN1; (+) strand; PAM type: YTN; PAM sequence: TTA
ttttattttattttatttat

SEQ ID NO: 248363 - DNA, 20 bp, Artificial Sequence
  Description of Artificial Sequence: Synthetic oligonucleotide
  Target: ATXN1; (+) strand; PAM type: YTN; PAM sequence: TTT
tattttattttatttatttt

SEQ ID NO: 248364 - DNA, 20 bp, Artificial Sequence
  Description of Artificial Sequence: Synthetic oligonucleotide
  Target: ATXN1; (+) strand; PAM type: YTN; PAM sequence: TTT
attttattttatttatttta

SEQ ID NO: 248365 - DNA, 20 bp, Artificial Sequence
  Description of Artificial Sequence: Synthetic oligonucleotide
  Target: ATXN1; (+) strand; PAM type: YTN; PAM sequence: TTA
ttttattttatttattttat

SEQ ID NO: 248366 - DNA, 20 bp, Artificial Sequence
  Description of Artificial Sequence: Synthetic oligonucleotide
  Target: ATXN1; (+) strand; PAM type: YTN; PAM sequence: TTT
tattttatttattttatttt

SEQ ID NO: 248367 - DNA, 20 bp, Artificial Sequence
  Description of Artificial Sequence: Synthetic oligonucleotide
  Target: ATXN1; (+) strand; PAM type: YTN; PAM sequence: TTT
attttatttattttatttta

SEQ ID NO: 248368 - DNA, 20 bp, Artificial Sequence
  Description of Artificial Sequence: Synthetic oligonucleotide
  Target: ATXN1; (+) strand; PAM type: YTN; PAM sequence: TTA
ttttatttattttattttat

SEQ ID NO: 248369 - DNA, 20 bp, Artificial Sequence
  Description of Artificial Sequence: Synthetic oligonucleotide
  Target: ATXN1; (+) strand; PAM type: YTN; PAM sequence: TTT
tatttattttattttatttt

SEQ ID NO: 248370 - DNA, 20 bp, Artificial Sequence
  Description of Artificial Sequence: Synthetic oligonucleotide
  Target: ATXN1; (+) strand; PAM type: YTN; PAM sequence: TTT
atttattttattttattttt

SEQ ID NO: 248371 - DNA, 20 bp, Artificial Sequence
  Description of Artificial Sequence: Synthetic oligonucleotide
  Target: ATXN1; (+) strand; PAM type: YTN; PAM sequence: TTA
tttattttattttatttttt

SEQ ID NO: 248372 - DNA, 20 bp, Artificial Sequence
  Description of Artificial Sequence: Synthetic oligonucleotide
  Target: ATXN1; (+) strand; PAM type: YTN; PAM sequence: TTT
attttattttattttttttt

SEQ ID NO: 248373 - DNA, 20 bp, Artificial Sequence
  Description of Artificial Sequence: Synthetic oligonucleotide
  Target: ATXN1; (+) strand; PAM type: YTN; PAM sequence: TTA
ttttattttatttttttttg

SEQ ID NO: 248374 - DNA, 20 bp, Artificial Sequence
  Description of Artificial Sequence: Synthetic oligonucleotide
  Target: ATXN1; (+) strand; PAM type: YTN; PAM sequence: TTT
tattttatttttttttgctt

SEQ ID NO: 248375 - DNA, 20 bp, Artificial Sequence
  Description of Artificial Sequence: Synthetic oligonucleotide
  Target: ATXN1; (+) strand; PAM type: YTN; PAM sequence: TTT
attttatttttttttgcttt

SEQ ID NO: 248376 - DNA, 20 bp, Artificial Sequence
  Description of Artificial Sequence: Synthetic oligonucleotide
  Target: ATXN1; (+) strand; PAM type: YTN; PAM sequence: TTA
ttttatttttttttgctttt

SEQ ID NO: 248377 - DNA, 20 bp, Artificial Sequence
  Description of Artificial Sequence: Synthetic oligonucleotide
  Target: ATXN1; (+) strand; PAM type: YTN; PAM sequence: TTT
tatttttttttgctttttga

SEQ ID NO: 248378 - DNA, 20 bp, Artificial Sequence
  Description of Artificial Sequence: Synthetic oligonucleotide
  Target: ATXN1; (+) strand; PAM type: YTN; PAM sequence: TTT
atttttttttgctttttgag

SEQ ID NO: 248379 - DNA, 20 bp, Artificial Sequence
  Description of Artificial Sequence: Synthetic oligonucleotide
  Target: ATXN1; (+) strand; PAM type: YTN; PAM sequence: TTA
tttttttttgctttttgaga

SEQ ID NO: 248380 - DNA, 20 bp, Artificial Sequence
  Description of Artificial Sequence: Synthetic oligonucleotide
  Target: ATXN1; (+) strand; PAM type: YTN; PAM sequence: TTT
ttttttgctttttgagacgc

SEQ ID NO: 248381 - DNA, 20 bp, Artificial Sequence
  Description of Artificial Sequence: Synthetic oligonucleotide
  Target: ATXN1; (+) strand; PAM type: YTN; PAM sequence: TTT
tttttgctttttgagacgca

SEQ ID NO: 248382 - DNA, 20 bp, Artificial Sequence
  Description of Artificial Sequence: Synthetic oligonucleotide
  Target: ATXN1; (+) strand; PAM type: YTN; PAM sequence: TTT
ttttgctttttgagacgcag

SEQ ID NO: 248383 - DNA, 20 bp, Artificial Sequence
  Description of Artificial Sequence: Synthetic oligonucleotide
  Target: ATXN1; (+) strand; PAM type: YTN; PAM sequence: TTT
tttgctttttgagacgcagt

SEQ ID NO: 248384 - DNA, 20 bp, Artificial Sequence
  Description of Artificial Sequence: Synthetic oligonucleotide
  Target: ATXN1; (+) strand; PAM type: YTN; PAM sequence: TTT
ttgctttttgagacgcagtc

SEQ ID NO: 248385 - DNA, 20 bp, Artificial Sequence
  Description of Artificial Sequence: Synthetic oligonucleotide
  Target: ATXN1; (+) strand; PAM type: YTN; PAM sequence: TTT
tgctttttgagacgcagtct

SEQ ID NO: 248386 - DNA, 20 bp, Artificial Sequence
  Description of Artificial Sequence: Synthetic oligonucleotide
  Target: ATXN1; (+) strand; PAM type: YTN; PAM sequence: TTT
gctttttgagacgcagtctc

SEQ ID NO: 248387 - DNA, 20 bp, Artificial Sequence
  Description of Artificial Sequence: Synthetic oligonucleotide
  Target: ATXN1; (+) strand; PAM type: YTN; PAM sequence: TTG
ctttttgagacgcagtctca

SEQ ID NO: 248388 - DNA, 20 bp, Artificial Sequence
  Description of Artificial Sequence: Synthetic oligonucleotide
  Target: ATXN1; (+) strand; PAM type: YTN; PAM sequence: CTT
tttgagacgcagtctcactc

SEQ ID NO: 248389 - DNA, 20 bp, Artificial Sequence
  Description of Artificial Sequence: Synthetic oligonucleotide
  Target: ATXN1; (+) strand; PAM type: YTN; PAM sequence: TTT
ttgagacgcagtctcactct

SEQ ID NO: 248390 - DNA, 20 bp, Artificial Sequence
  Description of Artificial Sequence: Synthetic oligonucleotide
  Target: ATXN1; (+) strand; PAM type: YTN; PAM sequence: TTT
tgagacgcagtctcactctg

SEQ ID NO: 248391 - DNA, 20 bp, Artificial Sequence
  Description of Artificial Sequence: Synthetic oligonucleotide
  Target: ATXN1; (+) strand; PAM type: YTN; PAM sequence: TTT
gagacgcagtctcactctgt

SEQ ID NO: 248392 - DNA, 20 bp, Artificial Sequence
  Description of Artificial Sequence: Synthetic oligonucleotide
  Target: ATXN1; (+) strand; PAM type: YTN; PAM sequence: TTG
agacgcagtctcactctgtc

SEQ ID NO: 248393 - DNA, 20 bp, Artificial Sequence
  Description of Artificial Sequence: Synthetic oligonucleotide
  Target: ATXN1; (+) strand; PAM type: YTN; PAM sequence: CTC
actctgtcacccaggctgga

SEQ ID NO: 248394 - DNA, 20 bp, Artificial Sequence
  Description of Artificial Sequence: Synthetic oligonucleotide
  Target: ATXN1; (+) strand; PAM type: YTN; PAM sequence: CTC
tgtcacccaggctggagtgc

SEQ ID NO: 248395 - DNA, 20 bp, Artificial Sequence
  Description of Artificial Sequence: Synthetic oligonucleotide
  Target: ATXN1; (+) strand; PAM type: YTN; PAM sequence: CTG
tcacccaggctggagtgcag

SEQ ID NO: 248396 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggcgtgacccc

SEQ ID NO: 248397 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctgcctcccg

SEQ ID NO: 248398 - DNA, 20 bp, Artificial Sequence
  Description of Artificial Sequence: Synthetic oligonucleotide
  Target: ATXN1; (+) strand; PAM type: YTN; PAM sequence: CTG
caacctctgcctcccgggtt

SEQ ID NO: 248399 - DNA, 20 bp, Artificial Sequence
  Description of Artificial Sequence: Synthetic oligonucleotide
  Target: ATXN1; (+) strand; PAM type: YTN; PAM sequence: CTC
tgcctcccgggttcaagcgg

SEQ ID NO: 248400 - DNA, 20 bp, Artificial Sequence
  Description of Artificial Sequence: Synthetic oligonucleotide
  Target: ATXN1; (+) strand; PAM type: YTN; PAM sequence: CTG
cctcccgggttcaagcggtt

SEQ ID NO: 248401 - DNA, 20 bp, Artificial Sequence
  Description of Artificial Sequence: Synthetic oligonucleotide
  Target: ATXN1; (+) strand; PAM type: YTN; PAM sequence: CTC
ccgggttcaagcggttcttc

SEQ ID NO: 248402 - DNA, 20 bp, Artificial Sequence
  Description of Artificial Sequence: Synthetic oligonucleotide
  Target: ATXN1; (+) strand; PAM type: YTN; PAM sequence: TTC
aagcggttcttctgcctcag

SEQ ID NO: 248403 - DNA, 20 bp, Artificial Sequence
  Description of Artificial Sequence: Synthetic oligonucleotide
  Target: ATXN1; (+) strand; PAM type: YTN; PAM sequence: TTC
ttctgcctcagcctcctgag

SEQ ID NO: 248404 - DNA, 20 bp, Artificial Sequence
  Description of Artificial Sequence: Synthetic oligonucleotide
  Target: ATXN1; (+) strand; PAM type: YTN; PAM sequence: CTT
ctgcctcagcctcctgagta

SEQ ID NO: 248405 - DNA, 20 bp, Artificial Sequence
  Description of Artificial Sequence: Synthetic oligonucleotide
  Target: ATXN1; (+) strand; PAM type: YTN; PAM sequence: TTC
tgcctcagcctcctgagtag

SEQ ID NO: 248406 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcctgagtagct

SEQ ID NO: 248407 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagtagctggga

SEQ ID NO: 248408 - DNA, 20 bp, Artificial Sequence
  Description of Artificial Sequence: Synthetic oligonucleotide
  Target: ATXN1; (+) strand; PAM type: YTN; PAM sequence: CTC
ctgagtagctgggactacag

SEQ ID NO: 248409 - DNA, 20 bp, Artificial Sequence
  Description of Artificial Sequence: Synthetic oligonucleotide
  Target: ATXN1; (+) strand; PAM type: YTN; PAM sequence: CTG
agtagctgggactacaggtg

SEQ ID NO: 248410 - DNA, 20 bp, Artificial Sequence
  Description of Artificial Sequence: Synthetic oligonucleotide
  Target: ATXN1; (+) strand; PAM type: YTN; PAM sequence: CTG
ggactacaggtgcccgccac

SEQ ID NO: 248411 - DNA, 20 bp, Artificial Sequence
  Description of Artificial Sequence: Synthetic oligonucleotide
  Target: ATXN1; (+) strand; PAM type: YTN; PAM sequence: CTA
caggtgcccgccaccatgcc

SEQ ID NO: 248412 - DNA, 20 bp, Artificial Sequence
  Description of Artificial Sequence: Synthetic oligonucleotide
  Target: ATXN1; (+) strand; PAM type: YTN; PAM sequence: CTA
atttttgtatttttggtaga

SEQ ID NO: 248413 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttggtagaggcg

SEQ ID NO: 248414 - DNA, 20 bp, Artificial Sequence
  Description of Artificial Sequence: Synthetic oligonucleotide
  Target: ATXN1; (+) strand; PAM type: YTN; PAM sequence: TTT
tgtatttttggtagaggcga

SEQ ID NO: 248415 - DNA, 20 bp, Artificial Sequence
  Description of Artificial Sequence: Synthetic oligonucleotide
  Target: ATXN1; (+) strand; PAM type: YTN; PAM sequence: TTT
gtatttttggtagaggcgag

SEQ ID NO: 248416 - DNA, 20 bp, Artificial Sequence
  Description of Artificial Sequence: Synthetic oligonucleotide
  Target: ATXN1; (+) strand; PAM type: YTN; PAM sequence: TTG
tatttttggtagaggcgaga

SEQ ID NO: 248417 - DNA, 20 bp, Artificial Sequence
  Description of Artificial Sequence: Synthetic oligonucleotide
  Target: ATXN1; (+) strand; PAM type: YTN; PAM sequence: TTT
ttggtagaggcgagatttca

SEQ ID NO: 248418 - DNA, 20 bp, Artificial Sequence
  Description of Artificial Sequence: Synthetic oligonucleotide
  Target: ATXN1; (+) strand; PAM type: YTN; PAM sequence: TTT
tggtagaggcgagatttcac

SEQ ID NO: 248419 - DNA, 20 bp, Artificial Sequence
  Description of Artificial Sequence: Synthetic oligonucleotide
  Target: ATXN1; (+) strand; PAM type: YTN; PAM sequence: TTT
ggtagaggcgagatttcacc

SEQ ID NO: 248420 - DNA, 20 bp, Artificial Sequence
  Description of Artificial Sequence: Synthetic oligonucleotide
  Target: ATXN1; (+) strand; PAM type: YTN; PAM sequence: TTG
gtagaggcgagatttcacca

SEQ ID NO: 248421 - DNA, 20 bp, Artificial Sequence
  Description of Artificial Sequence: Synthetic oligonucleotide
  Target: ATXN1; (+) strand; PAM type: YTN; PAM sequence: TTT
caccatgttggtcaggctgg

SEQ ID NO: 248422 - DNA, 20 bp, Artificial Sequence
  Description of Artificial Sequence: Synthetic oligonucleotide
  Target: ATXN1; (+) strand; PAM type: YTN; PAM sequence: TTC
accatgttggtcaggctggt

SEQ ID NO: 248423 - DNA, 20 bp, Artificial Sequence
  Description of Artificial Sequence: Synthetic oligonucleotide
  Target: ATXN1; (+) strand; PAM type: YTN; PAM sequence: TTG
gtcaggctggtctcaaactc

SEQ ID NO: 248424 - DNA, 20 bp, Artificial Sequence
  Description of Artificial Sequence: Synthetic oligonucleotide
  Target: ATXN1; (+) strand; PAM type: YTN; PAM sequence: CTG
gtctcaaactcctgacctca

SEQ ID NO: 248425 - DNA, 20 bp, Artificial Sequence
  Description of Artificial Sequence: Synthetic oligonucleotide
  Target: ATXN1; (+) strand; PAM type: YTN; PAM sequence: CTC
aaactcctgacctcaaatga

SEQ ID NO: 248426 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaaatgatccacc

SEQ ID NO: 248427 - DNA, 20 bp, Artificial Sequence
  Description of Artificial Sequence: Synthetic oligonucleotide
  Target: ATXN1; (+) strand; PAM type: YTN; PAM sequence: CTG
acctcaaatgatccacccac

SEQ ID NO: 248428 - DNA, 20 bp, Artificial Sequence
  Description of Artificial Sequence: Synthetic oligonucleotide
  Target: ATXN1; (+) strand; PAM type: YTN; PAM sequence: CTC
aaatgatccacccacatcgg

SEQ ID NO: 248429 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 248430 - DNA, 20 bp, Artificial Sequence
  Description of Artificial Sequence: Synthetic oligonucleotide
  Target: ATXN1; (+) strand; PAM type: YTN; PAM sequence: CTG
ggattacaggtgtgagccac

SEQ ID NO: 248431 - DNA, 20 bp, Artificial Sequence
  Description of Artificial Sequence: Synthetic oligonucleotide
  Target: ATXN1; (+) strand; PAM type: YTN; PAM sequence: TTA
caggtgtgagccaccatgcc

SEQ ID NO: 248432 - DNA, 20 bp, Artificial Sequence
  Description of Artificial Sequence: Synthetic oligonucleotide
  Target: ATXN1; (+) strand; PAM type: YTN; PAM sequence: CTG
gccaagacattttaattaaa

SEQ ID NO: 248433 - DNA, 20 bp, Artificial Sequence
  Description of Artificial Sequence: Synthetic oligonucleotide
  Target: ATXN1; (+) strand; PAM type: YTN; PAM sequence: TTT
taattaaatgcttaaccgag

SEQ ID NO: 248434 - DNA, 20 bp, Artificial Sequence
  Description of Artificial Sequence: Synthetic oligonucleotide
  Target: ATXN1; (+) strand; PAM type: YTN; PAM sequence: TTT
aattaaatgcttaaccgagt

SEQ ID NO: 248435 - DNA, 20 bp, Artificial Sequence
  Description of Artificial Sequence: Synthetic oligonucleotide
  Target: ATXN1; (+) strand; PAM type: YTN; PAM sequence: TTA
attaaatgcttaaccgagtc

SEQ ID NO: 248436 - DNA, 20 bp, Artificial Sequence
  Description of Artificial Sequence: Synthetic oligonucleotide
  Target: ATXN1; (+) strand; PAM type: YTN; PAM sequence: TTA
aatgcttaaccgagtccaga

SEQ ID NO: 248437 - DNA, 20 bp, Artificial Sequence
  Description of Artificial Sequence: Synthetic oligonucleotide
  Target: ATXN1; (+) strand; PAM type: YTN; PAM sequence: CTT
aaccgagtccagaatttgat

SEQ ID NO: 248438 - DNA, 20 bp, Artificial Sequence
  Description of Artificial Sequence: Synthetic oligonucleotide
  Target: ATXN1; (+) strand; PAM type: YTN; PAM sequence: TTA
accgagtccagaatttgatc

SEQ ID NO: 248439 - DNA, 20 bp, Artificial Sequence
  Description of Artificial Sequence: Synthetic oligonucleotide
  Target: ATXN1; (+) strand; PAM type: YTN; PAM sequence: TTT
gatctttctaactccacatc

SEQ ID NO: 248440 - DNA, 20 bp, Artificial Sequence
  Description of Artificial Sequence: Synthetic oligonucleotide
  Target: ATXN1; (+) strand; PAM type: YTN; PAM sequence: TTG
atctttctaactccacatcc

SEQ ID NO: 248441 - DNA, 20 bp, Artificial Sequence
  Description of Artificial Sequence: Synthetic oligonucleotide
  Target: ATXN1; (+) strand; PAM type: YTN; PAM sequence: CTT
tctaactccacatccattac

SEQ ID NO: 248442 - DNA, 20 bp, Artificial Sequence
  Description of Artificial Sequence: Synthetic oligonucleotide
  Target: ATXN1; (+) strand; PAM type: YTN; PAM sequence: TTT
ctaactccacatccattaca

SEQ ID NO: 248443 - DNA, 20 bp, Artificial Sequence
  Description of Artificial Sequence: Synthetic oligonucleotide
  Target: ATXN1; (+) strand; PAM type: YTN; PAM sequence: TTC
taactccacatccattacac

SEQ ID NO: 248444 - DNA, 20 bp, Artificial Sequence
  Description of Artificial Sequence: Synthetic oligonucleotide
  Target: ATXN1; (+) strand; PAM type: YTN; PAM sequence: CTA
actccacatccattacactt

SEQ ID NO: 248445 - DNA, 20 bp, Artificial Sequence
  Description of Artificial Sequence: Synthetic oligonucleotide
  Target: ATXN1; (+) strand; PAM type: YTN; PAM sequence: CTC
cacatccattacactttcca

SEQ ID NO: 248446 - DNA, 20 bp, Artificial Sequence
  Description of Artificial Sequence: Synthetic oligonucleotide
  Target: ATXN1; (+) strand; PAM type: YTN; PAM sequence: TTA
cactttccactctacaccat

SEQ ID NO: 248447 - DNA, 20 bp, Artificial Sequence
  Description of Artificial Sequence: Synthetic oligonucleotide
  Target: ATXN1; (+) strand; PAM type: YTN; PAM sequence: CTT
tccactctacaccatggctc

SEQ ID NO: 248448 - DNA, 20 bp, Artificial Sequence
  Description of Artificial Sequence: Synthetic oligonucleotide
  Target: ATXN1; (+) strand; PAM type: YTN; PAM sequence: TTT
ccactctacaccatggctcc

SEQ ID NO: 248449 - DNA, 20 bp, Artificial Sequence
  Description of Artificial Sequence: Synthetic oligonucleotide
  Target: ATXN1; (+) strand; PAM type: YTN; PAM sequence: TTC
cactctacaccatggctccc

SEQ ID NO: 248450 - DNA, 20 bp, Artificial Sequence
  Description of Artificial Sequence: Synthetic oligonucleotide
  Target: ATXN1; (+) strand; PAM type: YTN; PAM sequence: CTC
tacaccatggctccccgtgc

SEQ ID NO: 248451 - DNA, 20 bp, Artificial Sequence
  Description of Artificial Sequence: Synthetic oligonucleotide
  Target: ATXN1; (+) strand; PAM type: YTN; PAM sequence: CTA
caccatggctccccgtgcag

SEQ ID NO: 248452 - DNA, 20 bp, Artificial Sequence
  Description of Artificial Sequence: Synthetic oligonucleotide
  Target: ATXN1; (+) strand; PAM type: YTN; PAM sequence: CTC
cccgtgcagaagactgcaat

SEQ ID NO: 248453 - DNA, 20 bp, Artificial Sequence
  Description of Artificial Sequence: Synthetic oligonucleotide
  Target: ATXN1; (+) strand; PAM type: YTN; PAM sequence: CTG
caatccaatcagctcagttc

SEQ ID NO: 248454 - DNA, 20 bp, Artificial Sequence
  Description of Artificial Sequence: Synthetic oligonucleotide
  Target: ATXN1; (+) strand; PAM type: YTN; PAM sequence: CTC
agttcccagagggtctagac

SEQ ID NO: 248455 - DNA, 20 bp, Artificial Sequence
  Description of Artificial Sequence: Synthetic oligonucleotide
  Target: ATXN1; (+) strand; PAM type: YTN; PAM sequence: TTC
ccagagggtctagactcagg

SEQ ID NO: 248456 - DNA, 20 bp, Artificial Sequence
  Description of Artificial Sequence: Synthetic oligonucleotide
  Target: ATXN1; (+) strand; PAM type: YTN; PAM sequence: CTA
gactcaggtagcgacaataa

SEQ ID NO: 248457 - DNA, 20 bp, Artificial Sequence
  Description of Artificial Sequence: Synthetic oligonucleotide
  Target: ATXN1; (+) strand; PAM type: YTN; PAM sequence: CTC
aggtagcgacaataaacatg

SEQ ID NO: 248458 - DNA, 20 bp, Artificial Sequence
  Description of Artificial Sequence: Synthetic oligonucleotide
  Target: ATXN1; (+) strand; PAM type: YTN; PAM sequence: TTG
gcaaggctcgaggaatgatt

SEQ ID NO: 248459 - DNA, 20 bp, Artificial Sequence
  Description of Artificial Sequence: Synthetic oligonucleotide
  Target: ATXN1; (+) strand; PAM type: YTN; PAM sequence: CTC
gaggaatgattgatggaagc

SEQ ID NO: 248460 - DNA, 20 bp, Artificial Sequence
  Description of Artificial Sequence: Synthetic oligonucleotide
  Target: ATXN1; (+) strand; PAM type: YTN; PAM sequence: TTG
atggaagctgggttgaacca

SEQ ID NO: 248461 - DNA, 20 bp, Artificial Sequence
  Description of Artificial Sequence: Synthetic oligonucleotide
  Target: ATXN1; (+) strand; PAM type: YTN; PAM sequence: CTG
ggttgaaccaaaggagtggg

SEQ ID NO: 248462 - DNA, 20 bp, Artificial Sequence
  Description of Artificial Sequence: Synthetic oligonucleotide
  Target: ATXN1; (+) strand; PAM type: YTN; PAM sequence: TTG
aaccaaaggagtgggagctc

SEQ ID NO: 248463 - DNA, 20 bp, Artificial Sequence
  Description of Artificial Sequence: Synthetic oligonucleotide
  Target: ATXN1; (+) strand; PAM type: YTN; PAM sequence: CTC
tcaggtgggaataggaaagg

SEQ ID NO: 248464 - DNA, 20 bp, Artificial Sequence
  Description of Artificial Sequence: Synthetic oligonucleotide
  Target: ATXN1; (+) strand; PAM type: YTN; PAM sequence: CTC
aggtgggaataggaaaggta

SEQ ID NO: 248465 - DNA, 20 bp, Artificial Sequence
  Description of Artificial Sequence: Synthetic oligonucleotide
  Target: ATXN1; (+) strand; PAM type: YTN; PAM sequence: CTG
caataagatacacagaatgg

SEQ ID NO: 248466 - DNA, 20 bp, Artificial Sequence
  Description of Artificial Sequence: Synthetic oligonucleotide
  Target: ATXN1; (+) strand; PAM type: YTN; PAM sequence: CTA
agctagaggaggggcagata

SEQ ID NO: 248467 - DNA, 20 bp, Artificial Sequence
  Description of Artificial Sequence: Synthetic oligonucleotide
  Target: ATXN1; (+) strand; PAM type: YTN; PAM sequence: CTA
gaggaggggcagataataaa

SEQ ID NO: 248468 - DNA, 20 bp, Artificial Sequence
  Description of Artificial Sequence: Synthetic oligonucleotide
  Target: ATXN1; (+) strand; PAM type: YTN; PAM sequence: CTC
gttaataaagatagtaagac

SEQ ID NO: 248469 - DNA, 20 bp, Artificial Sequence
  Description of Artificial Sequence: Synthetic oligonucleotide
  Target: ATXN1; (+) strand; PAM type: YTN; PAM sequence: TTA
ataaagatagtaagacccat

SEQ ID NO: 248470 - DNA, 20 bp, Artificial Sequence
  Description of Artificial Sequence: Synthetic oligonucleotide
  Target: ATXN1; (+) strand; PAM type: YTN; PAM sequence: TTT
agctttacgtggctctaaga

SEQ ID NO: 248471 - DNA, 20 bp, Artificial Sequence
  Description of Artificial Sequence: Synthetic oligonucleotide
  Target: ATXN1; (+) strand; PAM type: YTN; PAM sequence: TTA
gctttacgtggctctaagat

SEQ ID NO: 248472 - DNA, 20 bp, Artificial Sequence
  Description of Artificial Sequence: Synthetic oligonucleotide
  Target: ATXN1; (+) strand; PAM type: YTN; PAM sequence: CTT
tacgtggctctaagataaac

SEQ ID NO: 248473 - DNA, 20 bp, Artificial Sequence
  Description of Artificial Sequence: Synthetic oligonucleotide
  Target: ATXN1; (+) strand; PAM type: YTN; PAM sequence: TTT
acgtggctctaagataaaca

SEQ ID NO: 248474 - DNA, 20 bp, Artificial Sequence
  Description of Artificial Sequence: Synthetic oligonucleotide
  Target: ATXN1; (+) strand; PAM type: YTN; PAM sequence: TTA
cgtggctctaagataaacat

SEQ ID NO: 248475 - DNA, 20 bp, Artificial Sequence
  Description of Artificial Sequence: Synthetic oligonucleotide
  Target: ATXN1; (+) strand; PAM type: YTN; PAM sequence: CTC
taagataaacatacaggaac

SEQ ID NO: 248476 - DNA, 20 bp, Artificial Sequence
  Description of Artificial Sequence: Synthetic oligonucleotide
  Target: ATXN1; (+) strand; PAM type: YTN; PAM sequence: CTA
agataaacatacaggaactc

SEQ ID NO: 248477 - DNA, 20 bp, Artificial Sequence
  Description of Artificial Sequence: Synthetic oligonucleotide
  Target: ATXN1; (+) strand; PAM type: YTN; PAM sequence: CTC
tcctgaaaggaccaagagta

SEQ ID NO: 248478 - DNA, 20 bp, Artificial Sequence
  Description of Artificial Sequence: Synthetic oligonucleotide
  Target: ATXN1; (+) strand; PAM type: YTN; PAM sequence: CTC
ctgaaaggaccaagagtagg

SEQ ID NO: 248479 - DNA, 20 bp, Artificial Sequence
  Description of Artificial Sequence: Synthetic oligonucleotide
  Target: ATXN1; (+) strand; PAM type: YTN; PAM sequence: CTG
aaaggaccaagagtaggtaa

SEQ ID NO: 248480 - DNA, 20 bp, Artificial Sequence
  Description of Artificial Sequence: Synthetic oligonucleotide
  Target: ATXN1; (+) strand; PAM type: YTN; PAM sequence: CTG
acactgggagaaatatccaa

SEQ ID NO: 248481 - DNA, 20 bp, Artificial Sequence
  Description of Artificial Sequence: Synthetic oligonucleotide
  Target: ATXN1; (+) strand; PAM type: YTN; PAM sequence: CTG
ggagaaatatccaagaaagg

SEQ ID NO: 248482 - DNA, 20 bp, Artificial Sequence
  Description of Artificial Sequence: Synthetic oligonucleotide
  Target: ATXN1; (+) strand; PAM type: YTN; PAM sequence: CTA
ccataattttggttagagag

SEQ ID NO: 248483 - DNA, 20 bp, Artificial Sequence
  Description of Artificial Sequence: Synthetic oligonucleotide
  Target: ATXN1; (+) strand; PAM type: YTN; PAM sequence: TTT
tggttagagagaggaaaagt

SEQ ID NO: 248484 - DNA, 20 bp, Artificial Sequence
  Description of Artificial Sequence: Synthetic oligonucleotide
  Target: ATXN1; (+) strand; PAM type: YTN; PAM sequence: TTT
ggttagagagaggaaaagta

SEQ ID NO: 248485 - DNA, 20 bp, Artificial Sequence
  Description of Artificial Sequence: Synthetic oligonucleotide
  Target: ATXN1; (+) strand; PAM type: YTN; PAM sequence: TTG
gttagagagaggaaaagtag

SEQ ID NO: 248486 - DNA, 20 bp, Artificial Sequence
  Description of Artificial Sequence: Synthetic oligonucleotide
  Target: ATXN1; (+) strand; PAM type: YTN; PAM sequence: TTA
gagagaggaaaagtagtcaa

SEQ ID NO: 248487 - DNA, 20 bp, Artificial Sequence
  Description of Artificial Sequence: Synthetic oligonucleotide
  Target: ATXN1; (+) strand; PAM type: YTN; PAM sequence: TTG
atggggatgtggtgaaacgg

SEQ ID NO: 248488 - DNA, 20 bp, Artificial Sequence
  Description of Artificial Sequence: Synthetic oligonucleotide
  Target: ATXN1; (+) strand; PAM type: YTN; PAM sequence: CTT
ttacattgctggtgggaatg

SEQ ID NO: 248489 - DNA, 20 bp, Artificial Sequence
  Description of Artificial Sequence: Synthetic oligonucleotide
  Target: ATXN1; (+) strand; PAM type: YTN; PAM sequence: TTT
tacattgctggtgggaatgt

SEQ ID NO: 248490 - DNA, 20 bp, Artificial Sequence
  Description of Artificial Sequence: Synthetic oligonucleotide
  Target: ATXN1; (+) strand; PAM type: YTN; PAM sequence: TTT
acattgctggtgggaatgta

SEQ ID NO: 248491 - DNA, 20 bp, Artificial Sequence
  Description of Artificial Sequence: Synthetic oligonucleotide
  Target: ATXN1; (+) strand; PAM type: YTN; PAM sequence: TTA
cattgctggtgggaatgtag

SEQ ID NO: 248492 - DNA, 20 bp, Artificial Sequence
  Description of Artificial Sequence: Synthetic oligonucleotide
  Target: ATXN1; (+) strand; PAM type: YTN; PAM sequence: TTG
ctggtgggaatgtagactaa

SEQ ID NO: 248493 - DNA, 20 bp, Artificial Sequence
  Description of Artificial Sequence: Synthetic oligonucleotide
  Target: ATXN1; (+) strand; PAM type: YTN; PAM sequence: CTG
gtgggaatgtagactaatac

SEQ ID NO: 248494 - DNA, 20 bp, Artificial Sequence
  Description of Artificial Sequence: Synthetic oligonucleotide
  Target: ATXN1; (+) strand; PAM type: YTN; PAM sequence: CTA
atacaaccactatggaaaac

SEQ ID NO: 248495 - DNA, 20 bp, Artificial Sequence
  Description of Artificial Sequence: Synthetic oligonucleotide
  Target: ATXN1; (+) strand; PAM type: YTN; PAM sequence: CTA
tggaaaacagtgtggagatt

SEQ ID NO: 248496 - DNA, 20 bp, Artificial Sequence
  Description of Artificial Sequence: Synthetic oligonucleotide
  Target: ATXN1; (+) strand; PAM type: YTN; PAM sequence: TTC
cttaaagaacttaaagtaga

SEQ ID NO: 248497 - DNA, 20 bp, Artificial Sequence
  Description of Artificial Sequence: Synthetic oligonucleotide
  Target: ATXN1; (+) strand; PAM type: YTN; PAM sequence: CTT
aaagaacttaaagtagaact

SEQ ID NO: 248498 - DNA, 20 bp, Artificial Sequence
  Description of Artificial Sequence: Synthetic oligonucleotide
  Target: ATXN1; (+) strand; PAM type: YTN; PAM sequence: TTA
aagaacttaaagtagaacta

SEQ ID NO: 248499 - DNA, 20 bp, Artificial Sequence
  Description of Artificial Sequence: Synthetic oligonucleotide
  Target: ATXN1; (+) strand; PAM type: YTN; PAM sequence: CTT
aaagtagaactaccatttga

SEQ ID NO: 248500 - DNA, 20 bp, Artificial Sequence
  Description of Artificial Sequence: Synthetic oligonucleotide
  Target: ATXN1; (+) strand; PAM type: YTN; PAM sequence: TTA
aagtagaactaccatttgat

SEQ ID NO: 248501 - DNA, 20 bp, Artificial Sequence
  Description of Artificial Sequence: Synthetic oligonucleotide
  Target: ATXN1; (+) strand; PAM type: YTN; PAM sequence: CTA
ccatttgatccaacaatccc

SEQ ID NO: 248502 - DNA, 20 bp, Artificial Sequence
  Description of Artificial Sequence: Synthetic oligonucleotide
  Target: ATXN1; (+) strand; PAM type: YTN; PAM sequence: TTT
gatccaacaatcccactact

SEQ ID NO: 248503 - DNA, 20 bp, Artificial Sequence
  Description of Artificial Sequence: Synthetic oligonucleotide
  Target: ATXN1; (+) strand; PAM type: YTN; PAM sequence: TTG
atccaacaatcccactactg

SEQ ID NO: 248504 - DNA, 20 bp, Artificial Sequence
  Description of Artificial Sequence: Synthetic oligonucleotide
  Target: ATXN1; (+) strand; PAM type: YTN; PAM sequence: CTA
ctgggtatctacccagagga

SEQ ID NO: 248505 - DNA, 20 bp, Artificial Sequence
  Description of Artificial Sequence: Synthetic oligonucleotide
  Target: ATXN1; (+) strand; PAM type: YTN; PAM sequence: CTG
ggtatctacccagaggagac

SEQ ID NO: 248506 - DNA, 20 bp, Artificial Sequence
  Description of Artificial Sequence: Synthetic oligonucleotide
  Target: ATXN1; (+) strand; PAM type: YTN; PAM sequence: CTA
cccagaggagacgtcttatg

SEQ ID NO: 248507 - DNA, 20 bp, Artificial Sequence
  Description of Artificial Sequence: Synthetic oligonucleotide
  Target: ATXN1; (+) strand; PAM type: YTN; PAM sequence: CTT
atgaaaaagatacttgcaca

SEQ ID NO: 248508 - DNA, 20 bp, Artificial Sequence
  Description of Artificial Sequence: Synthetic oligonucleotide
  Target: ATXN1; (+) strand; PAM type: YTN; PAM sequence: TTA
tgaaaaagatacttgcacat

SEQ ID NO: 248509 - DNA, 20 bp, Artificial Sequence
  Description of Artificial Sequence: Synthetic oligonucleotide
  Target: ATXN1; (+) strand; PAM type: YTN; PAM sequence: CTT
gcacatgcatgtttacagca

SEQ ID NO: 248510 - DNA, 20 bp, Artificial Sequence
  Description of Artificial Sequence: Synthetic oligonucleotide
  Target: ATXN1; (+) strand; PAM type: YTN; PAM sequence: TTG
cacatgcatgtttacagcag

SEQ ID NO: 248511 - DNA, 20 bp, Artificial Sequence
  Description of Artificial Sequence: Synthetic oligonucleotide
  Target: ATXN1; (+) strand; PAM type: YTN; PAM sequence: TTT
acagcagcacaattcgcaat

SEQ ID NO: 248512 - DNA, 20 bp, Artificial Sequence
  Description of Artificial Sequence: Synthetic oligonucleotide
  Target: ATXN1; (+) strand; PAM type: YTN; PAM sequence: TTA
cagcagcacaattcgcaatt

SEQ ID NO: 248513 - DNA, 20 bp, Artificial Sequence
  Description of Artificial Sequence: Synthetic oligonucleotide
  Target: ATXN1; (+) strand; PAM type: YTN; PAM sequence: TTC
gcaattgcagaaatatggaa

SEQ ID NO: 248514 - DNA, 20 bp, Artificial Sequence
  Description of Artificial Sequence: Synthetic oligonucleotide
  Target: ATXN1; (+) strand; PAM type: YTN; PAM sequence: TTG
cagaaatatggaaccagccc

SEQ ID NO: 248515 - DNA, 20 bp, Artificial Sequence
  Description of Artificial Sequence: Synthetic oligonucleotide
  Target: ATXN1; (+) strand; PAM type: YTN; PAM sequence: TTA
ttgtatgtatatatcacaga

SEQ ID NO: 248516 - DNA, 20 bp, Artificial Sequence
  Description of Artificial Sequence: Synthetic oligonucleotide
  Target: ATXN1; (+) strand; PAM type: YTN; PAM sequence: TTG
tatgtatatatcacagaata

SEQ ID NO: 248517 - DNA, 20 bp, Artificial Sequence
  Description of Artificial Sequence: Synthetic oligonucleotide
  Target: ATXN1; (+) strand; PAM type: YTN; PAM sequence: CTA
ctcagccataaaaaggaaca

SEQ ID NO: 248518 - DNA, 20 bp, Artificial Sequence
  Description of Artificial Sequence: Synthetic oligonucleotide
  Target: ATXN1; (+) strand; PAM type: YTN; PAM sequence: CTC
agccataaaaaggaacaaaa

SEQ ID NO: 248519 - DNA, 20 bp, Artificial Sequence
  Description of Artificial Sequence: Synthetic oligonucleotide
  Target: ATXN1; (+) strand; PAM type: YTN; PAM sequence: TTC
acagcaacctgtttggaact

SEQ ID NO: 248520 - DNA, 20 bp, Artificial Sequence
  Description of Artificial Sequence: Synthetic oligonucleotide
  Target: ATXN1; (+) strand; PAM type: YTN; PAM sequence: CTG
tttggaactggataccatta

SEQ ID NO: 248521 - DNA, 20 bp, Artificial Sequence
  Description of Artificial Sequence: Synthetic oligonucleotide
  Target: ATXN1; (+) strand; PAM type: YTN; PAM sequence: TTT
ggaactggataccattattc

SEQ ID NO: 248522 - DNA, 20 bp, Artificial Sequence
  Description of Artificial Sequence: Synthetic oligonucleotide
  Target: ATXN1; (+) strand; PAM type: YTN; PAM sequence: TTG
gaactggataccattattct

SEQ ID NO: 248523 - DNA, 20 bp, Artificial Sequence
  Description of Artificial Sequence: Synthetic oligonucleotide
  Target: ATXN1; (+) strand; PAM type: YTN; PAM sequence: CTG
gataccattattctaagtga

SEQ ID NO: 248524 - DNA, 20 bp, Artificial Sequence
  Description of Artificial Sequence: Synthetic oligonucleotide
  Target: ATXN1; (+) strand; PAM type: YTN; PAM sequence: TTA
ttctaagtgaagtaactcag

SEQ ID NO: 248525 - DNA, 20 bp, Artificial Sequence
  Description of Artificial Sequence: Synthetic oligonucleotide
  Target: ATXN1; (+) strand; PAM type: YTN; PAM sequence: TTC
taagtgaagtaactcaggaa

SEQ ID NO: 248526 - DNA, 20 bp, Artificial Sequence
  Description of Artificial Sequence: Synthetic oligonucleotide
  Target: ATXN1; (+) strand; PAM type: YTN; PAM sequence: CTA
agtgaagtaactcaggaatg

SEQ ID NO: 248527 - DNA, 20 bp, Artificial Sequence
  Description of Artificial Sequence: Synthetic oligonucleotide
  Target: ATXN1; (+) strand; PAM type: YTN; PAM sequence: CTC
aggaatggaaaactgaacac

SEQ ID NO: 248528 - DNA, 20 bp, Artificial Sequence
  Description of Artificial Sequence: Synthetic oligonucleotide
  Target: ATXN1; (+) strand; PAM type: YTN; PAM sequence: CTG
aacaccgtaatgatggcagt

SEQ ID NO: 248529 - DNA, 20 bp, Artificial Sequence
  Description of Artificial Sequence: Synthetic oligonucleotide
  Target: ATXN1; (+) strand; PAM type: YTN; PAM sequence: CTG
ctgccatcaagctggctgcg

SEQ ID NO: 248530 - DNA, 20 bp, Artificial Sequence
  Description of Artificial Sequence: Synthetic oligonucleotide
  Target: ATXN1; (+) strand; PAM type: YTN; PAM sequence: CTG
ccatcaagctggctgcgcgg

SEQ ID NO: 248531 - DNA, 20 bp, Artificial Sequence
  Description of Artificial Sequence: Synthetic oligonucleotide
  Target: ATXN1; (+) strand; PAM type: YTN; PAM sequence: CTG
gctgcgcggctggtgctgca

SEQ ID NO: 248532 - DNA, 20 bp, Artificial Sequence
  Description of Artificial Sequence: Synthetic oligonucleotide
  Target: ATXN1; (+) strand; PAM type: YTN; PAM sequence: CTG
cgcggctggtgctgcatact

SEQ ID NO: 248533 - DNA, 20 bp, Artificial Sequence
  Description of Artificial Sequence: Synthetic oligonucleotide
  Target: ATXN1; (+) strand; PAM type: YTN; PAM sequence: CTG
gtgctgcatactccatggag

SEQ ID NO: 248534 - DNA, 20 bp, Artificial Sequence
  Description of Artificial Sequence: Synthetic oligonucleotide
  Target: ATXN1; (+) strand; PAM type: YTN; PAM sequence: CTG
catactccatggagctggtg

SEQ ID NO: 248535 - DNA, 20 bp, Artificial Sequence
  Description of Artificial Sequence: Synthetic oligonucleotide
  Target: ATXN1; (+) strand; PAM type: YTN; PAM sequence: CTC
catggagctggtggcagccc

SEQ ID NO: 248536 - DNA, 20 bp, Artificial Sequence
  Description of Artificial Sequence: Synthetic oligonucleotide
  Target: ATXN1; (+) strand; PAM type: YTN; PAM sequence: CTG
gtggcagccctgttcattcc

SEQ ID NO: 248537 - DNA, 20 bp, Artificial Sequence
  Description of Artificial Sequence: Synthetic oligonucleotide
  Target: ATXN1; (+) strand; PAM type: YTN; PAM sequence: CTG
ttcattccgagttgggatgg

SEQ ID NO: 248538 - DNA, 20 bp, Artificial Sequence
  Description of Artificial Sequence: Synthetic oligonucleotide
  Target: ATXN1; (+) strand; PAM type: YTN; PAM sequence: TTC
attccgagttgggatgggag

SEQ ID NO: 248539 - DNA, 20 bp, Artificial Sequence
  Description of Artificial Sequence: Synthetic oligonucleotide
  Target: ATXN1; (+) strand; PAM type: YTN; PAM sequence: TTC
cgagttgggatgggagctcc

SEQ ID NO: 248540 - DNA, 20 bp, Artificial Sequence
  Description of Artificial Sequence: Synthetic oligonucleotide
  Target: ATXN1; (+) strand; PAM type: YTN; PAM sequence: TTG
ggatgggagctccgcgtgcc

SEQ ID NO: 248541 - DNA, 20 bp, Artificial Sequence
  Description of Artificial Sequence: Synthetic oligonucleotide
  Target: ATXN1; (+) strand; PAM type: YTN; PAM sequence: CTC
cgcgtgccactgcagccacc

SEQ ID NO: 248542 - DNA, 20 bp, Artificial Sequence
  Description of Artificial Sequence: Synthetic oligonucleotide
  Target: ATXN1; (+) strand; PAM type: YTN; PAM sequence: CTG
cagccacctgaactgcagct

SEQ ID NO: 248543 - DNA, 20 bp, Artificial Sequence
  Description of Artificial Sequence: Synthetic oligonucleotide
  Target: ATXN1; (+) strand; PAM type: YTN; PAM sequence: CTG
aactgcagctgcagacccag

SEQ ID NO: 248544 - DNA, 20 bp, Artificial Sequence
  Description of Artificial Sequence: Synthetic oligonucleotide
  Target: ATXN1; (+) strand; PAM type: YTN; PAM sequence: CTG
cagctgcagacccaggcctc

SEQ ID NO: 248545 - DNA, 20 bp, Artificial Sequence
  Description of Artificial Sequence: Synthetic oligonucleotide
  Target: ATXN1; (+) strand; PAM type: YTN; PAM sequence: CTG
cagacccaggcctcctgctc

SEQ ID NO: 248546 - DNA, 20 bp, Artificial Sequence
  Description of Artificial Sequence: Synthetic oligonucleotide
  Target: ATXN1; (+) strand; PAM type: YTN; PAM sequence: CTC
ctgctccacagagcaagcag

SEQ ID NO: 248547 - DNA, 20 bp, Artificial Sequence
  Description of Artificial Sequence: Synthetic oligonucleotide
  Target: ATXN1; (+) strand; PAM type: YTN; PAM sequence: CTG
ctccacagagcaagcaggag

SEQ ID NO: 248548 - DNA, 20 bp, Artificial Sequence
  Description of Artificial Sequence: Synthetic oligonucleotide
  Target: ATXN1; (+) strand; PAM type: YTN; PAM sequence: CTC
cacagagcaagcaggagccc

SEQ ID NO: 248549 - DNA, 20 bp, Artificial Sequence
  Description of Artificial Sequence: Synthetic oligonucleotide
  Target: ATXN1; (+) strand; PAM type: YTN; PAM sequence: CTC
ttggggccacagccacccaa

SEQ ID NO: 248550 - DNA, 20 bp, Artificial Sequence
  Description of Artificial Sequence: Synthetic oligonucleotide
  Target: ATXN1; (+) strand; PAM type: YTN; PAM sequence: CTT
ggggccacagccacccaaac

SEQ ID NO: 248551 - DNA, 20 bp, Artificial Sequence
  Description of Artificial Sequence: Synthetic oligonucleotide
  Target: ATXN1; (+) strand; PAM type: YTN; PAM sequence: TTG
gggccacagccacccaaact

SEQ ID NO: 248552 - DNA, 20 bp, Artificial Sequence
  Description of Artificial Sequence: Synthetic oligonucleotide
  Target: ATXN1; (+) strand; PAM type: YTN; PAM sequence: CTG
cagctgtagatccgagtctc

SEQ ID NO: 248553 - DNA, 20 bp, Artificial Sequence
  Description of Artificial Sequence: Synthetic oligonucleotide
  Target: ATXN1; (+) strand; PAM type: YTN; PAM sequence: CTG
tagatccgagtctccctgtg

SEQ ID NO: 248554 - DNA, 20 bp, Artificial Sequence
  Description of Artificial Sequence: Synthetic oligonucleotide
  Target: ATXN1; (+) strand; PAM type: YTN; PAM sequence: CTC
cctgtgctcttgggggagcc

SEQ ID NO: 248555 - DNA, 20 bp, Artificial Sequence
  Description of Artificial Sequence: Synthetic oligonucleotide
  Target: ATXN1; (+) strand; PAM type: YTN; PAM sequence: CTG
tgctcttgggggagcctgga

SEQ ID NO: 248556 - DNA, 20 bp, Artificial Sequence
  Description of Artificial Sequence: Synthetic oligonucleotide
  Target: ATXN1; (+) strand; PAM type: YTN; PAM sequence: CTC
ttgggggagcctggaacagg

SEQ ID NO: 248557 - DNA, 20 bp, Artificial Sequence
  Description of Artificial Sequence: Synthetic oligonucleotide
  Target: ATXN1; (+) strand; PAM type: YTN; PAM sequence: CTT
gggggagcctggaacaggca

SEQ ID NO: 248558 - DNA, 20 bp, Artificial Sequence
  Description of Artificial Sequence: Synthetic oligonucleotide
  Target: ATXN1; (+) strand; PAM type: YTN; PAM sequence: TTG
ggggagcctggaacaggcag

SEQ ID NO: 248559 - DNA, 20 bp, Artificial Sequence
  Description of Artificial Sequence: Synthetic oligonucleotide
  Target: ATXN1; (+) strand; PAM type: YTN; PAM sequence: CTG
gaacaggcaggatctgcctt

SEQ ID NO: 248560 - DNA, 20 bp, Artificial Sequence
  Description of Artificial Sequence: Synthetic oligonucleotide
  Target: ATXN1; (+) strand; PAM type: YTN; PAM sequence: CTG
ccttcccaggtgcagctgca

SEQ ID NO: 248561 - DNA, 20 bp, Artificial Sequence
  Description of Artificial Sequence: Synthetic oligonucleotide
  Target: ATXN1; (+) strand; PAM type: YTN; PAM sequence: CTT
cccaggtgcagctgcagctg

SEQ ID NO: 248562 - DNA, 20 bp, Artificial Sequence
  Description of Artificial Sequence: Synthetic oligonucleotide
  Target: ATXN1; (+) strand; PAM type: YTN; PAM sequence: TTC
ccaggtgcagctgcagctgc

SEQ ID NO: 248563 - DNA, 20 bp, Artificial Sequence
  Description of Artificial Sequence: Synthetic oligonucleotide
  Target: ATXN1; (+) strand; PAM type: YTN; PAM sequence: CTG
cagctgccgcacccacggct

SEQ ID NO: 248564 - DNA, 20 bp, Artificial Sequence
  Description of Artificial Sequence: Synthetic oligonucleotide
  Target: ATXN1; (+) strand; PAM type: YTN; PAM sequence: CTG
ccgcacccacggctgcagac

SEQ ID NO: 248565 - DNA, 20 bp, Artificial Sequence
  Description of Artificial Sequence: Synthetic oligonucleotide
  Target: ATXN1; (+) strand; PAM type: YTN; PAM sequence: CTG
cagacctgggcctcccattc

SEQ ID NO: 248566 - DNA, 20 bp, Artificial Sequence
  Description of Artificial Sequence: Synthetic oligonucleotide
  Target: ATXN1; (+) strand; PAM type: YTN; PAM sequence: CTG
ggcctcccattccaggaagc

SEQ ID NO: 248567 - DNA, 20 bp, Artificial Sequence
  Description of Artificial Sequence: Synthetic oligonucleotide
  Target: ATXN1; (+) strand; PAM type: YTN; PAM sequence: CTC
ccattccaggaagcaggcag

SEQ ID NO: 248568 - DNA, 20 bp, Artificial Sequence
  Description of Artificial Sequence: Synthetic oligonucleotide
  Target: ATXN1; (+) strand; PAM type: YTN; PAM sequence: TTC
caggaagcaggcaggagcca

SEQ ID NO: 248569 - DNA, 20 bp, Artificial Sequence
  Description of Artificial Sequence: Synthetic oligonucleotide
  Target: ATXN1; (+) strand; PAM type: YTN; PAM sequence: CTG
ccccttccgagttgtcaggg

SEQ ID NO: 248570 - DNA, 20 bp, Artificial Sequence
  Description of Artificial Sequence: Synthetic oligonucleotide
  Target: ATXN1; (+) strand; PAM type: YTN; PAM sequence: CTT
ccgagttgtcagggcgggag

SEQ ID NO: 248571 - DNA, 20 bp, Artificial Sequence
  Description of Artificial Sequence: Synthetic oligonucleotide
  Target: ATXN1; (+) strand; PAM type: YTN; PAM sequence: TTC
cgagttgtcagggcgggagc

SEQ ID NO: 248572 - DNA, 20 bp, Artificial Sequence
  Description of Artificial Sequence: Synthetic oligonucleotide
  Target: ATXN1; (+) strand; PAM type: YTN; PAM sequence: TTG
tcagggcgggagctcccggg

SEQ ID NO: 248573 - DNA, 20 bp, Artificial Sequence
  Description of Artificial Sequence: Synthetic oligonucleotide
  Target: ATXN1; (+) strand; PAM type: YTN; PAM sequence: CTC
ccgggtgcagctgtggccaa

SEQ ID NO: 248574 - DNA, 20 bp, Artificial Sequence
  Description of Artificial Sequence: Synthetic oligonucleotide
  Target: ATXN1; (+) strand; PAM type: YTN; PAM sequence: CTG
tggccaaccctcccaggcac

SEQ ID NO: 248575 - DNA, 20 bp, Artificial Sequence
  Description of Artificial Sequence: Synthetic oligonucleotide
  Target: ATXN1; (+) strand; PAM type: YTN; PAM sequence: CTC
ccaggcacaggacctgggcg

SEQ ID NO: 248576 - DNA, 20 bp, Artificial Sequence
  Description of Artificial Sequence: Synthetic oligonucleotide
  Target: ATXN1; (+) strand; PAM type: YTN; PAM sequence: CTG
ggcgtctctgcagcctgcac

SEQ ID NO: 248577 - DNA, 20 bp, Artificial Sequence
  Description of Artificial Sequence: Synthetic oligonucleotide
  Target: ATXN1; (+) strand; PAM type: YTN; PAM sequence: CTC
tgcagcctgcacccttgggc

SEQ ID NO: 248578 - DNA, 20 bp, Artificial Sequence
  Description of Artificial Sequence: Synthetic oligonucleotide
  Target: ATXN1; (+) strand; PAM type: YTN; PAM sequence: CTG
cagcctgcacccttgggcgc

SEQ ID NO: 248579 - DNA, 20 bp, Artificial Sequence
  Description of Artificial Sequence: Synthetic oligonucleotide
  Target: ATXN1; (+) strand; PAM type: YTN; PAM sequence: CTG
cacccttgggcgccccagga

SEQ ID NO: 248580 - DNA, 20 bp, Artificial Sequence
  Description of Artificial Sequence: Synthetic oligonucleotide
  Target: ATXN1; (+) strand; PAM type: YTN; PAM sequence: CTT
gggcgccccaggaaggaccc

SEQ ID NO: 248581 - DNA, 20 bp, Artificial Sequence
  Description of Artificial Sequence: Synthetic oligonucleotide
  Target: ATXN1; (+) strand; PAM type: YTN; PAM sequence: TTG
ggcgccccaggaaggaccct

SEQ ID NO: 248582 - DNA, 20 bp, Artificial Sequence
  Description of Artificial Sequence: Synthetic oligonucleotide
  Target: ATXN1; (+) strand; PAM type: YTN; PAM sequence: CTC
cccatctctgcatgctcaga

SEQ ID NO: 248583 - DNA, 20 bp, Artificial Sequence
  Description of Artificial Sequence: Synthetic oligonucleotide
  Target: ATXN1; (+) strand; PAM type: YTN; PAM sequence: CTC
tgcatgctcagatgtgtctg

SEQ ID NO: 248584 - DNA, 20 bp, Artificial Sequence
  Description of Artificial Sequence: Synthetic oligonucleotide
  Target: ATXN1; (+) strand; PAM type: YTN; PAM sequence: CTG
catgctcagatgtgtctgcg

SEQ ID NO: 248585 - DNA, 20 bp, Artificial Sequence
  Description of Artificial Sequence: Synthetic oligonucleotide
  Target: ATXN1; (+) strand; PAM type: YTN; PAM sequence: CTC
agatgtgtctgcgcccactg

SEQ ID NO: 248586 - DNA, 20 bp, Artificial Sequence
  Description of Artificial Sequence: Synthetic oligonucleotide
  Target: ATXN1; (+) strand; PAM type: YTN; PAM sequence: CTG
cgcccactgcctggcctctc

SEQ ID NO: 248587 - DNA, 20 bp, Artificial Sequence
  Description of Artificial Sequence: Synthetic oligonucleotide
  Target: ATXN1; (+) strand; PAM type: YTN; PAM sequence: CTG
cctggcctctctccgttcca

SEQ ID NO: 248588 - DNA, 20 bp, Artificial Sequence
  Description of Artificial Sequence: Synthetic oligonucleotide
  Target: ATXN1; (+) strand; PAM type: YTN; PAM sequence: CTG
gcctctctccgttccaggca

SEQ ID NO: 248589 - DNA, 20 bp, Artificial Sequence
  Description of Artificial Sequence: Synthetic oligonucleotide
  Target: ATXN1; (+) strand; PAM type: YTN; PAM sequence: CTC
tctccgttccaggcacccac

SEQ ID NO: 248590 - DNA, 20 bp, Artificial Sequence
  Description of Artificial Sequence: Synthetic oligonucleotide
  Target: ATXN1; (+) strand; PAM type: YTN; PAM sequence: CTC
tccgttccaggcacccactc

SEQ ID NO: 248591 - DNA, 20 bp, Artificial Sequence
  Description of Artificial Sequence: Synthetic oligonucleotide
  Target: ATXN1; (+) strand; PAM type: YTN; PAM sequence: CTC
cgttccaggcacccactcag

SEQ ID NO: 248592 - DNA, 20 bp, Artificial Sequence
  Description of Artificial Sequence: Synthetic oligonucleotide
  Target: ATXN1; (+) strand; PAM type: YTN; PAM sequence: TTC
caggcacccactcagatctc

SEQ ID NO: 248593 - DNA, 20 bp, Artificial Sequence
  Description of Artificial Sequence: Synthetic oligonucleotide
  Target: ATXN1; (+) strand; PAM type: YTN; PAM sequence: CTC
agatctcagagctgggttgg

SEQ ID NO: 248594 - DNA, 20 bp, Artificial Sequence
  Description of Artificial Sequence: Synthetic oligonucleotide
  Target: ATXN1; (+) strand; PAM type: YTN; PAM sequence: CTC
agagctgggttggggccaag

SEQ ID NO: 248595 - DNA, 20 bp, Artificial Sequence
  Description of Artificial Sequence: Synthetic oligonucleotide
  Target: ATXN1; (+) strand; PAM type: YTN; PAM sequence: CTG
ggttggggccaagccccggg

SEQ ID NO: 248596 - DNA, 20 bp, Artificial Sequence
  Description of Artificial Sequence: Synthetic oligonucleotide
  Target: ATXN1; (+) strand; PAM type: YTN; PAM sequence: TTG
gggccaagccccggggccat

SEQ ID NO: 248597 - DNA, 20 bp, Artificial Sequence
  Description of Artificial Sequence: Synthetic oligonucleotide
  Target: ATXN1; (+) strand; PAM type: YTN; PAM sequence: TTA
ggccccaccttcaggcgagg

SEQ ID NO: 248598 - DNA, 20 bp, Artificial Sequence
  Description of Artificial Sequence: Synthetic oligonucleotide
  Target: ATXN1; (+) strand; PAM type: YTN; PAM sequence: CTT
caggcgagggagggcctgaa

SEQ ID NO: 248599 - DNA, 20 bp, Artificial Sequence
  Description of Artificial Sequence: Synthetic oligonucleotide
  Target: ATXN1; (+) strand; PAM type: YTN; PAM sequence: TTC
aggcgagggagggcctgaag

SEQ ID NO: 248600 - DNA, 20 bp, Artificial Sequence
  Description of Artificial Sequence: Synthetic oligonucleotide
  Target: ATXN1; (+) strand; PAM type: YTN; PAM sequence: CTG
aaggctgggggccgggctgc

SEQ ID NO: 248601 - DNA, 20 bp, Artificial Sequence
  Description of Artificial Sequence: Synthetic oligonucleotide
  Target: ATXN1; (+) strand; PAM type: YTN; PAM sequence: CTG
ggggccgggctgccagtcct

SEQ ID NO: 248602 - DNA, 20 bp, Artificial Sequence
  Description of Artificial Sequence: Synthetic oligonucleotide
  Target: ATXN1; (+) strand; PAM type: YTN; PAM sequence: CTG
ccagtcctgccgaccagagt

SEQ ID NO: 248603 - DNA, 20 bp, Artificial Sequence
  Description of Artificial Sequence: Synthetic oligonucleotide
  Target: ATXN1; (+) strand; PAM type: YTN; PAM sequence: CTG
ccgaccagagtggggactcg

SEQ ID NO: 248604 - DNA, 20 bp, Artificial Sequence
  Description of Artificial Sequence: Synthetic oligonucleotide
  Target: ATXN1; (+) strand; PAM type: YTN; PAM sequence: CTC
gtggtgcctcttccgtccac

SEQ ID NO: 248605 - DNA, 20 bp, Artificial Sequence
  Description of Artificial Sequence: Synthetic oligonucleotide
  Target: ATXN1; (+) strand; PAM type: YTN; PAM sequence: CTC
ttccgtccacccatggccac

SEQ ID NO: 248606 - DNA, 20 bp, Artificial Sequence
  Description of Artificial Sequence: Synthetic oligonucleotide
  Target: ATXN1; (+) strand; PAM type: YTN; PAM sequence: CTT
ccgtccacccatggccaccc

SEQ ID NO: 248607 - DNA, 20 bp, Artificial Sequence
  Description of Artificial Sequence: Synthetic oligonucleotide
  Target: ATXN1; (+) strand; PAM type: YTN; PAM sequence: TTC
cgtccacccatggccaccca

SEQ ID NO: 248608 - DNA, 20 bp, Artificial Sequence
  Description of Artificial Sequence: Synthetic oligonucleotide
  Target: ATXN1; (+) strand; PAM type: YTN; PAM sequence: TTG
gcacatacttcctcccctct

SEQ ID NO: 248609 - DNA, 20 bp, Artificial Sequence
  Description of Artificial Sequence: Synthetic oligonucleotide
  Target: ATXN1; (+) strand; PAM type: YTN; PAM sequence: CTT
cctcccctctgaggtccata

SEQ ID NO: 248610 - DNA, 20 bp, Artificial Sequence
  Description of Artificial Sequence: Synthetic oligonucleotide
  Target: ATXN1; (+) strand; PAM type: YTN; PAM sequence: TTC
ctcccctctgaggtccataa

SEQ ID NO: 248611 - DNA, 20 bp, Artificial Sequence
  Description of Artificial Sequence: Synthetic oligonucleotide
  Target: ATXN1; (+) strand; PAM type: YTN; PAM sequence: CTC
ccctctgaggtccataaaag

SEQ ID NO: 248612 - DNA, 20 bp, Artificial Sequence
  Description of Artificial Sequence: Synthetic oligonucleotide
  Target: ATXN1; (+) strand; PAM type: YTN; PAM sequence: CTC
tgaggtccataaaagccctg

SEQ ID NO: 248613 - DNA, 20 bp, Artificial Sequence
  Description of Artificial Sequence: Synthetic oligonucleotide
  Target: ATXN1; (+) strand; PAM type: YTN; PAM sequence: CTG
aggtccataaaagccctggg

SEQ ID NO: 248614 - DNA, 20 bp, Artificial Sequence
  Description of Artificial Sequence: Synthetic oligonucleotide
  Target: ATXN1; (+) strand; PAM type: YTN; PAM sequence: CTG
ggcttagccacagcaggcag

SEQ ID NO: 248615 - DNA, 20 bp, Artificial Sequence
  Description of Artificial Sequence: Synthetic oligonucleotide
  Target: ATXN1; (+) strand; PAM type: YTN; PAM sequence: CTT
agccacagcaggcaggagga

SEQ ID NO: 248616 - DNA, 20 bp, Artificial Sequence
  Description of Artificial Sequence: Synthetic oligonucleotide
  Target: ATXN1; (+) strand; PAM type: YTN; PAM sequence: TTA
gccacagcaggcaggaggat

SEQ ID NO: 248617 - DNA, 20 bp, Artificial Sequence
  Description of Artificial Sequence: Synthetic oligonucleotide
  Target: ATXN1; (+) strand; PAM type: YTN; PAM sequence: CTG
gatgaccagttgcagagagg

SEQ ID NO: 248618 - DNA, 20 bp, Artificial Sequence
  Description of Artificial Sequence: Synthetic oligonucleotide
  Target: ATXN1; (+) strand; PAM type: YTN; PAM sequence: TTG
cagagaggagtaccctctct

SEQ ID NO: 248619 - DNA, 20 bp, Artificial Sequence
  Description of Artificial Sequence: Synthetic oligonucleotide
  Target: ATXN1; (+) strand; PAM type: YTN; PAM sequence: CTC
tctgctgatagctggagacg

SEQ ID NO: 248620 - DNA, 20 bp, Artificial Sequence
  Description of Artificial Sequence: Synthetic oligonucleotide
  Target: ATXN1; (+) strand; PAM type: YTN; PAM sequence: CTC
tgctgatagctggagacgat

SEQ ID NO: 248621 - DNA, 20 bp, Artificial Sequence
  Description of Artificial Sequence: Synthetic oligonucleotide
  Target: ATXN1; (+) strand; PAM type: YTN; PAM sequence: CTG
ctgatagctggagacgatgg

SEQ ID NO: 248622 - DNA, 20 bp, Artificial Sequence
  Description of Artificial Sequence: Synthetic oligonucleotide
  Target: ATXN1; (+) strand; PAM type: YTN; PAM sequence: CTG
atagctggagacgatgggac

SEQ ID NO: 248623 - DNA, 20 bp, Artificial Sequence
  Description of Artificial Sequence: Synthetic oligonucleotide
  Target: ATXN1; (+) strand; PAM type: YTN; PAM sequence: CTG
gagacgatgggacaaccagc

SEQ ID NO: 248624 - DNA, 20 bp, Artificial Sequence
  Description of Artificial Sequence: Synthetic oligonucleotide
  Target: ATXN1; (+) strand; PAM type: YTN; PAM sequence: CTG
cagagatgacctgctggcag

SEQ ID NO: 248625 - DNA, 20 bp, Artificial Sequence
  Description of Artificial Sequence: Synthetic oligonucleotide
  Target: ATXN1; (+) strand; PAM type: YTN; PAM sequence: CTG
ctggcagagaggagctaccc

SEQ ID NO: 248626 - DNA, 20 bp, Artificial Sequence
  Description of Artificial Sequence: Synthetic oligonucleotide
  Target: ATXN1; (+) strand; PAM type: YTN; PAM sequence: CTG
gcagagaggagctaccctct

SEQ ID NO: 248627 - DNA, 20 bp, Artificial Sequence
  Description of Artificial Sequence: Synthetic oligonucleotide
  Target: ATXN1; (+) strand; PAM type: YTN; PAM sequence: CTA
ccctctctgctaagaggagt

SEQ ID NO: 248628 - DNA, 20 bp, Artificial Sequence
  Description of Artificial Sequence: Synthetic oligonucleotide
  Target: ATXN1; (+) strand; PAM type: YTN; PAM sequence: CTC
tctgctaagaggagtgcttc

SEQ ID NO: 248629 - DNA, 20 bp, Artificial Sequence
  Description of Artificial Sequence: Synthetic oligonucleotide
  Target: ATXN1; (+) strand; PAM type: YTN; PAM sequence: CTC
tgctaagaggagtgcttcag

SEQ ID NO: 248630 - DNA, 20 bp, Artificial Sequence
  Description of Artificial Sequence: Synthetic oligonucleotide
  Target: ATXN1; (+) strand; PAM type: YTN; PAM sequence: CTG
ctaagaggagtgcttcagag

SEQ ID NO: 248631 - DNA, 20 bp, Artificial Sequence
  Description of Artificial Sequence: Synthetic oligonucleotide
  Target: ATXN1; (+) strand; PAM type: YTN; PAM sequence: CTA
agaggagtgcttcagagacc

SEQ ID NO: 248632 - DNA, 20 bp, Artificial Sequence
  Description of Artificial Sequence: Synthetic oligonucleotide
  Target: ATXN1; (+) strand; PAM type: YTN; PAM sequence: CTT
cagagacctgcagaatgact

SEQ ID NO: 248633 - DNA, 20 bp, Artificial Sequence
  Description of Artificial Sequence: Synthetic oligonucleotide
  Target: ATXN1; (+) strand; PAM type: YTN; PAM sequence: TTC
agagacctgcagaatgactt

SEQ ID NO: 248634 - DNA, 20 bp, Artificial Sequence
  Description of Artificial Sequence: Synthetic oligonucleotide
  Target: ATXN1; (+) strand; PAM type: YTN; PAM sequence: CTG
cagaatgacttgcctgcaga

SEQ ID NO: 248635 - DNA, 20 bp, Artificial Sequence
  Description of Artificial Sequence: Synthetic oligonucleotide
  Target: ATXN1; (+) strand; PAM type: YTN; PAM sequence: CTT
gcctgcagagaggagccacc

SEQ ID NO: 248636 - DNA, 20 bp, Artificial Sequence
  Description of Artificial Sequence: Synthetic oligonucleotide
  Target: ATXN1; (+) strand; PAM type: YTN; PAM sequence: TTG
cctgcagagaggagccaccc

SEQ ID NO: 248637 - DNA, 20 bp, Artificial Sequence
  Description of Artificial Sequence: Synthetic oligonucleotide
  Target: ATXN1; (+) strand; PAM type: YTN; PAM sequence: CTG
cagagaggagccaccctttc

SEQ ID NO: 248638 - DNA, 20 bp, Artificial Sequence
  Description of Artificial Sequence: Synthetic oligonucleotide
  Target: ATXN1; (+) strand; PAM type: YTN; PAM sequence: CTT
tccagggcctcctctctgct

SEQ ID NO: 248639 - DNA, 20 bp, Artificial Sequence
  Description of Artificial Sequence: Synthetic oligonucleotide
  Target: ATXN1; (+) strand; PAM type: YTN; PAM sequence: TTT
ccagggcctcctctctgctg

SEQ ID NO: 248640 - DNA, 20 bp, Artificial Sequence
  Description of Artificial Sequence: Synthetic oligonucleotide
  Target: ATXN1; (+) strand; PAM type: YTN; PAM sequence: TTC
cagggcctcctctctgctga

SEQ ID NO: 248641 - DNA, 20 bp, Artificial Sequence
  Description of Artificial Sequence: Synthetic oligonucleotide
  Target: ATXN1; (+) strand; PAM type: YTN; PAM sequence: CTC
ctctctgctgagagctgaac

SEQ ID NO: 248642 - DNA, 20 bp, Artificial Sequence
  Description of Artificial Sequence: Synthetic oligonucleotide
  Target: ATXN1; (+) strand; PAM type: YTN; PAM sequence: CTC
tctgctgagagctgaacact

SEQ ID NO: 248643 - DNA, 20 bp, Artificial Sequence
  Description of Artificial Sequence: Synthetic oligonucleotide
  Target: ATXN1; (+) strand; PAM type: YTN; PAM sequence: CTC
tgctgagagctgaacactca

SEQ ID NO: 248644 - DNA, 20 bp, Artificial Sequence
  Description of Artificial Sequence: Synthetic oligonucleotide
  Target: ATXN1; (+) strand; PAM type: YTN; PAM sequence: CTG
ctgagagctgaacactcaat

SEQ ID NO: 248645 - DNA, 20 bp, Artificial Sequence
  Description of Artificial Sequence: Synthetic oligonucleotide
  Target: ATXN1; (+) strand; PAM type: YTN; PAM sequence: CTG
agagctgaacactcaatggg

SEQ ID NO: 248646 - DNA, 20 bp, Artificial Sequence
  Description of Artificial Sequence: Synthetic oligonucleotide
  Target: ATXN1; (+) strand; PAM type: YTN; PAM sequence: CTG
aacactcaatgggacgatct

SEQ ID NO: 248647 - DNA, 20 bp, Artificial Sequence
  Description of Artificial Sequence: Synthetic oligonucleotide
  Target: ATXN1; (+) strand; PAM type: YTN; PAM sequence: CTC
aatgggacgatctgcttata

SEQ ID NO: 248648 - DNA, 20 bp, Artificial Sequence
  Description of Artificial Sequence: Synthetic oligonucleotide
  Target: ATXN1; (+) strand; PAM type: YTN; PAM sequence: CTG
cttatagagaggagctcccc

SEQ ID NO: 248649 - DNA, 20 bp, Artificial Sequence
  Description of Artificial Sequence: Synthetic oligonucleotide
  Target: ATXN1; (+) strand; PAM type: YTN; PAM sequence: CTT
atagagaggagctccccact

SEQ ID NO: 248650 - DNA, 20 bp, Artificial Sequence
  Description of Artificial Sequence: Synthetic oligonucleotide
  Target: ATXN1; (+) strand; PAM type: YTN; PAM sequence: TTA
tagagaggagctccccactc

SEQ ID NO: 248651 - DNA, 20 bp, Artificial Sequence
  Description of Artificial Sequence: Synthetic oligonucleotide
  Target: ATXN1; (+) strand; PAM type: YTN; PAM sequence: CTC
cccactcctccgagttgttc

SEQ ID NO: 248652 - DNA, 20 bp, Artificial Sequence
  Description of Artificial Sequence: Synthetic oligonucleotide
  Target: ATXN1; (+) strand; PAM type: YTN; PAM sequence: CTC
ctccgagttgttctaacact

SEQ ID NO: 248653 - DNA, 20 bp, Artificial Sequence
  Description of Artificial Sequence: Synthetic oligonucleotide
  Target: ATXN1; (+) strand; PAM type: YTN; PAM sequence: CTC
cgagttgttctaacactaaa

SEQ ID NO: 248654 - DNA, 20 bp, Artificial Sequence
  Description of Artificial Sequence: Synthetic oligonucleotide
  Target: ATXN1; (+) strand; PAM type: YTN; PAM sequence: TTG
ttctaacactaaataaaact

SEQ ID NO: 248655 - DNA, 20 bp, Artificial Sequence
  Description of Artificial Sequence: Synthetic oligonucleotide
  Target: ATXN1; (+) strand; PAM type: YTN; PAM sequence: TTC
taacactaaataaaactctt

SEQ ID NO: 248656 - DNA, 20 bp, Artificial Sequence
  Description of Artificial Sequence: Synthetic oligonucleotide
  Target: ATXN1; (+) strand; PAM type: YTN; PAM sequence: CTA
acactaaataaaactcttct

SEQ ID NO: 248657 - DNA, 20 bp, Artificial Sequence
  Description of Artificial Sequence: Synthetic oligonucleotide
  Target: ATXN1; (+) strand; PAM type: YTN; PAM sequence: CTA
aataaaactcttctttttca

SEQ ID NO: 248658 - DNA, 20 bp, Artificial Sequence
  Description of Artificial Sequence: Synthetic oligonucleotide
  Target: ATXN1; (+) strand; PAM type: YTN; PAM sequence: CTC
ttctttttcacccttcacat

SEQ ID NO: 248659 - DNA, 20 bp, Artificial Sequence
  Description of Artificial Sequence: Synthetic oligonucleotide
  Target: ATXN1; (+) strand; PAM type: YTN; PAM sequence: CTT
ctttttcacccttcacatgt

SEQ ID NO: 248660 - DNA, 20 bp, Artificial Sequence
  Description of Artificial Sequence: Synthetic oligonucleotide
  Target: ATXN1; (+) strand; PAM type: YTN; PAM sequence: TTC
tttttcacccttcacatgtc

SEQ ID NO: 248661 - DNA, 20 bp, Artificial Sequence
  Description of Artificial Sequence: Synthetic oligonucleotide
  Target: ATXN1; (+) strand; PAM type: YTN; PAM sequence: CTT
tttcacccttcacatgtctg

SEQ ID NO: 248662 - DNA, 20 bp, Artificial Sequence
  Description of Artificial Sequence: Synthetic oligonucleotide
  Target: ATXN1; (+) strand; PAM type: YTN; PAM sequence: TTT
ttcacccttcacatgtctgt

SEQ ID NO: 248663 - DNA, 20 bp, Artificial Sequence
  Description of Artificial Sequence: Synthetic oligonucleotide
  Target: ATXN1; (+) strand; PAM type: YTN; PAM sequence: TTT
tcacccttcacatgtctgtg

SEQ ID NO: 248664 - DNA, 20 bp, Artificial Sequence
  Description of Artificial Sequence: Synthetic oligonucleotide
  Target: ATXN1; (+) strand; PAM type: YTN; PAM sequence: TTT
cacccttcacatgtctgtgt

SEQ ID NO: 248665 - DNA, 20 bp, Artificial Sequence
  Description of Artificial Sequence: Synthetic oligonucleotide
  Target: ATXN1; (+) strand; PAM type: YTN; PAM sequence: TTC
acccttcacatgtctgtgta

SEQ ID NO: 248666 - DNA, 20 bp, Artificial Sequence
  Description of Artificial Sequence: Synthetic oligonucleotide
  Target: ATXN1; (+) strand; PAM type: YTN; PAM sequence: CTT
cacatgtctgtgtacctcat

SEQ ID NO: 248667 - DNA, 20 bp, Artificial Sequence
  Description of Artificial Sequence: Synthetic oligonucleotide
  Target: ATXN1; (+) strand; PAM type: YTN; PAM sequence: TTC
acatgtctgtgtacctcatt

SEQ ID NO: 248668 - DNA, 20 bp, Artificial Sequence
  Description of Artificial Sequence: Synthetic oligonucleotide
  Target: ATXN1; (+) strand; PAM type: YTN; PAM sequence: CTG
tgtacctcattctttctgga

SEQ ID NO: 248669 - DNA, 20 bp, Artificial Sequence
  Description of Artificial Sequence: Synthetic oligonucleotide
  Target: ATXN1; (+) strand; PAM type: YTN; PAM sequence: CTC
attctttctggacgcaggac

SEQ ID NO: 248670 - DNA, 20 bp, Artificial Sequence
  Description of Artificial Sequence: Synthetic oligonucleotide
  Target: ATXN1; (+) strand; PAM type: YTN; PAM sequence: TTC
tttctggacgcaggacaaaa

SEQ ID NO: 248671 - DNA, 20 bp, Artificial Sequence
  Description of Artificial Sequence: Synthetic oligonucleotide
  Target: ATXN1; (+) strand; PAM type: YTN; PAM sequence: CTT
tctggacgcaggacaaaaac

SEQ ID NO: 248672 - DNA, 20 bp, Artificial Sequence
  Description of Artificial Sequence: Synthetic oligonucleotide
  Target: ATXN1; (+) strand; PAM type: YTN; PAM sequence: TTT
ctggacgcaggacaaaaact

SEQ ID NO: 248673 - DNA, 20 bp, Artificial Sequence
  Description of Artificial Sequence: Synthetic oligonucleotide
  Target: ATXN1; (+) strand; PAM type: YTN; PAM sequence: TTC
tggacgcaggacaaaaactt

SEQ ID NO: 248674 - DNA, 20 bp, Artificial Sequence
  Description of Artificial Sequence: Synthetic oligonucleotide
  Target: ATXN1; (+) strand; PAM type: YTN; PAM sequence: CTG
gacgcaggacaaaaacttgg

SEQ ID NO: 248675 - DNA, 20 bp, Artificial Sequence
  Description of Artificial Sequence: Synthetic oligonucleotide
  Target: ATXN1; (+) strand; PAM type: YTN; PAM sequence: CTT
gggcttaaaaggcgttgcgg

SEQ ID NO: 248676 - DNA, 20 bp, Artificial Sequence
  Description of Artificial Sequence: Synthetic oligonucleotide
  Target: ATXN1; (+) strand; PAM type: YTN; PAM sequence: TTG
ggcttaaaaggcgttgcggc

SEQ ID NO: 248677 - DNA, 20 bp, Artificial Sequence
  Description of Artificial Sequence: Synthetic oligonucleotide
  Target: ATXN1; (+) strand; PAM type: YTN; PAM sequence: CTT
aaaaggcgttgcggccacag

SEQ ID NO: 248678 - DNA, 20 bp, Artificial Sequence
  Description of Artificial Sequence: Synthetic oligonucleotide
  Target: ATXN1; (+) strand; PAM type: YTN; PAM sequence: TTA
aaaggcgttgcggccacaga

SEQ ID NO: 248679 - DNA, 20 bp, Artificial Sequence
  Description of Artificial Sequence: Synthetic oligonucleotide
  Target: ATXN1; (+) strand; PAM type: YTN; PAM sequence: TTG
cggccacagaagtttcccat

SEQ ID NO: 248680 - DNA, 20 bp, Artificial Sequence
  Description of Artificial Sequence: Synthetic oligonucleotide
  Target: ATXN1; (+) strand; PAM type: YTN; PAM sequence: TTT
cccatcagaaaaattgacac

SEQ ID NO: 248681 - DNA, 20 bp, Artificial Sequence
  Description of Artificial Sequence: Synthetic oligonucleotide
  Target: ATXN1; (+) strand; PAM type: YTN; PAM sequence: TTC
ccatcagaaaaattgacacc

SEQ ID NO: 248682 - DNA, 20 bp, Artificial Sequence
  Description of Artificial Sequence: Synthetic oligonucleotide
  Target: ATXN1; (+) strand; PAM type: YTN; PAM sequence: TTG
acaccccagagatcctataa

SEQ ID NO: 248683 - DNA, 20 bp, Artificial Sequence
  Description of Artificial Sequence: Synthetic oligonucleotide
  Target: ATXN1; (+) strand; PAM type: YTN; PAM sequence: CTA
taacagtatgttctcacgca

SEQ ID NO: 248684 - DNA, 20 bp, Artificial Sequence
  Description of Artificial Sequence: Synthetic oligonucleotide
  Target: ATXN1; (+) strand; PAM type: YTN; PAM sequence: TTC
tcacgcataagtgggagcca

SEQ ID NO: 248685 - DNA, 20 bp, Artificial Sequence
  Description of Artificial Sequence: Synthetic oligonucleotide
  Target: ATXN1; (+) strand; PAM type: YTN; PAM sequence: CTC
acgcataagtgggagccaag

SEQ ID NO: 248686 - DNA, 20 bp, Artificial Sequence
  Description of Artificial Sequence: Synthetic oligonucleotide
  Target: ATXN1; (+) strand; PAM type: YTN; PAM sequence: CTC
acaatgatacagtggacttt

SEQ ID NO: 248687 - DNA, 20 bp, Artificial Sequence
  Description of Artificial Sequence: Synthetic oligonucleotide
  Target: ATXN1; (+) strand; PAM type: YTN; PAM sequence: CTT
tggggacttgggagaaaggg

SEQ ID NO: 248688 - DNA, 20 bp, Artificial Sequence
  Description of Artificial Sequence: Synthetic oligonucleotide
  Target: ATXN1; (+) strand; PAM type: YTN; PAM sequence: TTT
ggggacttgggagaaagggt

SEQ ID NO: 248689 - DNA, 20 bp, Artificial Sequence
  Description of Artificial Sequence: Synthetic oligonucleotide
  Target: ATXN1; (+) strand; PAM type: YTN; PAM sequence: TTG
gggacttgggagaaagggtg

SEQ ID NO: 248690 - DNA, 20 bp, Artificial Sequence
  Description of Artificial Sequence: Synthetic oligonucleotide
  Target: ATXN1; (+) strand; PAM type: YTN; PAM sequence: CTT
gggagaaagggtgggagggg

SEQ ID NO: 248691 - DNA, 20 bp, Artificial Sequence
  Description of Artificial Sequence: Synthetic oligonucleotide
  Target: ATXN1; (+) strand; PAM type: YTN; PAM sequence: TTG
ggagaaagggtgggaggggg

SEQ ID NO: 248692 - DNA, 20 bp, Artificial Sequence
  Description of Artificial Sequence: Synthetic oligonucleotide
  Target: ATXN1; (+) strand; PAM type: YTN; PAM sequence: CTA
caaaatgggtacagtgtata

SEQ ID NO: 248693 - DNA, 20 bp, Artificial Sequence
  Description of Artificial Sequence: Synthetic oligonucleotide
  Target: ATXN1; (+) strand; PAM type: YTN; PAM sequence: CTC
gggtgatggctgcaccgaaa

SEQ ID NO: 248694 - DNA, 20 bp, Artificial Sequence
  Description of Artificial Sequence: Synthetic oligonucleotide
  Target: ATXN1; (+) strand; PAM type: YTN; PAM sequence: CTG
caccgaaaatctcagaaatc

SEQ ID NO: 248695 - DNA, 20 bp, Artificial Sequence
  Description of Artificial Sequence: Synthetic oligonucleotide
  Target: ATXN1; (+) strand; PAM type: YTN; PAM sequence: CTC
agaaatcaccaccgaagaac

SEQ ID NO: 248696 - DNA, 20 bp, Artificial Sequence
  Description of Artificial Sequence: Synthetic oligonucleotide
  Target: ATXN1; (+) strand; PAM type: YTN; PAM sequence: CTT
attcatgtaaccaaacacca

SEQ ID NO: 248697 - DNA, 20 bp, Artificial Sequence
  Description of Artificial Sequence: Synthetic oligonucleotide
  Target: ATXN1; (+) strand; PAM type: YTN; PAM sequence: TTA
ttcatgtaaccaaacaccac

SEQ ID NO: 248698 - DNA, 20 bp, Artificial Sequence
  Description of Artificial Sequence: Synthetic oligonucleotide
  Target: ATXN1; (+) strand; PAM type: YTN; PAM sequence: TTC
atgtaaccaaacaccacctg

SEQ ID NO: 248699 - DNA, 20 bp, Artificial Sequence
  Description of Artificial Sequence: Synthetic oligonucleotide
  Target: ATXN1; (+) strand; PAM type: YTN; PAM sequence: CTG
ttcccccaaaacctatggac

SEQ ID NO: 248700 - DNA, 20 bp, Artificial Sequence
  Description of Artificial Sequence: Synthetic oligonucleotide
  Target: ATXN1; (+) strand; PAM type: YTN; PAM sequence: TTC
ccccaaaacctatggacgta

SEQ ID NO: 248701 - DNA, 20 bp, Artificial Sequence
  Description of Artificial Sequence: Synthetic oligonucleotide
  Target: ATXN1; (+) strand; PAM type: YTN; PAM sequence: CTA
tggacgtaaaaaataaaaat

SEQ ID NO: 248702 - DNA, 20 bp, Artificial Sequence
  Description of Artificial Sequence: Synthetic oligonucleotide
  Target: ATXN1; (+) strand; PAM type: YTN; PAM sequence: TTA
agacatcaattatattaaat

SEQ ID NO: 248703 - DNA, 20 bp, Artificial Sequence
  Description of Artificial Sequence: Synthetic oligonucleotide
  Target: ATXN1; (+) strand; PAM type: YTN; PAM sequence: TTA
tattaaatgcagcagagaaa

SEQ ID NO: 248704 - DNA, 20 bp, Artificial Sequence
  Description of Artificial Sequence: Synthetic oligonucleotide
  Target: ATXN1; (+) strand; PAM type: YTN; PAM sequence: TTA
aatgcagcagagaaacagaa

SEQ ID NO: 248705 - DNA, 20 bp, Artificial Sequence
  Description of Artificial Sequence: Synthetic oligonucleotide
  Target: ATXN1; (+) strand; PAM type: YTN; PAM sequence: CTA
agaatggccattggattaga

SEQ ID NO: 248706 - DNA, 20 bp, Artificial Sequence
  Description of Artificial Sequence: Synthetic oligonucleotide
  Target: ATXN1; (+) strand; PAM type: YTN; PAM sequence: TTG
gattagaccatgggttctca

SEQ ID NO: 248707 - DNA, 20 bp, Artificial Sequence
  Description of Artificial Sequence: Synthetic oligonucleotide
  Target: ATXN1; (+) strand; PAM type: YTN; PAM sequence: TTA
gaccatgggttctcaatatc

SEQ ID NO: 248708 - DNA, 20 bp, Artificial Sequence
  Description of Artificial Sequence: Synthetic oligonucleotide
  Target: ATXN1; (+) strand; PAM type: YTN; PAM sequence: TTC
tcaatatctgctgaatatta

SEQ ID NO: 248709 - DNA, 20 bp, Artificial Sequence
  Description of Artificial Sequence: Synthetic oligonucleotide
  Target: ATXN1; (+) strand; PAM type: YTN; PAM sequence: CTC
aatatctgctgaatattaga

SEQ ID NO: 248710 - DNA, 20 bp, Artificial Sequence
  Description of Artificial Sequence: Synthetic oligonucleotide
  Target: ATXN1; (+) strand; PAM type: YTN; PAM sequence: CTG
ctgaatattagaagcaccgg

SEQ ID NO: 248711 - DNA, 20 bp, Artificial Sequence
  Description of Artificial Sequence: Synthetic oligonucleotide
  Target: ATXN1; (+) strand; PAM type: YTN; PAM sequence: CTG
aatattagaagcaccggaga

SEQ ID NO: 248712 - DNA, 20 bp, Artificial Sequence
  Description of Artificial Sequence: Synthetic oligonucleotide
  Target: ATXN1; (+) strand; PAM type: YTN; PAM sequence: TTA
gaagcaccggagagcttcta

SEQ ID NO: 248713 - DNA, 20 bp, Artificial Sequence
  Description of Artificial Sequence: Synthetic oligonucleotide
  Target: ATXN1; (+) strand; PAM type: YTN; PAM sequence: CTT
ctacaagacactaacccaga

SEQ ID NO: 248714 - DNA, 20 bp, Artificial Sequence
  Description of Artificial Sequence: Synthetic oligonucleotide
  Target: ATXN1; (+) strand; PAM type: YTN; PAM sequence: TTC
tacaagacactaacccagaa

SEQ ID NO: 248715 - DNA, 20 bp, Artificial Sequence
  Description of Artificial Sequence: Synthetic oligonucleotide
  Target: ATXN1; (+) strand; PAM type: YTN; PAM sequence: CTA
caagacactaacccagaatc

SEQ ID NO: 248716 - DNA, 20 bp, Artificial Sequence
  Description of Artificial Sequence: Synthetic oligonucleotide
  Target: ATXN1; (+) strand; PAM type: YTN; PAM sequence: CTA
acccagaatctgaattaatg

SEQ ID NO: 248717 - DNA, 20 bp, Artificial Sequence
  Description of Artificial Sequence: Synthetic oligonucleotide
  Target: ATXN1; (+) strand; PAM type: YTN; PAM sequence: CTG
aattaatgcccactggatta

SEQ ID NO: 248718 - DNA, 20 bp, Artificial Sequence
  Description of Artificial Sequence: Synthetic oligonucleotide
  Target: ATXN1; (+) strand; PAM type: YTN; PAM sequence: TTA
atgcccactggattaaactg

SEQ ID NO: 248719 - DNA, 20 bp, Artificial Sequence
  Description of Artificial Sequence: Synthetic oligonucleotide
  Target: ATXN1; (+) strand; PAM type: YTN; PAM sequence: CTG
gattaaactgtatggtcaga

SEQ ID NO: 248720 - DNA, 20 bp, Artificial Sequence
  Description of Artificial Sequence: Synthetic oligonucleotide
  Target: ATXN1; (+) strand; PAM type: YTN; PAM sequence: TTA
aactgtatggtcagagatga

SEQ ID NO: 248721 - DNA, 20 bp, Artificial Sequence
  Description of Artificial Sequence: Synthetic oligonucleotide
  Target: ATXN1; (+) strand; PAM type: YTN; PAM sequence: CTG
tatggtcagagatgacttca

SEQ ID NO: 248722 - DNA, 20 bp, Artificial Sequence
  Description of Artificial Sequence: Synthetic oligonucleotide
  Target: ATXN1; (+) strand; PAM type: YTN; PAM sequence: CTT
caaagagaacagctctatag

SEQ ID NO: 248723 - DNA, 20 bp, Artificial Sequence
  Description of Artificial Sequence: Synthetic oligonucleotide
  Target: ATXN1; (+) strand; PAM type: YTN; PAM sequence: TTC
aaagagaacagctctatagt

SEQ ID NO: 248724 - DNA, 20 bp, Artificial Sequence
  Description of Artificial Sequence: Synthetic oligonucleotide
  Target: ATXN1; (+) strand; PAM type: YTN; PAM sequence: CTC
tatagtcctattttaaagta

SEQ ID NO: 248725 - DNA, 20 bp, Artificial Sequence
  Description of Artificial Sequence: Synthetic oligonucleotide
  Target: ATXN1; (+) strand; PAM type: YTN; PAM sequence: CTA
tagtcctattttaaagtagg

SEQ ID NO: 248726 - DNA, 20 bp, Artificial Sequence
  Description of Artificial Sequence: Synthetic oligonucleotide
  Target: ATXN1; (+) strand; PAM type: YTN; PAM sequence: CTA
ttttaaagtaggggaacaga

SEQ ID NO: 248727 - DNA, 20 bp, Artificial Sequence
  Description of Artificial Sequence: Synthetic oligonucleotide
  Target: ATXN1; (+) strand; PAM type: YTN; PAM sequence: TTT
taaagtaggggaacagatat

SEQ ID NO: 248728 - DNA, 20 bp, Artificial Sequence
  Description of Artificial Sequence: Synthetic oligonucleotide
  Target: ATXN1; (+) strand; PAM type: YTN; PAM sequence: TTT
aaagtaggggaacagatata

SEQ ID NO: 248729 - DNA, 20 bp, Artificial Sequence
  Description of Artificial Sequence: Synthetic oligonucleotide
  Target: ATXN1; (+) strand; PAM type: YTN; PAM sequence: TTA
aagtaggggaacagatatac

SEQ ID NO: 248730 - DNA, 20 bp, Artificial Sequence
  Description of Artificial Sequence: Synthetic oligonucleotide
  Target: ATXN1; (+) strand; PAM type: YTN; PAM sequence: TTT
tccattcccaagattcaata

SEQ ID NO: 248731 - DNA, 20 bp, Artificial Sequence
  Description of Artificial Sequence: Synthetic oligonucleotide
  Target: ATXN1; (+) strand; PAM type: YTN; PAM sequence: TTT
ccattcccaagattcaatat

SEQ ID NO: 248732 - DNA, 20 bp, Artificial Sequence
  Description of Artificial Sequence: Synthetic oligonucleotide
  Target: ATXN1; (+) strand; PAM type: YTN; PAM sequence: TTC
cattcccaagattcaatatg

SEQ ID NO: 248733 - DNA, 20 bp, Artificial Sequence
  Description of Artificial Sequence: Synthetic oligonucleotide
  Target: ATXN1; (+) strand; PAM type: YTN; PAM sequence: TTC
ccaagattcaatatgtaaat

SEQ ID NO: 248734 - DNA, 20 bp, Artificial Sequence
  Description of Artificial Sequence: Synthetic oligonucleotide
  Target: ATXN1; (+) strand; PAM type: YTN; PAM sequence: TTC
aatatgtaaatttgcattat

SEQ ID NO: 248735 - DNA, 20 bp, Artificial Sequence
  Description of Artificial Sequence: Synthetic oligonucleotide
  Target: ATXN1; (+) strand; PAM type: YTN; PAM sequence: TTT
gcattattattttattttta

SEQ ID NO: 248736 - DNA, 20 bp, Artificial Sequence
  Description of Artificial Sequence: Synthetic oligonucleotide
  Target: ATXN1; (+) strand; PAM type: YTN; PAM sequence: TTG
cattattattttatttttaa

SEQ ID NO: 248737 - DNA, 20 bp, Artificial Sequence
  Description of Artificial Sequence: Synthetic oligonucleotide
  Target: ATXN1; (+) strand; PAM type: YTN; PAM sequence: TTA
ttattttatttttaaattta

SEQ ID NO: 248738 - DNA, 20 bp, Artificial Sequence
  Description of Artificial Sequence: Synthetic oligonucleotide
  Target: ATXN1; (+) strand; PAM type: YTN; PAM sequence: TTA
ttttatttttaaatttacat

SEQ ID NO: 248739 - DNA, 20 bp, Artificial Sequence
  Description of Artificial Sequence: Synthetic oligonucleotide
  Target: ATXN1; (+) strand; PAM type: YTN; PAM sequence: TTT
tatttttaaatttacatatg

SEQ ID NO: 248740 - DNA, 20 bp, Artificial Sequence
  Description of Artificial Sequence: Synthetic oligonucleotide
  Target: ATXN1; (+) strand; PAM type: YTN; PAM sequence: TTT
atttttaaatttacatatgt

SEQ ID NO: 248741 - DNA, 20 bp, Artificial Sequence
  Description of Artificial Sequence: Synthetic oligonucleotide
  Target: ATXN1; (+) strand; PAM type: YTN; PAM sequence: TTA
tttttaaatttacatatgtc

SEQ ID NO: 248742 - DNA, 20 bp, Artificial Sequence
  Description of Artificial Sequence: Synthetic oligonucleotide
  Target: ATXN1; (+) strand; PAM type: YTN; PAM sequence: TTT
ttaaatttacatatgtcaat

SEQ ID NO: 248743 - DNA, 20 bp, Artificial Sequence
  Description of Artificial Sequence: Synthetic oligonucleotide
  Target: ATXN1; (+) strand; PAM type: YTN; PAM sequence: TTT
taaatttacatatgtcaatg

SEQ ID NO: 248744 - DNA, 20 bp, Artificial Sequence
  Description of Artificial Sequence: Synthetic oligonucleotide
  Target: ATXN1; (+) strand; PAM type: YTN; PAM sequence: TTT
aaatttacatatgtcaatgg

SEQ ID NO: 248745 - DNA, 20 bp, Artificial Sequence
  Description of Artificial Sequence: Synthetic oligonucleotide
  Target: ATXN1; (+) strand; PAM type: YTN; PAM sequence: TTA
aatttacatatgtcaatggg

SEQ ID NO: 248746 - DNA, 20 bp, Artificial Sequence
  Description of Artificial Sequence: Synthetic oligonucleotide
  Target: ATXN1; (+) strand; PAM type: YTN; PAM sequence: TTT
acatatgtcaatgggaaata

SEQ ID NO: 248747 - DNA, 20 bp, Artificial Sequence
  Description of Artificial Sequence: Synthetic oligonucleotide
  Target: ATXN1; (+) strand; PAM type: YTN; PAM sequence: TTA
catatgtcaatgggaaataa

SEQ ID NO: 248748 - DNA, 20 bp, Artificial Sequence
  Description of Artificial Sequence: Synthetic oligonucleotide
  Target: ATXN1; (+) strand; PAM type: YTN; PAM sequence: CTT
gaataacatattcagcattt

SEQ ID NO: 248749 - DNA, 20 bp, Artificial Sequence
  Description of Artificial Sequence: Synthetic oligonucleotide
  Target: ATXN1; (+) strand; PAM type: YTN; PAM sequence: TTG
aataacatattcagcatttg

SEQ ID NO: 248750 - DNA, 20 bp, Artificial Sequence
  Description of Artificial Sequence: Synthetic oligonucleotide
  Target: ATXN1; (+) strand; PAM type: YTN; PAM sequence: TTC
agcatttgaacatctcatgc

SEQ ID NO: 248751 - DNA, 20 bp, Artificial Sequence
  Description of Artificial Sequence: Synthetic oligonucleotide
  Target: ATXN1; (+) strand; PAM type: YTN; PAM sequence: TTT
gaacatctcatgcctgggat

SEQ ID NO: 248752 - DNA, 20 bp, Artificial Sequence
  Description of Artificial Sequence: Synthetic oligonucleotide
  Target: ATXN1; (+) strand; PAM type: YTN; PAM sequence: TTG
aacatctcatgcctgggatt

SEQ ID NO: 248753 - DNA, 20 bp, Artificial Sequence
  Description of Artificial Sequence: Synthetic oligonucleotide
  Target: ATXN1; (+) strand; PAM type: YTN; PAM sequence: CTC
atgcctgggattacactggc

SEQ ID NO: 248754 - DNA, 20 bp, Artificial Sequence
  Description of Artificial Sequence: Synthetic oligonucleotide
  Target: ATXN1; (+) strand; PAM type: YTN; PAM sequence: CTG
ggattacactggctgagcct

SEQ ID NO: 248755 - DNA, 20 bp, Artificial Sequence
  Description of Artificial Sequence: Synthetic oligonucleotide
  Target: ATXN1; (+) strand; PAM type: YTN; PAM sequence: TTA
cactggctgagcctcccaca

SEQ ID NO: 248756 - DNA, 20 bp, Artificial Sequence
  Description of Artificial Sequence: Synthetic oligonucleotide
  Target: ATXN1; (+) strand; PAM type: YTN; PAM sequence: CTG
gctgagcctcccacatcacg

SEQ ID NO: 248757 - DNA, 20 bp, Artificial Sequence
  Description of Artificial Sequence: Synthetic oligonucleotide
  Target: ATXN1; (+) strand; PAM type: YTN; PAM sequence: CTG
agcctcccacatcacgaagc

SEQ ID NO: 248758 - DNA, 20 bp, Artificial Sequence
  Description of Artificial Sequence: Synthetic oligonucleotide
  Target: ATXN1; (+) strand; PAM type: YTN; PAM sequence: CTC
ccacatcacgaagcaaatgc

SEQ ID NO: 248759 - DNA, 20 bp, Artificial Sequence
  Description of Artificial Sequence: Synthetic oligonucleotide
  Target: ATXN1; (+) strand; PAM type: YTN; PAM sequence: CTT
gaataaacatatgggctctg

SEQ ID NO: 248760 - DNA, 20 bp, Artificial Sequence
  Description of Artificial Sequence: Synthetic oligonucleotide
  Target: ATXN1; (+) strand; PAM type: YTN; PAM sequence: TTG
aataaacatatgggctctga

SEQ ID NO: 248761 - DNA, 20 bp, Artificial Sequence
  Description of Artificial Sequence: Synthetic oligonucleotide
  Target: ATXN1; (+) strand; PAM type: YTN; PAM sequence: CTC
tgagaaagtgccctcagagc

SEQ ID NO: 248762 - DNA, 20 bp, Artificial Sequence
  Description of Artificial Sequence: Synthetic oligonucleotide
  Target: ATXN1; (+) strand; PAM type: YTN; PAM sequence: CTG
agaaagtgccctcagagcca

SEQ ID NO: 248763 - DNA, 20 bp, Artificial Sequence
  Description of Artificial Sequence: Synthetic oligonucleotide
  Target: ATXN1; (+) strand; PAM type: YTN; PAM sequence: CTC
agagccagggaacatgacta

SEQ ID NO: 248764 - DNA, 20 bp, Artificial Sequence
  Description of Artificial Sequence: Synthetic oligonucleotide
  Target: ATXN1; (+) strand; PAM type: YTN; PAM sequence: CTA
tatttcaatttaagagaagt

SEQ ID NO: 248765 - DNA, 20 bp, Artificial Sequence
  Description of Artificial Sequence: Synthetic oligonucleotide
  Target: ATXN1; (+) strand; PAM type: YTN; PAM sequence: TTT
caatttaagagaagtaagcc

SEQ ID NO: 248766 - DNA, 20 bp, Artificial Sequence
  Description of Artificial Sequence: Synthetic oligonucleotide
  Target: ATXN1; (+) strand; PAM type: YTN; PAM sequence: TTC
aatttaagagaagtaagcct

SEQ ID NO: 248767 - DNA, 20 bp, Artificial Sequence
  Description of Artificial Sequence: Synthetic oligonucleotide
  Target: ATXN1; (+) strand; PAM type: YTN; PAM sequence: TTT
aagagaagtaagcctcttgg

SEQ ID NO: 248768 - DNA, 20 bp, Artificial Sequence
  Description of Artificial Sequence: Synthetic oligonucleotide
  Target: ATXN1; (+) strand; PAM type: YTN; PAM sequence: TTA
agagaagtaagcctcttgga

SEQ ID NO: 248769 - DNA, 20 bp, Artificial Sequence
  Description of Artificial Sequence: Synthetic oligonucleotide
  Target: ATXN1; (+) strand; PAM type: YTN; PAM sequence: CTC
ttggaaaacactgttcctct

SEQ ID NO: 248770 - DNA, 20 bp, Artificial Sequence
  Description of Artificial Sequence: Synthetic oligonucleotide
  Target: ATXN1; (+) strand; PAM type: YTN; PAM sequence: CTT
ggaaaacactgttcctcttg

SEQ ID NO: 248771 - DNA, 20 bp, Artificial Sequence
  Description of Artificial Sequence: Synthetic oligonucleotide
  Target: ATXN1; (+) strand; PAM type: YTN; PAM sequence: TTG
gaaaacactgttcctcttgt

SEQ ID NO: 248772 - DNA, 20 bp, Artificial Sequence
  Description of Artificial Sequence: Synthetic oligonucleotide
  Target: ATXN1; (+) strand; PAM type: YTN; PAM sequence: CTG
ttcctcttgtttgctccctc

SEQ ID NO: 248773 - DNA, 20 bp, Artificial Sequence
  Description of Artificial Sequence: Synthetic oligonucleotide
  Target: ATXN1; (+) strand; PAM type: YTN; PAM sequence: TTC
ctcttgtttgctccctcttc

SEQ ID NO: 248774 - DNA, 20 bp, Artificial Sequence
  Description of Artificial Sequence: Synthetic oligonucleotide
  Target: ATXN1; (+) strand; PAM type: YTN; PAM sequence: CTC
ttgtttgctccctcttcaac

SEQ ID NO: 248775 - DNA, 20 bp, Artificial Sequence
  Description of Artificial Sequence: Synthetic oligonucleotide
  Target: ATXN1; (+) strand; PAM type: YTN; PAM sequence: CTT
gtttgctccctcttcaacgg

SEQ ID NO: 248776 - DNA, 20 bp, Artificial Sequence
  Description of Artificial Sequence: Synthetic oligonucleotide
  Target: ATXN1; (+) strand; PAM type: YTN; PAM sequence: TTG
tttgctccctcttcaacggg

SEQ ID NO: 248777 - DNA, 20 bp, Artificial Sequence
  Description of Artificial Sequence: Synthetic oligonucleotide
  Target: ATXN1; (+) strand; PAM type: YTN; PAM sequence: TTT
gctccctcttcaacgggttt

SEQ ID NO: 248778 - DNA, 20 bp, Artificial Sequence
  Description of Artificial Sequence: Synthetic oligonucleotide
  Target: ATXN1; (+) strand; PAM type: YTN; PAM sequence: TTG
ctccctcttcaacgggtttt

SEQ ID NO: 248779 - DNA, 20 bp, Artificial Sequence
  Description of Artificial Sequence: Synthetic oligonucleotide
  Target: ATXN1; (+) strand; PAM type: YTN; PAM sequence: CTC
cctcttcaacgggtttttaa

SEQ ID NO: 248780 - DNA, 20 bp, Artificial Sequence
  Description of Artificial Sequence: Synthetic oligonucleotide
  Target: ATXN1; (+) strand; PAM type: YTN; PAM sequence: CTC
ttcaacgggtttttaagtcc

SEQ ID NO: 248781 - DNA, 20 bp, Artificial Sequence
  Description of Artificial Sequence: Synthetic oligonucleotide
  Target: ATXN1; (+) strand; PAM type: YTN; PAM sequence: CTT
caacgggtttttaagtccag

SEQ ID NO: 248782 - DNA, 20 bp, Artificial Sequence
  Description of Artificial Sequence: Synthetic oligonucleotide
  Target: ATXN1; (+) strand; PAM type: YTN; PAM sequence: TTC
aacgggtttttaagtccagg

SEQ ID NO: 248783 - DNA, 20 bp, Artificial Sequence
  Description of Artificial Sequence: Synthetic oligonucleotide
  Target: ATXN1; (+) strand; PAM type: YTN; PAM sequence: TTT
ttaagtccagggctcattcc

SEQ ID NO: 248784 - DNA, 20 bp, Artificial Sequence
  Description of Artificial Sequence: Synthetic oligonucleotide
  Target: ATXN1; (+) strand; PAM type: YTN; PAM sequence: TTT
taagtccagggctcattcca

SEQ ID NO: 248785 - DNA, 20 bp, Artificial Sequence
  Description of Artificial Sequence: Synthetic oligonucleotide
  Target: ATXN1; (+) strand; PAM type: YTN; PAM sequence: TTT
aagtccagggctcattccaa

SEQ ID NO: 248786 - DNA, 20 bp, Artificial Sequence
  Description of Artificial Sequence: Synthetic oligonucleotide
  Target: ATXN1; (+) strand; PAM type: YTN; PAM sequence: TTA
agtccagggctcattccaaa

SEQ ID NO: 248787 - DNA, 20 bp, Artificial Sequence
  Description of Artificial Sequence: Synthetic oligonucleotide
  Target: ATXN1; (+) strand; PAM type: YTN; PAM sequence: CTC
attccaaaagtcctttagcc

SEQ ID NO: 248788 - DNA, 20 bp, Artificial Sequence
  Description of Artificial Sequence: Synthetic oligonucleotide
  Target: ATXN1; (+) strand; PAM type: YTN; PAM sequence: TTC
caaaagtcctttagccaatc

SEQ ID NO: 248789 - DNA, 20 bp, Artificial Sequence
  Description of Artificial Sequence: Synthetic oligonucleotide
  Target: ATXN1; (+) strand; PAM type: YTN; PAM sequence: CTT
tagccaatcttagttcctct

SEQ ID NO: 248790 - DNA, 20 bp, Artificial Sequence
  Description of Artificial Sequence: Synthetic oligonucleotide
  Target: ATXN1; (+) strand; PAM type: YTN; PAM sequence: TTT
agccaatcttagttcctcta

SEQ ID NO: 248791 - DNA, 20 bp, Artificial Sequence
  Description of Artificial Sequence: Synthetic oligonucleotide
  Target: ATXN1; (+) strand; PAM type: YTN; PAM sequence: TTA
gccaatcttagttcctctaa

SEQ ID NO: 248792 - DNA, 20 bp, Artificial Sequence
  Description of Artificial Sequence: Synthetic oligonucleotide
  Target: ATXN1; (+) strand; PAM type: YTN; PAM sequence: CTT
agttcctctaatcgtaacat

SEQ ID NO: 248793 - DNA, 20 bp, Artificial Sequence
  Description of Artificial Sequence: Synthetic oligonucleotide
  Target: ATXN1; (+) strand; PAM type: YTN; PAM sequence: TTA
gttcctctaatcgtaacata

SEQ ID NO: 248794 - DNA, 20 bp, Artificial Sequence
  Description of Artificial Sequence: Synthetic oligonucleotide
  Target: ATXN1; (+) strand; PAM type: YTN; PAM sequence: TTC
ctctaatcgtaacatattca

SEQ ID NO: 248795 - DNA, 20 bp, Artificial Sequence
  Description of Artificial Sequence: Synthetic oligonucleotide
  Target: ATXN1; (+) strand; PAM type: YTN; PAM sequence: CTC
taatcgtaacatattcagtg

SEQ ID NO: 248796 - DNA, 20 bp, Artificial Sequence
  Description of Artificial Sequence: Synthetic oligonucleotide
  Target: ATXN1; (+) strand; PAM type: YTN; PAM sequence: CTA
atcgtaacatattcagtgag

SEQ ID NO: 248797 - DNA, 20 bp, Artificial Sequence
  Description of Artificial Sequence: Synthetic oligonucleotide
  Target: ATXN1; (+) strand; PAM type: YTN; PAM sequence: TTC
agtgagaaaggagatcctat

SEQ ID NO: 248798 - DNA, 20 bp, Artificial Sequence
  Description of Artificial Sequence: Synthetic oligonucleotide
  Target: ATXN1; (+) strand; PAM type: YTN; PAM sequence: CTA
taaggtcaggcaaattgttg

SEQ ID NO: 248799 - DNA, 20 bp, Artificial Sequence
  Description of Artificial Sequence: Synthetic oligonucleotide
  Target: ATXN1; (+) strand; PAM type: YTN; PAM sequence: TTG
ttgttagaaatgtgatccag

SEQ ID NO: 248800 - DNA, 20 bp, Artificial Sequence
  Description of Artificial Sequence: Synthetic oligonucleotide
  Target: ATXN1; (+) strand; PAM type: YTN; PAM sequence: TTG
ttagaaatgtgatccagcaa

SEQ ID NO: 248801 - DNA, 20 bp, Artificial Sequence
  Description of Artificial Sequence: Synthetic oligonucleotide
  Target: ATXN1; (+) strand; PAM type: YTN; PAM sequence: TTA
gaaatgtgatccagcaactt

SEQ ID NO: 248802 - DNA, 20 bp, Artificial Sequence
  Description of Artificial Sequence: Synthetic oligonucleotide
  Target: ATXN1; (+) strand; PAM type: YTN; PAM sequence: CTT
taggtttgaagaaatccagt

SEQ ID NO: 248803 - DNA, 20 bp, Artificial Sequence
  Description of Artificial Sequence: Synthetic oligonucleotide
  Target: ATXN1; (+) strand; PAM type: YTN; PAM sequence: TTT
aggtttgaagaaatccagtg

SEQ ID NO: 248804 - DNA, 20 bp, Artificial Sequence
  Description of Artificial Sequence: Synthetic oligonucleotide
  Target: ATXN1; (+) strand; PAM type: YTN; PAM sequence: TTA
ggtttgaagaaatccagtgg

SEQ ID NO: 248805 - DNA, 20 bp, Artificial Sequence
  Description of Artificial Sequence: Synthetic oligonucleotide
  Target: ATXN1; (+) strand; PAM type: YTN; PAM sequence: TTT
gaagaaatccagtggagaaa

SEQ ID NO: 248806 - DNA, 20 bp, Artificial Sequence
  Description of Artificial Sequence: Synthetic oligonucleotide
  Target: ATXN1; (+) strand; PAM type: YTN; PAM sequence: TTG
aagaaatccagtggagaaaa

SEQ ID NO: 248807 - DNA, 20 bp, Artificial Sequence
  Description of Artificial Sequence: Synthetic oligonucleotide
  Target: ATXN1; (+) strand; PAM type: YTN; PAM sequence: CTC
acattcagacctgtctgtct

SEQ ID NO: 248808 - DNA, 20 bp, Artificial Sequence
  Description of Artificial Sequence: Synthetic oligonucleotide
  Target: ATXN1; (+) strand; PAM type: YTN; PAM sequence: TTC
agacctgtctgtctccatta

SEQ ID NO: 248809 - DNA, 20 bp, Artificial Sequence
  Description of Artificial Sequence: Synthetic oligonucleotide
  Target: ATXN1; (+) strand; PAM type: YTN; PAM sequence: CTG
tctgtctccattatcccaat

SEQ ID NO: 248810 - DNA, 20 bp, Artificial Sequence
  Description of Artificial Sequence: Synthetic oligonucleotide
  Target: ATXN1; (+) strand; PAM type: YTN; PAM sequence: CTG
tctccattatcccaatacac

SEQ ID NO: 248811 - DNA, 20 bp, Artificial Sequence
  Description of Artificial Sequence: Synthetic oligonucleotide
  Target: ATXN1; (+) strand; PAM type: YTN; PAM sequence: CTC
cattatcccaatacaccact

SEQ ID NO: 248812 - DNA, 20 bp, Artificial Sequence
  Description of Artificial Sequence: Synthetic oligonucleotide
  Target: ATXN1; (+) strand; PAM type: YTN; PAM sequence: TTA
tcccaatacaccactggggt

SEQ ID NO: 248813 - DNA, 20 bp, Artificial Sequence
  Description of Artificial Sequence: Synthetic oligonucleotide
  Target: ATXN1; (+) strand; PAM type: YTN; PAM sequence: CTG
gggtctttccctgtattcag

SEQ ID NO: 248814 - DNA, 20 bp, Artificial Sequence
  Description of Artificial Sequence: Synthetic oligonucleotide
  Target: ATXN1; (+) strand; PAM type: YTN; PAM sequence: CTT
tccctgtattcaggaagtgg

SEQ ID NO: 248815 - DNA, 20 bp, Artificial Sequence
  Description of Artificial Sequence: Synthetic oligonucleotide
  Target: ATXN1; (+) strand; PAM type: YTN; PAM sequence: TTT
ccctgtattcaggaagtggg

SEQ ID NO: 248816 - DNA, 20 bp, Artificial Sequence
  Description of Artificial Sequence: Synthetic oligonucleotide
  Target: ATXN1; (+) strand; PAM type: YTN; PAM sequence: TTC
cctgtattcaggaagtgggt

SEQ ID NO: 248817 - DNA, 20 bp, Artificial Sequence
  Description of Artificial Sequence: Synthetic oligonucleotide
  Target: ATXN1; (+) strand; PAM type: YTN; PAM sequence: CTG
tattcaggaagtgggttcta

SEQ ID NO: 248818 - DNA, 20 bp, Artificial Sequence
  Description of Artificial Sequence: Synthetic oligonucleotide
  Target: ATXN1; (+) strand; PAM type: YTN; PAM sequence: TTC
aggaagtgggttctagaaca

SEQ ID NO: 248819 - DNA, 20 bp, Artificial Sequence
  Description of Artificial Sequence: Synthetic oligonucleotide
  Target: ATXN1; (+) strand; PAM type: YTN; PAM sequence: TTC
tagaacagccctgtccattt

SEQ ID NO: 248820 - DNA, 20 bp, Artificial Sequence
  Description of Artificial Sequence: Synthetic oligonucleotide
  Target: ATXN1; (+) strand; PAM type: YTN; PAM sequence: CTA
gaacagccctgtccatttgt

SEQ ID NO: 248821 - DNA, 20 bp, Artificial Sequence
  Description of Artificial Sequence: Synthetic oligonucleotide
  Target: ATXN1; (+) strand; PAM type: YTN; PAM sequence: CTG
tccatttgtaaggaataaca

SEQ ID NO: 248822 - DNA, 20 bp, Artificial Sequence
  Description of Artificial Sequence: Synthetic oligonucleotide
  Target: ATXN1; (+) strand; PAM type: YTN; PAM sequence: TTT
gtaaggaataacacaaggta

SEQ ID NO: 248823 - DNA, 20 bp, Artificial Sequence
  Description of Artificial Sequence: Synthetic oligonucleotide
  Target: ATXN1; (+) strand; PAM type: YTN; PAM sequence: TTG
taaggaataacacaaggtaa

SEQ ID NO: 248824 - DNA, 20 bp, Artificial Sequence
  Description of Artificial Sequence: Synthetic oligonucleotide
  Target: ATXN1; (+) strand; PAM type: YTN; PAM sequence: CTG
aaactagcaagtgagaaagt

SEQ ID NO: 248825 - DNA, 20 bp, Artificial Sequence
  Description of Artificial Sequence: Synthetic oligonucleotide
  Target: ATXN1; (+) strand; PAM type: YTN; PAM sequence: CTA
gcaagtgagaaagtctttac

SEQ ID NO: 248826 - DNA, 20 bp, Artificial Sequence
  Description of Artificial Sequence: Synthetic oligonucleotide
  Target: ATXN1; (+) strand; PAM type: YTN; PAM sequence: CTT
tacttattctaagtaaatga

SEQ ID NO: 248827 - DNA, 20 bp, Artificial Sequence
  Description of Artificial Sequence: Synthetic oligonucleotide
  Target: ATXN1; (+) strand; PAM type: YTN; PAM sequence: TTT
acttattctaagtaaatgac

SEQ ID NO: 248828 - DNA, 20 bp, Artificial Sequence
  Description of Artificial Sequence: Synthetic oligonucleotide
  Target: ATXN1; (+) strand; PAM type: YTN; PAM sequence: TTA
cttattctaagtaaatgact

SEQ ID NO: 248829 - DNA, 20 bp, Artificial Sequence
  Description of Artificial Sequence: Synthetic oligonucleotide
  Target: ATXN1; (+) strand; PAM type: YTN; PAM sequence: CTT
attctaagtaaatgactccc

SEQ ID NO: 248830 - DNA, 20 bp, Artificial Sequence
  Description of Artificial Sequence: Synthetic oligonucleotide
  Target: ATXN1; (+) strand; PAM type: YTN; PAM sequence: TTA
ttctaagtaaatgactccca

SEQ ID NO: 248831 - DNA, 20 bp, Artificial Sequence
  Description of Artificial Sequence: Synthetic oligonucleotide
  Target: ATXN1; (+) strand; PAM type: YTN; PAM sequence: TTC
taagtaaatgactcccaagg

SEQ ID NO: 248832 - DNA, 20 bp, Artificial Sequence
  Description of Artificial Sequence: Synthetic oligonucleotide
  Target: ATXN1; (+) strand; PAM type: YTN; PAM sequence: CTA
agtaaatgactcccaaggac

SEQ ID NO: 248833 - DNA, 20 bp, Artificial Sequence
  Description of Artificial Sequence: Synthetic oligonucleotide
  Target: ATXN1; (+) strand; PAM type: YTN; PAM sequence: CTC
ccaaggacaagatgtagctc

SEQ ID NO: 248834 - DNA, 20 bp, Artificial Sequence
  Description of Artificial Sequence: Synthetic oligonucleotide
  Target: ATXN1; (+) strand; PAM type: YTN; PAM sequence: CTC
gcagcttcttcagtgttgct

SEQ ID NO: 248835 - DNA, 20 bp, Artificial Sequence
  Description of Artificial Sequence: Synthetic oligonucleotide
  Target: ATXN1; (+) strand; PAM type: YTN; PAM sequence: CTT
cttcagtgttgctgcacatt

SEQ ID NO: 248836 - DNA, 20 bp, Artificial Sequence
  Description of Artificial Sequence: Synthetic oligonucleotide
  Target: ATXN1; (+) strand; PAM type: YTN; PAM sequence: TTC
ttcagtgttgctgcacattt

SEQ ID NO: 248837 - DNA, 20 bp, Artificial Sequence
  Description of Artificial Sequence: Synthetic oligonucleotide
  Target: ATXN1; (+) strand; PAM type: YTN; PAM sequence: CTT
cagtgttgctgcacatttac

SEQ ID NO: 248838 - DNA, 20 bp, Artificial Sequence
  Description of Artificial Sequence: Synthetic oligonucleotide
  Target: ATXN1; (+) strand; PAM type: YTN; PAM sequence: TTC
agtgttgctgcacatttacg

SEQ ID NO: 248839 - DNA, 20 bp, Artificial Sequence
  Description of Artificial Sequence: Synthetic oligonucleotide
  Target: ATXN1; (+) strand; PAM type: YTN; PAM sequence: TTG
ctgcacatttacgacataca

SEQ ID NO: 248840 - DNA, 20 bp, Artificial Sequence
  Description of Artificial Sequence: Synthetic oligonucleotide
  Target: ATXN1; (+) strand; PAM type: YTN; PAM sequence: CTG
cacatttacgacatacattt

SEQ ID NO: 248841 - DNA, 20 bp, Artificial Sequence
  Description of Artificial Sequence: Synthetic oligonucleotide
  Target: ATXN1; (+) strand; PAM type: YTN; PAM sequence: TTT
acgacatacatttaatttat

SEQ ID NO: 248842 - DNA, 20 bp, Artificial Sequence
  Description of Artificial Sequence: Synthetic oligonucleotide
  Target: ATXN1; (+) strand; PAM type: YTN; PAM sequence: TTA
cgacatacatttaatttatt

SEQ ID NO: 248843 - DNA, 20 bp, Artificial Sequence
  Description of Artificial Sequence: Synthetic oligonucleotide
  Target: ATXN1; (+) strand; PAM type: YTN; PAM sequence: TTT
aatttattttagctaatgaa

SEQ ID NO: 248844 - DNA, 20 bp, Artificial Sequence
  Description of Artificial Sequence: Synthetic oligonucleotide
  Target: ATXN1; (+) strand; PAM type: YTN; PAM sequence: TTA
atttattttagctaatgaaa

SEQ ID NO: 248845 - DNA, 20 bp, Artificial Sequence
  Description of Artificial Sequence: Synthetic oligonucleotide
  Target: ATXN1; (+) strand; PAM type: YTN; PAM sequence: TTT
attttagctaatgaaaatgc

SEQ ID NO: 248846 - DNA, 20 bp, Artificial Sequence
  Description of Artificial Sequence: Synthetic oligonucleotide
  Target: ATXN1; (+) strand; PAM type: YTN; PAM sequence: TTA
ttttagctaatgaaaatgct

SEQ ID NO: 248847 - DNA, 20 bp, Artificial Sequence
  Description of Artificial Sequence: Synthetic oligonucleotide
  Target: ATXN1; (+) strand; PAM type: YTN; PAM sequence: TTT
tagctaatgaaaatgctcaa

SEQ ID NO: 248848 - DNA, 20 bp, Artificial Sequence
  Description of Artificial Sequence: Synthetic oligonucleotide
  Target: ATXN1; (+) strand; PAM type: YTN; PAM sequence: TTT
agctaatgaaaatgctcaat

SEQ ID NO: 248849 - DNA, 20 bp, Artificial Sequence
  Description of Artificial Sequence: Synthetic oligonucleotide
  Target: ATXN1; (+) strand; PAM type: YTN; PAM sequence: TTA
gctaatgaaaatgctcaata

SEQ ID NO: 248850 - DNA, 20 bp, Artificial Sequence
  Description of Artificial Sequence: Synthetic oligonucleotide
  Target: ATXN1; (+) strand; PAM type: YTN; PAM sequence: CTA
atgaaaatgctcaatagtga

SEQ ID NO: 248851 - DNA, 20 bp, Artificial Sequence
  Description of Artificial Sequence: Synthetic oligonucleotide
  Target: ATXN1; (+) strand; PAM type: YTN; PAM sequence: CTC
aatagtgaatatgtctgagc

SEQ ID NO: 248852 - DNA, 20 bp, Artificial Sequence
  Description of Artificial Sequence: Synthetic oligonucleotide
  Target: ATXN1; (+) strand; PAM type: YTN; PAM sequence: CTG
agcccctatggagaataagt

SEQ ID NO: 248853 - DNA, 20 bp, Artificial Sequence
  Description of Artificial Sequence: Synthetic oligonucleotide
  Target: ATXN1; (+) strand; PAM type: YTN; PAM sequence: CTA
tggagaataagtagtgcaat

SEQ ID NO: 248854 - DNA, 20 bp, Artificial Sequence
  Description of Artificial Sequence: Synthetic oligonucleotide
  Target: ATXN1; (+) strand; PAM type: YTN; PAM sequence: TTT
aactgtctctgagaggcaag

SEQ ID NO: 248855 - DNA, 20 bp, Artificial Sequence
  Description of Artificial Sequence: Synthetic oligonucleotide
  Target: ATXN1; (+) strand; PAM type: YTN; PAM sequence: TTA
actgtctctgagaggcaaga

SEQ ID NO: 248856 - DNA, 20 bp, Artificial Sequence
  Description of Artificial Sequence: Synthetic oligonucleotide
  Target: ATXN1; (+) strand; PAM type: YTN; PAM sequence: CTG
tctctgagaggcaagaagaa

SEQ ID NO: 248857 - DNA, 20 bp, Artificial Sequence
  Description of Artificial Sequence: Synthetic oligonucleotide
  Target: ATXN1; (+) strand; PAM type: YTN; PAM sequence: CTC
tgagaggcaagaagaatctg

SEQ ID NO: 248858 - DNA, 20 bp, Artificial Sequence
  Description of Artificial Sequence: Synthetic oligonucleotide
  Target: ATXN1; (+) strand; PAM type: YTN; PAM sequence: CTG
agaggcaagaagaatctgtg

SEQ ID NO: 248859 - DNA, 20 bp, Artificial Sequence
  Description of Artificial Sequence: Synthetic oligonucleotide
  Target: ATXN1; (+) strand; PAM type: YTN; PAM sequence: CTG
tgttaggggtgtggctctat

SEQ ID NO: 248860 - DNA, 20 bp, Artificial Sequence
  Description of Artificial Sequence: Synthetic oligonucleotide
  Target: ATXN1; (+) strand; PAM type: YTN; PAM sequence: TTA
ggggtgtggctctatatata

SEQ ID NO: 248861 - DNA, 20 bp, Artificial Sequence
  Description of Artificial Sequence: Synthetic oligonucleotide
  Target: ATXN1; (+) strand; PAM type: YTN; PAM sequence: CTC
tatatatagagacattaaat

SEQ ID NO: 248862 - DNA, 20 bp, Artificial Sequence
  Description of Artificial Sequence: Synthetic oligonucleotide
  Target: ATXN1; (+) strand; PAM type: YTN; PAM sequence: CTA
tatatagagacattaaattc

SEQ ID NO: 248863 - DNA, 20 bp, Artificial Sequence
  Description of Artificial Sequence: Synthetic oligonucleotide
  Target: ATXN1; (+) strand; PAM type: YTN; PAM sequence: TTA
aattcatagccaaaagggta

SEQ ID NO: 248864 - DNA, 20 bp, Artificial Sequence
  Description of Artificial Sequence: Synthetic oligonucleotide
  Target: ATXN1; (+) strand; PAM type: YTN; PAM sequence: TTC
atagccaaaagggtaatagt

SEQ ID NO: 248865 - DNA, 20 bp, Artificial Sequence
  Description of Artificial Sequence: Synthetic oligonucleotide
  Target: ATXN1; (+) strand; PAM type: YTN; PAM sequence: TTA
ttacaaaattcaggggtaac

SEQ ID NO: 248866 - DNA, 20 bp, Artificial Sequence
  Description of Artificial Sequence: Synthetic oligonucleotide
  Target: ATXN1; (+) strand; PAM type: YTN; PAM sequence: TTA
caaaattcaggggtaacaag

SEQ ID NO: 248867 - DNA, 20 bp, Artificial Sequence
  Description of Artificial Sequence: Synthetic oligonucleotide
  Target: ATXN1; (+) strand; PAM type: YTN; PAM sequence: TTC
aggggtaacaagggtgaaag

SEQ ID NO: 248868 - DNA, 20 bp, Artificial Sequence
  Description of Artificial Sequence: Synthetic oligonucleotide
  Target: ATXN1; (+) strand; PAM type: YTN; PAM sequence: TTT
ccttcacattctgtttctga

SEQ ID NO: 248869 - DNA, 20 bp, Artificial Sequence
  Description of Artificial Sequence: Synthetic oligonucleotide
  Target: ATXN1; (+) strand; PAM type: YTN; PAM sequence: TTC
cttcacattctgtttctgaa

SEQ ID NO: 248870 - DNA, 20 bp, Artificial Sequence
  Description of Artificial Sequence: Synthetic oligonucleotide
  Target: ATXN1; (+) strand; PAM type: YTN; PAM sequence: CTT
cacattctgtttctgaaaca

SEQ ID NO: 248871 - DNA, 20 bp, Artificial Sequence
  Description of Artificial Sequence: Synthetic oligonucleotide
  Target: ATXN1; (+) strand; PAM type: YTN; PAM sequence: TTC
acattctgtttctgaaacag

SEQ ID NO: 248872 - DNA, 20 bp, Artificial Sequence
  Description of Artificial Sequence: Synthetic oligonucleotide
  Target: ATXN1; (+) strand; PAM type: YTN; PAM sequence: TTC
tgtttctgaaacaggattca

SEQ ID NO: 248873 - DNA, 20 bp, Artificial Sequence
  Description of Artificial Sequence: Synthetic oligonucleotide
  Target: ATXN1; (+) strand; PAM type: YTN; PAM sequence: CTG
tttctgaaacaggattcaag

SEQ ID NO: 248874 - DNA, 20 bp, Artificial Sequence
  Description of Artificial Sequence: Synthetic oligonucleotide
  Target: ATXN1; (+) strand; PAM type: YTN; PAM sequence: TTT
ctgaaacaggattcaagcag

SEQ ID NO: 248875 - DNA, 20 bp, Artificial Sequence
  Description of Artificial Sequence: Synthetic oligonucleotide
  Target: ATXN1; (+) strand; PAM type: YTN; PAM sequence: TTC
tgaaacaggattcaagcagg

SEQ ID NO: 248876 - DNA, 20 bp, Artificial Sequence
  Description of Artificial Sequence: Synthetic oligonucleotide
  Target: ATXN1; (+) strand; PAM type: YTN; PAM sequence: CTG
aaacaggattcaagcaggac

SEQ ID NO: 248877 - DNA, 20 bp, Artificial Sequence
  Description of Artificial Sequence: Synthetic oligonucleotide
  Target: ATXN1; (+) strand; PAM type: YTN; PAM sequence: TTC
aagcaggacattgtaccatt

SEQ ID NO: 248878 - DNA, 20 bp, Artificial Sequence
  Description of Artificial Sequence: Synthetic oligonucleotide
  Target: ATXN1; (+) strand; PAM type: YTN; PAM sequence: TTG
taccatttggtattcattat

SEQ ID NO: 248879 - DNA, 20 bp, Artificial Sequence
  Description of Artificial Sequence: Synthetic oligonucleotide
  Target: ATXN1; (+) strand; PAM type: YTN; PAM sequence: TTT
ggtattcattattttcgttc

SEQ ID NO: 248880 - DNA, 20 bp, Artificial Sequence
  Description of Artificial Sequence: Synthetic oligonucleotide
  Target: ATXN1; (+) strand; PAM type: YTN; PAM sequence: TTG
gtattcattattttcgttca

SEQ ID NO: 248881 - DNA, 20 bp, Artificial Sequence
  Description of Artificial Sequence: Synthetic oligonucleotide
  Target: ATXN1; (+) strand; PAM type: YTN; PAM sequence: TTC
attattttcgttcacgcaca

SEQ ID NO: 248882 - DNA, 20 bp, Artificial Sequence
  Description of Artificial Sequence: Synthetic oligonucleotide
  Target: ATXN1; (+) strand; PAM type: YTN; PAM sequence: TTA
ttttcgttcacgcacatggc

SEQ ID NO: 248883 - DNA, 20 bp, Artificial Sequence
  Description of Artificial Sequence: Synthetic oligonucleotide
  Target: ATXN1; (+) strand; PAM type: YTN; PAM sequence: TTT
tcgttcacgcacatggctaa

SEQ ID NO: 248884 - DNA, 20 bp, Artificial Sequence
  Description of Artificial Sequence: Synthetic oligonucleotide
  Target: ATXN1; (+) strand; PAM type: YTN; PAM sequence: TTT
cgttcacgcacatggctaat

SEQ ID NO: 248885 - DNA, 20 bp, Artificial Sequence
  Description of Artificial Sequence: Synthetic oligonucleotide
  Target: ATXN1; (+) strand; PAM type: YTN; PAM sequence: TTC
gttcacgcacatggctaatt

SEQ ID NO: 248886 - DNA, 20 bp, Artificial Sequence
  Description of Artificial Sequence: Synthetic oligonucleotide
  Target: ATXN1; (+) strand; PAM type: YTN; PAM sequence: TTC
acgcacatggctaattattt

SEQ ID NO: 248887 - DNA, 20 bp, Artificial Sequence
  Description of Artificial Sequence: Synthetic oligonucleotide
  Target: ATXN1; (+) strand; PAM type: YTN; PAM sequence: CTA
attatttctacagcattcag

SEQ ID NO: 248888 - DNA, 20 bp, Artificial Sequence
  Description of Artificial Sequence: Synthetic oligonucleotide
  Target: ATXN1; (+) strand; PAM type: YTN; PAM sequence: TTA
tttctacagcattcagatct

SEQ ID NO: 248889 - DNA, 20 bp, Artificial Sequence
  Description of Artificial Sequence: Synthetic oligonucleotide
  Target: ATXN1; (+) strand; PAM type: YTN; PAM sequence: TTT
ctacagcattcagatctctt

SEQ ID NO: 248890 - DNA, 20 bp, Artificial Sequence
  Description of Artificial Sequence: Synthetic oligonucleotide
  Target: ATXN1; (+) strand; PAM type: YTN; PAM sequence: TTC
tacagcattcagatctcttt

SEQ ID NO: 248891 - DNA, 20 bp, Artificial Sequence
  Description of Artificial Sequence: Synthetic oligonucleotide
  Target: ATXN1; (+) strand; PAM type: YTN; PAM sequence: CTA
cagcattcagatctctttaa

SEQ ID NO: 248892 - DNA, 20 bp, Artificial Sequence
  Description of Artificial Sequence: Synthetic oligonucleotide
  Target: ATXN1; (+) strand; PAM type: YTN; PAM sequence: TTC
agatctctttaaaacaaaca

SEQ ID NO: 248893 - DNA, 20 bp, Artificial Sequence
  Description of Artificial Sequence: Synthetic oligonucleotide
  Target: ATXN1; (+) strand; PAM type: YTN; PAM sequence: CTC
tttaaaacaaacatgttttg

SEQ ID NO: 248894 - DNA, 20 bp, Artificial Sequence
  Description of Artificial Sequence: Synthetic oligonucleotide
  Target: ATXN1; (+) strand; PAM type: YTN; PAM sequence: CTT
taaaacaaacatgttttgca

SEQ ID NO: 248895 - DNA, 20 bp, Artificial Sequence
  Description of Artificial Sequence: Synthetic oligonucleotide
  Target: ATXN1; (+) strand; PAM type: YTN; PAM sequence: TTT
aaaacaaacatgttttgcac

SEQ ID NO: 248896 - DNA, 20 bp, Artificial Sequence
  Description of Artificial Sequence: Synthetic oligonucleotide
  Target: ATXN1; (+) strand; PAM type: YTN; PAM sequence: TTA
aaacaaacatgttttgcaca

SEQ ID NO: 248897 - DNA, 20 bp, Artificial Sequence
  Description of Artificial Sequence: Synthetic oligonucleotide
  Target: ATXN1; (+) strand; PAM type: YTN; PAM sequence: TTT
tgcacatacacgcccacctt

SEQ ID NO: 248898 - DNA, 20 bp, Artificial Sequence
  Description of Artificial Sequence: Synthetic oligonucleotide
  Target: ATXN1; (+) strand; PAM type: YTN; PAM sequence: TTT
gcacatacacgcccaccttt

SEQ ID NO: 248899 - DNA, 20 bp, Artificial Sequence
  Description of Artificial Sequence: Synthetic oligonucleotide
  Target: ATXN1; (+) strand; PAM type: YTN; PAM sequence: TTG
cacatacacgcccaccttta

SEQ ID NO: 248900 - DNA, 20 bp, Artificial Sequence
  Description of Artificial Sequence: Synthetic oligonucleotide
  Target: ATXN1; (+) strand; PAM type: YTN; PAM sequence: CTT
taaaaatatgccttttatcc

SEQ ID NO: 248901 - DNA, 20 bp, Artificial Sequence
  Description of Artificial Sequence: Synthetic oligonucleotide
  Target: ATXN1; (+) strand; PAM type: YTN; PAM sequence: TTT
aaaaatatgccttttatccc

SEQ ID NO: 248902 - DNA, 20 bp, Artificial Sequence
  Description of Artificial Sequence: Synthetic oligonucleotide
  Target: ATXN1; (+) strand; PAM type: YTN; PAM sequence: TTA
aaaatatgccttttatcccc

SEQ ID NO: 248903 - DNA, 20 bp, Artificial Sequence
  Description of Artificial Sequence: Synthetic oligonucleotide
  Target: ATXN1; (+) strand; PAM type: YTN; PAM sequence: CTT
ttatccccttttccacagcc

SEQ ID NO: 248904 - DNA, 20 bp, Artificial Sequence
  Description of Artificial Sequence: Synthetic oligonucleotide
  Target: ATXN1; (+) strand; PAM type: YTN; PAM sequence: TTT
tatccccttttccacagcct

SEQ ID NO: 248905 - DNA, 20 bp, Artificial Sequence
  Description of Artificial Sequence: Synthetic oligonucleotide
  Target: ATXN1; (+) strand; PAM type: YTN; PAM sequence: TTT
atccccttttccacagcctt

SEQ ID NO: 248906 - DNA, 20 bp, Artificial Sequence
  Description of Artificial Sequence: Synthetic oligonucleotide
  Target: ATXN1; (+) strand; PAM type: YTN; PAM sequence: TTA
tccccttttccacagccttg

SEQ ID NO: 248907 - DNA, 20 bp, Artificial Sequence
  Description of Artificial Sequence: Synthetic oligonucleotide
  Target: ATXN1; (+) strand; PAM type: YTN; PAM sequence: CTT
ttccacagccttgaggaaat

SEQ ID NO: 248908 - DNA, 20 bp, Artificial Sequence
  Description of Artificial Sequence: Synthetic oligonucleotide
  Target: ATXN1; (+) strand; PAM type: YTN; PAM sequence: TTT
tccacagccttgaggaaata

SEQ ID NO: 248909 - DNA, 20 bp, Artificial Sequence
  Description of Artificial Sequence: Synthetic oligonucleotide
  Target: ATXN1; (+) strand; PAM type: YTN; PAM sequence: TTT
ccacagccttgaggaaatat

SEQ ID NO: 248910 - DNA, 20 bp, Artificial Sequence
  Description of Artificial Sequence: Synthetic oligonucleotide
  Target: ATXN1; (+) strand; PAM type: YTN; PAM sequence: TTC
cacagccttgaggaaatatc

SEQ ID NO: 248911 - DNA, 20 bp, Artificial Sequence
  Description of Artificial Sequence: Synthetic oligonucleotide
  Target: ATXN1; (+) strand; PAM type: YTN; PAM sequence: CTT
gaggaaatatctgatggatt

SEQ ID NO: 248912 - DNA, 20 bp, Artificial Sequence
  Description of Artificial Sequence: Synthetic oligonucleotide
  Target: ATXN1; (+) strand; PAM type: YTN; PAM sequence: TTG
aggaaatatctgatggattg

SEQ ID NO: 248913 - DNA, 20 bp, Artificial Sequence
  Description of Artificial Sequence: Synthetic oligonucleotide
  Target: ATXN1; (+) strand; PAM type: YTN; PAM sequence: CTG
atggattgtctcaggagcag

SEQ ID NO: 248914 - DNA, 20 bp, Artificial Sequence
  Description of Artificial Sequence: Synthetic oligonucleotide
  Target: ATXN1; (+) strand; PAM type: YTN; PAM sequence: TTG
tctcaggagcagtgttttgg

SEQ ID NO: 248915 - DNA, 20 bp, Artificial Sequence
  Description of Artificial Sequence: Synthetic oligonucleotide
  Target: ATXN1; (+) strand; PAM type: YTN; PAM sequence: CTC
aggagcagtgttttgggaat

SEQ ID NO: 248916 - DNA, 20 bp, Artificial Sequence
  Description of Artificial Sequence: Synthetic oligonucleotide
  Target: ATXN1; (+) strand; PAM type: YTN; PAM sequence: TTT
tgggaataaatgtagattat

SEQ ID NO: 248917 - DNA, 20 bp, Artificial Sequence
  Description of Artificial Sequence: Synthetic oligonucleotide
  Target: ATXN1; (+) strand; PAM type: YTN; PAM sequence: TTT
gggaataaatgtagattata

SEQ ID NO: 248918 - DNA, 20 bp, Artificial Sequence
  Description of Artificial Sequence: Synthetic oligonucleotide
  Target: ATXN1; (+) strand; PAM type: YTN; PAM sequence: TTG
ggaataaatgtagattatat

SEQ ID NO: 248919 - DNA, 20 bp, Artificial Sequence
  Description of Artificial Sequence: Synthetic oligonucleotide
  Target: ATXN1; (+) strand; PAM type: YTN; PAM sequence: TTA
tatgctaaaaaaacgtaact

SEQ ID NO: 248920 - DNA, 20 bp, Artificial Sequence
  Description of Artificial Sequence: Synthetic oligonucleotide
  Target: ATXN1; (+) strand; PAM type: YTN; PAM sequence: CTA
aaaaaacgtaacttgtcccc

SEQ ID NO: 248921 - DNA, 20 bp, Artificial Sequence
  Description of Artificial Sequence: Synthetic oligonucleotide
  Target: ATXN1; (+) strand; PAM type: YTN; PAM sequence: CTT
gtcccctaaaacttgcataa

SEQ ID NO: 248922 - DNA, 20 bp, Artificial Sequence
  Description of Artificial Sequence: Synthetic oligonucleotide
  Target: ATXN1; (+) strand; PAM type: YTN; PAM sequence: TTG
tcccctaaaacttgcataaa

SEQ ID NO: 248923 - DNA, 20 bp, Artificial Sequence
  Description of Artificial Sequence: Synthetic oligonucleotide
  Target: ATXN1; (+) strand; PAM type: YTN; PAM sequence: CTA
aaacttgcataaacaaatca

SEQ ID NO: 248924 - DNA, 20 bp, Artificial Sequence
  Description of Artificial Sequence: Synthetic oligonucleotide
  Target: ATXN1; (+) strand; PAM type: YTN; PAM sequence: CTT
gcataaacaaatcaaaggac

SEQ ID NO: 248925 - DNA, 20 bp, Artificial Sequence
  Description of Artificial Sequence: Synthetic oligonucleotide
  Target: ATXN1; (+) strand; PAM type: YTN; PAM sequence: TTG
cataaacaaatcaaaggaca

SEQ ID NO: 248926 - DNA, 20 bp, Artificial Sequence
  Description of Artificial Sequence: Synthetic oligonucleotide
  Target: ATXN1; (+) strand; PAM type: YTN; PAM sequence: TTG
tagcatttcgagtataaaca

SEQ ID NO: 248927 - DNA, 20 bp, Artificial Sequence
  Description of Artificial Sequence: Synthetic oligonucleotide
  Target: ATXN1; (+) strand; PAM type: YTN; PAM sequence: TTT
cgagtataaacaaaatgact

SEQ ID NO: 248928 - DNA, 20 bp, Artificial Sequence
  Description of Artificial Sequence: Synthetic oligonucleotide
  Target: ATXN1; (+) strand; PAM type: YTN; PAM sequence: TTC
gagtataaacaaaatgactc

SEQ ID NO: 248929 - DNA, 20 bp, Artificial Sequence
  Description of Artificial Sequence: Synthetic oligonucleotide
  Target: ATXN1; (+) strand; PAM type: YTN; PAM sequence: CTC
tcaacttaacttgcagatct

SEQ ID NO: 248930 - DNA, 20 bp, Artificial Sequence
  Description of Artificial Sequence: Synthetic oligonucleotide
  Target: ATXN1; (+) strand; PAM type: YTN; PAM sequence: CTC
aacttaacttgcagatcttt

SEQ ID NO: 248931 - DNA, 20 bp, Artificial Sequence
  Description of Artificial Sequence: Synthetic oligonucleotide
  Target: ATXN1; (+) strand; PAM type: YTN; PAM sequence: CTT
aacttgcagatcttttttta

SEQ ID NO: 248932 - DNA, 20 bp, Artificial Sequence
  Description of Artificial Sequence: Synthetic oligonucleotide
  Target: ATXN1; (+) strand; PAM type: YTN; PAM sequence: TTA
acttgcagatctttttttaa

SEQ ID NO: 248933 - DNA, 20 bp, Artificial Sequence
  Description of Artificial Sequence: Synthetic oligonucleotide
  Target: ATXN1; (+) strand; PAM type: YTN; PAM sequence: CTT
gcagatctttttttaatgtt

SEQ ID NO: 248934 - DNA, 20 bp, Artificial Sequence
  Description of Artificial Sequence: Synthetic oligonucleotide
  Target: ATXN1; (+) strand; PAM type: YTN; PAM sequence: TTG
cagatctttttttaatgttc

SEQ ID NO: 248935 - DNA, 20 bp, Artificial Sequence
  Description of Artificial Sequence: Synthetic oligonucleotide
  Target: ATXN1; (+) strand; PAM type: YTN; PAM sequence: CTT
tttttaatgttcagtaataa

SEQ ID NO: 248936 - DNA, 20 bp, Artificial Sequence
  Description of Artificial Sequence: Synthetic oligonucleotide
  Target: ATXN1; (+) strand; PAM type: YTN; PAM sequence: TTT
ttttaatgttcagtaataaa

SEQ ID NO: 248937 - DNA, 20 bp, Artificial Sequence
  Description of Artificial Sequence: Synthetic oligonucleotide
  Target: ATXN1; (+) strand; PAM type: YTN; PAM sequence: TTT
tttaatgttcagtaataaat

SEQ ID NO: 248938 - DNA, 20 bp, Artificial Sequence
  Description of Artificial Sequence: Synthetic oligonucleotide
  Target: ATXN1; (+) strand; PAM type: YTN; PAM sequence: TTT
ttaatgttcagtaataaatt

SEQ ID NO: 248939 - DNA, 20 bp, Artificial Sequence
  Description of Artificial Sequence: Synthetic oligonucleotide
  Target: ATXN1; (+) strand; PAM type: YTN; PAM sequence: TTT
taatgttcagtaataaattt

SEQ ID NO: 248940 - DNA, 20 bp, Artificial Sequence
  Description of Artificial Sequence: Synthetic oligonucleotide
  Target: ATXN1; (+) strand; PAM type: YTN; PAM sequence: TTT
aatgttcagtaataaatttt

SEQ ID NO: 248941 - DNA, 20 bp, Artificial Sequence
  Description of Artificial Sequence: Synthetic oligonucleotide
  Target: ATXN1; (+) strand; PAM type: YTN; PAM sequence: TTA
atgttcagtaataaatttta

SEQ ID NO: 248942 - DNA, 20 bp, Artificial Sequence
  Description of Artificial Sequence: Synthetic oligonucleotide
  Target: ATXN1; (+) strand; PAM type: YTN; PAM sequence: TTC
agtaataaattttactccca

SEQ ID NO: 248943 - DNA, 20 bp, Artificial Sequence
  Description of Artificial Sequence: Synthetic oligonucleotide
  Target: ATXN1; (+) strand; PAM type: YTN; PAM sequence: TTT
tactcccagaagattacact

SEQ ID NO: 248944 - DNA, 20 bp, Artificial Sequence
  Description of Artificial Sequence: Synthetic oligonucleotide
  Target: ATXN1; (+) strand; PAM type: YTN; PAM sequence: TTT
actcccagaagattacactg

SEQ ID NO: 248945 - DNA, 20 bp, Artificial Sequence
  Description of Artificial Sequence: Synthetic oligonucleotide
  Target: ATXN1; (+) strand; PAM type: YTN; PAM sequence: TTA
ctcccagaagattacactgt

SEQ ID NO: 248946 - DNA, 20 bp, Artificial Sequence
  Description of Artificial Sequence: Synthetic oligonucleotide
  Target: ATXN1; (+) strand; PAM type: YTN; PAM sequence: CTC
ccagaagattacactgtcct

SEQ ID NO: 248947 - DNA, 20 bp, Artificial Sequence
  Description of Artificial Sequence: Synthetic oligonucleotide
  Target: ATXN1; (+) strand; PAM type: YTN; PAM sequence: TTA
cactgtcctctctcttccca

SEQ ID NO: 248948 - DNA, 20 bp, Artificial Sequence
  Description of Artificial Sequence: Synthetic oligonucleotide
  Target: ATXN1; (+) strand; PAM type: YTN; PAM sequence: CTG
tcctctctcttcccaaactt

SEQ ID NO: 248949 - DNA, 20 bp, Artificial Sequence
  Description of Artificial Sequence: Synthetic oligonucleotide
  Target: ATXN1; (+) strand; PAM type: YTN; PAM sequence: CTC
tctcttcccaaacttctcct

SEQ ID NO: 248950 - DNA, 20 bp, Artificial Sequence
  Description of Artificial Sequence: Synthetic oligonucleotide
  Target: ATXN1; (+) strand; PAM type: YTN; PAM sequence: CTC
tcttcccaaacttctcctcc

SEQ ID NO: 248951 - DNA, 20 bp, Artificial Sequence
  Description of Artificial Sequence: Synthetic oligonucleotide
  Target: ATXN1; (+) strand; PAM type: YTN; PAM sequence: CTC
ttcccaaacttctcctcctc

SEQ ID NO: 248952 - DNA, 20 bp, Artificial Sequence
  Description of Artificial Sequence: Synthetic oligonucleotide
  Target: ATXN1; (+) strand; PAM type: YTN; PAM sequence: CTT
cccaaacttctcctcctcct

SEQ ID NO: 248953 - DNA, 20 bp, Artificial Sequence
  Description of Artificial Sequence: Synthetic oligonucleotide
  Target: ATXN1; (+) strand; PAM type: YTN; PAM sequence: TTC
ccaaacttctcctcctccta

SEQ ID NO: 248954 - DNA, 20 bp, Artificial Sequence
  Description of Artificial Sequence: Synthetic oligonucleotide
  Target: ATXN1; (+) strand; PAM type: YTN; PAM sequence: CTT
ctcctcctcctacaatcccc

SEQ ID NO: 248955 - DNA, 20 bp, Artificial Sequence
  Description of Artificial Sequence: Synthetic oligonucleotide
  Target: ATXN1; (+) strand; PAM type: YTN; PAM sequence: TTC
tcctcctcctacaatccccc

SEQ ID NO: 248956 - DNA, 20 bp, Artificial Sequence
  Description of Artificial Sequence: Synthetic oligonucleotide
  Target: ATXN1; (+) strand; PAM type: YTN; PAM sequence: CTC
ctcctcctacaatcccccag

SEQ ID NO: 248957 - DNA, 20 bp, Artificial Sequence
  Description of Artificial Sequence: Synthetic oligonucleotide
  Target: ATXN1; (+) strand; PAM type: YTN; PAM sequence: CTC
ctcctacaatcccccagttg

SEQ ID NO: 248958 - DNA, 20 bp, Artificial Sequence
  Description of Artificial Sequence: Synthetic oligonucleotide
  Target: ATXN1; (+) strand; PAM type: YTN; PAM sequence: CTC
ctacaatcccccagttgttt

SEQ ID NO: 248959 - DNA, 20 bp, Artificial Sequence
  Description of Artificial Sequence: Synthetic oligonucleotide
  Target: ATXN1; (+) strand; PAM type: YTN; PAM sequence: CTA
caatcccccagttgttttaa

SEQ ID NO: 248960 - DNA, 20 bp, Artificial Sequence
  Description of Artificial Sequence: Synthetic oligonucleotide
  Target: ATXN1; (+) strand; PAM type: YTN; PAM sequence: TTG
ttttaatgtcagatgcataa

SEQ ID NO: 248961 - DNA, 20 bp, Artificial Sequence
  Description of Artificial Sequence: Synthetic oligonucleotide
  Target: ATXN1; (+) strand; PAM type: YTN; PAM sequence: TTT
taatgtcagatgcataattc

SEQ ID NO: 248962 - DNA, 20 bp, Artificial Sequence
  Description of Artificial Sequence: Synthetic oligonucleotide
  Target: ATXN1; (+) strand; PAM type: YTN; PAM sequence: TTT
aatgtcagatgcataattca

SEQ ID NO: 248963 - DNA, 20 bp, Artificial Sequence
  Description of Artificial Sequence: Synthetic oligonucleotide
  Target: ATXN1; (+) strand; PAM type: YTN; PAM sequence: TTA
atgtcagatgcataattcag

SEQ ID NO: 248964 - DNA, 20 bp, Artificial Sequence
  Description of Artificial Sequence: Synthetic oligonucleotide
  Target: ATXN1; (+) strand; PAM type: YTN; PAM sequence: TTC
agttgtctggcttgaactca

SEQ ID NO: 248965 - DNA, 20 bp, Artificial Sequence
  Description of Artificial Sequence: Synthetic oligonucleotide
  Target: ATXN1; (+) strand; PAM type: YTN; PAM sequence: TTG
tctggcttgaactcattatg

SEQ ID NO: 248966 - DNA, 20 bp, Artificial Sequence
  Description of Artificial Sequence: Synthetic oligonucleotide
  Target: ATXN1; (+) strand; PAM type: YTN; PAM sequence: CTG
gcttgaactcattatgggaa

SEQ ID NO: 248967 - DNA, 20 bp, Artificial Sequence
  Description of Artificial Sequence: Synthetic oligonucleotide
  Target: ATXN1; (+) strand; PAM type: YTN; PAM sequence: CTT
gaactcattatgggaatcat

SEQ ID NO: 248968 - DNA, 20 bp, Artificial Sequence
  Description of Artificial Sequence: Synthetic oligonucleotide
  Target: ATXN1; (+) strand; PAM type: YTN; PAM sequence: TTG
aactcattatgggaatcatt

SEQ ID NO: 248969 - DNA, 20 bp, Artificial Sequence
  Description of Artificial Sequence: Synthetic oligonucleotide
  Target: ATXN1; (+) strand; PAM type: YTN; PAM sequence: CTC
attatgggaatcattacatt

SEQ ID NO: 248970 - DNA, 20 bp, Artificial Sequence
  Description of Artificial Sequence: Synthetic oligonucleotide
  Target: ATXN1; (+) strand; PAM type: YTN; PAM sequence: TTA
tgggaatcattacatttgat

SEQ ID NO: 248971 - DNA, 20 bp, Artificial Sequence
  Description of Artificial Sequence: Synthetic oligonucleotide
  Target: ATXN1; (+) strand; PAM type: YTN; PAM sequence: TTA
catttgattttcctgtgagg

SEQ ID NO: 248972 - DNA, 20 bp, Artificial Sequence
  Description of Artificial Sequence: Synthetic oligonucleotide
  Target: ATXN1; (+) strand; PAM type: YTN; PAM sequence: TTT
gattttcctgtgaggccagc

SEQ ID NO: 248973 - DNA, 20 bp, Artificial Sequence
  Description of Artificial Sequence: Synthetic oligonucleotide
  Target: ATXN1; (+) strand; PAM type: YTN; PAM sequence: TTG
attttcctgtgaggccagcc

SEQ ID NO: 248974 - DNA, 20 bp, Artificial Sequence
  Description of Artificial Sequence: Synthetic oligonucleotide
  Target: ATXN1; (+) strand; PAM type: YTN; PAM sequence: TTT
tcctgtgaggccagccttga

SEQ ID NO: 248975 - DNA, 20 bp, Artificial Sequence
  Description of Artificial Sequence: Synthetic oligonucleotide
  Target: ATXN1; (+) strand; PAM type: YTN; PAM sequence: TTT
cctgtgaggccagccttgac

SEQ ID NO: 248976 - DNA, 20 bp, Artificial Sequence
  Description of Artificial Sequence: Synthetic oligonucleotide
  Target: ATXN1; (+) strand; PAM type: YTN; PAM sequence: TTC
ctgtgaggccagccttgact

SEQ ID NO: 248977 - DNA, 20 bp, Artificial Sequence
  Description of Artificial Sequence: Synthetic oligonucleotide
  Target: ATXN1; (+) strand; PAM type: YTN; PAM sequence: CTG
tgaggccagccttgactgag

SEQ ID NO: 248978 - DNA, 20 bp, Artificial Sequence
  Description of Artificial Sequence: Synthetic oligonucleotide
  Target: ATXN1; (+) strand; PAM type: YTN; PAM sequence: CTT
gactgagggtcttctgattc

SEQ ID NO: 248979 - DNA, 20 bp, Artificial Sequence
  Description of Artificial Sequence: Synthetic oligonucleotide
  Target: ATXN1; (+) strand; PAM type: YTN; PAM sequence: TTG
actgagggtcttctgattct

SEQ ID NO: 248980 - DNA, 20 bp, Artificial Sequence
  Description of Artificial Sequence: Synthetic oligonucleotide
  Target: ATXN1; (+) strand; PAM type: YTN; PAM sequence: CTG
agggtcttctgattctaaat

SEQ ID NO: 248981 - DNA, 20 bp, Artificial Sequence
  Description of Artificial Sequence: Synthetic oligonucleotide
  Target: ATXN1; (+) strand; PAM type: YTN; PAM sequence: CTT
ctgattctaaatggtcaatg

SEQ ID NO: 248982 - DNA, 20 bp, Artificial Sequence
  Description of Artificial Sequence: Synthetic oligonucleotide
  Target: ATXN1; (+) strand; PAM type: YTN; PAM sequence: TTC
tgattctaaatggtcaatgt

SEQ ID NO: 248983 - DNA, 20 bp, Artificial Sequence
  Description of Artificial Sequence: Synthetic oligonucleotide
  Target: ATXN1; (+) strand; PAM type: YTN; PAM sequence: CTG
attctaaatggtcaatgttt

SEQ ID NO: 248984 - DNA, 20 bp, Artificial Sequence
  Description of Artificial Sequence: Synthetic oligonucleotide
  Target: ATXN1; (+) strand; PAM type: YTN; PAM sequence: TTC
taaatggtcaatgtttctgt

SEQ ID NO: 248985 - DNA, 20 bp, Artificial Sequence
  Description of Artificial Sequence: Synthetic oligonucleotide
  Target: ATXN1; (+) strand; PAM type: YTN; PAM sequence: CTA
aatggtcaatgtttctgtag

SEQ ID NO: 248986 - DNA, 20 bp, Artificial Sequence
  Description of Artificial Sequence: Synthetic oligonucleotide
  Target: ATXN1; (+) strand; PAM type: YTN; PAM sequence: TTT
ctgtagtgtcaggaatcatt

SEQ ID NO: 248987 - DNA, 20 bp, Artificial Sequence
  Description of Artificial Sequence: Synthetic oligonucleotide
  Target: ATXN1; (+) strand; PAM type: YTN; PAM sequence: TTC
tgtagtgtcaggaatcattc

SEQ ID NO: 248988 - DNA, 20 bp, Artificial Sequence
  Description of Artificial Sequence: Synthetic oligonucleotide
  Target: ATXN1; (+) strand; PAM type: YTN; PAM sequence: CTG
tagtgtcaggaatcattctc

SEQ ID NO: 248989 - DNA, 20 bp, Artificial Sequence
  Description of Artificial Sequence: Synthetic oligonucleotide
  Target: ATXN1; (+) strand; PAM type: YTN; PAM sequence: TTC
tctgaaaatgcttcaccttc

SEQ ID NO: 248990 - DNA, 20 bp, Artificial Sequence
  Description of Artificial Sequence: Synthetic oligonucleotide
  Target: ATXN1; (+) strand; PAM type: YTN; PAM sequence: CTC
tgaaaatgcttcaccttctt

SEQ ID NO: 248991 - DNA, 20 bp, Artificial Sequence
  Description of Artificial Sequence: Synthetic oligonucleotide
  Target: ATXN1; (+) strand; PAM type: YTN; PAM sequence: CTG
aaaatgcttcaccttcttga

SEQ ID NO: 248992 - DNA, 20 bp, Artificial Sequence
  Description of Artificial Sequence: Synthetic oligonucleotide
  Target: ATXN1; (+) strand; PAM type: YTN; PAM sequence: CTT
caccttcttgaggctgtggg

SEQ ID NO: 248993 - DNA, 20 bp, Artificial Sequence
  Description of Artificial Sequence: Synthetic oligonucleotide
  Target: ATXN1; (+) strand; PAM type: YTN; PAM sequence: TTC
accttcttgaggctgtgggc

SEQ ID NO: 248994 - DNA, 20 bp, Artificial Sequence
  Description of Artificial Sequence: Synthetic oligonucleotide
  Target: ATXN1; (+) strand; PAM type: YTN; PAM sequence: CTT
cttgaggctgtgggcatgtg

SEQ ID NO: 248995 - DNA, 20 bp, Artificial Sequence
  Description of Artificial Sequence: Synthetic oligonucleotide
  Target: ATXN1; (+) strand; PAM type: YTN; PAM sequence: TTC
ttgaggctgtgggcatgtgg

SEQ ID NO: 248996 - DNA, 20 bp, Artificial Sequence
  Description of Artificial Sequence: Synthetic oligonucleotide
  Target: ATXN1; (+) strand; PAM type: YTN; PAM sequence: CTT
gaggctgtgggcatgtggcc

SEQ ID NO: 248997 - DNA, 20 bp, Artificial Sequence
  Description of Artificial Sequence: Synthetic oligonucleotide
  Target: ATXN1; (+) strand; PAM type: YTN; PAM sequence: TTG
aggctgtgggcatgtggcca

SEQ ID NO: 248998 - DNA, 20 bp, Artificial Sequence
  Description of Artificial Sequence: Synthetic oligonucleotide
  Target: ATXN1; (+) strand; PAM type: YTN; PAM sequence: CTG
tgggcatgtggccatatgaa

SEQ ID NO: 248999 - DNA, 20 bp, Artificial Sequence
  Description of Artificial Sequence: Synthetic oligonucleotide
  Target: ATXN1; (+) strand; PAM type: YTN; PAM sequence: TTG
tgtgattatctggtgaaatt

SEQ ID NO: 249000 - DNA, 20 bp, Artificial Sequence
  Description of Artificial Sequence: Synthetic oligonucleotide
  Target: ATXN1; (+) strand; PAM type: YTN; PAM sequence: TTA
tctggtgaaattgggggact

SEQ ID NO: 249001 - DNA, 20 bp, Artificial Sequence
  Description of Artificial Sequence: Synthetic oligonucleotide
  Target: ATXN1; (+) strand; PAM type: YTN; PAM sequence: CTG
gtgaaattgggggactcctc

SEQ ID NO: 249002 - DNA, 20 bp, Artificial Sequence
  Description of Artificial Sequence: Synthetic oligonucleotide
  Target: ATXN1; (+) strand; PAM type: YTN; PAM sequence: TTG
ggggactcctcatccagcga

SEQ ID NO: 249003 - DNA, 20 bp, Artificial Sequence
  Description of Artificial Sequence: Synthetic oligonucleotide
  Target: ATXN1; (+) strand; PAM type: YTN; PAM sequence: CTC
ctcatccagcgaactaggag

SEQ ID NO: 249004 - DNA, 20 bp, Artificial Sequence
  Description of Artificial Sequence: Synthetic oligonucleotide
  Target: ATXN1; (+) strand; PAM type: YTN; PAM sequence: CTC
atccagcgaactaggaggtt

SEQ ID NO: 249005 - DNA, 20 bp, Artificial Sequence
  Description of Artificial Sequence: Synthetic oligonucleotide
  Target: ATXN1; (+) strand; PAM type: YTN; PAM sequence: CTA
ggaggttctgtgtgttcctt

SEQ ID NO: 249006 - DNA, 20 bp, Artificial Sequence
  Description of Artificial Sequence: Synthetic oligonucleotide
  Target: ATXN1; (+) strand; PAM type: YTN; PAM sequence: TTC
tgtgtgttccttcacctgaa

SEQ ID NO: 249007 - DNA, 20 bp, Artificial Sequence
  Description of Artificial Sequence: Synthetic oligonucleotide
  Target: ATXN1; (+) strand; PAM type: YTN; PAM sequence: CTG
tgtgttccttcacctgaatt

SEQ ID NO: 249008 - DNA, 20 bp, Artificial Sequence
  Description of Artificial Sequence: Synthetic oligonucleotide
  Target: ATXN1; (+) strand; PAM type: YTN; PAM sequence: TTC
cttcacctgaattgctgggt

SEQ ID NO: 249009 - DNA, 20 bp, Artificial Sequence
  Description of Artificial Sequence: Synthetic oligonucleotide
  Target: ATXN1; (+) strand; PAM type: YTN; PAM sequence: CTT
cacctgaattgctgggtctg

SEQ ID NO: 249010 - DNA, 20 bp, Artificial Sequence
  Description of Artificial Sequence: Synthetic oligonucleotide
  Target: ATXN1; (+) strand; PAM type: YTN; PAM sequence: TTC
acctgaattgctgggtctga

SEQ ID NO: 249011 - DNA, 20 bp, Artificial Sequence
  Description of Artificial Sequence: Synthetic oligonucleotide
  Target: ATXN1; (+) strand; PAM type: YTN; PAM sequence: CTG
aattgctgggtctgacgtgt

SEQ ID NO: 249012 - DNA, 20 bp, Artificial Sequence
  Description of Artificial Sequence: Synthetic oligonucleotide
  Target: ATXN1; (+) strand; PAM type: YTN; PAM sequence: TTG
ctgggtctgacgtgtggatg

SEQ ID NO: 249013 - DNA, 20 bp, Artificial Sequence
  Description of Artificial Sequence: Synthetic oligonucleotide
  Target: ATXN1; (+) strand; PAM type: YTN; PAM sequence: CTG
ggtctgacgtgtggatggcc

SEQ ID NO: 249014 - DNA, 20 bp, Artificial Sequence
  Description of Artificial Sequence: Synthetic oligonucleotide
  Target: ATXN1; (+) strand; PAM type: YTN; PAM sequence: CTG
acgtgtggatggcctttgtt

SEQ ID NO: 249015 - DNA, 20 bp, Artificial Sequence
  Description of Artificial Sequence: Synthetic oligonucleotide
  Target: ATXN1; (+) strand; PAM type: YTN; PAM sequence: CTT
tgttcccttgctgggtgagc

SEQ ID NO: 249016 - DNA, 20 bp, Artificial Sequence
  Description of Artificial Sequence: Synthetic oligonucleotide
  Target: ATXN1; (+) strand; PAM type: YTN; PAM sequence: TTT
gttcccttgctgggtgagcc

SEQ ID NO: 249017 - DNA, 20 bp, Artificial Sequence
  Description of Artificial Sequence: Synthetic oligonucleotide
  Target: ATXN1; (+) strand; PAM type: YTN; PAM sequence: TTG
ttcccttgctgggtgagccg

SEQ ID NO: 249018 - DNA, 20 bp, Artificial Sequence
  Description of Artificial Sequence: Synthetic oligonucleotide
  Target: ATXN1; (+) strand; PAM type: YTN; PAM sequence: TTC
ccttgctgggtgagccgggt

SEQ ID NO: 249019 - DNA, 20 bp, Artificial Sequence
  Description of Artificial Sequence: Synthetic oligonucleotide
  Target: ATXN1; (+) strand; PAM type: YTN; PAM sequence: CTT
gctgggtgagccgggtcagc

SEQ ID NO: 249020 - DNA, 20 bp, Artificial Sequence
  Description of Artificial Sequence: Synthetic oligonucleotide
  Target: ATXN1; (+) strand; PAM type: YTN; PAM sequence: TTG
ctgggtgagccgggtcagcc

SEQ ID NO: 249021 - DNA, 20 bp, Artificial Sequence
  Description of Artificial Sequence: Synthetic oligonucleotide
  Target: ATXN1; (+) strand; PAM type: YTN; PAM sequence: CTG
ggtgagccgggtcagccctg

SEQ ID NO: 249022 - DNA, 20 bp, Artificial Sequence
  Description of Artificial Sequence: Synthetic oligonucleotide
  Target: ATXN1; (+) strand; PAM type: YTN; PAM sequence: CTG
ctgtgtcttgtcataactgt

SEQ ID NO: 249023 - DNA, 20 bp, Artificial Sequence
  Description of Artificial Sequence: Synthetic oligonucleotide
  Target: ATXN1; (+) strand; PAM type: YTN; PAM sequence: CTG
tgtcttgtcataactgtaga

SEQ ID NO: 249024 - DNA, 20 bp, Artificial Sequence
  Description of Artificial Sequence: Synthetic oligonucleotide
  Target: ATXN1; (+) strand; PAM type: YTN; PAM sequence: CTT
gtcataactgtagacattcc

SEQ ID NO: 249025 - DNA, 20 bp, Artificial Sequence
  Description of Artificial Sequence: Synthetic oligonucleotide
  Target: ATXN1; (+) strand; PAM type: YTN; PAM sequence: TTG
tcataactgtagacattccg

SEQ ID NO: 249026 - DNA, 20 bp, Artificial Sequence
  Description of Artificial Sequence: Synthetic oligonucleotide
  Target: ATXN1; (+) strand; PAM type: YTN; PAM sequence: CTG
tagacattccgtaactggtg

SEQ ID NO: 249027 - DNA, 20 bp, Artificial Sequence
  Description of Artificial Sequence: Synthetic oligonucleotide
  Target: ATXN1; (+) strand; PAM type: YTN; PAM sequence: TTC
cgtaactggtgttcatgtaa

SEQ ID NO: 249028 - DNA, 20 bp, Artificial Sequence
  Description of Artificial Sequence: Synthetic oligonucleotide
  Target: ATXN1; (+) strand; PAM type: YTN; PAM sequence: CTG
gtgttcatgtaactgctgga

SEQ ID NO: 249029 - DNA, 20 bp, Artificial Sequence
  Description of Artificial Sequence: Synthetic oligonucleotide
  Target: ATXN1; (+) strand; PAM type: YTN; PAM sequence: TTC
atgtaactgctggagcttgc

SEQ ID NO: 249030 - DNA, 20 bp, Artificial Sequence
  Description of Artificial Sequence: Synthetic oligonucleotide
  Target: ATXN1; (+) strand; PAM type: YTN; PAM sequence: CTG
ctggagcttgcttcaaacca

SEQ ID NO: 249031 - DNA, 20 bp, Artificial Sequence
  Description of Artificial Sequence: Synthetic oligonucleotide
  Target: ATXN1; (+) strand; PAM type: YTN; PAM sequence: CTG
gagcttgcttcaaaccaagg

SEQ ID NO: 249032 - DNA, 20 bp, Artificial Sequence
  Description of Artificial Sequence: Synthetic oligonucleotide
  Target: ATXN1; (+) strand; PAM type: YTN; PAM sequence: CTT
gcttcaaaccaaggcagaaa

SEQ ID NO: 249033 - DNA, 20 bp, Artificial Sequence
  Description of Artificial Sequence: Synthetic oligonucleotide
  Target: ATXN1; (+) strand; PAM type: YTN; PAM sequence: TTG
cttcaaaccaaggcagaaac

SEQ ID NO: 249034 - DNA, 20 bp, Artificial Sequence
  Description of Artificial Sequence: Synthetic oligonucleotide
  Target: ATXN1; (+) strand; PAM type: YTN; PAM sequence: CTT
caaaccaaggcagaaacccg

SEQ ID NO: 249035 - DNA, 20 bp, Artificial Sequence
  Description of Artificial Sequence: Synthetic oligonucleotide
  Target: ATXN1; (+) strand; PAM type: YTN; PAM sequence: TTC
aaaccaaggcagaaacccgt

SEQ ID NO: 249036 - DNA, 20 bp, Artificial Sequence
  Description of Artificial Sequence: Synthetic oligonucleotide
  Target: ATXN1; (+) strand; PAM type: YTN; PAM sequence: TTC
ttgccttcccctcacattaa

SEQ ID NO: 249037 - DNA, 20 bp, Artificial Sequence
  Description of Artificial Sequence: Synthetic oligonucleotide
  Target: ATXN1; (+) strand; PAM type: YTN; PAM sequence: CTT
gccttcccctcacattaacc

SEQ ID NO: 249038 - DNA, 20 bp, Artificial Sequence
  Description of Artificial Sequence: Synthetic oligonucleotide
  Target: ATXN1; (+) strand; PAM type: YTN; PAM sequence: TTG
ccttcccctcacattaacca

SEQ ID NO: 249039 - DNA, 20 bp, Artificial Sequence
  Description of Artificial Sequence: Synthetic oligonucleotide
  Target: ATXN1; (+) strand; PAM type: YTN; PAM sequence: CTT
cccctcacattaaccagttc

SEQ ID NO: 249040 - DNA, 20 bp, Artificial Sequence
  Description of Artificial Sequence: Synthetic oligonucleotide
  Target: ATXN1; (+) strand; PAM type: YTN; PAM sequence: TTC
ccctcacattaaccagttcg

SEQ ID NO: 249041 - DNA, 20 bp, Artificial Sequence
  Description of Artificial Sequence: Synthetic oligonucleotide
  Target: ATXN1; (+) strand; PAM type: YTN; PAM sequence: CTC
acattaaccagttcgtgact

SEQ ID NO: 249042 - DNA, 20 bp, Artificial Sequence
  Description of Artificial Sequence: Synthetic oligonucleotide
  Target: ATXN1; (+) strand; PAM type: YTN; PAM sequence: TTA
accagttcgtgactatggag

SEQ ID NO: 249043 - DNA, 20 bp, Artificial Sequence
  Description of Artificial Sequence: Synthetic oligonucleotide
  Target: ATXN1; (+) strand; PAM type: YTN; PAM sequence: TTC
gtgactatggagaaacaggg

SEQ ID NO: 249044 - DNA, 20 bp, Artificial Sequence
  Description of Artificial Sequence: Synthetic oligonucleotide
  Target: ATXN1; (+) strand; PAM type: YTN; PAM sequence: CTA
tggagaaacagggcaagtag

SEQ ID NO: 249045 - DNA, 20 bp, Artificial Sequence
  Description of Artificial Sequence: Synthetic oligonucleotide
  Target: ATXN1; (+) strand; PAM type: YTN; PAM sequence: CTC
ttgatctgactggacggatg

SEQ ID NO: 249046 - DNA, 20 bp, Artificial Sequence
  Description of Artificial Sequence: Synthetic oligonucleotide
  Target: ATXN1; (+) strand; PAM type: YTN; PAM sequence: CTT
gatctgactggacggatggc

SEQ ID NO: 249047 - DNA, 20 bp, Artificial Sequence
  Description of Artificial Sequence: Synthetic oligonucleotide
  Target: ATXN1; (+) strand; PAM type: YTN; PAM sequence: TTG
atctgactggacggatggct

SEQ ID NO: 249048 - DNA, 20 bp, Artificial Sequence
  Description of Artificial Sequence: Synthetic oligonucleotide
  Target: ATXN1; (+) strand; PAM type: YTN; PAM sequence: CTG
actggacggatggctttgga

SEQ ID NO: 249049 - DNA, 20 bp, Artificial Sequence
  Description of Artificial Sequence: Synthetic oligonucleotide
  Target: ATXN1; (+) strand; PAM type: YTN; PAM sequence: CTG
gacggatggctttggagacc

SEQ ID NO: 249050 - DNA, 20 bp, Artificial Sequence
  Description of Artificial Sequence: Synthetic oligonucleotide
  Target: ATXN1; (+) strand; PAM type: YTN; PAM sequence: CTT
tggagaccaggctctgaaga

SEQ ID NO: 249051 - DNA, 20 bp, Artificial Sequence
  Description of Artificial Sequence: Synthetic oligonucleotide
  Target: ATXN1; (+) strand; PAM type: YTN; PAM sequence: TTT
ggagaccaggctctgaagag

SEQ ID NO: 249052 - DNA, 20 bp, Artificial Sequence
  Description of Artificial Sequence: Synthetic oligonucleotide
  Target: ATXN1; (+) strand; PAM type: YTN; PAM sequence: TTG
gagaccaggctctgaagaga

SEQ ID NO: 249053 - DNA, 20 bp, Artificial Sequence
  Description of Artificial Sequence: Synthetic oligonucleotide
  Target: ATXN1; (+) strand; PAM type: YTN; PAM sequence: CTC
tgaagagatgcttgtaaaaa

SEQ ID NO: 249054 - DNA, 20 bp, Artificial Sequence
  Description of Artificial Sequence: Synthetic oligonucleotide
  Target: ATXN1; (+) strand; PAM type: YTN; PAM sequence: CTG
aagagatgcttgtaaaaatc

SEQ ID NO: 249055 - DNA, 20 bp, Artificial Sequence
  Description of Artificial Sequence: Synthetic oligonucleotide
  Target: ATXN1; (+) strand; PAM type: YTN; PAM sequence: CTT
gtaaaaatctggagcttaac

SEQ ID NO: 249056 - DNA, 20 bp, Artificial Sequence
  Description of Artificial Sequence: Synthetic oligonucleotide
  Target: ATXN1; (+) strand; PAM type: YTN; PAM sequence: TTG
taaaaatctggagcttaaca

SEQ ID NO: 249057 - DNA, 20 bp, Artificial Sequence
  Description of Artificial Sequence: Synthetic oligonucleotide
  Target: ATXN1; (+) strand; PAM type: YTN; PAM sequence: CTG
gagcttaacacaagaagctt

SEQ ID NO: 249058 - DNA, 20 bp, Artificial Sequence
  Description of Artificial Sequence: Synthetic oligonucleotide
  Target: ATXN1; (+) strand; PAM type: YTN; PAM sequence: CTT
aacacaagaagcttaaaaca

SEQ ID NO: 249059 - DNA, 20 bp, Artificial Sequence
  Description of Artificial Sequence: Synthetic oligonucleotide
  Target: ATXN1; (+) strand; PAM type: YTN; PAM sequence: TTA
acacaagaagcttaaaacaa

SEQ ID NO: 249060 - DNA, 20 bp, Artificial Sequence
  Description of Artificial Sequence: Synthetic oligonucleotide
  Target: ATXN1; (+) strand; PAM type: YTN; PAM sequence: CTT
aaaacaagaagctcctttaa

SEQ ID NO: 249061 - DNA, 20 bp, Artificial Sequence
  Description of Artificial Sequence: Synthetic oligonucleotide
  Target: ATXN1; (+) strand; PAM type: YTN; PAM sequence: TTA
aaacaagaagctcctttaag

SEQ ID NO: 249062 - DNA, 20 bp, Artificial Sequence
  Description of Artificial Sequence: Synthetic oligonucleotide
  Target: ATXN1; (+) strand; PAM type: YTN; PAM sequence: CTC
ctttaagtgttggagcttca

SEQ ID NO: 249063 - DNA, 20 bp, Artificial Sequence
  Description of Artificial Sequence: Synthetic oligonucleotide
  Target: ATXN1; (+) strand; PAM type: YTN; PAM sequence: CTT
taagtgttggagcttcagag

SEQ ID NO: 249064 - DNA, 20 bp, Artificial Sequence
  Description of Artificial Sequence: Synthetic oligonucleotide
  Target: ATXN1; (+) strand; PAM type: YTN; PAM sequence: TTT
aagtgttggagcttcagaga

SEQ ID NO: 249065 - DNA, 20 bp, Artificial Sequence
  Description of Artificial Sequence: Synthetic oligonucleotide
  Target: ATXN1; (+) strand; PAM type: YTN; PAM sequence: TTA
agtgttggagcttcagagaa

SEQ ID NO: 249066 - DNA, 20 bp, Artificial Sequence
  Description of Artificial Sequence: Synthetic oligonucleotide
  Target: ATXN1; (+) strand; PAM type: YTN; PAM sequence: TTG
gagcttcagagaaaggagcc

SEQ ID NO: 249067 - DNA, 20 bp, Artificial Sequence
  Description of Artificial Sequence: Synthetic oligonucleotide
  Target: ATXN1; (+) strand; PAM type: YTN; PAM sequence: CTT
cagagaaaggagccacgtta

SEQ ID NO: 249068 - DNA, 20 bp, Artificial Sequence
  Description of Artificial Sequence: Synthetic oligonucleotide
  Target: ATXN1; (+) strand; PAM type: YTN; PAM sequence: TTC
agagaaaggagccacgttac

SEQ ID NO: 249069 - DNA, 20 bp, Artificial Sequence
  Description of Artificial Sequence: Synthetic oligonucleotide
  Target: ATXN1; (+) strand; PAM type: YTN; PAM sequence: TTA
cccatttcagagcagggaga

SEQ ID NO: 249070 - DNA, 20 bp, Artificial Sequence
  Description of Artificial Sequence: Synthetic oligonucleotide
  Target: ATXN1; (+) strand; PAM type: YTN; PAM sequence: TTT
cagagcagggagattccaga

SEQ ID NO: 249071 - DNA, 20 bp, Artificial Sequence
  Description of Artificial Sequence: Synthetic oligonucleotide
  Target: ATXN1; (+) strand; PAM type: YTN; PAM sequence: TTC
agagcagggagattccagag

SEQ ID NO: 249072 - DNA, 20 bp, Artificial Sequence
  Description of Artificial Sequence: Synthetic oligonucleotide
  Target: ATXN1; (+) strand; PAM type: YTN; PAM sequence: TTC
cagagaagtcacctgggtgt

SEQ ID NO: 249073 - DNA, 20 bp, Artificial Sequence
  Description of Artificial Sequence: Synthetic oligonucleotide
  Target: ATXN1; (+) strand; PAM type: YTN; PAM sequence: CTG
ggtgtcggcttctgagcact

SEQ ID NO: 249074 - DNA, 20 bp, Artificial Sequence
  Description of Artificial Sequence: Synthetic oligonucleotide
  Target: ATXN1; (+) strand; PAM type: YTN; PAM sequence: CTT
ctgagcactgtcttctcacg

SEQ ID NO: 249075 - DNA, 20 bp, Artificial Sequence
  Description of Artificial Sequence: Synthetic oligonucleotide
  Target: ATXN1; (+) strand; PAM type: YTN; PAM sequence: TTC
tgagcactgtcttctcacgc

SEQ ID NO: 249076 - DNA, 20 bp, Artificial Sequence
  Description of Artificial Sequence: Synthetic oligonucleotide
  Target: ATXN1; (+) strand; PAM type: YTN; PAM sequence: CTG
agcactgtcttctcacgctc

SEQ ID NO: 249077 - DNA, 20 bp, Artificial Sequence
  Description of Artificial Sequence: Synthetic oligonucleotide
  Target: ATXN1; (+) strand; PAM type: YTN; PAM sequence: CTG
tcttctcacgctcacactcc

SEQ ID NO: 249078 - DNA, 20 bp, Artificial Sequence
  Description of Artificial Sequence: Synthetic oligonucleotide
  Target: ATXN1; (+) strand; PAM type: YTN; PAM sequence: CTT
ctcacgctcacactcctcct

SEQ ID NO: 249079 - DNA, 20 bp, Artificial Sequence
  Description of Artificial Sequence: Synthetic oligonucleotide
  Target: ATXN1; (+) strand; PAM type: YTN; PAM sequence: TTC
tcacgctcacactcctcctg

SEQ ID NO: 249080 - DNA, 20 bp, Artificial Sequence
  Description of Artificial Sequence: Synthetic oligonucleotide
  Target: ATXN1; (+) strand; PAM type: YTN; PAM sequence: CTC
acgctcacactcctcctgtt

SEQ ID NO: 249081 - DNA, 20 bp, Artificial Sequence
  Description of Artificial Sequence: Synthetic oligonucleotide
  Target: ATXN1; (+) strand; PAM type: YTN; PAM sequence: CTC
acactcctcctgttcctggc

SEQ ID NO: 249082 - DNA, 20 bp, Artificial Sequence
  Description of Artificial Sequence: Synthetic oligonucleotide
  Target: ATXN1; (+) strand; PAM type: YTN; PAM sequence: CTC
ctcctgttcctggcccccac

SEQ ID NO: 249083 - DNA, 20 bp, Artificial Sequence
  Description of Artificial Sequence: Synthetic oligonucleotide
  Target: ATXN1; (+) strand; PAM type: YTN; PAM sequence: CTC
ctgttcctggcccccaccct

SEQ ID NO: 249084 - DNA, 20 bp, Artificial Sequence
  Description of Artificial Sequence: Synthetic oligonucleotide
  Target: ATXN1; (+) strand; PAM type: YTN; PAM sequence: CTG
ttcctggcccccaccctccc

SEQ ID NO: 249085 - DNA, 20 bp, Artificial Sequence
  Description of Artificial Sequence: Synthetic oligonucleotide
  Target: ATXN1; (+) strand; PAM type: YTN; PAM sequence: TTC
ctggcccccaccctcccgct

SEQ ID NO: 249086 - DNA, 20 bp, Artificial Sequence
  Description of Artificial Sequence: Synthetic oligonucleotide
  Target: ATXN1; (+) strand; PAM type: YTN; PAM sequence: CTG
gcccccaccctcccgctctc

SEQ ID NO: 249087 - DNA, 20 bp, Artificial Sequence
  Description of Artificial Sequence: Synthetic oligonucleotide
  Target: ATXN1; (+) strand; PAM type: YTN; PAM sequence: CTC
ccgctctcagcagttacccc

SEQ ID NO: 249088 - DNA, 20 bp, Artificial Sequence
  Description of Artificial Sequence: Synthetic oligonucleotide
  Target: ATXN1; (+) strand; PAM type: YTN; PAM sequence: CTC
tcagcagttacccccattat

SEQ ID NO: 249089 - DNA, 20 bp, Artificial Sequence
  Description of Artificial Sequence: Synthetic oligonucleotide
  Target: ATXN1; (+) strand; PAM type: YTN; PAM sequence: CTC
agcagttacccccattatca

SEQ ID NO: 249090 - DNA, 20 bp, Artificial Sequence
  Description of Artificial Sequence: Synthetic oligonucleotide
  Target: ATXN1; (+) strand; PAM type: YTN; PAM sequence: TTA
cccccattatcaccatcatc

SEQ ID NO: 249091 - DNA, 20 bp, Artificial Sequence
  Description of Artificial Sequence: Synthetic oligonucleotide
  Target: ATXN1; (+) strand; PAM type: YTN; PAM sequence: TTA
tcaccatcatcacttcgctc

SEQ ID NO: 249092 - DNA, 20 bp, Artificial Sequence
  Description of Artificial Sequence: Synthetic oligonucleotide
  Target: ATXN1; (+) strand; PAM type: YTN; PAM sequence: CTT
cgctcccgcccggtccctct

SEQ ID NO: 249093 - DNA, 20 bp, Artificial Sequence
  Description of Artificial Sequence: Synthetic oligonucleotide
  Target: ATXN1; (+) strand; PAM type: YTN; PAM sequence: TTC
gctcccgcccggtccctctc

SEQ ID NO: 249094 - DNA, 20 bp, Artificial Sequence
  Description of Artificial Sequence: Synthetic oligonucleotide
  Target: ATXN1; (+) strand; PAM type: YTN; PAM sequence: CTC
ccgcccggtccctctcctgt

SEQ ID NO: 249095 - DNA, 20 bp, Artificial Sequence
  Description of Artificial Sequence: Synthetic oligonucleotide
  Target: ATXN1; (+) strand; PAM type: YTN; PAM sequence: CTC
tcctgtcatcacccccgctc

SEQ ID NO: 249096 - DNA, 20 bp, Artificial Sequence
  Description of Artificial Sequence: Synthetic oligonucleotide
  Target: ATXN1; (+) strand; PAM type: YTN; PAM sequence: CTC
ctgtcatcacccccgctccg

SEQ ID NO: 249097 - DNA, 20 bp, Artificial Sequence
  Description of Artificial Sequence: Synthetic oligonucleotide
  Target: ATXN1; (+) strand; PAM type: YTN; PAM sequence: CTG
tcatcacccccgctccggag

SEQ ID NO: 249098 - DNA, 20 bp, Artificial Sequence
  Description of Artificial Sequence: Synthetic oligonucleotide
  Target: ATXN1; (+) strand; PAM type: YTN; PAM sequence: CTC
cggagtgaaagaaaggagac

SEQ ID NO: 249099 - DNA, 20 bp, Artificial Sequence
  Description of Artificial Sequence: Synthetic oligonucleotide
  Target: ATXN1; (+) strand; PAM type: YTN; PAM sequence: CTT
accacggctcttcccaccag

SEQ ID NO: 249100 - DNA, 20 bp, Artificial Sequence
  Description of Artificial Sequence: Synthetic oligonucleotide
  Target: ATXN1; (+) strand; PAM type: YTN; PAM sequence: TTA
ccacggctcttcccaccagc

SEQ ID NO: 249101 - DNA, 20 bp, Artificial Sequence
  Description of Artificial Sequence: Synthetic oligonucleotide
  Target: ATXN1; (+) strand; PAM type: YTN; PAM sequence: CTC
ttcccaccagcagcaccagg

SEQ ID NO: 249102 - DNA, 20 bp, Artificial Sequence
  Description of Artificial Sequence: Synthetic oligonucleotide
  Target: ATXN1; (+) strand; PAM type: YTN; PAM sequence: CTT
cccaccagcagcaccaggaa

SEQ ID NO: 249103 - DNA, 20 bp, Artificial Sequence
  Description of Artificial Sequence: Synthetic oligonucleotide
  Target: ATXN1; (+) strand; PAM type: YTN; PAM sequence: TTC
ccaccagcagcaccaggaag

SEQ ID NO: 249104 - DNA, 20 bp, Artificial Sequence
  Description of Artificial Sequence: Synthetic oligonucleotide
  Target: ATXN1; (+) strand; PAM type: YTN; PAM sequence: CTG
ctactgccatttctatttaa

SEQ ID NO: 249105 - DNA, 20 bp, Artificial Sequence
  Description of Artificial Sequence: Synthetic oligonucleotide
  Target: ATXN1; (+) strand; PAM type: YTN; PAM sequence: CTA
ctgccatttctatttaaatg

SEQ ID NO: 249106 - DNA, 20 bp, Artificial Sequence
  Description of Artificial Sequence: Synthetic oligonucleotide
  Target: ATXN1; (+) strand; PAM type: YTN; PAM sequence: CTG
ccatttctatttaaatggat

SEQ ID NO: 249107 - DNA, 20 bp, Artificial Sequence
  Description of Artificial Sequence: Synthetic oligonucleotide
  Target: ATXN1; (+) strand; PAM type: YTN; PAM sequence: TTT
ctatttaaatggatagggat

SEQ ID NO: 249108 - DNA, 20 bp, Artificial Sequence
  Description of Artificial Sequence: Synthetic oligonucleotide
  Target: ATXN1; (+) strand; PAM type: YTN; PAM sequence: TTC
tatttaaatggatagggatg

SEQ ID NO: 249109 - DNA, 20 bp, Artificial Sequence
  Description of Artificial Sequence: Synthetic oligonucleotide
  Target: ATXN1; (+) strand; PAM type: YTN; PAM sequence: CTA
tttaaatggatagggatgtt

SEQ ID NO: 249110 - DNA, 20 bp, Artificial Sequence
  Description of Artificial Sequence: Synthetic oligonucleotide
  Target: ATXN1; (+) strand; PAM type: YTN; PAM sequence: TTT
aaatggatagggatgttggg

SEQ ID NO: 249111 - DNA, 20 bp, Artificial Sequence
  Description of Artificial Sequence: Synthetic oligonucleotide
  Target: ATXN1; (+) strand; PAM type: YTN; PAM sequence: TTA
aatggatagggatgttgggc

SEQ ID NO: 249112 - DNA, 20 bp, Artificial Sequence
  Description of Artificial Sequence: Synthetic oligonucleotide
  Target: ATXN1; (+) strand; PAM type: YTN; PAM sequence: TTG
ggcagagagacactttcgga

SEQ ID NO: 249113 - DNA, 20 bp, Artificial Sequence
  Description of Artificial Sequence: Synthetic oligonucleotide
  Target: ATXN1; (+) strand; PAM type: YTN; PAM sequence: CTT
tcggagcctgtaagtttaag

SEQ ID NO: 249114 - DNA, 20 bp, Artificial Sequence
  Description of Artificial Sequence: Synthetic oligonucleotide
  Target: ATXN1; (+) strand; PAM type: YTN; PAM sequence: TTT
cggagcctgtaagtttaagt

SEQ ID NO: 249115 - DNA, 20 bp, Artificial Sequence
  Description of Artificial Sequence: Synthetic oligonucleotide
  Target: ATXN1; (+) strand; PAM type: YTN; PAM sequence: TTC
ggagcctgtaagtttaagtg

SEQ ID NO: 249116 - DNA, 20 bp, Artificial Sequence
  Description of Artificial Sequence: Synthetic oligonucleotide
  Target: ATXN1; (+) strand; PAM type: YTN; PAM sequence: CTG
taagtttaagtgttcagatc

SEQ ID NO: 249117 - DNA, 20 bp, Artificial Sequence
  Description of Artificial Sequence: Synthetic oligonucleotide
  Target: ATXN1; (+) strand; PAM type: YTN; PAM sequence: TTT
aagtgttcagatcattcttt

SEQ ID NO: 249118 - DNA, 20 bp, Artificial Sequence
  Description of Artificial Sequence: Synthetic oligonucleotide
  Target: ATXN1; (+) strand; PAM type: YTN; PAM sequence: TTA
agtgttcagatcattctttg

SEQ ID NO: 249119 - DNA, 20 bp, Artificial Sequence
  Description of Artificial Sequence: Synthetic oligonucleotide
  Target: ATXN1; (+) strand; PAM type: YTN; PAM sequence: TTC
agatcattctttgcagaata

SEQ ID NO: 249120 - DNA, 20 bp, Artificial Sequence
  Description of Artificial Sequence: Synthetic oligonucleotide
  Target: ATXN1; (+) strand; PAM type: YTN; PAM sequence: TTC
tttgcagaatataatgtgaa

SEQ ID NO: 249121 - DNA, 20 bp, Artificial Sequence
  Description of Artificial Sequence: Synthetic oligonucleotide
  Target: ATXN1; (+) strand; PAM type: YTN; PAM sequence: CTT
tgcagaatataatgtgaaca

SEQ ID NO: 249122 - DNA, 20 bp, Artificial Sequence
  Description of Artificial Sequence: Synthetic oligonucleotide
  Target: ATXN1; (+) strand; PAM type: YTN; PAM sequence: TTT
gcagaatataatgtgaacat

SEQ ID NO: 249123 - DNA, 20 bp, Artificial Sequence
  Description of Artificial Sequence: Synthetic oligonucleotide
  Target: ATXN1; (+) strand; PAM type: YTN; PAM sequence: TTG
cagaatataatgtgaacatc

SEQ ID NO: 249124 - DNA, 20 bp, Artificial Sequence
  Description of Artificial Sequence: Synthetic oligonucleotide
  Target: ATXN1; (+) strand; PAM type: YTN; PAM sequence: CTT
gctcttgcttgtactgtaaa

SEQ ID NO: 249125 - DNA, 20 bp, Artificial Sequence
  Description of Artificial Sequence: Synthetic oligonucleotide
  Target: ATXN1; (+) strand; PAM type: YTN; PAM sequence: TTG
ctcttgcttgtactgtaaaa

SEQ ID NO: 249126 - DNA, 20 bp, Artificial Sequence
  Description of Artificial Sequence: Synthetic oligonucleotide
  Target: ATXN1; (+) strand; PAM type: YTN; PAM sequence: CTC
ttgcttgtactgtaaaaggt

SEQ ID NO: 249127 - DNA, 20 bp, Artificial Sequence
  Description of Artificial Sequence: Synthetic oligonucleotide
  Target: ATXN1; (+) strand; PAM type: YTN; PAM sequence: CTT
gcttgtactgtaaaaggttc

SEQ ID NO: 249128 - DNA, 20 bp, Artificial Sequence
  Description of Artificial Sequence: Synthetic oligonucleotide
  Target: ATXN1; (+) strand; PAM type: YTN; PAM sequence: TTG
cttgtactgtaaaaggttct

SEQ ID NO: 249129 - DNA, 20 bp, Artificial Sequence
  Description of Artificial Sequence: Synthetic oligonucleotide
  Target: ATXN1; (+) strand; PAM type: YTN; PAM sequence: CTT
gtactgtaaaaggttctcta

SEQ ID NO: 249130 - DNA, 20 bp, Artificial Sequence
  Description of Artificial Sequence: Synthetic oligonucleotide
  Target: ATXN1; (+) strand; PAM type: YTN; PAM sequence: TTG
tactgtaaaaggttctctat

SEQ ID NO: 249131 - DNA, 20 bp, Artificial Sequence
  Description of Artificial Sequence: Synthetic oligonucleotide
  Target: ATXN1; (+) strand; PAM type: YTN; PAM sequence: CTG
taaaaggttctctattcata

SEQ ID NO: 249132 - DNA, 20 bp, Artificial Sequence
  Description of Artificial Sequence: Synthetic oligonucleotide
  Target: ATXN1; (+) strand; PAM type: YTN; PAM sequence: TTC
tctattcatatagatgtgat

SEQ ID NO: 249133 - DNA, 20 bp, Artificial Sequence
  Description of Artificial Sequence: Synthetic oligonucleotide
  Target: ATXN1; (+) strand; PAM type: YTN; PAM sequence: CTC
tattcatatagatgtgatat

SEQ ID NO: 249134 - DNA, 20 bp, Artificial Sequence
  Description of Artificial Sequence: Synthetic oligonucleotide
  Target: ATXN1; (+) strand; PAM type: YTN; PAM sequence: CTA
ttcatatagatgtgatattc

SEQ ID NO: 249135 - DNA, 20 bp, Artificial Sequence
  Description of Artificial Sequence: Synthetic oligonucleotide
  Target: ATXN1; (+) strand; PAM type: YTN; PAM sequence: TTC
atatagatgtgatattcagt

SEQ ID NO: 249136 - DNA, 20 bp, Artificial Sequence
  Description of Artificial Sequence: Synthetic oligonucleotide
  Target: ATXN1; (+) strand; PAM type: YTN; PAM sequence: TTC
agtttatgtataggtttaca

SEQ ID NO: 249137 - DNA, 20 bp, Artificial Sequence
  Description of Artificial Sequence: Synthetic oligonucleotide
  Target: ATXN1; (+) strand; PAM type: YTN; PAM sequence: TTT
atgtataggtttacatttca

SEQ ID NO: 249138 - DNA, 20 bp, Artificial Sequence
  Description of Artificial Sequence: Synthetic oligonucleotide
  Target: ATXN1; (+) strand; PAM type: YTN; PAM sequence: TTA
tgtataggtttacatttcag

SEQ ID NO: 249139 - DNA, 20 bp, Artificial Sequence
  Description of Artificial Sequence: Synthetic oligonucleotide
  Target: ATXN1; (+) strand; PAM type: YTN; PAM sequence: TTT
acatttcagcactaaatctc

SEQ ID NO: 249140 - DNA, 20 bp, Artificial Sequence
  Description of Artificial Sequence: Synthetic oligonucleotide
  Target: ATXN1; (+) strand; PAM type: YTN; PAM sequence: TTA
catttcagcactaaatctcc

SEQ ID NO: 249141 - DNA, 20 bp, Artificial Sequence
  Description of Artificial Sequence: Synthetic oligonucleotide
  Target: ATXN1; (+) strand; PAM type: YTN; PAM sequence: TTT
cagcactaaatctcccaccc

SEQ ID NO: 249142 - DNA, 20 bp, Artificial Sequence
  Description of Artificial Sequence: Synthetic oligonucleotide
  Target: ATXN1; (+) strand; PAM type: YTN; PAM sequence: TTC
agcactaaatctcccaccca

SEQ ID NO: 249143 - DNA, 20 bp, Artificial Sequence
  Description of Artificial Sequence: Synthetic oligonucleotide
  Target: ATXN1; (+) strand; PAM type: YTN; PAM sequence: CTA
aatctcccacccactcatgt

SEQ ID NO: 249144 - DNA, 20 bp, Artificial Sequence
  Description of Artificial Sequence: Synthetic oligonucleotide
  Target: ATXN1; (+) strand; PAM type: YTN; PAM sequence: CTC
ccacccactcatgtcgcaaa

SEQ ID NO: 249145 - DNA, 20 bp, Artificial Sequence
  Description of Artificial Sequence: Synthetic oligonucleotide
  Target: ATXN1; (+) strand; PAM type: YTN; PAM sequence: CTC
atgtcgcaaacctttatgga

SEQ ID NO: 249146 - DNA, 20 bp, Artificial Sequence
  Description of Artificial Sequence: Synthetic oligonucleotide
  Target: ATXN1; (+) strand; PAM type: YTN; PAM sequence: CTT
tatggagtgcctactacata

SEQ ID NO: 249147 - DNA, 20 bp, Artificial Sequence
  Description of Artificial Sequence: Synthetic oligonucleotide
  Target: ATXN1; (+) strand; PAM type: YTN; PAM sequence: TTT
atggagtgcctactacatat

SEQ ID NO: 249148 - DNA, 20 bp, Artificial Sequence
  Description of Artificial Sequence: Synthetic oligonucleotide
  Target: ATXN1; (+) strand; PAM type: YTN; PAM sequence: TTA
tggagtgcctactacatatt

SEQ ID NO: 249149 - DNA, 20 bp, Artificial Sequence
  Description of Artificial Sequence: Synthetic oligonucleotide
  Target: ATXN1; (+) strand; PAM type: YTN; PAM sequence: CTA
ctacatattagtgatgagca

SEQ ID NO: 249150 - DNA, 20 bp, Artificial Sequence
  Description of Artificial Sequence: Synthetic oligonucleotide
  Target: ATXN1; (+) strand; PAM type: YTN; PAM sequence: CTA
catattagtgatgagcagta

SEQ ID NO: 249151 - DNA, 20 bp, Artificial Sequence
  Description of Artificial Sequence: Synthetic oligonucleotide
  Target: ATXN1; (+) strand; PAM type: YTN; PAM sequence: TTA
gtgatgagcagtaggaataa

SEQ ID NO: 249152 - DNA, 20 bp, Artificial Sequence
  Description of Artificial Sequence: Synthetic oligonucleotide
  Target: ATXN1; (+) strand; PAM type: YTN; PAM sequence: CTA
atacctacaaagcactttca

SEQ ID NO: 249153 - DNA, 20 bp, Artificial Sequence
  Description of Artificial Sequence: Synthetic oligonucleotide
  Target: ATXN1; (+) strand; PAM type: YTN; PAM sequence: CTA
caaagcactttcagtctgct

SEQ ID NO: 249154 - DNA, 20 bp, Artificial Sequence
  Description of Artificial Sequence: Synthetic oligonucleotide
  Target: ATXN1; (+) strand; PAM type: YTN; PAM sequence: CTT
tcagtctgctagggctttgc

SEQ ID NO: 249155 - DNA, 20 bp, Artificial Sequence
  Description of Artificial Sequence: Synthetic oligonucleotide
  Target: ATXN1; (+) strand; PAM type: YTN; PAM sequence: TTT
cagtctgctagggctttgca

SEQ ID NO: 249156 - DNA, 20 bp, Artificial Sequence
  Description of Artificial Sequence: Synthetic oligonucleotide
  Target: ATXN1; (+) strand; PAM type: YTN; PAM sequence: TTC
agtctgctagggctttgcat

SEQ ID NO: 249157 - DNA, 20 bp, Artificial Sequence
  Description of Artificial Sequence: Synthetic oligonucleotide
  Target: ATXN1; (+) strand; PAM type: YTN; PAM sequence: CTG
ctagggctttgcatggagcc

SEQ ID NO: 249158 - DNA, 20 bp, Artificial Sequence
  Description of Artificial Sequence: Synthetic oligonucleotide
  Target: ATXN1; (+) strand; PAM type: YTN; PAM sequence: CTA
gggctttgcatggagccgct

SEQ ID NO: 249159 - DNA, 20 bp, Artificial Sequence
  Description of Artificial Sequence: Synthetic oligonucleotide
  Target: ATXN1; (+) strand; PAM type: YTN; PAM sequence: CTT
tgcatggagccgctcattta

SEQ ID NO: 249160 - DNA, 20 bp, Artificial Sequence
  Description of Artificial Sequence: Synthetic oligonucleotide
  Target: ATXN1; (+) strand; PAM type: YTN; PAM sequence: TTT
gcatggagccgctcatttaa

SEQ ID NO: 249161 - DNA, 20 bp, Artificial Sequence
  Description of Artificial Sequence: Synthetic oligonucleotide
  Target: ATXN1; (+) strand; PAM type: YTN; PAM sequence: TTG
catggagccgctcatttaag

SEQ ID NO: 249162 - DNA, 20 bp, Artificial Sequence
  Description of Artificial Sequence: Synthetic oligonucleotide
  Target: ATXN1; (+) strand; PAM type: YTN; PAM sequence: CTC
atttaagtaagcactcttct

SEQ ID NO: 249163 - DNA, 20 bp, Artificial Sequence
  Description of Artificial Sequence: Synthetic oligonucleotide
  Target: ATXN1; (+) strand; PAM type: YTN; PAM sequence: TTT
aagtaagcactcttctagtt

SEQ ID NO: 249164 - DNA, 20 bp, Artificial Sequence
  Description of Artificial Sequence: Synthetic oligonucleotide
  Target: ATXN1; (+) strand; PAM type: YTN; PAM sequence: TTA
agtaagcactcttctagttg

SEQ ID NO: 249165 - DNA, 20 bp, Artificial Sequence
  Description of Artificial Sequence: Synthetic oligonucleotide
  Target: ATXN1; (+) strand; PAM type: YTN; PAM sequence: CTC
ttctagttgccatgatacca

SEQ ID NO: 249166 - DNA, 20 bp, Artificial Sequence
  Description of Artificial Sequence: Synthetic oligonucleotide
  Target: ATXN1; (+) strand; PAM type: YTN; PAM sequence: CTT
ctagttgccatgataccatc

SEQ ID NO: 249167 - DNA, 20 bp, Artificial Sequence
  Description of Artificial Sequence: Synthetic oligonucleotide
  Target: ATXN1; (+) strand; PAM type: YTN; PAM sequence: TTC
tagttgccatgataccatct

SEQ ID NO: 249168 - DNA, 20 bp, Artificial Sequence
  Description of Artificial Sequence: Synthetic oligonucleotide
  Target: ATXN1; (+) strand; PAM type: YTN; PAM sequence: CTA
gttgccatgataccatctaa

SEQ ID NO: 249169 - DNA, 20 bp, Artificial Sequence
  Description of Artificial Sequence: Synthetic oligonucleotide
  Target: ATXN1; (+) strand; PAM type: YTN; PAM sequence: TTG
ccatgataccatctaattaa

SEQ ID NO: 249170 - DNA, 20 bp, Artificial Sequence
  Description of Artificial Sequence: Synthetic oligonucleotide
  Target: ATXN1; (+) strand; PAM type: YTN; PAM sequence: CTA
attaaatgaggtgcttcaca

SEQ ID NO: 249171 - DNA, 20 bp, Artificial Sequence
  Description of Artificial Sequence: Synthetic oligonucleotide
  Target: ATXN1; (+) strand; PAM type: YTN; PAM sequence: TTA
aatgaggtgcttcacagaca

SEQ ID NO: 249172 - DNA, 20 bp, Artificial Sequence
  Description of Artificial Sequence: Synthetic oligonucleotide
  Target: ATXN1; (+) strand; PAM type: YTN; PAM sequence: CTT
cacagacacaaatatacagc

SEQ ID NO: 249173 - DNA, 20 bp, Artificial Sequence
  Description of Artificial Sequence: Synthetic oligonucleotide
  Target: ATXN1; (+) strand; PAM type: YTN; PAM sequence: TTC
acagacacaaatatacagcg

SEQ ID NO: 249174 - DNA, 20 bp, Artificial Sequence
  Description of Artificial Sequence: Synthetic oligonucleotide
  Target: ATXN1; (+) strand; PAM type: YTN; PAM sequence: CTA
tatgtatgctgttcctttat

SEQ ID NO: 249175 - DNA, 20 bp, Artificial Sequence
  Description of Artificial Sequence: Synthetic oligonucleotide
  Target: ATXN1; (+) strand; PAM type: YTN; PAM sequence: CTG
ttcctttataacggaatctt

SEQ ID NO: 249176 - DNA, 20 bp, Artificial Sequence
  Description of Artificial Sequence: Synthetic oligonucleotide
  Target: ATXN1; (+) strand; PAM type: YTN; PAM sequence: TTC
ctttataacggaatcttccc

SEQ ID NO: 249177 - DNA, 20 bp, Artificial Sequence
  Description of Artificial Sequence: Synthetic oligonucleotide
  Target: ATXN1; (+) strand; PAM type: YTN; PAM sequence: CTT
tataacggaatcttccccat

SEQ ID NO: 249178 - DNA, 20 bp, Artificial Sequence
  Description of Artificial Sequence: Synthetic oligonucleotide
  Target: ATXN1; (+) strand; PAM type: YTN; PAM sequence: TTT
ataacggaatcttccccatt

SEQ ID NO: 249179 - DNA, 20 bp, Artificial Sequence
  Description of Artificial Sequence: Synthetic oligonucleotide
  Target: ATXN1; (+) strand; PAM type: YTN; PAM sequence: TTA
taacggaatcttccccattg

SEQ ID NO: 249180 - DNA, 20 bp, Artificial Sequence
  Description of Artificial Sequence: Synthetic oligonucleotide
  Target: ATXN1; (+) strand; PAM type: YTN; PAM sequence: CTT
ccccattgccatccctaccc

SEQ ID NO: 249181 - DNA, 20 bp, Artificial Sequence
  Description of Artificial Sequence: Synthetic oligonucleotide
  Target: ATXN1; (+) strand; PAM type: YTN; PAM sequence: TTC
cccattgccatccctaccct

SEQ ID NO: 249182 - DNA, 20 bp, Artificial Sequence
  Description of Artificial Sequence: Synthetic oligonucleotide
  Target: ATXN1; (+) strand; PAM type: YTN; PAM sequence: TTG
ccatccctaccctgcctact

SEQ ID NO: 249183 - DNA, 20 bp, Artificial Sequence
  Description of Artificial Sequence: Synthetic oligonucleotide
  Target: ATXN1; (+) strand; PAM type: YTN; PAM sequence: CTA
ccctgcctacttttctcaga

SEQ ID NO: 249184 - DNA, 20 bp, Artificial Sequence
  Description of Artificial Sequence: Synthetic oligonucleotide
  Target: ATXN1; (+) strand; PAM type: YTN; PAM sequence: CTG
cctacttttctcagatccct

SEQ ID NO: 249185 - DNA, 20 bp, Artificial Sequence
  Description of Artificial Sequence: Synthetic oligonucleotide
  Target: ATXN1; (+) strand; PAM type: YTN; PAM sequence: CTA
cttttctcagatcccttatc

SEQ ID NO: 249186 - DNA, 20 bp, Artificial Sequence
  Description of Artificial Sequence: Synthetic oligonucleotide
  Target: ATXN1; (+) strand; PAM type: YTN; PAM sequence: CTT
ttctcagatcccttatcatg

SEQ ID NO: 249187 - DNA, 20 bp, Artificial Sequence
  Description of Artificial Sequence: Synthetic oligonucleotide
  Target: ATXN1; (+) strand; PAM type: YTN; PAM sequence: TTT
tctcagatcccttatcatgt

SEQ ID NO: 249188 - DNA, 20 bp, Artificial Sequence
  Description of Artificial Sequence: Synthetic oligonucleotide
  Target: ATXN1; (+) strand; PAM type: YTN; PAM sequence: TTT
ctcagatcccttatcatgtt

SEQ ID NO: 249189 - DNA, 20 bp, Artificial Sequence
  Description of Artificial Sequence: Synthetic oligonucleotide
  Target: ATXN1; (+) strand; PAM type: YTN; PAM sequence: TTC
tcagatcccttatcatgtta

SEQ ID NO: 249190 - DNA, 20 bp, Artificial Sequence
  Description of Artificial Sequence: Synthetic oligonucleotide
  Target: ATXN1; (+) strand; PAM type: YTN; PAM sequence: CTC
agatcccttatcatgttatt

SEQ ID NO: 249191 - DNA, 20 bp, Artificial Sequence
  Description of Artificial Sequence: Synthetic oligonucleotide
  Target: ATXN1; (+) strand; PAM type: YTN; PAM sequence: CTT
atcatgttatttcaccccaa

SEQ ID NO: 249192 - DNA, 20 bp, Artificial Sequence
  Description of Artificial Sequence: Synthetic oligonucleotide
  Target: ATXN1; (+) strand; PAM type: YTN; PAM sequence: TTA
tcatgttatttcaccccaac

SEQ ID NO: 249193 - DNA, 20 bp, Artificial Sequence
  Description of Artificial Sequence: Synthetic oligonucleotide
  Target: ATXN1; (+) strand; PAM type: YTN; PAM sequence: TTA
tttcaccccaacagactttt

SEQ ID NO: 249194 - DNA, 20 bp, Artificial Sequence
  Description of Artificial Sequence: Synthetic oligonucleotide
  Target: ATXN1; (+) strand; PAM type: YTN; PAM sequence: TTT
caccccaacagactttttct

SEQ ID NO: 249195 - DNA, 20 bp, Artificial Sequence
  Description of Artificial Sequence: Synthetic oligonucleotide
  Target: ATXN1; (+) strand; PAM type: YTN; PAM sequence: TTC
accccaacagactttttctg

SEQ ID NO: 249196 - DNA, 20 bp, Artificial Sequence
  Description of Artificial Sequence: Synthetic oligonucleotide
  Target: ATXN1; (+) strand; PAM type: YTN; PAM sequence: CTT
tttctggaaaaatgattgct

SEQ ID NO: 249197 - DNA, 20 bp, Artificial Sequence
  Description of Artificial Sequence: Synthetic oligonucleotide
  Target: ATXN1; (+) strand; PAM type: YTN; PAM sequence: TTT
ttctggaaaaatgattgctt

SEQ ID NO: 249198 - DNA, 20 bp, Artificial Sequence
  Description of Artificial Sequence: Synthetic oligonucleotide
  Target: ATXN1; (+) strand; PAM type: YTN; PAM sequence: TTT
tctggaaaaatgattgctta

SEQ ID NO: 249199 - DNA, 20 bp, Artificial Sequence
  Description of Artificial Sequence: Synthetic oligonucleotide
  Target: ATXN1; (+) strand; PAM type: YTN; PAM sequence: TTT
ctggaaaaatgattgcttac

SEQ ID NO: 249200 - DNA, 20 bp, Artificial Sequence
  Description of Artificial Sequence: Synthetic oligonucleotide
  Target: ATXN1; (+) strand; PAM type: YTN; PAM sequence: TTC
tggaaaaatgattgcttact

SEQ ID NO: 249201 - DNA, 20 bp, Artificial Sequence
  Description of Artificial Sequence: Synthetic oligonucleotide
  Target: ATXN1; (+) strand; PAM type: YTN; PAM sequence: CTG
gaaaaatgattgcttactac

SEQ ID NO: 249202 - DNA, 20 bp, Artificial Sequence
  Description of Artificial Sequence: Synthetic oligonucleotide
  Target: ATXN1; (+) strand; PAM type: YTN; PAM sequence: TTG
cttactacatgtcagttggc

SEQ ID NO: 249203 - DNA, 20 bp, Artificial Sequence
  Description of Artificial Sequence: Synthetic oligonucleotide
  Target: ATXN1; (+) strand; PAM type: YTN; PAM sequence: CTT
actacatgtcagttggctgt

SEQ ID NO: 249204 - DNA, 20 bp, Artificial Sequence
  Description of Artificial Sequence: Synthetic oligonucleotide
  Target: ATXN1; (+) strand; PAM type: YTN; PAM sequence: TTA
ctacatgtcagttggctgtt

SEQ ID NO: 249205 - DNA, 20 bp, Artificial Sequence
  Description of Artificial Sequence: Synthetic oligonucleotide
  Target: ATXN1; (+) strand; PAM type: YTN; PAM sequence: CTA
catgtcagttggctgttcac

SEQ ID NO: 249206 - DNA, 20 bp, Artificial Sequence
  Description of Artificial Sequence: Synthetic oligonucleotide
  Target: ATXN1; (+) strand; PAM type: YTN; PAM sequence: TTG
gctgttcacagtttcagaaa

SEQ ID NO: 249207 - DNA, 20 bp, Artificial Sequence
  Description of Artificial Sequence: Synthetic oligonucleotide
  Target: ATXN1; (+) strand; PAM type: YTN; PAM sequence: CTG
ttcacagtttcagaaataca

SEQ ID NO: 249208 - DNA, 20 bp, Artificial Sequence
  Description of Artificial Sequence: Synthetic oligonucleotide
  Target: ATXN1; (+) strand; PAM type: YTN; PAM sequence: TTC
acagtttcagaaatacaagt

SEQ ID NO: 249209 - DNA, 20 bp, Artificial Sequence
  Description of Artificial Sequence: Synthetic oligonucleotide
  Target: ATXN1; (+) strand; PAM type: YTN; PAM sequence: TTT
cagaaatacaagtggagaaa

SEQ ID NO: 249210 - DNA, 20 bp, Artificial Sequence
  Description of Artificial Sequence: Synthetic oligonucleotide
  Target: ATXN1; (+) strand; PAM type: YTN; PAM sequence: TTC
agaaatacaagtggagaaac

SEQ ID NO: 249211 - DNA, 20 bp, Artificial Sequence
  Description of Artificial Sequence: Synthetic oligonucleotide
  Target: ATXN1; (+) strand; PAM type: YTN; PAM sequence: CTT
ggaaaacagcatctatcaac

SEQ ID NO: 249212 - DNA, 20 bp, Artificial Sequence
  Description of Artificial Sequence: Synthetic oligonucleotide
  Target: ATXN1; (+) strand; PAM type: YTN; PAM sequence: TTG
gaaaacagcatctatcaact

SEQ ID NO: 249213 - DNA, 20 bp, Artificial Sequence
  Description of Artificial Sequence: Synthetic oligonucleotide
  Target: ATXN1; (+) strand; PAM type: YTN; PAM sequence: CTA
tcaacttctagatctaagct

SEQ ID NO: 249214 - DNA, 20 bp, Artificial Sequence
  Description of Artificial Sequence: Synthetic oligonucleotide
  Target: ATXN1; (+) strand; PAM type: YTN; PAM sequence: CTT
ctagatctaagctctctgag

SEQ ID NO: 249215 - DNA, 20 bp, Artificial Sequence
  Description of Artificial Sequence: Synthetic oligonucleotide
  Target: ATXN1; (+) strand; PAM type: YTN; PAM sequence: TTC
tagatctaagctctctgaga

SEQ ID NO: 249216 - DNA, 20 bp, Artificial Sequence
  Description of Artificial Sequence: Synthetic oligonucleotide
  Target: ATXN1; (+) strand; PAM type: YTN; PAM sequence: CTA
gatctaagctctctgagagc

SEQ ID NO: 249217 - DNA, 20 bp, Artificial Sequence
  Description of Artificial Sequence: Synthetic oligonucleotide
  Target: ATXN1; (+) strand; PAM type: YTN; PAM sequence: CTA
agctctctgagagcaagaac

SEQ ID NO: 249218 - DNA, 20 bp, Artificial Sequence
  Description of Artificial Sequence: Synthetic oligonucleotide
  Target: ATXN1; (+) strand; PAM type: YTN; PAM sequence: CTC
tctgagagcaagaactatgt

SEQ ID NO: 249219 - DNA, 20 bp, Artificial Sequence
  Description of Artificial Sequence: Synthetic oligonucleotide
  Target: ATXN1; (+) strand; PAM type: YTN; PAM sequence: CTC
tgagagcaagaactatgttt

SEQ ID NO: 249220 - DNA, 20 bp, Artificial Sequence
  Description of Artificial Sequence: Synthetic oligonucleotide
  Target: ATXN1; (+) strand; PAM type: YTN; PAM sequence: CTG
agagcaagaactatgttttt

SEQ ID NO: 249221 - DNA, 20 bp, Artificial Sequence
  Description of Artificial Sequence: Synthetic oligonucleotide
  Target: ATXN1; (+) strand; PAM type: YTN; PAM sequence: CTA
tgttttttcttctccatcct

SEQ ID NO: 249222 - DNA, 20 bp, Artificial Sequence
  Description of Artificial Sequence: Synthetic oligonucleotide
  Target: ATXN1; (+) strand; PAM type: YTN; PAM sequence: TTT
tttcttctccatcctaaggc

SEQ ID NO: 249223 - DNA, 20 bp, Artificial Sequence
  Description of Artificial Sequence: Synthetic oligonucleotide
  Target: ATXN1; (+) strand; PAM type: YTN; PAM sequence: TTT
ttcttctccatcctaaggcc

SEQ ID NO: 249224 - DNA, 20 bp, Artificial Sequence
  Description of Artificial Sequence: Synthetic oligonucleotide
  Target: ATXN1; (+) strand; PAM type: YTN; PAM sequence: TTT
tcttctccatcctaaggccg

SEQ ID NO: 249225 - DNA, 20 bp, Artificial Sequence
  Description of Artificial Sequence: Synthetic oligonucleotide
  Target: ATXN1; (+) strand; PAM type: YTN; PAM sequence: TTT
cttctccatcctaaggccgt

SEQ ID NO: 249226 - DNA, 20 bp, Artificial Sequence
  Description of Artificial Sequence: Synthetic oligonucleotide
  Target: ATXN1; (+) strand; PAM type: YTN; PAM sequence: TTC
ttctccatcctaaggccgtg

SEQ ID NO: 249227 - DNA, 20 bp, Artificial Sequence
  Description of Artificial Sequence: Synthetic oligonucleotide
  Target: ATXN1; (+) strand; PAM type: YTN; PAM sequence: CTT
ctccatcctaaggccgtggc

SEQ ID NO: 249228 - DNA, 20 bp, Artificial Sequence
  Description of Artificial Sequence: Synthetic oligonucleotide
  Target: ATXN1; (+) strand; PAM type: YTN; PAM sequence: TTC
tccatcctaaggccgtggca

SEQ ID NO: 249229 - DNA, 20 bp, Artificial Sequence
  Description of Artificial Sequence: Synthetic oligonucleotide
  Target: ATXN1; (+) strand; PAM type: YTN; PAM sequence: CTC
catcctaaggccgtggcact

SEQ ID NO: 249230 - DNA, 20 bp, Artificial Sequence
  Description of Artificial Sequence: Synthetic oligonucleotide
  Target: ATXN1; (+) strand; PAM type: YTN; PAM sequence: CTA
aggccgtggcactgtgcctg

SEQ ID NO: 249231 - DNA, 20 bp, Artificial Sequence
  Description of Artificial Sequence: Synthetic oligonucleotide
  Target: ATXN1; (+) strand; PAM type: YTN; PAM sequence: CTG
tgcctgatacatatttgata

SEQ ID NO: 249232 - DNA, 20 bp, Artificial Sequence
  Description of Artificial Sequence: Synthetic oligonucleotide
  Target: ATXN1; (+) strand; PAM type: YTN; PAM sequence: CTG
atacatatttgataggtgca

SEQ ID NO: 249233 - DNA, 20 bp, Artificial Sequence
  Description of Artificial Sequence: Synthetic oligonucleotide
  Target: ATXN1; (+) strand; PAM type: YTN; PAM sequence: TTT
gataggtgcatgctaagtat

SEQ ID NO: 249234 - DNA, 20 bp, Artificial Sequence
  Description of Artificial Sequence: Synthetic oligonucleotide
  Target: ATXN1; (+) strand; PAM type: YTN; PAM sequence: TTG
ataggtgcatgctaagtatg

SEQ ID NO: 249235 - DNA, 20 bp, Artificial Sequence
  Description of Artificial Sequence: Synthetic oligonucleotide
  Target: ATXN1; (+) strand; PAM type: YTN; PAM sequence: CTA
agtatgtgttacataaatta

SEQ ID NO: 249236 - DNA, 20 bp, Artificial Sequence
  Description of Artificial Sequence: Synthetic oligonucleotide
  Target: ATXN1; (+) strand; PAM type: YTN; PAM sequence: TTA
cataaattaattccatgatg

SEQ ID NO: 249237 - DNA, 20 bp, Artificial Sequence
  Description of Artificial Sequence: Synthetic oligonucleotide
  Target: ATXN1; (+) strand; PAM type: YTN; PAM sequence: TTA
attccatgatgtgccatatg

SEQ ID NO: 249238 - DNA, 20 bp, Artificial Sequence
  Description of Artificial Sequence: Synthetic oligonucleotide
  Target: ATXN1; (+) strand; PAM type: YTN; PAM sequence: TTC
catgatgtgccatatgctaa

SEQ ID NO: 249239 - DNA, 20 bp, Artificial Sequence
  Description of Artificial Sequence: Synthetic oligonucleotide
  Target: ATXN1; (+) strand; PAM type: YTN; PAM sequence: CTA
atatcctgtctagtaataac

SEQ ID NO: 249240 - DNA, 20 bp, Artificial Sequence
  Description of Artificial Sequence: Synthetic oligonucleotide
  Target: ATXN1; (+) strand; PAM type: YTN; PAM sequence: CTG
tctagtaataactgctgagg

SEQ ID NO: 249241 - DNA, 20 bp, Artificial Sequence
  Description of Artificial Sequence: Synthetic oligonucleotide
  Target: ATXN1; (+) strand; PAM type: YTN; PAM sequence: CTA
gtaataactgctgaggactt

SEQ ID NO: 249242 - DNA, 20 bp, Artificial Sequence
  Description of Artificial Sequence: Synthetic oligonucleotide
  Target: ATXN1; (+) strand; PAM type: YTN; PAM sequence: CTG
ctgaggacttcagaatattt

SEQ ID NO: 249243 - DNA, 20 bp, Artificial Sequence
  Description of Artificial Sequence: Synthetic oligonucleotide
  Target: ATXN1; (+) strand; PAM type: YTN; PAM sequence: CTG
aggacttcagaatatttgct

SEQ ID NO: 249244 - DNA, 20 bp, Artificial Sequence
  Description of Artificial Sequence: Synthetic oligonucleotide
  Target: ATXN1; (+) strand; PAM type: YTN; PAM sequence: CTT
cagaatatttgctgaccagg

SEQ ID NO: 249245 - DNA, 20 bp, Artificial Sequence
  Description of Artificial Sequence: Synthetic oligonucleotide
  Target: ATXN1; (+) strand; PAM type: YTN; PAM sequence: TTC
agaatatttgctgaccaggt

SEQ ID NO: 249246 - DNA, 20 bp, Artificial Sequence
  Description of Artificial Sequence: Synthetic oligonucleotide
  Target: ATXN1; (+) strand; PAM type: YTN; PAM sequence: TTT
gctgaccaggttgtcctggt

SEQ ID NO: 249247 - DNA, 20 bp, Artificial Sequence
  Description of Artificial Sequence: Synthetic oligonucleotide
  Target: ATXN1; (+) strand; PAM type: YTN; PAM sequence: TTG
ctgaccaggttgtcctggtg

SEQ ID NO: 249248 - DNA, 20 bp, Artificial Sequence
  Description of Artificial Sequence: Synthetic oligonucleotide
  Target: ATXN1; (+) strand; PAM type: YTN; PAM sequence: CTG
accaggttgtcctggtgtct

SEQ ID NO: 249249 - DNA, 20 bp, Artificial Sequence
  Description of Artificial Sequence: Synthetic oligonucleotide
  Target: ATXN1; (+) strand; PAM type: YTN; PAM sequence: TTG
tcctggtgtctgatactcca

SEQ ID NO: 249250 - DNA, 20 bp, Artificial Sequence
  Description of Artificial Sequence: Synthetic oligonucleotide
  Target: ATXN1; (+) strand; PAM type: YTN; PAM sequence: CTG
gtgtctgatactccactgaa

SEQ ID NO: 249251 - DNA, 20 bp, Artificial Sequence
  Description of Artificial Sequence: Synthetic oligonucleotide
  Target: ATXN1; (+) strand; PAM type: YTN; PAM sequence: CTG
atactccactgaaggacaaa

SEQ ID NO: 249252 - DNA, 20 bp, Artificial Sequence
  Description of Artificial Sequence: Synthetic oligonucleotide
  Target: ATXN1; (+) strand; PAM type: YTN; PAM sequence: CTC
cactgaaggacaaaacaaaa

SEQ ID NO: 249253 - DNA, 20 bp, Artificial Sequence
  Description of Artificial Sequence: Synthetic oligonucleotide
  Target: ATXN1; (+) strand; PAM type: YTN; PAM sequence: CTG
aaggacaaaacaaaattgat

SEQ ID NO: 249254 - DNA, 20 bp, Artificial Sequence
  Description of Artificial Sequence: Synthetic oligonucleotide
  Target: ATXN1; (+) strand; PAM type: YTN; PAM sequence: TTG
atcattgattcaaggttcca

SEQ ID NO: 249255 - DNA, 20 bp, Artificial Sequence
  Description of Artificial Sequence: Synthetic oligonucleotide
  Target: ATXN1; (+) strand; PAM type: YTN; PAM sequence: TTG
attcaaggttccactaagag

SEQ ID NO: 249256 - DNA, 20 bp, Artificial Sequence
  Description of Artificial Sequence: Synthetic oligonucleotide
  Target: ATXN1; (+) strand; PAM type: YTN; PAM sequence: TTC
aaggttccactaagagtaaa

SEQ ID NO: 249257 - DNA, 20 bp, Artificial Sequence
  Description of Artificial Sequence: Synthetic oligonucleotide
  Target: ATXN1; (+) strand; PAM type: YTN; PAM sequence: TTC
cactaagagtaaataaagtg

SEQ ID NO: 249258 - DNA, 20 bp, Artificial Sequence
  Description of Artificial Sequence: Synthetic oligonucleotide
  Target: ATXN1; (+) strand; PAM type: YTN; PAM sequence: CTA
agagtaaataaagtgtgatg

SEQ ID NO: 249259 - DNA, 20 bp, Artificial Sequence
  Description of Artificial Sequence: Synthetic oligonucleotide
  Target: ATXN1; (+) strand; PAM type: YTN; PAM sequence: TTG
atgctctttgacatgaattg

SEQ ID NO: 249260 - DNA, 20 bp, Artificial Sequence
  Description of Artificial Sequence: Synthetic oligonucleotide
  Target: ATXN1; (+) strand; PAM type: YTN; PAM sequence: CTC
tttgacatgaattgatctgt

SEQ ID NO: 249261 - DNA, 20 bp, Artificial Sequence
  Description of Artificial Sequence: Synthetic oligonucleotide
  Target: ATXN1; (+) strand; PAM type: YTN; PAM sequence: CTT
tgacatgaattgatctgttc

SEQ ID NO: 249262 - DNA, 20 bp, Artificial Sequence
  Description of Artificial Sequence: Synthetic oligonucleotide
  Target: ATXN1; (+) strand; PAM type: YTN; PAM sequence: TTT
gacatgaattgatctgttca

SEQ ID NO: 249263 - DNA, 20 bp, Artificial Sequence
  Description of Artificial Sequence: Synthetic oligonucleotide
  Target: ATXN1; (+) strand; PAM type: YTN; PAM sequence: TTG
acatgaattgatctgttcag

SEQ ID NO: 249264 - DNA, 20 bp, Artificial Sequence
  Description of Artificial Sequence: Synthetic oligonucleotide
  Target: ATXN1; (+) strand; PAM type: YTN; PAM sequence: TTG
atctgttcagcacaatctaa

SEQ ID NO: 249265 - DNA, 20 bp, Artificial Sequence
  Description of Artificial Sequence: Synthetic oligonucleotide
  Target: ATXN1; (+) strand; PAM type: YTN; PAM sequence: CTG
ttcagcacaatctaaccaaa

SEQ ID NO: 249266 - DNA, 20 bp, Artificial Sequence
  Description of Artificial Sequence: Synthetic oligonucleotide
  Target: ATXN1; (+) strand; PAM type: YTN; PAM sequence: TTC
agcacaatctaaccaaagaa

SEQ ID NO: 249267 - DNA, 20 bp, Artificial Sequence
  Description of Artificial Sequence: Synthetic oligonucleotide
  Target: ATXN1; (+) strand; PAM type: YTN; PAM sequence: CTA
accaaagaacaaggcaaagt

SEQ ID NO: 249268 - DNA, 20 bp, Artificial Sequence
  Description of Artificial Sequence: Synthetic oligonucleotide
  Target: ATXN1; (+) strand; PAM type: YTN; PAM sequence: TTT
tccttcaagcatagaatgag

SEQ ID NO: 249269 - DNA, 20 bp, Artificial Sequence
  Description of Artificial Sequence: Synthetic oligonucleotide
  Target: ATXN1; (+) strand; PAM type: YTN; PAM sequence: TTT
ccttcaagcatagaatgagt

SEQ ID NO: 249270 - DNA, 20 bp, Artificial Sequence
  Description of Artificial Sequence: Synthetic oligonucleotide
  Target: ATXN1; (+) strand; PAM type: YTN; PAM sequence: TTC
cttcaagcatagaatgagtt

SEQ ID NO: 249271 - DNA, 20 bp, Artificial Sequence
  Description of Artificial Sequence: Synthetic oligonucleotide
  Target: ATXN1; (+) strand; PAM type: YTN; PAM sequence: CTT
caagcatagaatgagttccc

SEQ ID NO: 249272 - DNA, 20 bp, Artificial Sequence
  Description of Artificial Sequence: Synthetic oligonucleotide
  Target: ATXN1; (+) strand; PAM type: YTN; PAM sequence: TTC
aagcatagaatgagttccct

SEQ ID NO: 249273 - DNA, 20 bp, Artificial Sequence
  Description of Artificial Sequence: Synthetic oligonucleotide
  Target: ATXN1; (+) strand; PAM type: YTN; PAM sequence: TTC
cctctgggatttataaagtg

SEQ ID NO: 249274 - DNA, 20 bp, Artificial Sequence
  Description of Artificial Sequence: Synthetic oligonucleotide
  Target: ATXN1; (+) strand; PAM type: YTN; PAM sequence: CTC
tgggatttataaagtggacc

SEQ ID NO: 249275 - DNA, 20 bp, Artificial Sequence
  Description of Artificial Sequence: Synthetic oligonucleotide
  Target: ATXN1; (+) strand; PAM type: YTN; PAM sequence: CTG
ggatttataaagtggaccag

SEQ ID NO: 249276 - DNA, 20 bp, Artificial Sequence
  Description of Artificial Sequence: Synthetic oligonucleotide
  Target: ATXN1; (+) strand; PAM type: YTN; PAM sequence: TTT
ataaagtggaccagtacaga

SEQ ID NO: 249277 - DNA, 20 bp, Artificial Sequence
  Description of Artificial Sequence: Synthetic oligonucleotide
  Target: ATXN1; (+) strand; PAM type: YTN; PAM sequence: TTA
taaagtggaccagtacagag

SEQ ID NO: 249278 - DNA, 20 bp, Artificial Sequence
  Description of Artificial Sequence: Synthetic oligonucleotide
  Target: ATXN1; (+) strand; PAM type: YTN; PAM sequence: CTC
ccacccgtaccgtttaaaac

SEQ ID NO: 249279 - DNA, 20 bp, Artificial Sequence
  Description of Artificial Sequence: Synthetic oligonucleotide
  Target: ATXN1; (+) strand; PAM type: YTN; PAM sequence: TTT
aaaactagttgatttttagt

SEQ ID NO: 249280 - DNA, 20 bp, Artificial Sequence
  Description of Artificial Sequence: Synthetic oligonucleotide
  Target: ATXN1; (+) strand; PAM type: YTN; PAM sequence: TTA
aaactagttgatttttagtg

SEQ ID NO: 249281 - DNA, 20 bp, Artificial Sequence
  Description of Artificial Sequence: Synthetic oligonucleotide
  Target: ATXN1; (+) strand; PAM type: YTN; PAM sequence: CTA
gttgatttttagtgtattct

SEQ ID NO: 249282 - DNA, 20 bp, Artificial Sequence
  Description of Artificial Sequence: Synthetic oligonucleotide
  Target: ATXN1; (+) strand; PAM type: YTN; PAM sequence: TTG
atttttagtgtattctccaa

SEQ ID NO: 249283 - DNA, 20 bp, Artificial Sequence
  Description of Artificial Sequence: Synthetic oligonucleotide
  Target: ATXN1; (+) strand; PAM type: YTN; PAM sequence: TTT
ttagtgtattctccaatttc

SEQ ID NO: 249284 - DNA, 20 bp, Artificial Sequence
  Description of Artificial Sequence: Synthetic oligonucleotide
  Target: ATXN1; (+) strand; PAM type: YTN; PAM sequence: TTT
tagtgtattctccaatttca

SEQ ID NO: 249285 - DNA, 20 bp, Artificial Sequence
  Description of Artificial Sequence: Synthetic oligonucleotide
  Target: ATXN1; (+) strand; PAM type: YTN; PAM sequence: TTT
agtgtattctccaatttcac

SEQ ID NO: 249286 - DNA, 20 bp, Artificial Sequence
  Description of Artificial Sequence: Synthetic oligonucleotide
  Target: ATXN1; (+) strand; PAM type: YTN; PAM sequence: TTA
gtgtattctccaatttcacc

SEQ ID NO: 249287 - DNA, 20 bp, Artificial Sequence
  Description of Artificial Sequence: Synthetic oligonucleotide
  Target: ATXN1; (+) strand; PAM type: YTN; PAM sequence: TTC
tccaatttcacctatcttcc

SEQ ID NO: 249288 - DNA, 20 bp, Artificial Sequence
  Description of Artificial Sequence: Synthetic oligonucleotide
  Target: ATXN1; (+) strand; PAM type: YTN; PAM sequence: CTC
caatttcacctatcttcccc

SEQ ID NO: 249289 - DNA, 20 bp, Artificial Sequence
  Description of Artificial Sequence: Synthetic oligonucleotide
  Target: ATXN1; (+) strand; PAM type: YTN; PAM sequence: TTT
cacctatcttccccctctca

SEQ ID NO: 249290 - DNA, 20 bp, Artificial Sequence
  Description of Artificial Sequence: Synthetic oligonucleotide
  Target: ATXN1; (+) strand; PAM type: YTN; PAM sequence: TTC
acctatcttccccctctcag

SEQ ID NO: 249291 - DNA, 20 bp, Artificial Sequence
  Description of Artificial Sequence: Synthetic oligonucleotide
  Target: ATXN1; (+) strand; PAM type: YTN; PAM sequence: CTA
tcttccccctctcagcaatc

SEQ ID NO: 249292 - DNA, 20 bp, Artificial Sequence
  Description of Artificial Sequence: Synthetic oligonucleotide
  Target: ATXN1; (+) strand; PAM type: YTN; PAM sequence: CTT
ccccctctcagcaatctatt

SEQ ID NO: 249293 - DNA, 20 bp, Artificial Sequence
  Description of Artificial Sequence: Synthetic oligonucleotide
  Target: ATXN1; (+) strand; PAM type: YTN; PAM sequence: TTC
cccctctcagcaatctatta

SEQ ID NO: 249294 - DNA, 20 bp, Artificial Sequence
  Description of Artificial Sequence: Synthetic oligonucleotide
  Target: ATXN1; (+) strand; PAM type: YTN; PAM sequence: CTC
tcagcaatctattacggatt

SEQ ID NO: 249295 - DNA, 20 bp, Artificial Sequence
  Description of Artificial Sequence: Synthetic oligonucleotide
  Target: ATXN1; (+) strand; PAM type: YTN; PAM sequence: CTC
agcaatctattacggatttg

SEQ ID NO: 249296 - DNA, 20 bp, Artificial Sequence
  Description of Artificial Sequence: Synthetic oligonucleotide
  Target: ATXN1; (+) strand; PAM type: YTN; PAM sequence: CTA
ttacggatttgtttgctgga

SEQ ID NO: 249297 - DNA, 20 bp, Artificial Sequence
  Description of Artificial Sequence: Synthetic oligonucleotide
  Target: ATXN1; (+) strand; PAM type: YTN; PAM sequence: TTA
cggatttgtttgctggaatg

SEQ ID NO: 249298 - DNA, 20 bp, Artificial Sequence
  Description of Artificial Sequence: Synthetic oligonucleotide
  Target: ATXN1; (+) strand; PAM type: YTN; PAM sequence: TTT
gtttgctggaatgacttgga

SEQ ID NO: 249299 - DNA, 20 bp, Artificial Sequence
  Description of Artificial Sequence: Synthetic oligonucleotide
  Target: ATXN1; (+) strand; PAM type: YTN; PAM sequence: TTG
tttgctggaatgacttggag

SEQ ID NO: 249300 - DNA, 20 bp, Artificial Sequence
  Description of Artificial Sequence: Synthetic oligonucleotide
  Target: ATXN1; (+) strand; PAM type: YTN; PAM sequence: TTT
gctggaatgacttggagtgg

SEQ ID NO: 249301 - DNA, 20 bp, Artificial Sequence
  Description of Artificial Sequence: Synthetic oligonucleotide
  Target: ATXN1; (+) strand; PAM type: YTN; PAM sequence: TTG
ctggaatgacttggagtggc

SEQ ID NO: 249302 - DNA, 20 bp, Artificial Sequence
  Description of Artificial Sequence: Synthetic oligonucleotide
  Target: ATXN1; (+) strand; PAM type: YTN; PAM sequence: CTG
gaatgacttggagtggcagg

SEQ ID NO: 249303 - DNA, 20 bp, Artificial Sequence
  Description of Artificial Sequence: Synthetic oligonucleotide
  Target: ATXN1; (+) strand; PAM type: YTN; PAM sequence: CTT
ggagtggcaggtggggtcag

SEQ ID NO: 249304 - DNA, 20 bp, Artificial Sequence
  Description of Artificial Sequence: Synthetic oligonucleotide
  Target: ATXN1; (+) strand; PAM type: YTN; PAM sequence: TTG
gagtggcaggtggggtcagg

SEQ ID NO: 249305 - DNA, 20 bp, Artificial Sequence
  Description of Artificial Sequence: Synthetic oligonucleotide
  Target: ATXN1; (+) strand; PAM type: YTN; PAM sequence: TTA
gtaagcatttcgtttcatcc

SEQ ID NO: 249306 - DNA, 20 bp, Artificial Sequence
  Description of Artificial Sequence: Synthetic oligonucleotide
  Target: ATXN1; (+) strand; PAM type: YTN; PAM sequence: TTT
cgtttcatccccagtaaagg

SEQ ID NO: 249307 - DNA, 20 bp, Artificial Sequence
  Description of Artificial Sequence: Synthetic oligonucleotide
  Target: ATXN1; (+) strand; PAM type: YTN; PAM sequence: TTC
gtttcatccccagtaaaggg

SEQ ID NO: 249308 - DNA, 20 bp, Artificial Sequence
  Description of Artificial Sequence: Synthetic oligonucleotide
  Target: ATXN1; (+) strand; PAM type: YTN; PAM sequence: TTT
catccccagtaaagggtaag

SEQ ID NO: 249309 - DNA, 20 bp, Artificial Sequence
  Description of Artificial Sequence: Synthetic oligonucleotide
  Target: ATXN1; (+) strand; PAM type: YTN; PAM sequence: TTC
atccccagtaaagggtaaga

SEQ ID NO: 249310 - DNA, 20 bp, Artificial Sequence
  Description of Artificial Sequence: Synthetic oligonucleotide
  Target: ATXN1; (+) strand; PAM type: YTN; PAM sequence: TTG
aatcagtcagtctgctgaga

SEQ ID NO: 249311 - DNA, 20 bp, Artificial Sequence
  Description of Artificial Sequence: Synthetic oligonucleotide
  Target: ATXN1; (+) strand; PAM type: YTN; PAM sequence: CTG
ctgagatggggccagagtta

SEQ ID NO: 249312 - DNA, 20 bp, Artificial Sequence
  Description of Artificial Sequence: Synthetic oligonucleotide
  Target: ATXN1; (+) strand; PAM type: YTN; PAM sequence: CTG
agatggggccagagttacct

SEQ ID NO: 249313 - DNA, 20 bp, Artificial Sequence
  Description of Artificial Sequence: Synthetic oligonucleotide
  Target: ATXN1; (+) strand; PAM type: YTN; PAM sequence: TTA
cctgataaatattggggcca

SEQ ID NO: 249314 - DNA, 20 bp, Artificial Sequence
  Description of Artificial Sequence: Synthetic oligonucleotide
  Target: ATXN1; (+) strand; PAM type: YTN; PAM sequence: CTG
ataaatattggggccatgcc

SEQ ID NO: 249315 - DNA, 20 bp, Artificial Sequence
  Description of Artificial Sequence: Synthetic oligonucleotide
  Target: ATXN1; (+) strand; PAM type: YTN; PAM sequence: TTG
gggccatgccactaggtgaa

SEQ ID NO: 249316 - DNA, 20 bp, Artificial Sequence
  Description of Artificial Sequence: Synthetic oligonucleotide
  Target: ATXN1; (+) strand; PAM type: YTN; PAM sequence: CTA
ggtgaaatcttttcgttaag

SEQ ID NO: 249317 - DNA, 20 bp, Artificial Sequence
  Description of Artificial Sequence: Synthetic oligonucleotide
  Target: ATXN1; (+) strand; PAM type: YTN; PAM sequence: CTT
ttcgttaagtgactctaaaa

SEQ ID NO: 249318 - DNA, 20 bp, Artificial Sequence
  Description of Artificial Sequence: Synthetic oligonucleotide
  Target: ATXN1; (+) strand; PAM type: YTN; PAM sequence: TTT
tcgttaagtgactctaaaat

SEQ ID NO: 249319 - DNA, 20 bp, Artificial Sequence
  Description of Artificial Sequence: Synthetic oligonucleotide
  Target: ATXN1; (+) strand; PAM type: YTN; PAM sequence: TTT
cgttaagtgactctaaaata

SEQ ID NO: 249320 - DNA, 20 bp, Artificial Sequence
  Description of Artificial Sequence: Synthetic oligonucleotide
  Target: ATXN1; (+) strand; PAM type: YTN; PAM sequence: TTC
gttaagtgactctaaaataa

SEQ ID NO: 249321 - DNA, 20 bp, Artificial Sequence
  Description of Artificial Sequence: Synthetic oligonucleotide
  Target: ATXN1; (+) strand; PAM type: YTN; PAM sequence: TTA
agtgactctaaaataaaatc

SEQ ID NO: 249322 - DNA, 20 bp, Artificial Sequence
  Description of Artificial Sequence: Synthetic oligonucleotide
  Target: ATXN1; (+) strand; PAM type: YTN; PAM sequence: CTC
taaaataaaatcccaaccta

SEQ ID NO: 249323 - DNA, 20 bp, Artificial Sequence
  Description of Artificial Sequence: Synthetic oligonucleotide
  Target: ATXN1; (+) strand; PAM type: YTN; PAM sequence: CTA
aaataaaatcccaacctaaa

SEQ ID NO: 249324 - DNA, 20 bp, Artificial Sequence
  Description of Artificial Sequence: Synthetic oligonucleotide
  Target: ATXN1; (+) strand; PAM type: YTN; PAM sequence: CTA
aaattgctgagtcagtggga

SEQ ID NO: 249325 - DNA, 20 bp, Artificial Sequence
  Description of Artificial Sequence: Synthetic oligonucleotide
  Target: ATXN1; (+) strand; PAM type: YTN; PAM sequence: TTG
ctgagtcagtgggaatttct

SEQ ID NO: 249326 - DNA, 20 bp, Artificial Sequence
  Description of Artificial Sequence: Synthetic oligonucleotide
  Target: ATXN1; (+) strand; PAM type: YTN; PAM sequence: CTG
agtcagtgggaatttctcag

SEQ ID NO: 249327 - DNA, 20 bp, Artificial Sequence
  Description of Artificial Sequence: Synthetic oligonucleotide
  Target: ATXN1; (+) strand; PAM type: YTN; PAM sequence: TTT
ctcagggaatccatgttccg

SEQ ID NO: 249328 - DNA, 20 bp, Artificial Sequence
  Description of Artificial Sequence: Synthetic oligonucleotide
  Target: ATXN1; (+) strand; PAM type: YTN; PAM sequence: TTC
tcagggaatccatgttccgc

SEQ ID NO: 249329 - DNA, 20 bp, Artificial Sequence
  Description of Artificial Sequence: Synthetic oligonucleotide
  Target: ATXN1; (+) strand; PAM type: YTN; PAM sequence: CTC
agggaatccatgttccgctg

SEQ ID NO: 249330 - DNA, 20 bp, Artificial Sequence
  Description of Artificial Sequence: Synthetic oligonucleotide
  Target: ATXN1; (+) strand; PAM type: YTN; PAM sequence: TTC
cgctggctctagaaatgatt

SEQ ID NO: 249331 - DNA, 20 bp, Artificial Sequence
  Description of Artificial Sequence: Synthetic oligonucleotide
  Target: ATXN1; (+) strand; PAM type: YTN; PAM sequence: CTG
gctctagaaatgattttgat

SEQ ID NO: 249332 - DNA, 20 bp, Artificial Sequence
  Description of Artificial Sequence: Synthetic oligonucleotide
  Target: ATXN1; (+) strand; PAM type: YTN; PAM sequence: CTC
tagaaatgattttgattatg

SEQ ID NO: 249333 - DNA, 20 bp, Artificial Sequence
  Description of Artificial Sequence: Synthetic oligonucleotide
  Target: ATXN1; (+) strand; PAM type: YTN; PAM sequence: CTA
gaaatgattttgattatgag

SEQ ID NO: 249334 - DNA, 20 bp, Artificial Sequence
  Description of Artificial Sequence: Synthetic oligonucleotide
  Target: ATXN1; (+) strand; PAM type: YTN; PAM sequence: TTT
tgattatgagacaaggtatt

SEQ ID NO: 249335 - DNA, 20 bp, Artificial Sequence
  Description of Artificial Sequence: Synthetic oligonucleotide
  Target: ATXN1; (+) strand; PAM type: YTN; PAM sequence: TTT
gattatgagacaaggtattt

SEQ ID NO: 249336 - DNA, 20 bp, Artificial Sequence
  Description of Artificial Sequence: Synthetic oligonucleotide
  Target: ATXN1; (+) strand; PAM type: YTN; PAM sequence: TTG
attatgagacaaggtatttt

SEQ ID NO: 249337 - DNA, 20 bp, Artificial Sequence
  Description of Artificial Sequence: Synthetic oligonucleotide
  Target: ATXN1; (+) strand; PAM type: YTN; PAM sequence: TTA
tgagacaaggtattttggca

SEQ ID NO: 249338 - DNA, 20 bp, Artificial Sequence
  Description of Artificial Sequence: Synthetic oligonucleotide
  Target: ATXN1; (+) strand; PAM type: YTN; PAM sequence: TTT
tggcagcaggtgctggcttt

SEQ ID NO: 249339 - DNA, 20 bp, Artificial Sequence
  Description of Artificial Sequence: Synthetic oligonucleotide
  Target: ATXN1; (+) strand; PAM type: YTN; PAM sequence: TTT
ggcagcaggtgctggctttt

SEQ ID NO: 249340 - DNA, 20 bp, Artificial Sequence
  Description of Artificial Sequence: Synthetic oligonucleotide
  Target: ATXN1; (+) strand; PAM type: YTN; PAM sequence: TTG
gcagcaggtgctggctttta

SEQ ID NO: 249341 - DNA, 20 bp, Artificial Sequence
  Description of Artificial Sequence: Synthetic oligonucleotide
  Target: ATXN1; (+) strand; PAM type: YTN; PAM sequence: CTG
gcttttatttaccatgttca

SEQ ID NO: 249342 - DNA, 20 bp, Artificial Sequence
  Description of Artificial Sequence: Synthetic oligonucleotide
  Target: ATXN1; (+) strand; PAM type: YTN; PAM sequence: CTT
ttatttaccatgttcagaac

SEQ ID NO: 249343 - DNA, 20 bp, Artificial Sequence
  Description of Artificial Sequence: Synthetic oligonucleotide
  Target: ATXN1; (+) strand; PAM type: YTN; PAM sequence: TTT
tatttaccatgttcagaact

SEQ ID NO: 249344 - DNA, 20 bp, Artificial Sequence
  Description of Artificial Sequence: Synthetic oligonucleotide
  Target: ATXN1; (+) strand; PAM type: YTN; PAM sequence: TTT
atttaccatgttcagaactt

SEQ ID NO: 249345 - DNA, 20 bp, Artificial Sequence
  Description of Artificial Sequence: Synthetic oligonucleotide
  Target: ATXN1; (+) strand; PAM type: YTN; PAM sequence: TTA
tttaccatgttcagaacttg

SEQ ID NO: 249346 - DNA, 20 bp, Artificial Sequence
  Description of Artificial Sequence: Synthetic oligonucleotide
  Target: ATXN1; (+) strand; PAM type: YTN; PAM sequence: TTT
accatgttcagaacttgaaa

SEQ ID NO: 249347 - DNA, 20 bp, Artificial Sequence
  Description of Artificial Sequence: Synthetic oligonucleotide
  Target: ATXN1; (+) strand; PAM type: YTN; PAM sequence: TTA
ccatgttcagaacttgaaag

SEQ ID NO: 249348 - DNA, 20 bp, Artificial Sequence
  Description of Artificial Sequence: Synthetic oligonucleotide
  Target: ATXN1; (+) strand; PAM type: YTN; PAM sequence: TTC
agaacttgaaagtgtccagt

SEQ ID NO: 249349 - DNA, 20 bp, Artificial Sequence
  Description of Artificial Sequence: Synthetic oligonucleotide
  Target: ATXN1; (+) strand; PAM type: YTN; PAM sequence: CTT
gaaagtgtccagttcattaa

SEQ ID NO: 249350 - DNA, 20 bp, Artificial Sequence
  Description of Artificial Sequence: Synthetic oligonucleotide
  Target: ATXN1; (+) strand; PAM type: YTN; PAM sequence: TTG
aaagtgtccagttcattaag

SEQ ID NO: 249351 - DNA, 20 bp, Artificial Sequence
  Description of Artificial Sequence: Synthetic oligonucleotide
  Target: ATXN1; (+) strand; PAM type: YTN; PAM sequence: TTC
attaagttcaagagctggag

SEQ ID NO: 249352 - DNA, 20 bp, Artificial Sequence
  Description of Artificial Sequence: Synthetic oligonucleotide
  Target: ATXN1; (+) strand; PAM type: YTN; PAM sequence: TTA
agttcaagagctggagtcgc

SEQ ID NO: 249353 - DNA, 20 bp, Artificial Sequence
  Description of Artificial Sequence: Synthetic oligonucleotide
  Target: ATXN1; (+) strand; PAM type: YTN; PAM sequence: TTC
aagagctggagtcgcttaaa

SEQ ID NO: 249354 - DNA, 20 bp, Artificial Sequence
  Description of Artificial Sequence: Synthetic oligonucleotide
  Target: ATXN1; (+) strand; PAM type: YTN; PAM sequence: CTG
gagtcgcttaaaggtagacc

SEQ ID NO: 249355 - DNA, 20 bp, Artificial Sequence
  Description of Artificial Sequence: Synthetic oligonucleotide
  Target: ATXN1; (+) strand; PAM type: YTN; PAM sequence: CTT
aaaggtagaccctgaatgat

SEQ ID NO: 249356 - DNA, 20 bp, Artificial Sequence
  Description of Artificial Sequence: Synthetic oligonucleotide
  Target: ATXN1; (+) strand; PAM type: YTN; PAM sequence: TTA
aaggtagaccctgaatgatg

SEQ ID NO: 249357 - DNA, 20 bp, Artificial Sequence
  Description of Artificial Sequence: Synthetic oligonucleotide
  Target: ATXN1; (+) strand; PAM type: YTN; PAM sequence: CTG
aatgatgccttaaggacccc

SEQ ID NO: 249358 - DNA, 20 bp, Artificial Sequence
  Description of Artificial Sequence: Synthetic oligonucleotide
  Target: ATXN1; (+) strand; PAM type: YTN; PAM sequence: CTT
aaggaccccccactgtattt

SEQ ID NO: 249359 - DNA, 20 bp, Artificial Sequence
  Description of Artificial Sequence: Synthetic oligonucleotide
  Target: ATXN1; (+) strand; PAM type: YTN; PAM sequence: TTA
aggaccccccactgtatttt

SEQ ID NO: 249360 - DNA, 20 bp, Artificial Sequence
  Description of Artificial Sequence: Synthetic oligonucleotide
  Target: ATXN1; (+) strand; PAM type: YTN; PAM sequence: CTG
tattttcattacactaaacc

SEQ ID NO: 249361 - DNA, 20 bp, Artificial Sequence
  Description of Artificial Sequence: Synthetic oligonucleotide
  Target: ATXN1; (+) strand; PAM type: YTN; PAM sequence: TTT
tcattacactaaaccatggc

SEQ ID NO: 249362 - DNA, 20 bp, Artificial Sequence
  Description of Artificial Sequence: Synthetic oligonucleotide
  Target: ATXN1; (+) strand; PAM type: YTN; PAM sequence: TTT
cattacactaaaccatggca

SEQ ID NO: 249363 - DNA, 20 bp, Artificial Sequence
  Description of Artificial Sequence: Synthetic oligonucleotide
  Target: ATXN1; (+) strand; PAM type: YTN; PAM sequence: TTC
attacactaaaccatggcac

SEQ ID NO: 249364 - DNA, 20 bp, Artificial Sequence
  Description of Artificial Sequence: Synthetic oligonucleotide
  Target: ATXN1; (+) strand; PAM type: YTN; PAM sequence: TTA
cactaaaccatggcacttag

SEQ ID NO: 249365 - DNA, 20 bp, Artificial Sequence
  Description of Artificial Sequence: Synthetic oligonucleotide
  Target: ATXN1; (+) strand; PAM type: YTN; PAM sequence: CTA
aaccatggcacttaggcagc

SEQ ID NO: 249366 - DNA, 20 bp, Artificial Sequence
  Description of Artificial Sequence: Synthetic oligonucleotide
  Target: ATXN1; (+) strand; PAM type: YTN; PAM sequence: CTT
aggcagccagtaaagctgga

SEQ ID NO: 249367 - DNA, 20 bp, Artificial Sequence
  Description of Artificial Sequence: Synthetic oligonucleotide
  Target: ATXN1; (+) strand; PAM type: YTN; PAM sequence: TTA
ggcagccagtaaagctggag

SEQ ID NO: 249368 - DNA, 20 bp, Artificial Sequence
  Description of Artificial Sequence: Synthetic oligonucleotide
  Target: ATXN1; (+) strand; PAM type: YTN; PAM sequence: CTG
gagtcagaactctgattcag

SEQ ID NO: 249369 - DNA, 20 bp, Artificial Sequence
  Description of Artificial Sequence: Synthetic oligonucleotide
  Target: ATXN1; (+) strand; PAM type: YTN; PAM sequence: CTC
tgattcagagcacctcattt

SEQ ID NO: 249370 - DNA, 20 bp, Artificial Sequence
  Description of Artificial Sequence: Synthetic oligonucleotide
  Target: ATXN1; (+) strand; PAM type: YTN; PAM sequence: CTG
attcagagcacctcatttac

SEQ ID NO: 249371 - DNA, 20 bp, Artificial Sequence
  Description of Artificial Sequence: Synthetic oligonucleotide
  Target: ATXN1; (+) strand; PAM type: YTN; PAM sequence: TTC
agagcacctcatttacagaa

SEQ ID NO: 249372 - DNA, 20 bp, Artificial Sequence
  Description of Artificial Sequence: Synthetic oligonucleotide
  Target: ATXN1; (+) strand; PAM type: YTN; PAM sequence: CTC
atttacagaaaataattccc

SEQ ID NO: 249373 - DNA, 20 bp, Artificial Sequence
  Description of Artificial Sequence: Synthetic oligonucleotide
  Target: ATXN1; (+) strand; PAM type: YTN; PAM sequence: TTT
acagaaaataattccccaaa

SEQ ID NO: 249374 - DNA, 20 bp, Artificial Sequence
  Description of Artificial Sequence: Synthetic oligonucleotide
  Target: ATXN1; (+) strand; PAM type: YTN; PAM sequence: TTA
cagaaaataattccccaaac

SEQ ID NO: 249375 - DNA, 20 bp, Artificial Sequence
  Description of Artificial Sequence: Synthetic oligonucleotide
  Target: ATXN1; (+) strand; PAM type: YTN; PAM sequence: TTC
cccaaactgaattgcctgaa

SEQ ID NO: 249376 - DNA, 20 bp, Artificial Sequence
  Description of Artificial Sequence: Synthetic oligonucleotide
  Target: ATXN1; (+) strand; PAM type: YTN; PAM sequence: CTG
aattgcctgaatttgactaa

SEQ ID NO: 249377 - DNA, 20 bp, Artificial Sequence
  Description of Artificial Sequence: Synthetic oligonucleotide
  Target: ATXN1; (+) strand; PAM type: YTN; PAM sequence: TTG
cctgaatttgactaagtata

SEQ ID NO: 249378 - DNA, 20 bp, Artificial Sequence
  Description of Artificial Sequence: Synthetic oligonucleotide
  Target: ATXN1; (+) strand; PAM type: YTN; PAM sequence: CTG
aatttgactaagtatagggc

SEQ ID NO: 249379 - DNA, 20 bp, Artificial Sequence
  Description of Artificial Sequence: Synthetic oligonucleotide
  Target: ATXN1; (+) strand; PAM type: YTN; PAM sequence: TTT
gactaagtatagggcaccat

SEQ ID NO: 249380 - DNA, 20 bp, Artificial Sequence
  Description of Artificial Sequence: Synthetic oligonucleotide
  Target: ATXN1; (+) strand; PAM type: YTN; PAM sequence: TTG
actaagtatagggcaccatt

SEQ ID NO: 249381 - DNA, 20 bp, Artificial Sequence
  Description of Artificial Sequence: Synthetic oligonucleotide
  Target: ATXN1; (+) strand; PAM type: YTN; PAM sequence: CTA
agtatagggcaccattttaa

SEQ ID NO: 249382 - DNA, 20 bp, Artificial Sequence
  Description of Artificial Sequence: Synthetic oligonucleotide
  Target: ATXN1; (+) strand; PAM type: YTN; PAM sequence: TTT
taaaaatggcttcatgctga

SEQ ID NO: 249383 - DNA, 20 bp, Artificial Sequence
  Description of Artificial Sequence: Synthetic oligonucleotide
  Target: ATXN1; (+) strand; PAM type: YTN; PAM sequence: TTT
aaaaatggcttcatgctgag

SEQ ID NO: 249384 - DNA, 20 bp, Artificial Sequence
  Description of Artificial Sequence: Synthetic oligonucleotide
  Target: ATXN1; (+) strand; PAM type: YTN; PAM sequence: TTA
aaaatggcttcatgctgagg

SEQ ID NO: 249385 - DNA, 20 bp, Artificial Sequence
  Description of Artificial Sequence: Synthetic oligonucleotide
  Target: ATXN1; (+) strand; PAM type: YTN; PAM sequence: CTT
catgctgaggttctagattt

SEQ ID NO: 249386 - DNA, 20 bp, Artificial Sequence
  Description of Artificial Sequence: Synthetic oligonucleotide
  Target: ATXN1; (+) strand; PAM type: YTN; PAM sequence: TTC
atgctgaggttctagatttt

SEQ ID NO: 249387 - DNA, 20 bp, Artificial Sequence
  Description of Artificial Sequence: Synthetic oligonucleotide
  Target: ATXN1; (+) strand; PAM type: YTN; PAM sequence: CTG
aggttctagatttttttttt

SEQ ID NO: 249388 - DNA, 20 bp, Artificial Sequence
  Description of Artificial Sequence: Synthetic oligonucleotide
  Target: ATXN1; (+) strand; PAM type: YTN; PAM sequence: TTC
tagattttttttttttggag

SEQ ID NO: 249389 - DNA, 20 bp, Artificial Sequence
  Description of Artificial Sequence: Synthetic oligonucleotide
  Target: ATXN1; (+) strand; PAM type: YTN; PAM sequence: CTA
gattttttttttttggagat

SEQ ID NO: 249390 - DNA, 20 bp, Artificial Sequence
  Description of Artificial Sequence: Synthetic oligonucleotide
  Target: ATXN1; (+) strand; PAM type: YTN; PAM sequence: TTT
tttttttttggagatggagg

SEQ ID NO: 249391 - DNA, 20 bp, Artificial Sequence
  Description of Artificial Sequence: Synthetic oligonucleotide
  Target: ATXN1; (+) strand; PAM type: YTN; PAM sequence: TTT
ttttttttggagatggaggc

SEQ ID NO: 249392 - DNA, 20 bp, Artificial Sequence
  Description of Artificial Sequence: Synthetic oligonucleotide
  Target: ATXN1; (+) strand; PAM type: YTN; PAM sequence: TTT
tttttttggagatggaggct

SEQ ID NO: 249393 - DNA, 20 bp, Artificial Sequence
  Description of Artificial Sequence: Synthetic oligonucleotide
  Target: ATXN1; (+) strand; PAM type: YTN; PAM sequence: TTT
ttttttggagatggaggctc

SEQ ID NO: 249394 - DNA, 20 bp, Artificial Sequence
  Description of Artificial Sequence: Synthetic oligonucleotide
  Target: ATXN1; (+) strand; PAM type: YTN; PAM sequence: TTT
tttttggagatggaggctcg

SEQ ID NO: 249395 - DNA, 20 bp, Artificial Sequence
  Description of Artificial Sequence: Synthetic oligonucleotide
  Target: ATXN1; (+) strand; PAM type: YTN; PAM sequence: TTT
ttttggagatggaggctcgt

SEQ ID NO: 249396 - DNA, 20 bp, Artificial Sequence
  Description of Artificial Sequence: Synthetic oligonucleotide
  Target: ATXN1; (+) strand; PAM type: YTN; PAM sequence: TTT
tttggagatggaggctcgtt

SEQ ID NO: 249397 - DNA, 20 bp, Artificial Sequence
  Description of Artificial Sequence: Synthetic oligonucleotide
  Target: ATXN1; (+) strand; PAM type: YTN; PAM sequence: TTT
ttggagatggaggctcgttc

SEQ ID NO: 249398 - DNA, 20 bp, Artificial Sequence
  Description of Artificial Sequence: Synthetic oligonucleotide
  Target: ATXN1; (+) strand; PAM type: YTN; PAM sequence: TTT
tggagatggaggctcgttct

SEQ ID NO: 249399 - DNA, 20 bp, Artificial Sequence
  Description of Artificial Sequence: Synthetic oligonucleotide
  Target: ATXN1; (+) strand; PAM type: YTN; PAM sequence: TTT
ggagatggaggctcgttctg

SEQ ID NO: 249400 - DNA, 20 bp, Artificial Sequence
  Description of Artificial Sequence: Synthetic oligonucleotide
  Target: ATXN1; (+) strand; PAM type: YTN; PAM sequence: TTG
gagatggaggctcgttctgt

SEQ ID NO: 249401 - DNA, 20 bp, Artificial Sequence
  Description of Artificial Sequence: Synthetic oligonucleotide
  Target: ATXN1; (+) strand; PAM type: YTN; PAM sequence: CTC
gttctgtcgccaggctggag

SEQ ID NO: 249402 - DNA, 20 bp, Artificial Sequence
  Description of Artificial Sequence: Synthetic oligonucleotide
  Target: ATXN1; (+) strand; PAM type: YTN; PAM sequence: TTC
tgtcgccaggctggagtgca

SEQ ID NO: 249403 - DNA, 20 bp, Artificial Sequence
  Description of Artificial Sequence: Synthetic oligonucleotide
  Target: ATXN1; (+) strand; PAM type: YTN; PAM sequence: CTG
tcgccaggctggagtgcagt

SEQ ID NO: 249404 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggcgcgatctc

SEQ ID NO: 249405 - DNA, 20 bp, Artificial Sequence
  Description of Artificial Sequence: Synthetic oligonucleotide
  Target: ATXN1; (+) strand; PAM type: YTN; PAM sequence: CTC
agctcactgcaagctccgcc

SEQ ID NO: 249406 - DNA, 20 bp, Artificial Sequence
  Description of Artificial Sequence: Synthetic oligonucleotide
  Target: ATXN1; (+) strand; PAM type: YTN; PAM sequence: CTC
actgcaagctccgcctccac

SEQ ID NO: 249407 - DNA, 20 bp, Artificial Sequence
  Description of Artificial Sequence: Synthetic oligonucleotide
  Target: ATXN1; (+) strand; PAM type: YTN; PAM sequence: CTG
caagctccgcctccacgttc

SEQ ID NO: 249408 - DNA, 20 bp, Artificial Sequence
  Description of Artificial Sequence: Synthetic oligonucleotide
  Target: ATXN1; (+) strand; PAM type: YTN; PAM sequence: CTC
cgcctccacgttcacaccat

SEQ ID NO: 249409 - DNA, 20 bp, Artificial Sequence
  Description of Artificial Sequence: Synthetic oligonucleotide
  Target: ATXN1; (+) strand; PAM type: YTN; PAM sequence: CTC
cacgttcacaccattctcct

SEQ ID NO: 249410 - DNA, 20 bp, Artificial Sequence
  Description of Artificial Sequence: Synthetic oligonucleotide
  Target: ATXN1; (+) strand; PAM type: YTN; PAM sequence: TTC
acaccattctcctgcctcag

SEQ ID NO: 249411 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccgag

SEQ ID NO: 249412 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccgagta

SEQ ID NO: 249413 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccgagtatct

SEQ ID NO: 249414 - DNA, 20 bp, Artificial Sequence
  Description of Artificial Sequence: Synthetic oligonucleotide
  Target: ATXN1; (+) strand; PAM type: YTN; PAM sequence: CTC
agcctcccgagtatctggga

SEQ ID NO: 249415 - DNA, 20 bp, Artificial Sequence
  Description of Artificial Sequence: Synthetic oligonucleotide
  Target: ATXN1; (+) strand; PAM type: YTN; PAM sequence: CTC
ccgagtatctgggactacag

SEQ ID NO: 249416 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcacccgccac

SEQ ID NO: 249417 - DNA, 20 bp, Artificial Sequence
  Description of Artificial Sequence: Synthetic oligonucleotide
  Target: ATXN1; (+) strand; PAM type: YTN; PAM sequence: CTA
caggcacccgccaccacgcc

SEQ ID NO: 249418 - DNA, 20 bp, Artificial Sequence
  Description of Artificial Sequence: Synthetic oligonucleotide
  Target: ATXN1; (+) strand; PAM type: YTN; PAM sequence: CTG
gctaattttttgtattttta

SEQ ID NO: 249419 - DNA, 20 bp, Artificial Sequence
  Description of Artificial Sequence: Synthetic oligonucleotide
  Target: ATXN1; (+) strand; PAM type: YTN; PAM sequence: CTA
attttttgtatttttagtag

SEQ ID NO: 249420 - DNA, 20 bp, Artificial Sequence
  Description of Artificial Sequence: Synthetic oligonucleotide
  Target: ATXN1; (+) strand; PAM type: YTN; PAM sequence: TTT
tttgtatttttagtagagat

SEQ ID NO: 249421 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagata

SEQ ID NO: 249422 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagatag

SEQ ID NO: 249423 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagatagg

SEQ ID NO: 249424 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagataggg

SEQ ID NO: 249425 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatagggtttca

SEQ ID NO: 249426 - DNA, 20 bp, Artificial Sequence
  Description of Artificial Sequence: Synthetic oligonucleotide
  Target: ATXN1; (+) strand; PAM type: YTN; PAM sequence: TTT
tagtagagatagggtttcac

SEQ ID NO: 249427 - DNA, 20 bp, Artificial Sequence
  Description of Artificial Sequence: Synthetic oligonucleotide
  Target: ATXN1; (+) strand; PAM type: YTN; PAM sequence: TTT
agtagagatagggtttcact

SEQ ID NO: 249428 - DNA, 20 bp, Artificial Sequence
  Description of Artificial Sequence: Synthetic oligonucleotide
  Target: ATXN1; (+) strand; PAM type: YTN; PAM sequence: TTA
gtagagatagggtttcactg

SEQ ID NO: 249429 - DNA, 20 bp, Artificial Sequence
  Description of Artificial Sequence: Synthetic oligonucleotide
  Target: ATXN1; (+) strand; PAM type: YTN; PAM sequence: TTT
cactgtgttagccaggatgg

SEQ ID NO: 249430 - DNA, 20 bp, Artificial Sequence
  Description of Artificial Sequence: Synthetic oligonucleotide
  Target: ATXN1; (+) strand; PAM type: YTN; PAM sequence: TTC
actgtgttagccaggatggt

SEQ ID NO: 249431 - DNA, 20 bp, Artificial Sequence
  Description of Artificial Sequence: Synthetic oligonucleotide
  Target: ATXN1; (+) strand; PAM type: YTN; PAM sequence: CTG
tgttagccaggatggtctcg

SEQ ID NO: 249432 - DNA, 20 bp, Artificial Sequence
  Description of Artificial Sequence: Synthetic oligonucleotide
  Target: ATXN1; (+) strand; PAM type: YTN; PAM sequence: TTA
gccaggatggtctcgatctc

SEQ ID NO: 249433 - DNA, 20 bp, Artificial Sequence
  Description of Artificial Sequence: Synthetic oligonucleotide
  Target: ATXN1; (+) strand; PAM type: YTN; PAM sequence: CTC
gatctcctgacctcgtgatc

SEQ ID NO: 249434 - DNA, 20 bp, Artificial Sequence
  Description of Artificial Sequence: Synthetic oligonucleotide
  Target: ATXN1; (+) strand; PAM type: YTN; PAM sequence: CTC
ctgacctcgtgatctgcccg

SEQ ID NO: 249435 - DNA, 20 bp, Artificial Sequence
  Description of Artificial Sequence: Synthetic oligonucleotide
  Target: ATXN1; (+) strand; PAM type: YTN; PAM sequence: CTG
acctcgtgatctgcccgcct

SEQ ID NO: 249436 - DNA, 20 bp, Artificial Sequence
  Description of Artificial Sequence: Synthetic oligonucleotide
  Target: ATXN1; (+) strand; PAM type: YTN; PAM sequence: CTC
gtgatctgcccgcctcagcc

SEQ ID NO: 249437 - DNA, 20 bp, Artificial Sequence
  Description of Artificial Sequence: Synthetic oligonucleotide
  Target: ATXN1; (+) strand; PAM type: YTN; PAM sequence: CTG
cccgcctcagcctcccaatg

SEQ ID NO: 249438 - DNA, 20 bp, Artificial Sequence
  Description of Artificial Sequence: Synthetic oligonucleotide
  Target: ATXN1; (+) strand; PAM type: YTN; PAM sequence: CTC
agcctcccaatgtgctggga

SEQ ID NO: 249439 - DNA, 20 bp, Artificial Sequence
  Description of Artificial Sequence: Synthetic oligonucleotide
  Target: ATXN1; (+) strand; PAM type: YTN; PAM sequence: CTC
ccaatgtgctgggattacag

SEQ ID NO: 249440 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcatgagccac

SEQ ID NO: 249441 - DNA, 20 bp, Artificial Sequence
  Description of Artificial Sequence: Synthetic oligonucleotide
  Target: ATXN1; (+) strand; PAM type: YTN; PAM sequence: TTA
caggcatgagccaccgcacc

SEQ ID NO: 249442 - DNA, 20 bp, Artificial Sequence
  Description of Artificial Sequence: Synthetic oligonucleotide
  Target: ATXN1; (+) strand; PAM type: YTN; PAM sequence: TTC
tagatattttgaggtggtaa

SEQ ID NO: 249443 - DNA, 20 bp, Artificial Sequence
  Description of Artificial Sequence: Synthetic oligonucleotide
  Target: ATXN1; (+) strand; PAM type: YTN; PAM sequence: CTA
gatattttgaggtggtaaga

SEQ ID NO: 249444 - DNA, 20 bp, Artificial Sequence
  Description of Artificial Sequence: Synthetic oligonucleotide
  Target: ATXN1; (+) strand; PAM type: YTN; PAM sequence: TTT
tgaggtggtaagaataaggt

SEQ ID NO: 249445 - DNA, 20 bp, Artificial Sequence
  Description of Artificial Sequence: Synthetic oligonucleotide
  Target: ATXN1; (+) strand; PAM type: YTN; PAM sequence: TTT
gaggtggtaagaataaggta

SEQ ID NO: 249446 - DNA, 20 bp, Artificial Sequence
  Description of Artificial Sequence: Synthetic oligonucleotide
  Target: ATXN1; (+) strand; PAM type: YTN; PAM sequence: TTG
aggtggtaagaataaggtat

SEQ ID NO: 249447 - DNA, 20 bp, Artificial Sequence
  Description of Artificial Sequence: Synthetic oligonucleotide
  Target: ATXN1; (+) strand; PAM type: YTN; PAM sequence: TTC
ccctactgctcaaggatact

SEQ ID NO: 249448 - DNA, 20 bp, Artificial Sequence
  Description of Artificial Sequence: Synthetic oligonucleotide
  Target: ATXN1; (+) strand; PAM type: YTN; PAM sequence: CTA
ctgctcaaggatacttgttt

SEQ ID NO: 249449 - DNA, 20 bp, Artificial Sequence
  Description of Artificial Sequence: Synthetic oligonucleotide
  Target: ATXN1; (+) strand; PAM type: YTN; PAM sequence: CTG
ctcaaggatacttgtttctc

SEQ ID NO: 249450 - DNA, 20 bp, Artificial Sequence
  Description of Artificial Sequence: Synthetic oligonucleotide
  Target: ATXN1; (+) strand; PAM type: YTN; PAM sequence: CTC
aaggatacttgtttctcatg

SEQ ID NO: 249451 - DNA, 20 bp, Artificial Sequence
  Description of Artificial Sequence: Synthetic oligonucleotide
  Target: ATXN1; (+) strand; PAM type: YTN; PAM sequence: CTT
gtttctcatgtgccagggac

SEQ ID NO: 249452 - DNA, 20 bp, Artificial Sequence
  Description of Artificial Sequence: Synthetic oligonucleotide
  Target: ATXN1; (+) strand; PAM type: YTN; PAM sequence: TTG
tttctcatgtgccagggacc

SEQ ID NO: 249453 - DNA, 20 bp, Artificial Sequence
  Description of Artificial Sequence: Synthetic oligonucleotide
  Target: ATXN1; (+) strand; PAM type: YTN; PAM sequence: TTT
ctcatgtgccagggacccag

SEQ ID NO: 249454 - DNA, 20 bp, Artificial Sequence
  Description of Artificial Sequence: Synthetic oligonucleotide
  Target: ATXN1; (+) strand; PAM type: YTN; PAM sequence: TTC
tcatgtgccagggacccagg

SEQ ID NO: 249455 - DNA, 20 bp, Artificial Sequence
  Description of Artificial Sequence: Synthetic oligonucleotide
  Target: ATXN1; (+) strand; PAM type: YTN; PAM sequence: CTC
atgtgccagggacccaggca

SEQ ID NO: 249456 - DNA, 20 bp, Artificial Sequence
  Description of Artificial Sequence: Synthetic oligonucleotide
  Target: ATXN1; (+) strand; PAM type: YTN; PAM sequence: TTG
agcccaatagaaagccatag

SEQ ID NO: 249457 - DNA, 20 bp, Artificial Sequence
  Description of Artificial Sequence: Synthetic oligonucleotide
  Target: ATXN1; (+) strand; PAM type: YTN; PAM sequence: CTG
gatgtgatgctattcatgaa

SEQ ID NO: 249458 - DNA, 20 bp, Artificial Sequence
  Description of Artificial Sequence: Synthetic oligonucleotide
  Target: ATXN1; (+) strand; PAM type: YTN; PAM sequence: CTA
ttcatgaatgtcacagtctc

SEQ ID NO: 249459 - DNA, 20 bp, Artificial Sequence
  Description of Artificial Sequence: Synthetic oligonucleotide
  Target: ATXN1; (+) strand; PAM type: YTN; PAM sequence: TTC
atgaatgtcacagtctcctt

SEQ ID NO: 249460 - DNA, 20 bp, Artificial Sequence
  Description of Artificial Sequence: Synthetic oligonucleotide
  Target: ATXN1; (+) strand; PAM type: YTN; PAM sequence: CTC
cttaaaccccattttattaa

SEQ ID NO: 249461 - DNA, 20 bp, Artificial Sequence
  Description of Artificial Sequence: Synthetic oligonucleotide
  Target: ATXN1; (+) strand; PAM type: YTN; PAM sequence: CTT
aaaccccattttattaaact

SEQ ID NO: 249462 - DNA, 20 bp, Artificial Sequence
  Description of Artificial Sequence: Synthetic oligonucleotide
  Target: ATXN1; (+) strand; PAM type: YTN; PAM sequence: TTA
aaccccattttattaaactg

SEQ ID NO: 249463 - DNA, 20 bp, Artificial Sequence
  Description of Artificial Sequence: Synthetic oligonucleotide
  Target: ATXN1; (+) strand; PAM type: YTN; PAM sequence: TTT
tattaaactgttcagggatc

SEQ ID NO: 249464 - DNA, 20 bp, Artificial Sequence
  Description of Artificial Sequence: Synthetic oligonucleotide
  Target: ATXN1; (+) strand; PAM type: YTN; PAM sequence: TTT
attaaactgttcagggatcc

SEQ ID NO: 249465 - DNA, 20 bp, Artificial Sequence
  Description of Artificial Sequence: Synthetic oligonucleotide
  Target: ATXN1; (+) strand; PAM type: YTN; PAM sequence: TTA
ttaaactgttcagggatcca

SEQ ID NO: 249466 - DNA, 20 bp, Artificial Sequence
  Description of Artificial Sequence: Synthetic oligonucleotide
  Target: ATXN1; (+) strand; PAM type: YTN; PAM sequence: TTA
aactgttcagggatccactc

SEQ ID NO: 249467 - DNA, 20 bp, Artificial Sequence
  Description of Artificial Sequence: Synthetic oligonucleotide
  Target: ATXN1; (+) strand; PAM type: YTN; PAM sequence: CTG
ttcagggatccactcgttca

SEQ ID NO: 249468 - DNA, 20 bp, Artificial Sequence
  Description of Artificial Sequence: Synthetic oligonucleotide
  Target: ATXN1; (+) strand; PAM type: YTN; PAM sequence: TTC
agggatccactcgttcagat

SEQ ID NO: 249469 - DNA, 20 bp, Artificial Sequence
  Description of Artificial Sequence: Synthetic oligonucleotide
  Target: ATXN1; (+) strand; PAM type: YTN; PAM sequence: CTC
gttcagattattcaacattt

SEQ ID NO: 249470 - DNA, 20 bp, Artificial Sequence
  Description of Artificial Sequence: Synthetic oligonucleotide
  Target: ATXN1; (+) strand; PAM type: YTN; PAM sequence: TTC
agattattcaacatttacgt

SEQ ID NO: 249471 - DNA, 20 bp, Artificial Sequence
  Description of Artificial Sequence: Synthetic oligonucleotide
  Target: ATXN1; (+) strand; PAM type: YTN; PAM sequence: TTA
ttcaacatttacgtgccagg

SEQ ID NO: 249472 - DNA, 20 bp, Artificial Sequence
  Description of Artificial Sequence: Synthetic oligonucleotide
  Target: ATXN1; (+) strand; PAM type: YTN; PAM sequence: TTC
aacatttacgtgccaggcac

SEQ ID NO: 249473 - DNA, 20 bp, Artificial Sequence
  Description of Artificial Sequence: Synthetic oligonucleotide
  Target: ATXN1; (+) strand; PAM type: YTN; PAM sequence: TTT
acgtgccaggcacatcatgg

SEQ ID NO: 249474 - DNA, 20 bp, Artificial Sequence
  Description of Artificial Sequence: Synthetic oligonucleotide
  Target: ATXN1; (+) strand; PAM type: YTN; PAM sequence: TTA
cgtgccaggcacatcatggt

SEQ ID NO: 249475 - DNA, 20 bp, Artificial Sequence
  Description of Artificial Sequence: Synthetic oligonucleotide
  Target: ATXN1; (+) strand; PAM type: YTN; PAM sequence: CTT
ggtgccttgtctccttcaag

SEQ ID NO: 249476 - DNA, 20 bp, Artificial Sequence
  Description of Artificial Sequence: Synthetic oligonucleotide
  Target: ATXN1; (+) strand; PAM type: YTN; PAM sequence: TTG
gtgccttgtctccttcaagg

SEQ ID NO: 249477 - DNA, 20 bp, Artificial Sequence
  Description of Artificial Sequence: Synthetic oligonucleotide
  Target: ATXN1; (+) strand; PAM type: YTN; PAM sequence: CTT
gtctccttcaaggagcttcc

SEQ ID NO: 249478 - DNA, 20 bp, Artificial Sequence
  Description of Artificial Sequence: Synthetic oligonucleotide
  Target: ATXN1; (+) strand; PAM type: YTN; PAM sequence: TTG
tctccttcaaggagcttcca

SEQ ID NO: 249479 - DNA, 20 bp, Artificial Sequence
  Description of Artificial Sequence: Synthetic oligonucleotide
  Target: ATXN1; (+) strand; PAM type: YTN; PAM sequence: CTC
cttcaaggagcttccagtcc

SEQ ID NO: 249480 - DNA, 20 bp, Artificial Sequence
  Description of Artificial Sequence: Synthetic oligonucleotide
  Target: ATXN1; (+) strand; PAM type: YTN; PAM sequence: CTT
caaggagcttccagtccaca

SEQ ID NO: 249481 - DNA, 20 bp, Artificial Sequence
  Description of Artificial Sequence: Synthetic oligonucleotide
  Target: ATXN1; (+) strand; PAM type: YTN; PAM sequence: TTC
aaggagcttccagtccacaa

SEQ ID NO: 249482 - DNA, 20 bp, Artificial Sequence
  Description of Artificial Sequence: Synthetic oligonucleotide
  Target: ATXN1; (+) strand; PAM type: YTN; PAM sequence: CTT
ccagtccacaaggggctaac

SEQ ID NO: 249483 - DNA, 20 bp, Artificial Sequence
  Description of Artificial Sequence: Synthetic oligonucleotide
  Target: ATXN1; (+) strand; PAM type: YTN; PAM sequence: TTC
cagtccacaaggggctaaca

SEQ ID NO: 249484 - DNA, 20 bp, Artificial Sequence
  Description of Artificial Sequence: Synthetic oligonucleotide
  Target: ATXN1; (+) strand; PAM type: YTN; PAM sequence: CTA
acagggaaatgagtggtgac

SEQ ID NO: 249485 - DNA, 20 bp, Artificial Sequence
  Description of Artificial Sequence: Synthetic oligonucleotide
  Target: ATXN1; (+) strand; PAM type: YTN; PAM sequence: CTA
cagctaaaaggcagttgctc

SEQ ID NO: 249486 - DNA, 20 bp, Artificial Sequence
  Description of Artificial Sequence: Synthetic oligonucleotide
  Target: ATXN1; (+) strand; PAM type: YTN; PAM sequence: CTA
aaaggcagttgctcctgtct

SEQ ID NO: 249487 - DNA, 20 bp, Artificial Sequence
  Description of Artificial Sequence: Synthetic oligonucleotide
  Target: ATXN1; (+) strand; PAM type: YTN; PAM sequence: TTG
ctcctgtcttcccagaatgg

SEQ ID NO: 249488 - DNA, 20 bp, Artificial Sequence
  Description of Artificial Sequence: Synthetic oligonucleotide
  Target: ATXN1; (+) strand; PAM type: YTN; PAM sequence: CTC
ctgtcttcccagaatggcgg

SEQ ID NO: 249489 - DNA, 20 bp, Artificial Sequence
  Description of Artificial Sequence: Synthetic oligonucleotide
  Target: ATXN1; (+) strand; PAM type: YTN; PAM sequence: CTG
tcttcccagaatggcggtga

SEQ ID NO: 249490 - DNA, 20 bp, Artificial Sequence
  Description of Artificial Sequence: Synthetic oligonucleotide
  Target: ATXN1; (+) strand; PAM type: YTN; PAM sequence: CTT
cccagaatggcggtgataag

SEQ ID NO: 249491 - DNA, 20 bp, Artificial Sequence
  Description of Artificial Sequence: Synthetic oligonucleotide
  Target: ATXN1; (+) strand; PAM type: YTN; PAM sequence: TTC
ccagaatggcggtgataagc

SEQ ID NO: 249492 - DNA, 20 bp, Artificial Sequence
  Description of Artificial Sequence: Synthetic oligonucleotide
  Target: ATXN1; (+) strand; PAM type: YTN; PAM sequence: CTA
gaggtatacccaggagagac

SEQ ID NO: 249493 - DNA, 20 bp, Artificial Sequence
  Description of Artificial Sequence: Synthetic oligonucleotide
  Target: ATXN1; (+) strand; PAM type: YTN; PAM sequence: CTC
aatcagcactgttgttttct

SEQ ID NO: 249494 - DNA, 20 bp, Artificial Sequence
  Description of Artificial Sequence: Synthetic oligonucleotide
  Target: ATXN1; (+) strand; PAM type: YTN; PAM sequence: CTG
ttgttttctttttctttttt

SEQ ID NO: 249495 - DNA, 20 bp, Artificial Sequence
  Description of Artificial Sequence: Synthetic oligonucleotide
  Target: ATXN1; (+) strand; PAM type: YTN; PAM sequence: TTG
ttttctttttcttttttcat

SEQ ID NO: 249496 - DNA, 20 bp, Artificial Sequence
  Description of Artificial Sequence: Synthetic oligonucleotide
  Target: ATXN1; (+) strand; PAM type: YTN; PAM sequence: TTT
tctttttcttttttcatata

SEQ ID NO: 249497 - DNA, 20 bp, Artificial Sequence
  Description of Artificial Sequence: Synthetic oligonucleotide
  Target: ATXN1; (+) strand; PAM type: YTN; PAM sequence: TTT
ctttttcttttttcatatat

SEQ ID NO: 249498 - DNA, 20 bp, Artificial Sequence
  Description of Artificial Sequence: Synthetic oligonucleotide
  Target: ATXN1; (+) strand; PAM type: YTN; PAM sequence: TTC
tttttcttttttcatatata

SEQ ID NO: 249499 - DNA, 20 bp, Artificial Sequence
  Description of Artificial Sequence: Synthetic oligonucleotide
  Target: ATXN1; (+) strand; PAM type: YTN; PAM sequence: CTT
tttcttttttcatatatata

SEQ ID NO: 249500 - DNA, 20 bp, Artificial Sequence
  Description of Artificial Sequence: Synthetic oligonucleotide
  Target: ATXN1; (+) strand; PAM type: YTN; PAM sequence: TTT
ttcttttttcatatatatat

SEQ ID NO: 249501 - DNA, 20 bp, Artificial Sequence
  Description of Artificial Sequence: Synthetic oligonucleotide
  Target: ATXN1; (+) strand; PAM type: YTN; PAM sequence: TTT
tcttttttcatatatatata

SEQ ID NO: 249502 - DNA, 20 bp, Artificial Sequence
  Description of Artificial Sequence: Synthetic oligonucleotide
  Target: ATXN1; (+) strand; PAM type: YTN; PAM sequence: TTT
cttttttcatatatatatat

SEQ ID NO: 249503 - DNA, 20 bp, Artificial Sequence
  Description of Artificial Sequence: Synthetic oligonucleotide
  Target: ATXN1; (+) strand; PAM type: YTN; PAM sequence: TTC
ttttttcatatatatatata

SEQ ID NO: 249504 - DNA, 20 bp, Artificial Sequence
  Description of Artificial Sequence: Synthetic oligonucleotide
  Target: ATXN1; (+) strand; PAM type: YTN; PAM sequence: CTT
ttttcatatatatatatatt

SEQ ID NO: 249505 - DNA, 20 bp, Artificial Sequence
  Description of Artificial Sequence: Synthetic oligonucleotide
  Target: ATXN1; (+) strand; PAM type: YTN; PAM sequence: TTT
tttcatatatatatatattt

SEQ ID NO: 249506 - DNA, 20 bp, Artificial Sequence
  Description of Artificial Sequence: Synthetic oligonucleotide
  Target: ATXN1; (+) strand; PAM type: YTN; PAM sequence: TTT
ttcatatatatatatatttt

SEQ ID NO: 249507 - DNA, 20 bp, Artificial Sequence
  Description of Artificial Sequence: Synthetic oligonucleotide
  Target: ATXN1; (+) strand; PAM type: YTN; PAM sequence: TTT
tcatatatatatatatttta

SEQ ID NO: 249508 - DNA, 20 bp, Artificial Sequence
  Description of Artificial Sequence: Synthetic oligonucleotide
  Target: ATXN1; (+) strand; PAM type: YTN; PAM sequence: TTT
catatatatatatattttat

SEQ ID NO: 249509 - DNA, 20 bp, Artificial Sequence
  Description of Artificial Sequence: Synthetic oligonucleotide
  Target: ATXN1; (+) strand; PAM type: YTN; PAM sequence: TTC
atatatatatatattttatt

SEQ ID NO: 249510 - DNA, 20 bp, Artificial Sequence
  Description of Artificial Sequence: Synthetic oligonucleotide
  Target: ATXN1; (+) strand; PAM type: YTN; PAM sequence: TTT
tattacactttaagttctag

SEQ ID NO: 249511 - DNA, 20 bp, Artificial Sequence
  Description of Artificial Sequence: Synthetic oligonucleotide
  Target: ATXN1; (+) strand; PAM type: YTN; PAM sequence: TTT
attacactttaagttctagg

SEQ ID NO: 249512 - DNA, 20 bp, Artificial Sequence
  Description of Artificial Sequence: Synthetic oligonucleotide
  Target: ATXN1; (+) strand; PAM type: YTN; PAM sequence: TTA
ttacactttaagttctaggg

SEQ ID NO: 249513 - DNA, 20 bp, Artificial Sequence
  Description of Artificial Sequence: Synthetic oligonucleotide
  Target: ATXN1; (+) strand; PAM type: YTN; PAM sequence: TTA
cactttaagttctagggtac

SEQ ID NO: 249514 - DNA, 20 bp, Artificial Sequence
  Description of Artificial Sequence: Synthetic oligonucleotide
  Target: ATXN1; (+) strand; PAM type: YTN; PAM sequence: CTT
taagttctagggtacatatg

SEQ ID NO: 249515 - DNA, 20 bp, Artificial Sequence
  Description of Artificial Sequence: Synthetic oligonucleotide
  Target: ATXN1; (+) strand; PAM type: YTN; PAM sequence: TTT
aagttctagggtacatatgc

SEQ ID NO: 249516 - DNA, 20 bp, Artificial Sequence
  Description of Artificial Sequence: Synthetic oligonucleotide
  Target: ATXN1; (+) strand; PAM type: YTN; PAM sequence: TTA
agttctagggtacatatgca

SEQ ID NO: 249517 - DNA, 20 bp, Artificial Sequence
  Description of Artificial Sequence: Synthetic oligonucleotide
  Target: ATXN1; (+) strand; PAM type: YTN; PAM sequence: TTC
tagggtacatatgcacaatg

SEQ ID NO: 249518 - DNA, 20 bp, Artificial Sequence
  Description of Artificial Sequence: Synthetic oligonucleotide
  Target: ATXN1; (+) strand; PAM type: YTN; PAM sequence: CTA
gggtacatatgcacaatgtg

SEQ ID NO: 249519 - DNA, 20 bp, Artificial Sequence
  Description of Artificial Sequence: Synthetic oligonucleotide
  Target: ATXN1; (+) strand; PAM type: YTN; PAM sequence: TTT
gttacatatgtatacatgtg

SEQ ID NO: 249520 - DNA, 20 bp, Artificial Sequence
  Description of Artificial Sequence: Synthetic oligonucleotide
  Target: ATXN1; (+) strand; PAM type: YTN; PAM sequence: TTG
ttacatatgtatacatgtgc

SEQ ID NO: 249521 - DNA, 20 bp, Artificial Sequence
  Description of Artificial Sequence: Synthetic oligonucleotide
  Target: ATXN1; (+) strand; PAM type: YTN; PAM sequence: TTA
catatgtatacatgtgccat

SEQ ID NO: 249522 - DNA, 20 bp, Artificial Sequence
  Description of Artificial Sequence: Synthetic oligonucleotide
  Target: ATXN1; (+) strand; PAM type: YTN; PAM sequence: TTC
caaaacagaattaccggttt

SEQ ID NO: 249523 - DNA, 20 bp, Artificial Sequence
  Description of Artificial Sequence: Synthetic oligonucleotide
  Target: ATXN1; (+) strand; PAM type: YTN; PAM sequence: TTA
ccggttttcttttttttctt

SEQ ID NO: 249524 - DNA, 20 bp, Artificial Sequence
  Description of Artificial Sequence: Synthetic oligonucleotide
  Target: ATXN1; (+) strand; PAM type: YTN; PAM sequence: TTT
tcttttttttcttattgaga

SEQ ID NO: 249525 - DNA, 20 bp, Artificial Sequence
  Description of Artificial Sequence: Synthetic oligonucleotide
  Target: ATXN1; (+) strand; PAM type: YTN; PAM sequence: TTT
cttttttttcttattgagac

SEQ ID NO: 249526 - DNA, 20 bp, Artificial Sequence
  Description of Artificial Sequence: Synthetic oligonucleotide
  Target: ATXN1; (+) strand; PAM type: YTN; PAM sequence: TTC
ttttttttcttattgagaca

SEQ ID NO: 249527 - DNA, 20 bp, Artificial Sequence
  Description of Artificial Sequence: Synthetic oligonucleotide
  Target: ATXN1; (+) strand; PAM type: YTN; PAM sequence: CTT
ttttttcttattgagacaaa

SEQ ID NO: 249528 - DNA, 20 bp, Artificial Sequence
  Description of Artificial Sequence: Synthetic oligonucleotide
  Target: ATXN1; (+) strand; PAM type: YTN; PAM sequence: TTT
tttttcttattgagacaaag

SEQ ID NO: 249529 - DNA, 20 bp, Artificial Sequence
  Description of Artificial Sequence: Synthetic oligonucleotide
  Target: ATXN1; (+) strand; PAM type: YTN; PAM sequence: TTT
ttttcttattgagacaaagt

SEQ ID NO: 249530 - DNA, 20 bp, Artificial Sequence
  Description of Artificial Sequence: Synthetic oligonucleotide
  Target: ATXN1; (+) strand; PAM type: YTN; PAM sequence: TTT
tttcttattgagacaaagtc

SEQ ID NO: 249531 - DNA, 20 bp, Artificial Sequence
  Description of Artificial Sequence: Synthetic oligonucleotide
  Target: ATXN1; (+) strand; PAM type: YTN; PAM sequence: TTT
ttcttattgagacaaagtct

SEQ ID NO: 249532 - DNA, 20 bp, Artificial Sequence
  Description of Artificial Sequence: Synthetic oligonucleotide
  Target: ATXN1; (+) strand; PAM type: YTN; PAM sequence: TTT
tcttattgagacaaagtctc

SEQ ID NO: 249533 - DNA, 20 bp, Artificial Sequence
  Description of Artificial Sequence: Synthetic oligonucleotide
  Target: ATXN1; (+) strand; PAM type: YTN; PAM sequence: TTT
cttattgagacaaagtctca

SEQ ID NO: 249534 - DNA, 20 bp, Artificial Sequence
  Description of Artificial Sequence: Synthetic oligonucleotide
  Target: ATXN1; (+) strand; PAM type: YTN; PAM sequence: TTC
ttattgagacaaagtctcac

SEQ ID NO: 249535 - DNA, 20 bp, Artificial Sequence
  Description of Artificial Sequence: Synthetic oligonucleotide
  Target: ATXN1; (+) strand; PAM type: YTN; PAM sequence: CTT
attgagacaaagtctcactc

SEQ ID NO: 249536 - DNA, 20 bp, Artificial Sequence
  Description of Artificial Sequence: Synthetic oligonucleotide
  Target: ATXN1; (+) strand; PAM type: YTN; PAM sequence: TTA
ttgagacaaagtctcactct

SEQ ID NO: 249537 - DNA, 20 bp, Artificial Sequence
  Description of Artificial Sequence: Synthetic oligonucleotide
  Target: ATXN1; (+) strand; PAM type: YTN; PAM sequence: TTG
agacaaagtctcactctgtt

SEQ ID NO: 249538 - DNA, 20 bp, Artificial Sequence
  Description of Artificial Sequence: Synthetic oligonucleotide
  Target: ATXN1; (+) strand; PAM type: YTN; PAM sequence: CTC
actctgttgcccaggctgga

SEQ ID NO: 249539 - DNA, 20 bp, Artificial Sequence
  Description of Artificial Sequence: Synthetic oligonucleotide
  Target: ATXN1; (+) strand; PAM type: YTN; PAM sequence: CTC
tgttgcccaggctggagtgc

SEQ ID NO: 249540 - DNA, 20 bp, Artificial Sequence
  Description of Artificial Sequence: Synthetic oligonucleotide
  Target: ATXN1; (+) strand; PAM type: YTN; PAM sequence: CTG
ttgcccaggctggagtgcag

SEQ ID NO: 249541 - DNA, 20 bp, Artificial Sequence
  Description of Artificial Sequence: Synthetic oligonucleotide
  Target: ATXN1; (+) strand; PAM type: YTN; PAM sequence: TTG
cccaggctggagtgcagtgg

SEQ ID NO: 249542 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggtgcaacctt

SEQ ID NO: 249543 - DNA, 20 bp, Artificial Sequence
  Description of Artificial Sequence: Synthetic oligonucleotide
  Target: ATXN1; (+) strand; PAM type: YTN; PAM sequence: CTT
ggcttactgcaacctctgcc

SEQ ID NO: 249544 - DNA, 20 bp, Artificial Sequence
  Description of Artificial Sequence: Synthetic oligonucleotide
  Target: ATXN1; (+) strand; PAM type: YTN; PAM sequence: TTG
gcttactgcaacctctgcct

SEQ ID NO: 249545 - DNA, 20 bp, Artificial Sequence
  Description of Artificial Sequence: Synthetic oligonucleotide
  Target: ATXN1; (+) strand; PAM type: YTN; PAM sequence: CTT
actgcaacctctgcctccca

SEQ ID NO: 249546 - DNA, 20 bp, Artificial Sequence
  Description of Artificial Sequence: Synthetic oligonucleotide
  Target: ATXN1; (+) strand; PAM type: YTN; PAM sequence: TTA
ctgcaacctctgcctcccaa

SEQ ID NO: 249547 - DNA, 20 bp, Artificial Sequence
  Description of Artificial Sequence: Synthetic oligonucleotide
  Target: ATXN1; (+) strand; PAM type: YTN; PAM sequence: CTG
caacctctgcctcccaagtt

SEQ ID NO: 249548 - DNA, 20 bp, Artificial Sequence
  Description of Artificial Sequence: Synthetic oligonucleotide
  Target: ATXN1; (+) strand; PAM type: YTN; PAM sequence: CTC
tgcctcccaagttcaagtga

SEQ ID NO: 249549 - DNA, 20 bp, Artificial Sequence
  Description of Artificial Sequence: Synthetic oligonucleotide
  Target: ATXN1; (+) strand; PAM type: YTN; PAM sequence: CTG
cctcccaagttcaagtgatt

SEQ ID NO: 249550 - DNA, 20 bp, Artificial Sequence
  Description of Artificial Sequence: Synthetic oligonucleotide
  Target: ATXN1; (+) strand; PAM type: YTN; PAM sequence: CTC
ccaagttcaagtgattcttc

SEQ ID NO: 249551 - DNA, 20 bp, Artificial Sequence
  Description of Artificial Sequence: Synthetic oligonucleotide
  Target: ATXN1; (+) strand; PAM type: YTN; PAM sequence: TTC
aagtgattcttctgcctcag

SEQ ID NO: 249552 - DNA, 20 bp, Artificial Sequence
  Description of Artificial Sequence: Synthetic oligonucleotide
  Target: ATXN1; (+) strand; PAM type: YTN; PAM sequence: TTC
ttctgcctcagcctcctgag

SEQ ID NO: 249553 - DNA, 20 bp, Artificial Sequence
  Description of Artificial Sequence: Synthetic oligonucleotide
  Target: ATXN1; (+) strand; PAM type: YTN; PAM sequence: CTT
ctgcctcagcctcctgagta

SEQ ID NO: 249554 - DNA, 20 bp, Artificial Sequence
  Description of Artificial Sequence: Synthetic oligonucleotide
  Target: ATXN1; (+) strand; PAM type: YTN; PAM sequence: TTC
tgcctcagcctcctgagtag

SEQ ID NO: 249555 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcctgagtagct

SEQ ID NO: 249556 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagtagctggga

SEQ ID NO: 249557 - DNA, 20 bp, Artificial Sequence
  Description of Artificial Sequence: Synthetic oligonucleotide
  Target: ATXN1; (+) strand; PAM type: YTN; PAM sequence: CTC
ctgagtagctgggactgcag

SEQ ID NO: 249558 - DNA, 20 bp, Artificial Sequence
  Description of Artificial Sequence: Synthetic oligonucleotide
  Target: ATXN1; (+) strand; PAM type: YTN; PAM sequence: CTG
agtagctgggactgcaggca

SEQ ID NO: 249559 - DNA, 20 bp, Artificial Sequence
  Description of Artificial Sequence: Synthetic oligonucleotide
  Target: ATXN1; (+) strand; PAM type: YTN; PAM sequence: CTG
ggactgcaggcacgcatcac

SEQ ID NO: 249560 - DNA, 20 bp, Artificial Sequence
  Description of Artificial Sequence: Synthetic oligonucleotide
  Target: ATXN1; (+) strand; PAM type: YTN; PAM sequence: CTG
caggcacgcatcaccacgcc

SEQ ID NO: 249561 - DNA, 20 bp, Artificial Sequence
  Description of Artificial Sequence: Synthetic oligonucleotide
  Target: ATXN1; (+) strand; PAM type: YTN; PAM sequence: CTG
cctaactttttgtattttta

SEQ ID NO: 249562 - DNA, 20 bp, Artificial Sequence
  Description of Artificial Sequence: Synthetic oligonucleotide
  Target: ATXN1; (+) strand; PAM type: YTN; PAM sequence: CTA
actttttgtatttttagtag

SEQ ID NO: 249563 - DNA, 20 bp, Artificial Sequence
  Description of Artificial Sequence: Synthetic oligonucleotide
  Target: ATXN1; (+) strand; PAM type: YTN; PAM sequence: CTT
tttgtatttttagtagagat

SEQ ID NO: 249564 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagatg

SEQ ID NO: 249565 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagatgg

SEQ ID NO: 249566 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagatggg

SEQ ID NO: 249567 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagatgggg

SEQ ID NO: 249568 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatggggtttca

SEQ ID NO: 249569 - DNA, 20 bp, Artificial Sequence
  Description of Artificial Sequence: Synthetic oligonucleotide
  Target: ATXN1; (+) strand; PAM type: YTN; PAM sequence: TTT
tagtagagatggggtttcac

SEQ ID NO: 249570 - DNA, 20 bp, Artificial Sequence
  Description of Artificial Sequence: Synthetic oligonucleotide
  Target: ATXN1; (+) strand; PAM type: YTN; PAM sequence: TTT
agtagagatggggtttcacc

SEQ ID NO: 249571 - DNA, 20 bp, Artificial Sequence
  Description of Artificial Sequence: Synthetic oligonucleotide
  Target: ATXN1; (+) strand; PAM type: YTN; PAM sequence: TTA
gtagagatggggtttcacca

SEQ ID NO: 249572 - DNA, 20 bp, Artificial Sequence
  Description of Artificial Sequence: Synthetic oligonucleotide
  Target: ATXN1; (+) strand; PAM type: YTN; PAM sequence: TTT
caccatgttggccaggctgg

SEQ ID NO: 249573 - DNA, 20 bp, Artificial Sequence
  Description of Artificial Sequence: Synthetic oligonucleotide
  Target: ATXN1; (+) strand; PAM type: YTN; PAM sequence: TTC
accatgttggccaggctggt

SEQ ID NO: 249574 - DNA, 20 bp, Artificial Sequence
  Description of Artificial Sequence: Synthetic oligonucleotide
  Target: ATXN1; (+) strand; PAM type: YTN; PAM sequence: TTG
gccaggctggtctcgaactc

SEQ ID NO: 249575 - DNA, 20 bp, Artificial Sequence
  Description of Artificial Sequence: Synthetic oligonucleotide
  Target: ATXN1; (+) strand; PAM type: YTN; PAM sequence: CTG
gtctcgaactcctgacctca

SEQ ID NO: 249576 - DNA, 20 bp, Artificial Sequence
  Description of Artificial Sequence: Synthetic oligonucleotide
  Target: ATXN1; (+) strand; PAM type: YTN; PAM sequence: CTC
gaactcctgacctcaggtga

SEQ ID NO: 249577 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggtgatccacc

SEQ ID NO: 249578 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatccacccac

SEQ ID NO: 249579 - DNA, 20 bp, Artificial Sequence
  Description of Artificial Sequence: Synthetic oligonucleotide
  Target: ATXN1; (+) strand; PAM type: YTN; PAM sequence: CTC
aggtgatccacccacattgg

SEQ ID NO: 249580 - DNA, 20 bp, Artificial Sequence
  Description of Artificial Sequence: Synthetic oligonucleotide
  Target: ATXN1; (+) strand; PAM type: YTN; PAM sequence: TTG
gcctcccaaagtgctgggat

SEQ ID NO: 249581 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 249582 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcattgagcca

SEQ ID NO: 249583 - DNA, 20 bp, Artificial Sequence
  Description of Artificial Sequence: Synthetic oligonucleotide
  Target: ATXN1; (+) strand; PAM type: YTN; PAM sequence: TTA
caggcattgagccactgcgc

SEQ ID NO: 249584 - DNA, 20 bp, Artificial Sequence
  Description of Artificial Sequence: Synthetic oligonucleotide
  Target: ATXN1; (+) strand; PAM type: YTN; PAM sequence: TTG
agccactgcgcctggccgaa

SEQ ID NO: 249585 - DNA, 20 bp, Artificial Sequence
  Description of Artificial Sequence: Synthetic oligonucleotide
  Target: ATXN1; (+) strand; PAM type: YTN; PAM sequence: CTG
cgcctggccgaattattggt

SEQ ID NO: 249586 - DNA, 20 bp, Artificial Sequence
  Description of Artificial Sequence: Synthetic oligonucleotide
  Target: ATXN1; (+) strand; PAM type: YTN; PAM sequence: CTG
gccgaattattggttttcaa

SEQ ID NO: 249587 - DNA, 20 bp, Artificial Sequence
  Description of Artificial Sequence: Synthetic oligonucleotide
  Target: ATXN1; (+) strand; PAM type: YTN; PAM sequence: TTA
ttggttttcaaagtgtttct

SEQ ID NO: 249588 - DNA, 20 bp, Artificial Sequence
  Description of Artificial Sequence: Synthetic oligonucleotide
  Target: ATXN1; (+) strand; PAM type: YTN; PAM sequence: TTG
gttttcaaagtgtttcttct

SEQ ID NO: 249589 - DNA, 20 bp, Artificial Sequence
  Description of Artificial Sequence: Synthetic oligonucleotide
  Target: ATXN1; (+) strand; PAM type: YTN; PAM sequence: TTT
tcaaagtgtttcttcttcct

SEQ ID NO: 249590 - DNA, 20 bp, Artificial Sequence
  Description of Artificial Sequence: Synthetic oligonucleotide
  Target: ATXN1; (+) strand; PAM type: YTN; PAM sequence: TTT
caaagtgtttcttcttcctc

SEQ ID NO: 249591 - DNA, 20 bp, Artificial Sequence
  Description of Artificial Sequence: Synthetic oligonucleotide
  Target: ATXN1; (+) strand; PAM type: YTN; PAM sequence: TTC
aaagtgtttcttcttcctct

SEQ ID NO: 249592 - DNA, 20 bp, Artificial Sequence
  Description of Artificial Sequence: Synthetic oligonucleotide
  Target: ATXN1; (+) strand; PAM type: YTN; PAM sequence: TTT
cttcttcctcttcttcatac

SEQ ID NO: 249593 - DNA, 20 bp, Artificial Sequence
  Description of Artificial Sequence: Synthetic oligonucleotide
  Target: ATXN1; (+) strand; PAM type: YTN; PAM sequence: TTC
ttcttcctcttcttcatact

SEQ ID NO: 249594 - DNA, 20 bp, Artificial Sequence
  Description of Artificial Sequence: Synthetic oligonucleotide
  Target: ATXN1; (+) strand; PAM type: YTN; PAM sequence: CTT
cttcctcttcttcatactgt

SEQ ID NO: 249595 - DNA, 20 bp, Artificial Sequence
  Description of Artificial Sequence: Synthetic oligonucleotide
  Target: ATXN1; (+) strand; PAM type: YTN; PAM sequence: TTC
ttcctcttcttcatactgta

SEQ ID NO: 249596 - DNA, 20 bp, Artificial Sequence
  Description of Artificial Sequence: Synthetic oligonucleotide
  Target: ATXN1; (+) strand; PAM type: YTN; PAM sequence: CTT
cctcttcttcatactgtaag

SEQ ID NO: 249597 - DNA, 20 bp, Artificial Sequence
  Description of Artificial Sequence: Synthetic oligonucleotide
  Target: ATXN1; (+) strand; PAM type: YTN; PAM sequence: TTC
ctcttcttcatactgtaaga

SEQ ID NO: 249598 - DNA, 20 bp, Artificial Sequence
  Description of Artificial Sequence: Synthetic oligonucleotide
  Target: ATXN1; (+) strand; PAM type: YTN; PAM sequence: CTC
ttcttcatactgtaagaaca

SEQ ID NO: 249599 - DNA, 20 bp, Artificial Sequence
  Description of Artificial Sequence: Synthetic oligonucleotide
  Target: ATXN1; (+) strand; PAM type: YTN; PAM sequence: CTT
cttcatactgtaagaacatt

SEQ ID NO: 249600 - DNA, 20 bp, Artificial Sequence
  Description of Artificial Sequence: Synthetic oligonucleotide
  Target: ATXN1; (+) strand; PAM type: YTN; PAM sequence: TTC
ttcatactgtaagaacattc

SEQ ID NO: 249601 - DNA, 20 bp, Artificial Sequence
  Description of Artificial Sequence: Synthetic oligonucleotide
  Target: ATXN1; (+) strand; PAM type: YTN; PAM sequence: CTT
catactgtaagaacattcaa

SEQ ID NO: 249602 - DNA, 20 bp, Artificial Sequence
  Description of Artificial Sequence: Synthetic oligonucleotide
  Target: ATXN1; (+) strand; PAM type: YTN; PAM sequence: TTC
atactgtaagaacattcaaa

SEQ ID NO: 249603 - DNA, 20 bp, Artificial Sequence
  Description of Artificial Sequence: Synthetic oligonucleotide
  Target: ATXN1; (+) strand; PAM type: YTN; PAM sequence: CTG
taagaacattcaaatgacat

SEQ ID NO: 249604 - DNA, 20 bp, Artificial Sequence
  Description of Artificial Sequence: Synthetic oligonucleotide
  Target: ATXN1; (+) strand; PAM type: YTN; PAM sequence: TTC
aaatgacatttgggggctta

SEQ ID NO: 249605 - DNA, 20 bp, Artificial Sequence
  Description of Artificial Sequence: Synthetic oligonucleotide
  Target: ATXN1; (+) strand; PAM type: YTN; PAM sequence: TTT
gggggcttaacaccccttgg

SEQ ID NO: 249606 - DNA, 20 bp, Artificial Sequence
  Description of Artificial Sequence: Synthetic oligonucleotide
  Target: ATXN1; (+) strand; PAM type: YTN; PAM sequence: TTG
ggggcttaacaccccttggc

SEQ ID NO: 249607 - DNA, 20 bp, Artificial Sequence
  Description of Artificial Sequence: Synthetic oligonucleotide
  Target: ATXN1; (+) strand; PAM type: YTN; PAM sequence: CTT
aacaccccttggctttagcc

SEQ ID NO: 249608 - DNA, 20 bp, Artificial Sequence
  Description of Artificial Sequence: Synthetic oligonucleotide
  Target: ATXN1; (+) strand; PAM type: YTN; PAM sequence: TTA
acaccccttggctttagcca

SEQ ID NO: 249609 - DNA, 20 bp, Artificial Sequence
  Description of Artificial Sequence: Synthetic oligonucleotide
  Target: ATXN1; (+) strand; PAM type: YTN; PAM sequence: CTT
ggctttagccagatgtgtcc

SEQ ID NO: 249610 - DNA, 20 bp, Artificial Sequence
  Description of Artificial Sequence: Synthetic oligonucleotide
  Target: ATXN1; (+) strand; PAM type: YTN; PAM sequence: TTG
gctttagccagatgtgtcca

SEQ ID NO: 249611 - DNA, 20 bp, Artificial Sequence
  Description of Artificial Sequence: Synthetic oligonucleotide
  Target: ATXN1; (+) strand; PAM type: YTN; PAM sequence: CTT
tagccagatgtgtccatgga

SEQ ID NO: 249612 - DNA, 20 bp, Artificial Sequence
  Description of Artificial Sequence: Synthetic oligonucleotide
  Target: ATXN1; (+) strand; PAM type: YTN; PAM sequence: TTT
agccagatgtgtccatggaa

SEQ ID NO: 249613 - DNA, 20 bp, Artificial Sequence
  Description of Artificial Sequence: Synthetic oligonucleotide
  Target: ATXN1; (+) strand; PAM type: YTN; PAM sequence: TTA
gccagatgtgtccatggaaa

SEQ ID NO: 249614 - DNA, 20 bp, Artificial Sequence
  Description of Artificial Sequence: Synthetic oligonucleotide
  Target: ATXN1; (+) strand; PAM type: YTN; PAM sequence: CTC
tagaaacattattttacttt

SEQ ID NO: 249615 - DNA, 20 bp, Artificial Sequence
  Description of Artificial Sequence: Synthetic oligonucleotide
  Target: ATXN1; (+) strand; PAM type: YTN; PAM sequence: CTA
gaaacattattttacttttc

SEQ ID NO: 249616 - DNA, 20 bp, Artificial Sequence
  Description of Artificial Sequence: Synthetic oligonucleotide
  Target: ATXN1; (+) strand; PAM type: YTN; PAM sequence: TTA
ttttacttttcatctgtttg

SEQ ID NO: 249617 - DNA, 20 bp, Artificial Sequence
  Description of Artificial Sequence: Synthetic oligonucleotide
  Target: ATXN1; (+) strand; PAM type: YTN; PAM sequence: TTT
tacttttcatctgtttgtca

SEQ ID NO: 249618 - DNA, 20 bp, Artificial Sequence
  Description of Artificial Sequence: Synthetic oligonucleotide
  Target: ATXN1; (+) strand; PAM type: YTN; PAM sequence: TTT
acttttcatctgtttgtcag

SEQ ID NO: 249619 - DNA, 20 bp, Artificial Sequence
  Description of Artificial Sequence: Synthetic oligonucleotide
  Target: ATXN1; (+) strand; PAM type: YTN; PAM sequence: TTA
cttttcatctgtttgtcagt

SEQ ID NO: 249620 - DNA, 20 bp, Artificial Sequence
  Description of Artificial Sequence: Synthetic oligonucleotide
  Target: ATXN1; (+) strand; PAM type: YTN; PAM sequence: CTT
ttcatctgtttgtcagttct

SEQ ID NO: 249621 - DNA, 20 bp, Artificial Sequence
  Description of Artificial Sequence: Synthetic oligonucleotide
  Target: ATXN1; (+) strand; PAM type: YTN; PAM sequence: TTT
tcatctgtttgtcagttcta

SEQ ID NO: 249622 - DNA, 20 bp, Artificial Sequence
  Description of Artificial Sequence: Synthetic oligonucleotide
  Target: ATXN1; (+) strand; PAM type: YTN; PAM sequence: TTT
catctgtttgtcagttctag

SEQ ID NO: 249623 - DNA, 20 bp, Artificial Sequence
  Description of Artificial Sequence: Synthetic oligonucleotide
  Target: ATXN1; (+) strand; PAM type: YTN; PAM sequence: TTC
atctgtttgtcagttctagt

SEQ ID NO: 249624 - DNA, 20 bp, Artificial Sequence
  Description of Artificial Sequence: Synthetic oligonucleotide
  Target: ATXN1; (+) strand; PAM type: YTN; PAM sequence: CTG
tttgtcagttctagtcaatg

SEQ ID NO: 249625 - DNA, 20 bp, Artificial Sequence
  Description of Artificial Sequence: Synthetic oligonucleotide
  Target: ATXN1; (+) strand; PAM type: YTN; PAM sequence: TTT
gtcagttctagtcaatgtaa

SEQ ID NO: 249626 - DNA, 20 bp, Artificial Sequence
  Description of Artificial Sequence: Synthetic oligonucleotide
  Target: ATXN1; (+) strand; PAM type: YTN; PAM sequence: TTG
tcagttctagtcaatgtaaa

SEQ ID NO: 249627 - DNA, 20 bp, Artificial Sequence
  Description of Artificial Sequence: Synthetic oligonucleotide
  Target: ATXN1; (+) strand; PAM type: YTN; PAM sequence: TTC
tagtcaatgtaaagcataga

SEQ ID NO: 249628 - DNA, 20 bp, Artificial Sequence
  Description of Artificial Sequence: Synthetic oligonucleotide
  Target: ATXN1; (+) strand; PAM type: YTN; PAM sequence: CTA
gtcaatgtaaagcatagact

SEQ ID NO: 249629 - DNA, 20 bp, Artificial Sequence
  Description of Artificial Sequence: Synthetic oligonucleotide
  Target: ATXN1; (+) strand; PAM type: YTN; PAM sequence: CTA
cagtcaaagggtgcattcag

SEQ ID NO: 249630 - DNA, 20 bp, Artificial Sequence
  Description of Artificial Sequence: Synthetic oligonucleotide
  Target: ATXN1; (+) strand; PAM type: YTN; PAM sequence: TTC
agtcccaaaactgtttacaa

SEQ ID NO: 249631 - DNA, 20 bp, Artificial Sequence
  Description of Artificial Sequence: Synthetic oligonucleotide
  Target: ATXN1; (+) strand; PAM type: YTN; PAM sequence: CTG
tttacaagcagtgtttaggg

SEQ ID NO: 249632 - DNA, 20 bp, Artificial Sequence
  Description of Artificial Sequence: Synthetic oligonucleotide
  Target: ATXN1; (+) strand; PAM type: YTN; PAM sequence: TTT
acaagcagtgtttagggagg

SEQ ID NO: 249633 - DNA, 20 bp, Artificial Sequence
  Description of Artificial Sequence: Synthetic oligonucleotide
  Target: ATXN1; (+) strand; PAM type: YTN; PAM sequence: TTA
caagcagtgtttagggagga

SEQ ID NO: 249634 - DNA, 20 bp, Artificial Sequence
  Description of Artificial Sequence: Synthetic oligonucleotide
  Target: ATXN1; (+) strand; PAM type: YTN; PAM sequence: TTT
agggaggacaatgggaatct

SEQ ID NO: 249635 - DNA, 20 bp, Artificial Sequence
  Description of Artificial Sequence: Synthetic oligonucleotide
  Target: ATXN1; (+) strand; PAM type: YTN; PAM sequence: TTA
gggaggacaatgggaatctg

SEQ ID NO: 249636 - DNA, 20 bp, Artificial Sequence
  Description of Artificial Sequence: Synthetic oligonucleotide
  Target: ATXN1; (+) strand; PAM type: YTN; PAM sequence: CTG
cctggacccaaacaacctgt

SEQ ID NO: 249637 - DNA, 20 bp, Artificial Sequence
  Description of Artificial Sequence: Synthetic oligonucleotide
  Target: ATXN1; (+) strand; PAM type: YTN; PAM sequence: CTG
gacccaaacaacctgtaatg

SEQ ID NO: 249638 - DNA, 20 bp, Artificial Sequence
  Description of Artificial Sequence: Synthetic oligonucleotide
  Target: ATXN1; (+) strand; PAM type: YTN; PAM sequence: CTG
taatgacctcatttttaaaa

SEQ ID NO: 249639 - DNA, 20 bp, Artificial Sequence
  Description of Artificial Sequence: Synthetic oligonucleotide
  Target: ATXN1; (+) strand; PAM type: YTN; PAM sequence: CTC
atttttaaaaaattaccttt

SEQ ID NO: 249640 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaattaccttttcct

SEQ ID NO: 249641 - DNA, 20 bp, Artificial Sequence
  Description of Artificial Sequence: Synthetic oligonucleotide
  Target: ATXN1; (+) strand; PAM type: YTN; PAM sequence: TTT
taaaaaattaccttttcctt

SEQ ID NO: 249642 - DNA, 20 bp, Artificial Sequence
  Description of Artificial Sequence: Synthetic oligonucleotide
  Target: ATXN1; (+) strand; PAM type: YTN; PAM sequence: TTT
aaaaaattaccttttccttc

SEQ ID NO: 249643 - DNA, 20 bp, Artificial Sequence
  Description of Artificial Sequence: Synthetic oligonucleotide
  Target: ATXN1; (+) strand; PAM type: YTN; PAM sequence: TTA
aaaaattaccttttccttcc

SEQ ID NO: 249644 - DNA, 20 bp, Artificial Sequence
  Description of Artificial Sequence: Synthetic oligonucleotide
  Target: ATXN1; (+) strand; PAM type: YTN; PAM sequence: TTA
ccttttccttcccagctgta

SEQ ID NO: 249645 - DNA, 20 bp, Artificial Sequence
  Description of Artificial Sequence: Synthetic oligonucleotide
  Target: ATXN1; (+) strand; PAM type: YTN; PAM sequence: CTT
ttccttcccagctgtagaaa

SEQ ID NO: 249646 - DNA, 20 bp, Artificial Sequence
  Description of Artificial Sequence: Synthetic oligonucleotide
  Target: ATXN1; (+) strand; PAM type: YTN; PAM sequence: TTT
tccttcccagctgtagaaac

SEQ ID NO: 249647 - DNA, 20 bp, Artificial Sequence
  Description of Artificial Sequence: Synthetic oligonucleotide
  Target: ATXN1; (+) strand; PAM type: YTN; PAM sequence: TTT
ccttcccagctgtagaaact

SEQ ID NO: 249648 - DNA, 20 bp, Artificial Sequence
  Description of Artificial Sequence: Synthetic oligonucleotide
  Target: ATXN1; (+) strand; PAM type: YTN; PAM sequence: TTC
cttcccagctgtagaaactt

SEQ ID NO: 249649 - DNA, 20 bp, Artificial Sequence
  Description of Artificial Sequence: Synthetic oligonucleotide
  Target: ATXN1; (+) strand; PAM type: YTN; PAM sequence: CTT
cccagctgtagaaacttcct

SEQ ID NO: 249650 - DNA, 20 bp, Artificial Sequence
  Description of Artificial Sequence: Synthetic oligonucleotide
  Target: ATXN1; (+) strand; PAM type: YTN; PAM sequence: TTC
ccagctgtagaaacttcctg

SEQ ID NO: 249651 - DNA, 20 bp, Artificial Sequence
  Description of Artificial Sequence: Synthetic oligonucleotide
  Target: ATXN1; (+) strand; PAM type: YTN; PAM sequence: CTG
tagaaacttcctgctgctct

SEQ ID NO: 249652 - DNA, 20 bp, Artificial Sequence
  Description of Artificial Sequence: Synthetic oligonucleotide
  Target: ATXN1; (+) strand; PAM type: YTN; PAM sequence: CTT
cctgctgctcttccacattt

SEQ ID NO: 249653 - DNA, 20 bp, Artificial Sequence
  Description of Artificial Sequence: Synthetic oligonucleotide
  Target: ATXN1; (+) strand; PAM type: YTN; PAM sequence: TTC
ctgctgctcttccacattta

SEQ ID NO: 249654 - DNA, 20 bp, Artificial Sequence
  Description of Artificial Sequence: Synthetic oligonucleotide
  Target: ATXN1; (+) strand; PAM type: YTN; PAM sequence: CTG
ctgctcttccacatttatat

SEQ ID NO: 249655 - DNA, 20 bp, Artificial Sequence
  Description of Artificial Sequence: Synthetic oligonucleotide
  Target: ATXN1; (+) strand; PAM type: YTN; PAM sequence: CTG
ctcttccacatttatataga

SEQ ID NO: 249656 - DNA, 20 bp, Artificial Sequence
  Description of Artificial Sequence: Synthetic oligonucleotide
  Target: ATXN1; (+) strand; PAM type: YTN; PAM sequence: CTC
ttccacatttatatagaatt

SEQ ID NO: 249657 - DNA, 20 bp, Artificial Sequence
  Description of Artificial Sequence: Synthetic oligonucleotide
  Target: ATXN1; (+) strand; PAM type: YTN; PAM sequence: CTT
ccacatttatatagaattac

SEQ ID NO: 249658 - DNA, 20 bp, Artificial Sequence
  Description of Artificial Sequence: Synthetic oligonucleotide
  Target: ATXN1; (+) strand; PAM type: YTN; PAM sequence: TTC
cacatttatatagaattacc

SEQ ID NO: 249659 - DNA, 20 bp, Artificial Sequence
  Description of Artificial Sequence: Synthetic oligonucleotide
  Target: ATXN1; (+) strand; PAM type: YTN; PAM sequence: TTT
atatagaattacctgtgtct

SEQ ID NO: 249660 - DNA, 20 bp, Artificial Sequence
  Description of Artificial Sequence: Synthetic oligonucleotide
  Target: ATXN1; (+) strand; PAM type: YTN; PAM sequence: TTA
tatagaattacctgtgtcta

SEQ ID NO: 249661 - DNA, 20 bp, Artificial Sequence
  Description of Artificial Sequence: Synthetic oligonucleotide
  Target: ATXN1; (+) strand; PAM type: YTN; PAM sequence: TTA
cctgtgtctacatctatata

SEQ ID NO: 249662 - DNA, 20 bp, Artificial Sequence
  Description of Artificial Sequence: Synthetic oligonucleotide
  Target: ATXN1; (+) strand; PAM type: YTN; PAM sequence: CTG
tgtctacatctatatattaa

SEQ ID NO: 249663 - DNA, 20 bp, Artificial Sequence
  Description of Artificial Sequence: Synthetic oligonucleotide
  Target: ATXN1; (+) strand; PAM type: YTN; PAM sequence: CTA
catctatatattaatcattt

SEQ ID NO: 249664 - DNA, 20 bp, Artificial Sequence
  Description of Artificial Sequence: Synthetic oligonucleotide
  Target: ATXN1; (+) strand; PAM type: YTN; PAM sequence: CTA
tatattaatcatttccactt

SEQ ID NO: 249665 - DNA, 20 bp, Artificial Sequence
  Description of Artificial Sequence: Synthetic oligonucleotide
  Target: ATXN1; (+) strand; PAM type: YTN; PAM sequence: TTA
atcatttccacttacatgcc

SEQ ID NO: 249666 - DNA, 20 bp, Artificial Sequence
  Description of Artificial Sequence: Synthetic oligonucleotide
  Target: ATXN1; (+) strand; PAM type: YTN; PAM sequence: TTT
ccacttacatgcctgcctgt

SEQ ID NO: 249667 - DNA, 20 bp, Artificial Sequence
  Description of Artificial Sequence: Synthetic oligonucleotide
  Target: ATXN1; (+) strand; PAM type: YTN; PAM sequence: TTC
cacttacatgcctgcctgta

SEQ ID NO: 249668 - DNA, 20 bp, Artificial Sequence
  Description of Artificial Sequence: Synthetic oligonucleotide
  Target: ATXN1; (+) strand; PAM type: YTN; PAM sequence: CTT
acatgcctgcctgtaatggg

SEQ ID NO: 249669 - DNA, 20 bp, Artificial Sequence
  Description of Artificial Sequence: Synthetic oligonucleotide
  Target: ATXN1; (+) strand; PAM type: YTN; PAM sequence: TTA
catgcctgcctgtaatgggt

SEQ ID NO: 249670 - DNA, 20 bp, Artificial Sequence
  Description of Artificial Sequence: Synthetic oligonucleotide
  Target: ATXN1; (+) strand; PAM type: YTN; PAM sequence: CTG
cctgtaatgggtctattcag

SEQ ID NO: 249671 - DNA, 20 bp, Artificial Sequence
  Description of Artificial Sequence: Synthetic oligonucleotide
  Target: ATXN1; (+) strand; PAM type: YTN; PAM sequence: CTG
taatgggtctattcagagtc

SEQ ID NO: 249672 - DNA, 20 bp, Artificial Sequence
  Description of Artificial Sequence: Synthetic oligonucleotide
  Target: ATXN1; (+) strand; PAM type: YTN; PAM sequence: CTA
ttcagagtcctatatatcta

SEQ ID NO: 249673 - DNA, 20 bp, Artificial Sequence
  Description of Artificial Sequence: Synthetic oligonucleotide
  Target: ATXN1; (+) strand; PAM type: YTN; PAM sequence: TTC
agagtcctatatatctatat

SEQ ID NO: 249674 - DNA, 20 bp, Artificial Sequence
  Description of Artificial Sequence: Synthetic oligonucleotide
  Target: ATXN1; (+) strand; PAM type: YTN; PAM sequence: CTA
tatatctatatagccgtcta

SEQ ID NO: 249675 - DNA, 20 bp, Artificial Sequence
  Description of Artificial Sequence: Synthetic oligonucleotide
  Target: ATXN1; (+) strand; PAM type: YTN; PAM sequence: CTA
tatagccgtctatctatcta

SEQ ID NO: 249676 - DNA, 20 bp, Artificial Sequence
  Description of Artificial Sequence: Synthetic oligonucleotide
  Target: ATXN1; (+) strand; PAM type: YTN; PAM sequence: CTA
tctatctaatccccatatct

SEQ ID NO: 249677 - DNA, 20 bp, Artificial Sequence
  Description of Artificial Sequence: Synthetic oligonucleotide
  Target: ATXN1; (+) strand; PAM type: YTN; PAM sequence: CTA
tctaatccccatatctacta

SEQ ID NO: 249678 - DNA, 20 bp, Artificial Sequence
  Description of Artificial Sequence: Synthetic oligonucleotide
  Target: ATXN1; (+) strand; PAM type: YTN; PAM sequence: CTA
atccccatatctactattgt

SEQ ID NO: 249679 - DNA, 20 bp, Artificial Sequence
  Description of Artificial Sequence: Synthetic oligonucleotide
  Target: ATXN1; (+) strand; PAM type: YTN; PAM sequence: CTA
ctattgtaaaatttttttct

SEQ ID NO: 249680 - DNA, 20 bp, Artificial Sequence
  Description of Artificial Sequence: Synthetic oligonucleotide
  Target: ATXN1; (+) strand; PAM type: YTN; PAM sequence: CTA
ttgtaaaatttttttctgct

SEQ ID NO: 249681 - DNA, 20 bp, Artificial Sequence
  Description of Artificial Sequence: Synthetic oligonucleotide
  Target: ATXN1; (+) strand; PAM type: YTN; PAM sequence: TTG
taaaatttttttctgcttac

SEQ ID NO: 249682 - DNA, 20 bp, Artificial Sequence
  Description of Artificial Sequence: Synthetic oligonucleotide
  Target: ATXN1; (+) strand; PAM type: YTN; PAM sequence: TTT
ttttctgcttacttcttttt

SEQ ID NO: 249683 - DNA, 20 bp, Artificial Sequence
  Description of Artificial Sequence: Synthetic oligonucleotide
  Target: ATXN1; (+) strand; PAM type: YTN; PAM sequence: TTT
tttctgcttacttctttttt

SEQ ID NO: 249684 - DNA, 20 bp, Artificial Sequence
  Description of Artificial Sequence: Synthetic oligonucleotide
  Target: ATXN1; (+) strand; PAM type: YTN; PAM sequence: TTT
ttctgcttacttcttttttc

SEQ ID NO: 249685 - DNA, 20 bp, Artificial Sequence
  Description of Artificial Sequence: Synthetic oligonucleotide
  Target: ATXN1; (+) strand; PAM type: YTN; PAM sequence: TTT
tctgcttacttcttttttcc

SEQ ID NO: 249686 - DNA, 20 bp, Artificial Sequence
  Description of Artificial Sequence: Synthetic oligonucleotide
  Target: ATXN1; (+) strand; PAM type: YTN; PAM sequence: TTT
ctgcttacttcttttttccc

SEQ ID NO: 249687 - DNA, 20 bp, Artificial Sequence
  Description of Artificial Sequence: Synthetic oligonucleotide
  Target: ATXN1; (+) strand; PAM type: YTN; PAM sequence: TTC
tgcttacttcttttttcccc

SEQ ID NO: 249688 - DNA, 20 bp, Artificial Sequence
  Description of Artificial Sequence: Synthetic oligonucleotide
  Target: ATXN1; (+) strand; PAM type: YTN; PAM sequence: CTG
cttacttcttttttcccctg

SEQ ID NO: 249689 - DNA, 20 bp, Artificial Sequence
  Description of Artificial Sequence: Synthetic oligonucleotide
  Target: ATXN1; (+) strand; PAM type: YTN; PAM sequence: CTT
acttcttttttcccctgtgt

SEQ ID NO: 249690 - DNA, 20 bp, Artificial Sequence
  Description of Artificial Sequence: Synthetic oligonucleotide
  Target: ATXN1; (+) strand; PAM type: YTN; PAM sequence: TTA
cttcttttttcccctgtgtt

SEQ ID NO: 249691 - DNA, 20 bp, Artificial Sequence
  Description of Artificial Sequence: Synthetic oligonucleotide
  Target: ATXN1; (+) strand; PAM type: YTN; PAM sequence: CTT
cttttttcccctgtgtttca

SEQ ID NO: 249692 - DNA, 20 bp, Artificial Sequence
  Description of Artificial Sequence: Synthetic oligonucleotide
  Target: ATXN1; (+) strand; PAM type: YTN; PAM sequence: TTC
ttttttcccctgtgtttcaa

SEQ ID NO: 249693 - DNA, 20 bp, Artificial Sequence
  Description of Artificial Sequence: Synthetic oligonucleotide
  Target: ATXN1; (+) strand; PAM type: YTN; PAM sequence: CTT
ttttcccctgtgtttcaact

SEQ ID NO: 249694 - DNA, 20 bp, Artificial Sequence
  Description of Artificial Sequence: Synthetic oligonucleotide
  Target: ATXN1; (+) strand; PAM type: YTN; PAM sequence: TTT
tttcccctgtgtttcaactc

SEQ ID NO: 249695 - DNA, 20 bp, Artificial Sequence
  Description of Artificial Sequence: Synthetic oligonucleotide
  Target: ATXN1; (+) strand; PAM type: YTN; PAM sequence: TTT
ttcccctgtgtttcaactca

SEQ ID NO: 249696 - DNA, 20 bp, Artificial Sequence
  Description of Artificial Sequence: Synthetic oligonucleotide
  Target: ATXN1; (+) strand; PAM type: YTN; PAM sequence: TTT
tcccctgtgtttcaactcat

SEQ ID NO: 249697 - DNA, 20 bp, Artificial Sequence
  Description of Artificial Sequence: Synthetic oligonucleotide
  Target: ATXN1; (+) strand; PAM type: YTN; PAM sequence: TTT
cccctgtgtttcaactcatt

SEQ ID NO: 249698 - DNA, 20 bp, Artificial Sequence
  Description of Artificial Sequence: Synthetic oligonucleotide
  Target: ATXN1; (+) strand; PAM type: YTN; PAM sequence: TTC
ccctgtgtttcaactcattc

SEQ ID NO: 249699 - DNA, 20 bp, Artificial Sequence
  Description of Artificial Sequence: Synthetic oligonucleotide
  Target: ATXN1; (+) strand; PAM type: YTN; PAM sequence: CTG
tgtttcaactcattctgatc

SEQ ID NO: 249700 - DNA, 20 bp, Artificial Sequence
  Description of Artificial Sequence: Synthetic oligonucleotide
  Target: ATXN1; (+) strand; PAM type: YTN; PAM sequence: TTT
caactcattctgatctcttc

SEQ ID NO: 249701 - DNA, 20 bp, Artificial Sequence
  Description of Artificial Sequence: Synthetic oligonucleotide
  Target: ATXN1; (+) strand; PAM type: YTN; PAM sequence: TTC
aactcattctgatctcttct

SEQ ID NO: 249702 - DNA, 20 bp, Artificial Sequence
  Description of Artificial Sequence: Synthetic oligonucleotide
  Target: ATXN1; (+) strand; PAM type: YTN; PAM sequence: CTC
attctgatctcttctcagca

SEQ ID NO: 249703 - DNA, 20 bp, Artificial Sequence
  Description of Artificial Sequence: Synthetic oligonucleotide
  Target: ATXN1; (+) strand; PAM type: YTN; PAM sequence: TTC
tgatctcttctcagcatcag

SEQ ID NO: 249704 - DNA, 20 bp, Artificial Sequence
  Description of Artificial Sequence: Synthetic oligonucleotide
  Target: ATXN1; (+) strand; PAM type: YTN; PAM sequence: CTG
atctcttctcagcatcagag

SEQ ID NO: 249705 - DNA, 20 bp, Artificial Sequence
  Description of Artificial Sequence: Synthetic oligonucleotide
  Target: ATXN1; (+) strand; PAM type: YTN; PAM sequence: CTC
ttctcagcatcagagattat

SEQ ID NO: 249706 - DNA, 20 bp, Artificial Sequence
  Description of Artificial Sequence: Synthetic oligonucleotide
  Target: ATXN1; (+) strand; PAM type: YTN; PAM sequence: CTT
ctcagcatcagagattatgt

SEQ ID NO: 249707 - DNA, 20 bp, Artificial Sequence
  Description of Artificial Sequence: Synthetic oligonucleotide
  Target: ATXN1; (+) strand; PAM type: YTN; PAM sequence: TTC
tcagcatcagagattatgtt

SEQ ID NO: 249708 - DNA, 20 bp, Artificial Sequence
  Description of Artificial Sequence: Synthetic oligonucleotide
  Target: ATXN1; (+) strand; PAM type: YTN; PAM sequence: CTC
agcatcagagattatgttta

SEQ ID NO: 249709 - DNA, 20 bp, Artificial Sequence
  Description of Artificial Sequence: Synthetic oligonucleotide
  Target: ATXN1; (+) strand; PAM type: YTN; PAM sequence: TTA
tgtttatttttgtggctaaa

SEQ ID NO: 249710 - DNA, 20 bp, Artificial Sequence
  Description of Artificial Sequence: Synthetic oligonucleotide
  Target: ATXN1; (+) strand; PAM type: YTN; PAM sequence: TTT
atttttgtggctaaatcttg

SEQ ID NO: 249711 - DNA, 20 bp, Artificial Sequence
  Description of Artificial Sequence: Synthetic oligonucleotide
  Target: ATXN1; (+) strand; PAM type: YTN; PAM sequence: TTA
tttttgtggctaaatcttgg

SEQ ID NO: 249712 - DNA, 20 bp, Artificial Sequence
  Description of Artificial Sequence: Synthetic oligonucleotide
  Target: ATXN1; (+) strand; PAM type: YTN; PAM sequence: TTT
ttgtggctaaatcttggtct

SEQ ID NO: 249713 - DNA, 20 bp, Artificial Sequence
  Description of Artificial Sequence: Synthetic oligonucleotide
  Target: ATXN1; (+) strand; PAM type: YTN; PAM sequence: TTT
tgtggctaaatcttggtctg

SEQ ID NO: 249714 - DNA, 20 bp, Artificial Sequence
  Description of Artificial Sequence: Synthetic oligonucleotide
  Target: ATXN1; (+) strand; PAM type: YTN; PAM sequence: TTT
gtggctaaatcttggtctgc

SEQ ID NO: 249715 - DNA, 20 bp, Artificial Sequence
  Description of Artificial Sequence: Synthetic oligonucleotide
  Target: ATXN1; (+) strand; PAM type: YTN; PAM sequence: TTG
tggctaaatcttggtctgcc

SEQ ID NO: 249716 - DNA, 20 bp, Artificial Sequence
  Description of Artificial Sequence: Synthetic oligonucleotide
  Target: ATXN1; (+) strand; PAM type: YTN; PAM sequence: CTA
aatcttggtctgcccaacag

SEQ ID NO: 249717 - DNA, 20 bp, Artificial Sequence
  Description of Artificial Sequence: Synthetic oligonucleotide
  Target: ATXN1; (+) strand; PAM type: YTN; PAM sequence: CTT
ggtctgcccaacagcaatct

SEQ ID NO: 249718 - DNA, 20 bp, Artificial Sequence
  Description of Artificial Sequence: Synthetic oligonucleotide
  Target: ATXN1; (+) strand; PAM type: YTN; PAM sequence: TTG
gtctgcccaacagcaatctt

SEQ ID NO: 249719 - DNA, 20 bp, Artificial Sequence
  Description of Artificial Sequence: Synthetic oligonucleotide
  Target: ATXN1; (+) strand; PAM type: YTN; PAM sequence: CTG
cccaacagcaatctttaaag

SEQ ID NO: 249720 - DNA, 20 bp, Artificial Sequence
  Description of Artificial Sequence: Synthetic oligonucleotide
  Target: ATXN1; (+) strand; PAM type: YTN; PAM sequence: CTT
taaagaaacaatcttggatg

SEQ ID NO: 249721 - DNA, 20 bp, Artificial Sequence
  Description of Artificial Sequence: Synthetic oligonucleotide
  Target: ATXN1; (+) strand; PAM type: YTN; PAM sequence: TTT
aaagaaacaatcttggatgt

SEQ ID NO: 249722 - DNA, 20 bp, Artificial Sequence
  Description of Artificial Sequence: Synthetic oligonucleotide
  Target: ATXN1; (+) strand; PAM type: YTN; PAM sequence: TTA
aagaaacaatcttggatgtt

SEQ ID NO: 249723 - DNA, 20 bp, Artificial Sequence
  Description of Artificial Sequence: Synthetic oligonucleotide
  Target: ATXN1; (+) strand; PAM type: YTN; PAM sequence: CTT
ggatgtttaccttttcttac

SEQ ID NO: 249724 - DNA, 20 bp, Artificial Sequence
  Description of Artificial Sequence: Synthetic oligonucleotide
  Target: ATXN1; (+) strand; PAM type: YTN; PAM sequence: TTG
gatgtttaccttttcttacc

SEQ ID NO: 249725 - DNA, 20 bp, Artificial Sequence
  Description of Artificial Sequence: Synthetic oligonucleotide
  Target: ATXN1; (+) strand; PAM type: YTN; PAM sequence: TTT
accttttcttacctatgagg

SEQ ID NO: 249726 - DNA, 20 bp, Artificial Sequence
  Description of Artificial Sequence: Synthetic oligonucleotide
  Target: ATXN1; (+) strand; PAM type: YTN; PAM sequence: TTA
ccttttcttacctatgaggc

SEQ ID NO: 249727 - DNA, 20 bp, Artificial Sequence
  Description of Artificial Sequence: Synthetic oligonucleotide
  Target: ATXN1; (+) strand; PAM type: YTN; PAM sequence: CTT
ttcttacctatgaggctttg

SEQ ID NO: 249728 - DNA, 20 bp, Artificial Sequence
  Description of Artificial Sequence: Synthetic oligonucleotide
  Target: ATXN1; (+) strand; PAM type: YTN; PAM sequence: TTT
tcttacctatgaggctttgg

SEQ ID NO: 249729 - DNA, 20 bp, Artificial Sequence
  Description of Artificial Sequence: Synthetic oligonucleotide
  Target: ATXN1; (+) strand; PAM type: YTN; PAM sequence: TTT
cttacctatgaggctttggt

SEQ ID NO: 249730 - DNA, 20 bp, Artificial Sequence
  Description of Artificial Sequence: Synthetic oligonucleotide
  Target: ATXN1; (+) strand; PAM type: YTN; PAM sequence: TTC
ttacctatgaggctttggtg

SEQ ID NO: 249731 - DNA, 20 bp, Artificial Sequence
  Description of Artificial Sequence: Synthetic oligonucleotide
  Target: ATXN1; (+) strand; PAM type: YTN; PAM sequence: CTT
acctatgaggctttggtgat

SEQ ID NO: 249732 - DNA, 20 bp, Artificial Sequence
  Description of Artificial Sequence: Synthetic oligonucleotide
  Target: ATXN1; (+) strand; PAM type: YTN; PAM sequence: TTA
cctatgaggctttggtgata

SEQ ID NO: 249733 - DNA, 20 bp, Artificial Sequence
  Description of Artificial Sequence: Synthetic oligonucleotide
  Target: ATXN1; (+) strand; PAM type: YTN; PAM sequence: CTA
tgaggctttggtgatatatg

SEQ ID NO: 249734 - DNA, 20 bp, Artificial Sequence
  Description of Artificial Sequence: Synthetic oligonucleotide
  Target: ATXN1; (+) strand; PAM type: YTN; PAM sequence: CTT
tggtgatatatggaaaaggg

SEQ ID NO: 249735 - DNA, 20 bp, Artificial Sequence
  Description of Artificial Sequence: Synthetic oligonucleotide
  Target: ATXN1; (+) strand; PAM type: YTN; PAM sequence: TTT
ggtgatatatggaaaagggg

SEQ ID NO: 249736 - DNA, 20 bp, Artificial Sequence
  Description of Artificial Sequence: Synthetic oligonucleotide
  Target: ATXN1; (+) strand; PAM type: YTN; PAM sequence: TTG
gtgatatatggaaaagggga

SEQ ID NO: 249737 - DNA, 20 bp, Artificial Sequence
  Description of Artificial Sequence: Synthetic oligonucleotide
  Target: ATXN1; (+) strand; PAM type: YTN; PAM sequence: CTC
tatggcaagtttcatgacag

SEQ ID NO: 249738 - DNA, 20 bp, Artificial Sequence
  Description of Artificial Sequence: Synthetic oligonucleotide
  Target: ATXN1; (+) strand; PAM type: YTN; PAM sequence: CTA
tggcaagtttcatgacaggt

SEQ ID NO: 249739 - DNA, 20 bp, Artificial Sequence
  Description of Artificial Sequence: Synthetic oligonucleotide
  Target: ATXN1; (+) strand; PAM type: YTN; PAM sequence: TTT
catgacaggtctgcttgtta

SEQ ID NO: 249740 - DNA, 20 bp, Artificial Sequence
  Description of Artificial Sequence: Synthetic oligonucleotide
  Target: ATXN1; (+) strand; PAM type: YTN; PAM sequence: TTC
atgacaggtctgcttgttaa

SEQ ID NO: 249741 - DNA, 20 bp, Artificial Sequence
  Description of Artificial Sequence: Synthetic oligonucleotide
  Target: ATXN1; (+) strand; PAM type: YTN; PAM sequence: CTG
cttgttaaaaacaacaacaa

SEQ ID NO: 249742 - DNA, 20 bp, Artificial Sequence
  Description of Artificial Sequence: Synthetic oligonucleotide
  Target: ATXN1; (+) strand; PAM type: YTN; PAM sequence: CTT
gttaaaaacaacaacaataa

SEQ ID NO: 249743 - DNA, 20 bp, Artificial Sequence
  Description of Artificial Sequence: Synthetic oligonucleotide
  Target: ATXN1; (+) strand; PAM type: YTN; PAM sequence: TTG
ttaaaaacaacaacaataat

SEQ ID NO: 249744 - DNA, 20 bp, Artificial Sequence
  Description of Artificial Sequence: Synthetic oligonucleotide
  Target: ATXN1; (+) strand; PAM type: YTN; PAM sequence: TTA
aaaacaacaacaataataac

SEQ ID NO: 249745 - DNA, 20 bp, Artificial Sequence
  Description of Artificial Sequence: Synthetic oligonucleotide
  Target: ATXN1; (+) strand; PAM type: YTN; PAM sequence: TTC
taatactatctccaccttcc

SEQ ID NO: 249746 - DNA, 20 bp, Artificial Sequence
  Description of Artificial Sequence: Synthetic oligonucleotide
  Target: ATXN1; (+) strand; PAM type: YTN; PAM sequence: CTA
atactatctccaccttcctg

SEQ ID NO: 249747 - DNA, 20 bp, Artificial Sequence
  Description of Artificial Sequence: Synthetic oligonucleotide
  Target: ATXN1; (+) strand; PAM type: YTN; PAM sequence: CTA
tctccaccttcctgaccact

SEQ ID NO: 249748 - DNA, 20 bp, Artificial Sequence
  Description of Artificial Sequence: Synthetic oligonucleotide
  Target: ATXN1; (+) strand; PAM type: YTN; PAM sequence: CTC
caccttcctgaccacttgtc

SEQ ID NO: 249749 - DNA, 20 bp, Artificial Sequence
  Description of Artificial Sequence: Synthetic oligonucleotide
  Target: ATXN1; (+) strand; PAM type: YTN; PAM sequence: CTT
cctgaccacttgtcctcttg

SEQ ID NO: 249750 - DNA, 20 bp, Artificial Sequence
  Description of Artificial Sequence: Synthetic oligonucleotide
  Target: ATXN1; (+) strand; PAM type: YTN; PAM sequence: TTC
ctgaccacttgtcctcttgg

SEQ ID NO: 249751 - DNA, 20 bp, Artificial Sequence
  Description of Artificial Sequence: Synthetic oligonucleotide
  Target: ATXN1; (+) strand; PAM type: YTN; PAM sequence: CTG
accacttgtcctcttggagg

SEQ ID NO: 249752 - DNA, 20 bp, Artificial Sequence
  Description of Artificial Sequence: Synthetic oligonucleotide
  Target: ATXN1; (+) strand; PAM type: YTN; PAM sequence: CTT
gtcctcttggaggtcagcta

SEQ ID NO: 249753 - DNA, 20 bp, Artificial Sequence
  Description of Artificial Sequence: Synthetic oligonucleotide
  Target: ATXN1; (+) strand; PAM type: YTN; PAM sequence: TTG
tcctcttggaggtcagctag

SEQ ID NO: 249754 - DNA, 20 bp, Artificial Sequence
  Description of Artificial Sequence: Synthetic oligonucleotide
  Target: ATXN1; (+) strand; PAM type: YTN; PAM sequence: CTC
ttggaggtcagctagatgct

SEQ ID NO: 249755 - DNA, 20 bp, Artificial Sequence
  Description of Artificial Sequence: Synthetic oligonucleotide
  Target: ATXN1; (+) strand; PAM type: YTN; PAM sequence: CTT
ggaggtcagctagatgctgg

SEQ ID NO: 249756 - DNA, 20 bp, Artificial Sequence
  Description of Artificial Sequence: Synthetic oligonucleotide
  Target: ATXN1; (+) strand; PAM type: YTN; PAM sequence: TTG
gaggtcagctagatgctggc

SEQ ID NO: 249757 - DNA, 20 bp, Artificial Sequence
  Description of Artificial Sequence: Synthetic oligonucleotide
  Target: ATXN1; (+) strand; PAM type: YTN; PAM sequence: CTA
gatgctggcagttccctagg

SEQ ID NO: 249758 - DNA, 20 bp, Artificial Sequence
  Description of Artificial Sequence: Synthetic oligonucleotide
  Target: ATXN1; (+) strand; PAM type: YTN; PAM sequence: CTG
gcagttccctaggaaatgac

SEQ ID NO: 249759 - DNA, 20 bp, Artificial Sequence
  Description of Artificial Sequence: Synthetic oligonucleotide
  Target: ATXN1; (+) strand; PAM type: YTN; PAM sequence: TTC
cctaggaaatgacattatat

SEQ ID NO: 249760 - DNA, 20 bp, Artificial Sequence
  Description of Artificial Sequence: Synthetic oligonucleotide
  Target: ATXN1; (+) strand; PAM type: YTN; PAM sequence: CTA
ggaaatgacattatattacc

SEQ ID NO: 249761 - DNA, 20 bp, Artificial Sequence
  Description of Artificial Sequence: Synthetic oligonucleotide
  Target: ATXN1; (+) strand; PAM type: YTN; PAM sequence: TTA
tattacccagaataccacat

SEQ ID NO: 249762 - DNA, 20 bp, Artificial Sequence
  Description of Artificial Sequence: Synthetic oligonucleotide
  Target: ATXN1; (+) strand; PAM type: YTN; PAM sequence: TTA
cccagaataccacattaatt

SEQ ID NO: 249763 - DNA, 20 bp, Artificial Sequence
  Description of Artificial Sequence: Synthetic oligonucleotide
  Target: ATXN1; (+) strand; PAM type: YTN; PAM sequence: TTA
attcagaacctgccacctag

SEQ ID NO: 249764 - DNA, 20 bp, Artificial Sequence
  Description of Artificial Sequence: Synthetic oligonucleotide
  Target: ATXN1; (+) strand; PAM type: YTN; PAM sequence: TTC
agaacctgccacctagctaa

SEQ ID NO: 249765 - DNA, 20 bp, Artificial Sequence
  Description of Artificial Sequence: Synthetic oligonucleotide
  Target: ATXN1; (+) strand; PAM type: YTN; PAM sequence: CTG
ccacctagctaacttctggc

SEQ ID NO: 249766 - DNA, 20 bp, Artificial Sequence
  Description of Artificial Sequence: Synthetic oligonucleotide
  Target: ATXN1; (+) strand; PAM type: YTN; PAM sequence: CTA
gctaacttctggctctggca

SEQ ID NO: 249767 - DNA, 20 bp, Artificial Sequence
  Description of Artificial Sequence: Synthetic oligonucleotide
  Target: ATXN1; (+) strand; PAM type: YTN; PAM sequence: CTA
acttctggctctggcaccct

SEQ ID NO: 249768 - DNA, 20 bp, Artificial Sequence
  Description of Artificial Sequence: Synthetic oligonucleotide
  Target: ATXN1; (+) strand; PAM type: YTN; PAM sequence: CTT
ctggctctggcaccctatcc

SEQ ID NO: 249769 - DNA, 20 bp, Artificial Sequence
  Description of Artificial Sequence: Synthetic oligonucleotide
  Target: ATXN1; (+) strand; PAM type: YTN; PAM sequence: TTC
tggctctggcaccctatccg

SEQ ID NO: 249770 - DNA, 20 bp, Artificial Sequence
  Description of Artificial Sequence: Synthetic oligonucleotide
  Target: ATXN1; (+) strand; PAM type: YTN; PAM sequence: CTG
gctctggcaccctatccgct

SEQ ID NO: 249771 - DNA, 20 bp, Artificial Sequence
  Description of Artificial Sequence: Synthetic oligonucleotide
  Target: ATXN1; (+) strand; PAM type: YTN; PAM sequence: CTC
tggcaccctatccgctgacc

SEQ ID NO: 249772 - DNA, 20 bp, Artificial Sequence
  Description of Artificial Sequence: Synthetic oligonucleotide
  Target: ATXN1; (+) strand; PAM type: YTN; PAM sequence: CTG
gcaccctatccgctgacccc

SEQ ID NO: 249773 - DNA, 20 bp, Artificial Sequence
  Description of Artificial Sequence: Synthetic oligonucleotide
  Target: ATXN1; (+) strand; PAM type: YTN; PAM sequence: CTA
tccgctgacccctttgcaac

SEQ ID NO: 249774 - DNA, 20 bp, Artificial Sequence
  Description of Artificial Sequence: Synthetic oligonucleotide
  Target: ATXN1; (+) strand; PAM type: YTN; PAM sequence: CTG
acccctttgcaacaatcaga

SEQ ID NO: 249775 - DNA, 20 bp, Artificial Sequence
  Description of Artificial Sequence: Synthetic oligonucleotide
  Target: ATXN1; (+) strand; PAM type: YTN; PAM sequence: CTT
tgcaacaatcagaagcagga

SEQ ID NO: 249776 - DNA, 20 bp, Artificial Sequence
  Description of Artificial Sequence: Synthetic oligonucleotide
  Target: ATXN1; (+) strand; PAM type: YTN; PAM sequence: TTT
gcaacaatcagaagcaggaa

SEQ ID NO: 249777 - DNA, 20 bp, Artificial Sequence
  Description of Artificial Sequence: Synthetic oligonucleotide
  Target: ATXN1; (+) strand; PAM type: YTN; PAM sequence: TTG
caacaatcagaagcaggaat

SEQ ID NO: 249778 - DNA, 20 bp, Artificial Sequence
  Description of Artificial Sequence: Synthetic oligonucleotide
  Target: ATXN1; (+) strand; PAM type: YTN; PAM sequence: TTT
agaatataacaaaagggcct

SEQ ID NO: 249779 - DNA, 20 bp, Artificial Sequence
  Description of Artificial Sequence: Synthetic oligonucleotide
  Target: ATXN1; (+) strand; PAM type: YTN; PAM sequence: TTA
gaatataacaaaagggcctc

SEQ ID NO: 249780 - DNA, 20 bp, Artificial Sequence
  Description of Artificial Sequence: Synthetic oligonucleotide
  Target: ATXN1; (+) strand; PAM type: YTN; PAM sequence: CTC
ttggattttgttagttgatc

SEQ ID NO: 249781 - DNA, 20 bp, Artificial Sequence
  Description of Artificial Sequence: Synthetic oligonucleotide
  Target: ATXN1; (+) strand; PAM type: YTN; PAM sequence: CTT
ggattttgttagttgatcaa

SEQ ID NO: 249782 - DNA, 20 bp, Artificial Sequence
  Description of Artificial Sequence: Synthetic oligonucleotide
  Target: ATXN1; (+) strand; PAM type: YTN; PAM sequence: TTG
gattttgttagttgatcaag

SEQ ID NO: 249783 - DNA, 20 bp, Artificial Sequence
  Description of Artificial Sequence: Synthetic oligonucleotide
  Target: ATXN1; (+) strand; PAM type: YTN; PAM sequence: TTT
tgttagttgatcaagaatct

SEQ ID NO: 249784 - DNA, 20 bp, Artificial Sequence
  Description of Artificial Sequence: Synthetic oligonucleotide
  Target: ATXN1; (+) strand; PAM type: YTN; PAM sequence: TTT
gttagttgatcaagaatctc

SEQ ID NO: 249785 - DNA, 20 bp, Artificial Sequence
  Description of Artificial Sequence: Synthetic oligonucleotide
  Target: ATXN1; (+) strand; PAM type: YTN; PAM sequence: TTG
ttagttgatcaagaatctca

SEQ ID NO: 249786 - DNA, 20 bp, Artificial Sequence
  Description of Artificial Sequence: Synthetic oligonucleotide
  Target: ATXN1; (+) strand; PAM type: YTN; PAM sequence: TTA
gttgatcaagaatctcagag

SEQ ID NO: 249787 - DNA, 20 bp, Artificial Sequence
  Description of Artificial Sequence: Synthetic oligonucleotide
  Target: ATXN1; (+) strand; PAM type: YTN; PAM sequence: TTG
atcaagaatctcagagacac

SEQ ID NO: 249788 - DNA, 20 bp, Artificial Sequence
  Description of Artificial Sequence: Synthetic oligonucleotide
  Target: ATXN1; (+) strand; PAM type: YTN; PAM sequence: CTC
agagacacttaaactatata

SEQ ID NO: 249789 - DNA, 20 bp, Artificial Sequence
  Description of Artificial Sequence: Synthetic oligonucleotide
  Target: ATXN1; (+) strand; PAM type: YTN; PAM sequence: CTT
aaactatatatgcatgaaat

SEQ ID NO: 249790 - DNA, 20 bp, Artificial Sequence
  Description of Artificial Sequence: Synthetic oligonucleotide
  Target: ATXN1; (+) strand; PAM type: YTN; PAM sequence: TTA
aactatatatgcatgaaata

SEQ ID NO: 249791 - DNA, 20 bp, Artificial Sequence
  Description of Artificial Sequence: Synthetic oligonucleotide
  Target: ATXN1; (+) strand; PAM type: YTN; PAM sequence: CTA
tatatgcatgaaataaaata

SEQ ID NO: 249792 - DNA, 20 bp, Artificial Sequence
  Description of Artificial Sequence: Synthetic oligonucleotide
  Target: ATXN1; (+) strand; PAM type: YTN; PAM sequence: CTG
ggcacggtggctcatgcctg

SEQ ID NO: 249793 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcccagcact

SEQ ID NO: 249794 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 249795 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcaggtgg

SEQ ID NO: 249796 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcaggtgga

SEQ ID NO: 249797 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcaggtggat

SEQ ID NO: 249798 - DNA, 20 bp, Artificial Sequence
  Description of Artificial Sequence: Synthetic oligonucleotide
  Target: ATXN1; (+) strand; PAM type: YTN; PAM sequence: CTT
gaggtcaggtgttggagacc

SEQ ID NO: 249799 - DNA, 20 bp, Artificial Sequence
  Description of Artificial Sequence: Synthetic oligonucleotide
  Target: ATXN1; (+) strand; PAM type: YTN; PAM sequence: TTG
aggtcaggtgttggagacca

SEQ ID NO: 249800 - DNA, 20 bp, Artificial Sequence
  Description of Artificial Sequence: Synthetic oligonucleotide
  Target: ATXN1; (+) strand; PAM type: YTN; PAM sequence: TTG
gagaccagactagccaacat

SEQ ID NO: 249801 - DNA, 20 bp, Artificial Sequence
  Description of Artificial Sequence: Synthetic oligonucleotide
  Target: ATXN1; (+) strand; PAM type: YTN; PAM sequence: CTA
gccaacatattgaaacccct

SEQ ID NO: 249802 - DNA, 20 bp, Artificial Sequence
  Description of Artificial Sequence: Synthetic oligonucleotide
  Target: ATXN1; (+) strand; PAM type: YTN; PAM sequence: TTG
aaaccccttctctattaaaa

SEQ ID NO: 249803 - DNA, 20 bp, Artificial Sequence
  Description of Artificial Sequence: Synthetic oligonucleotide
  Target: ATXN1; (+) strand; PAM type: YTN; PAM sequence: CTT
ctctattaaaaatacaaaaa

SEQ ID NO: 249804 - DNA, 20 bp, Artificial Sequence
  Description of Artificial Sequence: Synthetic oligonucleotide
  Target: ATXN1; (+) strand; PAM type: YTN; PAM sequence: TTC
tctattaaaaatacaaaaat

SEQ ID NO: 249805 - DNA, 20 bp, Artificial Sequence
  Description of Artificial Sequence: Synthetic oligonucleotide
  Target: ATXN1; (+) strand; PAM type: YTN; PAM sequence: CTC
tattaaaaatacaaaaatta

SEQ ID NO: 249806 - DNA, 20 bp, Artificial Sequence
  Description of Artificial Sequence: Synthetic oligonucleotide
  Target: ATXN1; (+) strand; PAM type: YTN; PAM sequence: CTA
ttaaaaatacaaaaattagc

SEQ ID NO: 249807 - DNA, 20 bp, Artificial Sequence
  Description of Artificial Sequence: Synthetic oligonucleotide
  Target: ATXN1; (+) strand; PAM type: YTN; PAM sequence: TTA
aaaatacaaaaattagccgg

SEQ ID NO: 249808 - DNA, 20 bp, Artificial Sequence
  Description of Artificial Sequence: Synthetic oligonucleotide
  Target: ATXN1; (+) strand; PAM type: YTN; PAM sequence: TTA
gccgggcatgatggcgggca

SEQ ID NO: 249809 - DNA, 20 bp, Artificial Sequence
  Description of Artificial Sequence: Synthetic oligonucleotide
  Target: ATXN1; (+) strand; PAM type: YTN; PAM sequence: CTG
taatcccagctactcgggag

SEQ ID NO: 249810 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggctgagacagga

SEQ ID NO: 249811 - DNA, 20 bp, Artificial Sequence
  Description of Artificial Sequence: Synthetic oligonucleotide
  Target: ATXN1; (+) strand; PAM type: YTN; PAM sequence: CTC
gggaggctgagacaggagaa

SEQ ID NO: 249812 - DNA, 20 bp, Artificial Sequence
  Description of Artificial Sequence: Synthetic oligonucleotide
  Target: ATXN1; (+) strand; PAM type: YTN; PAM sequence: CTG
agacaggagaatcacttgaa

SEQ ID NO: 249813 - DNA, 20 bp, Artificial Sequence
  Description of Artificial Sequence: Synthetic oligonucleotide
  Target: ATXN1; (+) strand; PAM type: YTN; PAM sequence: CTT
gaacccgggaggtggaggtt

SEQ ID NO: 249814 - DNA, 20 bp, Artificial Sequence
  Description of Artificial Sequence: Synthetic oligonucleotide
  Target: ATXN1; (+) strand; PAM type: YTN; PAM sequence: TTG
aacccgggaggtggaggttg

SEQ ID NO: 249815 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagactacacc

SEQ ID NO: 249816 - DNA, 20 bp, Artificial Sequence
  Description of Artificial Sequence: Synthetic oligonucleotide
  Target: ATXN1; (+) strand; PAM type: YTN; PAM sequence: CTA
caccactacactccagcctg

SEQ ID NO: 249817 - DNA, 20 bp, Artificial Sequence
  Description of Artificial Sequence: Synthetic oligonucleotide
  Target: ATXN1; (+) strand; PAM type: YTN; PAM sequence: CTA
cactccagcctgggtgacag

SEQ ID NO: 249818 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacagagtga

SEQ ID NO: 249819 - DNA, 20 bp, Artificial Sequence
  Description of Artificial Sequence: Synthetic oligonucleotide
  Target: ATXN1; (+) strand; PAM type: YTN; PAM sequence: CTG
ggtgacagagtgagactctg

SEQ ID NO: 249820 - DNA, 20 bp, Artificial Sequence
  Description of Artificial Sequence: Synthetic oligonucleotide
  Target: ATXN1; (+) strand; PAM type: YTN; PAM sequence: CTC
tgtctgaaaaaaaaaaaaaa

SEQ ID NO: 249821 - DNA, 20 bp, Artificial Sequence
  Description of Artificial Sequence: Synthetic oligonucleotide
  Target: ATXN1; (+) strand; PAM type: YTN; PAM sequence: CTG
tctgaaaaaaaaaaaaaaag

SEQ ID NO: 249822 - DNA, 20 bp, Artificial Sequence
  Description of Artificial Sequence: Synthetic oligonucleotide
  Target: ATXN1; (+) strand; PAM type: YTN; PAM sequence: CTG
aaaaaaaaaaaaaaagaaaa

SEQ ID NO: 249823 - DNA, 20 bp, Artificial Sequence
  Description of Artificial Sequence: Synthetic oligonucleotide
  Target: ATXN1; (+) strand; PAM type: YTN; PAM sequence: CTC
taatcaacccacatgttaca

SEQ ID NO: 249824 - DNA, 20 bp, Artificial Sequence
  Description of Artificial Sequence: Synthetic oligonucleotide
  Target: ATXN1; (+) strand; PAM type: YTN; PAM sequence: CTA
atcaacccacatgttacatg

SEQ ID NO: 249825 - DNA, 20 bp, Artificial Sequence
  Description of Artificial Sequence: Synthetic oligonucleotide
  Target: ATXN1; (+) strand; PAM type: YTN; PAM sequence: TTA
catgttcacaaaaatatcca

SEQ ID NO: 249826 - DNA, 20 bp, Artificial Sequence
  Description of Artificial Sequence: Synthetic oligonucleotide
  Target: ATXN1; (+) strand; PAM type: YTN; PAM sequence: TTC
acaaaaatatccaatggggg

SEQ ID NO: 249827 - DNA, 20 bp, Artificial Sequence
  Description of Artificial Sequence: Synthetic oligonucleotide
  Target: ATXN1; (+) strand; PAM type: YTN; PAM sequence: TTC
tgacccagaatattaaagtc

SEQ ID NO: 249828 - DNA, 20 bp, Artificial Sequence
  Description of Artificial Sequence: Synthetic oligonucleotide
  Target: ATXN1; (+) strand; PAM type: YTN; PAM sequence: CTG
acccagaatattaaagtcct

SEQ ID NO: 249829 - DNA, 20 bp, Artificial Sequence
  Description of Artificial Sequence: Synthetic oligonucleotide
  Target: ATXN1; (+) strand; PAM type: YTN; PAM sequence: TTA
aagtcctggttttaatgagc

SEQ ID NO: 249830 - DNA, 20 bp, Artificial Sequence
  Description of Artificial Sequence: Synthetic oligonucleotide
  Target: ATXN1; (+) strand; PAM type: YTN; PAM sequence: CTG
gttttaatgagctatgaaat

SEQ ID NO: 249831 - DNA, 20 bp, Artificial Sequence
  Description of Artificial Sequence: Synthetic oligonucleotide
  Target: ATXN1; (+) strand; PAM type: YTN; PAM sequence: TTT
taatgagctatgaaatgggg

SEQ ID NO: 249832 - DNA, 20 bp, Artificial Sequence
  Description of Artificial Sequence: Synthetic oligonucleotide
  Target: ATXN1; (+) strand; PAM type: YTN; PAM sequence: TTT
aatgagctatgaaatgggga

SEQ ID NO: 249833 - DNA, 20 bp, Artificial Sequence
  Description of Artificial Sequence: Synthetic oligonucleotide
  Target: ATXN1; (+) strand; PAM type: YTN; PAM sequence: TTA
atgagctatgaaatggggaa

SEQ ID NO: 249834 - DNA, 20 bp, Artificial Sequence
  Description of Artificial Sequence: Synthetic oligonucleotide
  Target: ATXN1; (+) strand; PAM type: YTN; PAM sequence: CTA
tgaaatggggaacttaaaaa

SEQ ID NO: 249835 - DNA, 20 bp, Artificial Sequence
  Description of Artificial Sequence: Synthetic oligonucleotide
  Target: ATXN1; (+) strand; PAM type: YTN; PAM sequence: CTT
aaaaaaattacaaatgtgca

SEQ ID NO: 249836 - DNA, 20 bp, Artificial Sequence
  Description of Artificial Sequence: Synthetic oligonucleotide
  Target: ATXN1; (+) strand; PAM type: YTN; PAM sequence: TTA
aaaaaattacaaatgtgcaa

SEQ ID NO: 249837 - DNA, 20 bp, Artificial Sequence
  Description of Artificial Sequence: Synthetic oligonucleotide
  Target: ATXN1; (+) strand; PAM type: YTN; PAM sequence: TTA
caaatgtgcaatttcctttt

SEQ ID NO: 249838 - DNA, 20 bp, Artificial Sequence
  Description of Artificial Sequence: Synthetic oligonucleotide
  Target: ATXN1; (+) strand; PAM type: YTN; PAM sequence: TTT
ccttttatatttctttgact

SEQ ID NO: 249839 - DNA, 20 bp, Artificial Sequence
  Description of Artificial Sequence: Synthetic oligonucleotide
  Target: ATXN1; (+) strand; PAM type: YTN; PAM sequence: TTC
cttttatatttctttgactt

SEQ ID NO: 249840 - DNA, 20 bp, Artificial Sequence
  Description of Artificial Sequence: Synthetic oligonucleotide
  Target: ATXN1; (+) strand; PAM type: YTN; PAM sequence: CTT
ttatatttctttgactttta

SEQ ID NO: 249841 - DNA, 20 bp, Artificial Sequence
  Description of Artificial Sequence: Synthetic oligonucleotide
  Target: ATXN1; (+) strand; PAM type: YTN; PAM sequence: TTT
tatatttctttgacttttaa

SEQ ID NO: 249842 - DNA, 20 bp, Artificial Sequence
  Description of Artificial Sequence: Synthetic oligonucleotide
  Target: ATXN1; (+) strand; PAM type: YTN; PAM sequence: TTT
atatttctttgacttttaag

SEQ ID NO: 249843 - DNA, 20 bp, Artificial Sequence
  Description of Artificial Sequence: Synthetic oligonucleotide
  Target: ATXN1; (+) strand; PAM type: YTN; PAM sequence: TTA
tatttctttgacttttaaga

SEQ ID NO: 249844 - DNA, 20 bp, Artificial Sequence
  Description of Artificial Sequence: Synthetic oligonucleotide
  Target: ATXN1; (+) strand; PAM type: YTN; PAM sequence: TTT
ctttgacttttaagaacaat

SEQ ID NO: 249845 - DNA, 20 bp, Artificial Sequence
  Description of Artificial Sequence: Synthetic oligonucleotide
  Target: ATXN1; (+) strand; PAM type: YTN; PAM sequence: TTC
tttgacttttaagaacaatc

SEQ ID NO: 249846 - DNA, 20 bp, Artificial Sequence
  Description of Artificial Sequence: Synthetic oligonucleotide
  Target: ATXN1; (+) strand; PAM type: YTN; PAM sequence: CTT
tgacttttaagaacaatctc

SEQ ID NO: 249847 - DNA, 20 bp, Artificial Sequence
  Description of Artificial Sequence: Synthetic oligonucleotide
  Target: ATXN1; (+) strand; PAM type: YTN; PAM sequence: TTT
gacttttaagaacaatctca

SEQ ID NO: 249848 - DNA, 20 bp, Artificial Sequence
  Description of Artificial Sequence: Synthetic oligonucleotide
  Target: ATXN1; (+) strand; PAM type: YTN; PAM sequence: TTG
acttttaagaacaatctcat

SEQ ID NO: 249849 - DNA, 20 bp, Artificial Sequence
  Description of Artificial Sequence: Synthetic oligonucleotide
  Target: ATXN1; (+) strand; PAM type: YTN; PAM sequence: CTT
ttaagaacaatctcatgcat

SEQ ID NO: 249850 - DNA, 20 bp, Artificial Sequence
  Description of Artificial Sequence: Synthetic oligonucleotide
  Target: ATXN1; (+) strand; PAM type: YTN; PAM sequence: TTT
taagaacaatctcatgcata

SEQ ID NO: 249851 - DNA, 20 bp, Artificial Sequence
  Description of Artificial Sequence: Synthetic oligonucleotide
  Target: ATXN1; (+) strand; PAM type: YTN; PAM sequence: TTT
aagaacaatctcatgcatag

SEQ ID NO: 249852 - DNA, 20 bp, Artificial Sequence
  Description of Artificial Sequence: Synthetic oligonucleotide
  Target: ATXN1; (+) strand; PAM type: YTN; PAM sequence: TTA
agaacaatctcatgcataga

SEQ ID NO: 249853 - DNA, 20 bp, Artificial Sequence
  Description of Artificial Sequence: Synthetic oligonucleotide
  Target: ATXN1; (+) strand; PAM type: YTN; PAM sequence: CTC
atgcatagagcccaaactgg

SEQ ID NO: 249854 - DNA, 20 bp, Artificial Sequence
  Description of Artificial Sequence: Synthetic oligonucleotide
  Target: ATXN1; (+) strand; PAM type: YTN; PAM sequence: CTG
gagatctgtagcttttagtg

SEQ ID NO: 249855 - DNA, 20 bp, Artificial Sequence
  Description of Artificial Sequence: Synthetic oligonucleotide
  Target: ATXN1; (+) strand; PAM type: YTN; PAM sequence: CTG
tagcttttagtgactttgtc

SEQ ID NO: 249856 - DNA, 20 bp, Artificial Sequence
  Description of Artificial Sequence: Synthetic oligonucleotide
  Target: ATXN1; (+) strand; PAM type: YTN; PAM sequence: CTT
ttagtgactttgtctctcaa

SEQ ID NO: 249857 - DNA, 20 bp, Artificial Sequence
  Description of Artificial Sequence: Synthetic oligonucleotide
  Target: ATXN1; (+) strand; PAM type: YTN; PAM sequence: TTT
tagtgactttgtctctcaat

SEQ ID NO: 249858 - DNA, 20 bp, Artificial Sequence
  Description of Artificial Sequence: Synthetic oligonucleotide
  Target: ATXN1; (+) strand; PAM type: YTN; PAM sequence: TTT
agtgactttgtctctcaatt

SEQ ID NO: 249859 - DNA, 20 bp, Artificial Sequence
  Description of Artificial Sequence: Synthetic oligonucleotide
  Target: ATXN1; (+) strand; PAM type: YTN; PAM sequence: TTA
gtgactttgtctctcaatta

SEQ ID NO: 249860 - DNA, 20 bp, Artificial Sequence
  Description of Artificial Sequence: Synthetic oligonucleotide
  Target: ATXN1; (+) strand; PAM type: YTN; PAM sequence: CTT
tgtctctcaattaccctggg

SEQ ID NO: 249861 - DNA, 20 bp, Artificial Sequence
  Description of Artificial Sequence: Synthetic oligonucleotide
  Target: ATXN1; (+) strand; PAM type: YTN; PAM sequence: TTT
gtctctcaattaccctgggg

SEQ ID NO: 249862 - DNA, 20 bp, Artificial Sequence
  Description of Artificial Sequence: Synthetic oligonucleotide
  Target: ATXN1; (+) strand; PAM type: YTN; PAM sequence: TTG
tctctcaattaccctggggg

SEQ ID NO: 249863 - DNA, 20 bp, Artificial Sequence
  Description of Artificial Sequence: Synthetic oligonucleotide
  Target: ATXN1; (+) strand; PAM type: YTN; PAM sequence: CTC
tcaattaccctgggggaagt

SEQ ID NO: 249864 - DNA, 20 bp, Artificial Sequence
  Description of Artificial Sequence: Synthetic oligonucleotide
  Target: ATXN1; (+) strand; PAM type: YTN; PAM sequence: CTC
aattaccctgggggaagttt

SEQ ID NO: 249865 - DNA, 20 bp, Artificial Sequence
  Description of Artificial Sequence: Synthetic oligonucleotide
  Target: ATXN1; (+) strand; PAM type: YTN; PAM sequence: TTA
ccctgggggaagtttcctcc

SEQ ID NO: 249866 - DNA, 20 bp, Artificial Sequence
  Description of Artificial Sequence: Synthetic oligonucleotide
  Target: ATXN1; (+) strand; PAM type: YTN; PAM sequence: CTG
ggggaagtttcctcccctgt

SEQ ID NO: 249867 - DNA, 20 bp, Artificial Sequence
  Description of Artificial Sequence: Synthetic oligonucleotide
  Target: ATXN1; (+) strand; PAM type: YTN; PAM sequence: TTT
cctcccctgtcctccgacct

SEQ ID NO: 249868 - DNA, 20 bp, Artificial Sequence
  Description of Artificial Sequence: Synthetic oligonucleotide
  Target: ATXN1; (+) strand; PAM type: YTN; PAM sequence: TTC
ctcccctgtcctccgacctg

SEQ ID NO: 249869 - DNA, 20 bp, Artificial Sequence
  Description of Artificial Sequence: Synthetic oligonucleotide
  Target: ATXN1; (+) strand; PAM type: YTN; PAM sequence: CTC
ccctgtcctccgacctgtct

SEQ ID NO: 249870 - DNA, 20 bp, Artificial Sequence
  Description of Artificial Sequence: Synthetic oligonucleotide
  Target: ATXN1; (+) strand; PAM type: YTN; PAM sequence: CTG
tcctccgacctgtcttaaca

SEQ ID NO: 249871 - DNA, 20 bp, Artificial Sequence
  Description of Artificial Sequence: Synthetic oligonucleotide
  Target: ATXN1; (+) strand; PAM type: YTN; PAM sequence: CTC
cgacctgtcttaacagacac

SEQ ID NO: 249872 - DNA, 20 bp, Artificial Sequence
  Description of Artificial Sequence: Synthetic oligonucleotide
  Target: ATXN1; (+) strand; PAM type: YTN; PAM sequence: CTG
tcttaacagacacagacaca

SEQ ID NO: 249873 - DNA, 20 bp, Artificial Sequence
  Description of Artificial Sequence: Synthetic oligonucleotide
  Target: ATXN1; (+) strand; PAM type: YTN; PAM sequence: CTT
aacagacacagacacatagc

SEQ ID NO: 249874 - DNA, 20 bp, Artificial Sequence
  Description of Artificial Sequence: Synthetic oligonucleotide
  Target: ATXN1; (+) strand; PAM type: YTN; PAM sequence: TTA
acagacacagacacatagca

SEQ ID NO: 249875 - DNA, 20 bp, Artificial Sequence
  Description of Artificial Sequence: Synthetic oligonucleotide
  Target: ATXN1; (+) strand; PAM type: YTN; PAM sequence: TTC
aatagtgctgctgttattag

SEQ ID NO: 249876 - DNA, 20 bp, Artificial Sequence
  Description of Artificial Sequence: Synthetic oligonucleotide
  Target: ATXN1; (+) strand; PAM type: YTN; PAM sequence: CTG
ctgttattagcagcctctgt

SEQ ID NO: 249877 - DNA, 20 bp, Artificial Sequence
  Description of Artificial Sequence: Synthetic oligonucleotide
  Target: ATXN1; (+) strand; PAM type: YTN; PAM sequence: CTG
ttattagcagcctctgtgaa

SEQ ID NO: 249878 - DNA, 20 bp, Artificial Sequence
  Description of Artificial Sequence: Synthetic oligonucleotide
  Target: ATXN1; (+) strand; PAM type: YTN; PAM sequence: TTA
ttagcagcctctgtgaaccc

SEQ ID NO: 249879 - DNA, 20 bp, Artificial Sequence
  Description of Artificial Sequence: Synthetic oligonucleotide
  Target: ATXN1; (+) strand; PAM type: YTN; PAM sequence: TTA
gcagcctctgtgaacccgag

SEQ ID NO: 249880 - DNA, 20 bp, Artificial Sequence
  Description of Artificial Sequence: Synthetic oligonucleotide
  Target: ATXN1; (+) strand; PAM type: YTN; PAM sequence: CTC
tgtgaacccgagtaaccttg

SEQ ID NO: 249881 - DNA, 20 bp, Artificial Sequence
  Description of Artificial Sequence: Synthetic oligonucleotide
  Target: ATXN1; (+) strand; PAM type: YTN; PAM sequence: CTG
tgaacccgagtaaccttgca

SEQ ID NO: 249882 - DNA, 20 bp, Artificial Sequence
  Description of Artificial Sequence: Synthetic oligonucleotide
  Target: ATXN1; (+) strand; PAM type: YTN; PAM sequence: CTT
gcatacaagtctcatggaaa

SEQ ID NO: 249883 - DNA, 20 bp, Artificial Sequence
  Description of Artificial Sequence: Synthetic oligonucleotide
  Target: ATXN1; (+) strand; PAM type: YTN; PAM sequence: TTG
catacaagtctcatggaaag

SEQ ID NO: 249884 - DNA, 20 bp, Artificial Sequence
  Description of Artificial Sequence: Synthetic oligonucleotide
  Target: ATXN1; (+) strand; PAM type: YTN; PAM sequence: CTC
atggaaagcacacatttgcc

SEQ ID NO: 249885 - DNA, 20 bp, Artificial Sequence
  Description of Artificial Sequence: Synthetic oligonucleotide
  Target: ATXN1; (+) strand; PAM type: YTN; PAM sequence: TTT
gccagttgctattaatcatt

SEQ ID NO: 249886 - DNA, 20 bp, Artificial Sequence
  Description of Artificial Sequence: Synthetic oligonucleotide
  Target: ATXN1; (+) strand; PAM type: YTN; PAM sequence: TTG
ccagttgctattaatcattg

SEQ ID NO: 249887 - DNA, 20 bp, Artificial Sequence
  Description of Artificial Sequence: Synthetic oligonucleotide
  Target: ATXN1; (+) strand; PAM type: YTN; PAM sequence: TTG
ctattaatcattgacatatt

SEQ ID NO: 249888 - DNA, 20 bp, Artificial Sequence
  Description of Artificial Sequence: Synthetic oligonucleotide
  Target: ATXN1; (+) strand; PAM type: YTN; PAM sequence: CTA
ttaatcattgacatattgat

SEQ ID NO: 249889 - DNA, 20 bp, Artificial Sequence
  Description of Artificial Sequence: Synthetic oligonucleotide
  Target: ATXN1; (+) strand; PAM type: YTN; PAM sequence: TTA
atcattgacatattgatagt

SEQ ID NO: 249890 - DNA, 20 bp, Artificial Sequence
  Description of Artificial Sequence: Synthetic oligonucleotide
  Target: ATXN1; (+) strand; PAM type: YTN; PAM sequence: TTG
acatattgatagtgtggggg

SEQ ID NO: 249891 - DNA, 20 bp, Artificial Sequence
  Description of Artificial Sequence: Synthetic oligonucleotide
  Target: ATXN1; (+) strand; PAM type: YTN; PAM sequence: TTG
atagtgtgggggtaacactg

SEQ ID NO: 249892 - DNA, 20 bp, Artificial Sequence
  Description of Artificial Sequence: Synthetic oligonucleotide
  Target: ATXN1; (+) strand; PAM type: YTN; PAM sequence: CTG
cgtatgctgatactggggag

SEQ ID NO: 249893 - DNA, 20 bp, Artificial Sequence
  Description of Artificial Sequence: Synthetic oligonucleotide
  Target: ATXN1; (+) strand; PAM type: YTN; PAM sequence: CTG
atactggggagggggcagag

SEQ ID NO: 249894 - DNA, 20 bp, Artificial Sequence
  Description of Artificial Sequence: Synthetic oligonucleotide
  Target: ATXN1; (+) strand; PAM type: YTN; PAM sequence: CTG
gggagggggcagagatggga

SEQ ID NO: 249895 - DNA, 20 bp, Artificial Sequence
  Description of Artificial Sequence: Synthetic oligonucleotide
  Target: ATXN1; (+) strand; PAM type: YTN; PAM sequence: TTA
taaattgctaagttattgtg

SEQ ID NO: 249896 - DNA, 20 bp, Artificial Sequence
  Description of Artificial Sequence: Synthetic oligonucleotide
  Target: ATXN1; (+) strand; PAM type: YTN; PAM sequence: TTG
ctaagttattgtgtttatat

SEQ ID NO: 249897 - DNA, 20 bp, Artificial Sequence
  Description of Artificial Sequence: Synthetic oligonucleotide
  Target: ATXN1; (+) strand; PAM type: YTN; PAM sequence: CTA
agttattgtgtttatattca

SEQ ID NO: 249898 - DNA, 20 bp, Artificial Sequence
  Description of Artificial Sequence: Synthetic oligonucleotide
  Target: ATXN1; (+) strand; PAM type: YTN; PAM sequence: TTA
ttgtgtttatattcagcaca

SEQ ID NO: 249899 - DNA, 20 bp, Artificial Sequence
  Description of Artificial Sequence: Synthetic oligonucleotide
  Target: ATXN1; (+) strand; PAM type: YTN; PAM sequence: TTG
tgtttatattcagcacatct

SEQ ID NO: 249900 - DNA, 20 bp, Artificial Sequence
  Description of Artificial Sequence: Synthetic oligonucleotide
  Target: ATXN1; (+) strand; PAM type: YTN; PAM sequence: TTT
atattcagcacatcttgcag

SEQ ID NO: 249901 - DNA, 20 bp, Artificial Sequence
  Description of Artificial Sequence: Synthetic oligonucleotide
  Target: ATXN1; (+) strand; PAM type: YTN; PAM sequence: TTA
tattcagcacatcttgcagc

SEQ ID NO: 249902 - DNA, 20 bp, Artificial Sequence
  Description of Artificial Sequence: Synthetic oligonucleotide
  Target: ATXN1; (+) strand; PAM type: YTN; PAM sequence: TTC
agcacatcttgcagccaaga

SEQ ID NO: 249903 - DNA, 20 bp, Artificial Sequence
  Description of Artificial Sequence: Synthetic oligonucleotide
  Target: ATXN1; (+) strand; PAM type: YTN; PAM sequence: CTT
gcagccaagattctgtttct

SEQ ID NO: 249904 - DNA, 20 bp, Artificial Sequence
  Description of Artificial Sequence: Synthetic oligonucleotide
  Target: ATXN1; (+) strand; PAM type: YTN; PAM sequence: TTG
cagccaagattctgtttctc

SEQ ID NO: 249905 - DNA, 20 bp, Artificial Sequence
  Description of Artificial Sequence: Synthetic oligonucleotide
  Target: ATXN1; (+) strand; PAM type: YTN; PAM sequence: TTC
tgtttctctctctctctctc

SEQ ID NO: 249906 - DNA, 20 bp, Artificial Sequence
  Description of Artificial Sequence: Synthetic oligonucleotide
  Target: ATXN1; (+) strand; PAM type: YTN; PAM sequence: CTG
tttctctctctctctctctc

SEQ ID NO: 249907 - DNA, 20 bp, Artificial Sequence
  Description of Artificial Sequence: Synthetic oligonucleotide
  Target: ATXN1; (+) strand; PAM type: YTN; PAM sequence: TTT
ctctctctctctctctctct

SEQ ID NO: 249908 - DNA, 20 bp, Artificial Sequence
  Description of Artificial Sequence: Synthetic oligonucleotide
  Target: ATXN1; (+) strand; PAM type: YTN; PAM sequence: TTC
tctctctctctctctctctc

SEQ ID NO: 249909 - DNA, 20 bp, Artificial Sequence
  Description of Artificial Sequence: Synthetic oligonucleotide
  Target: ATXN1; (+) strand; PAM type: YTN; PAM sequence: CTC
tctctctctctctctctctc

SEQ ID NO: 249910 - DNA, 20 bp, Artificial Sequence
  Description of Artificial Sequence: Synthetic oligonucleotide
  Target: ATXN1; (+) strand; PAM type: YTN; PAM sequence: CTC
tctctctctctctctctctc

SEQ ID NO: 249911 - DNA, 20 bp, Artificial Sequence
  Description of Artificial Sequence: Synthetic oligonucleotide
  Target: ATXN1; (+) strand; PAM type: YTN; PAM sequence: CTC
tctctctctctctctctctc

SEQ ID NO: 249912 - DNA, 20 bp, Artificial Sequence
  Description of Artificial Sequence: Synthetic oligonucleotide
  Target: ATXN1; (+) strand; PAM type: YTN; PAM sequence: CTC
tctctctctctctctctctc

SEQ ID NO: 249913 - DNA, 20 bp, Artificial Sequence
  Description of Artificial Sequence: Synthetic oligonucleotide
  Target: ATXN1; (+) strand; PAM type: YTN; PAM sequence: CTC
tctctctctctctctctcac

SEQ ID NO: 249914 - DNA, 20 bp, Artificial Sequence
  Description of Artificial Sequence: Synthetic oligonucleotide
  Target: ATXN1; (+) strand; PAM type: YTN; PAM sequence: CTC
tctctctctctctctcacac

SEQ ID NO: 249915 - DNA, 20 bp, Artificial Sequence
  Description of Artificial Sequence: Synthetic oligonucleotide
  Target: ATXN1; (+) strand; PAM type: YTN; PAM sequence: CTC
tctctctctctctcacacac

SEQ ID NO: 249916 - DNA, 20 bp, Artificial Sequence
  Description of Artificial Sequence: Synthetic oligonucleotide
  Target: ATXN1; (+) strand; PAM type: YTN; PAM sequence: CTC
tctctctctctcacacacac

SEQ ID NO: 249917 - DNA, 20 bp, Artificial Sequence
  Description of Artificial Sequence: Synthetic oligonucleotide
  Target: ATXN1; (+) strand; PAM type: YTN; PAM sequence: CTC
tctctctctcacacacacac

SEQ ID NO: 249918 - DNA, 20 bp, Artificial Sequence
  Description of Artificial Sequence: Synthetic oligonucleotide
  Target: ATXN1; (+) strand; PAM type: YTN; PAM sequence: CTC
tctctctcacacacacacac

SEQ ID NO: 249919 - DNA, 20 bp, Artificial Sequence
  Description of Artificial Sequence: Synthetic oligonucleotide
  Target: ATXN1; (+) strand; PAM type: YTN; PAM sequence: CTC
tctctcacacacacacacac

SEQ ID NO: 249920 - DNA, 20 bp, Artificial Sequence
  Description of Artificial Sequence: Synthetic oligonucleotide
  Target: ATXN1; (+) strand; PAM type: YTN; PAM sequence: CTC
tctcacacacacacacacac

SEQ ID NO: 249921 - DNA, 20 bp, Artificial Sequence
  Description of Artificial Sequence: Synthetic oligonucleotide
  Target: ATXN1; (+) strand; PAM type: YTN; PAM sequence: CTC
tcacacacacacacacacac

SEQ ID NO: 249922 - DNA, 20 bp, Artificial Sequence
  Description of Artificial Sequence: Synthetic oligonucleotide
  Target: ATXN1; (+) strand; PAM type: YTN; PAM sequence: CTC
acacacacacacacacacac

SEQ ID NO: 249923 - DNA, 20 bp, Artificial Sequence
  Description of Artificial Sequence: Synthetic oligonucleotide
  Target: ATXN1; (+) strand; PAM type: YTN; PAM sequence: TTC
tgacctatgcctggaaatac

SEQ ID NO: 249924 - DNA, 20 bp, Artificial Sequence
  Description of Artificial Sequence: Synthetic oligonucleotide
  Target: ATXN1; (+) strand; PAM type: YTN; PAM sequence: CTG
acctatgcctggaaatacaa

SEQ ID NO: 249925 - DNA, 20 bp, Artificial Sequence
  Description of Artificial Sequence: Synthetic oligonucleotide
  Target: ATXN1; (+) strand; PAM type: YTN; PAM sequence: CTA
tgcctggaaatacaatccta

SEQ ID NO: 249926 - DNA, 20 bp, Artificial Sequence
  Description of Artificial Sequence: Synthetic oligonucleotide
  Target: ATXN1; (+) strand; PAM type: YTN; PAM sequence: CTG
gaaatacaatcctaagtcta

SEQ ID NO: 249927 - DNA, 20 bp, Artificial Sequence
  Description of Artificial Sequence: Synthetic oligonucleotide
  Target: ATXN1; (+) strand; PAM type: YTN; PAM sequence: CTA
agtctagataaaggggagag

SEQ ID NO: 249928 - DNA, 20 bp, Artificial Sequence
  Description of Artificial Sequence: Synthetic oligonucleotide
  Target: ATXN1; (+) strand; PAM type: YTN; PAM sequence: CTA
gataaaggggagagctaatg

SEQ ID NO: 249929 - DNA, 20 bp, Artificial Sequence
  Description of Artificial Sequence: Synthetic oligonucleotide
  Target: ATXN1; (+) strand; PAM type: YTN; PAM sequence: CTA
atgaaggctcacagttgaag

SEQ ID NO: 249930 - DNA, 20 bp, Artificial Sequence
  Description of Artificial Sequence: Synthetic oligonucleotide
  Target: ATXN1; (+) strand; PAM type: YTN; PAM sequence: CTC
acagttgaagttgtctgatt

SEQ ID NO: 249931 - DNA, 20 bp, Artificial Sequence
  Description of Artificial Sequence: Synthetic oligonucleotide
  Target: ATXN1; (+) strand; PAM type: YTN; PAM sequence: TTG
aagttgtctgatttgtacac

SEQ ID NO: 249932 - DNA, 20 bp, Artificial Sequence
  Description of Artificial Sequence: Synthetic oligonucleotide
  Target: ATXN1; (+) strand; PAM type: YTN; PAM sequence: TTG
tctgatttgtacacacccag

SEQ ID NO: 249933 - DNA, 20 bp, Artificial Sequence
  Description of Artificial Sequence: Synthetic oligonucleotide
  Target: ATXN1; (+) strand; PAM type: YTN; PAM sequence: CTG
atttgtacacacccagcaca

SEQ ID NO: 249934 - DNA, 20 bp, Artificial Sequence
  Description of Artificial Sequence: Synthetic oligonucleotide
  Target: ATXN1; (+) strand; PAM type: YTN; PAM sequence: TTT
gtacacacccagcacacatt

SEQ ID NO: 249935 - DNA, 20 bp, Artificial Sequence
  Description of Artificial Sequence: Synthetic oligonucleotide
  Target: ATXN1; (+) strand; PAM type: YTN; PAM sequence: TTG
tacacacccagcacacattc

SEQ ID NO: 249936 - DNA, 20 bp, Artificial Sequence
  Description of Artificial Sequence: Synthetic oligonucleotide
  Target: ATXN1; (+) strand; PAM type: YTN; PAM sequence: TTC
agactcgattgtataggtca

SEQ ID NO: 249937 - DNA, 20 bp, Artificial Sequence
  Description of Artificial Sequence: Synthetic oligonucleotide
  Target: ATXN1; (+) strand; PAM type: YTN; PAM sequence: CTC
gattgtataggtcaaatttt

SEQ ID NO: 249938 - DNA, 20 bp, Artificial Sequence
  Description of Artificial Sequence: Synthetic oligonucleotide
  Target: ATXN1; (+) strand; PAM type: YTN; PAM sequence: TTG
tataggtcaaattttcccag

SEQ ID NO: 249939 - DNA, 20 bp, Artificial Sequence
  Description of Artificial Sequence: Synthetic oligonucleotide
  Target: ATXN1; (+) strand; PAM type: YTN; PAM sequence: TTT
tcccagaaacatgcgatcac

SEQ ID NO: 249940 - DNA, 20 bp, Artificial Sequence
  Description of Artificial Sequence: Synthetic oligonucleotide
  Target: ATXN1; (+) strand; PAM type: YTN; PAM sequence: TTT
cccagaaacatgcgatcacg

SEQ ID NO: 249941 - DNA, 20 bp, Artificial Sequence
  Description of Artificial Sequence: Synthetic oligonucleotide
  Target: ATXN1; (+) strand; PAM type: YTN; PAM sequence: TTC
ccagaaacatgcgatcacgg

SEQ ID NO: 249942 - DNA, 20 bp, Artificial Sequence
  Description of Artificial Sequence: Synthetic oligonucleotide
  Target: ATXN1; (+) strand; PAM type: YTN; PAM sequence: CTT
tttgagctcaaaacctgtgg

SEQ ID NO: 249943 - DNA, 20 bp, Artificial Sequence
  Description of Artificial Sequence: Synthetic oligonucleotide
  Target: ATXN1; (+) strand; PAM type: YTN; PAM sequence: TTT
ttgagctcaaaacctgtgga

SEQ ID NO: 249944 - DNA, 20 bp, Artificial Sequence
  Description of Artificial Sequence: Synthetic oligonucleotide
  Target: ATXN1; (+) strand; PAM type: YTN; PAM sequence: TTT
tgagctcaaaacctgtggat

SEQ ID NO: 249945 - DNA, 20 bp, Artificial Sequence
  Description of Artificial Sequence: Synthetic oligonucleotide
  Target: ATXN1; (+) strand; PAM type: YTN; PAM sequence: TTT
gagctcaaaacctgtggata

SEQ ID NO: 249946 - DNA, 20 bp, Artificial Sequence
  Description of Artificial Sequence: Synthetic oligonucleotide
  Target: ATXN1; (+) strand; PAM type: YTN; PAM sequence: TTG
agctcaaaacctgtggataa

SEQ ID NO: 249947 - DNA, 20 bp, Artificial Sequence
  Description of Artificial Sequence: Synthetic oligonucleotide
  Target: ATXN1; (+) strand; PAM type: YTN; PAM sequence: CTC
aaaacctgtggataattgtt

SEQ ID NO: 249948 - DNA, 20 bp, Artificial Sequence
  Description of Artificial Sequence: Synthetic oligonucleotide
  Target: ATXN1; (+) strand; PAM type: YTN; PAM sequence: CTG
tggataattgttgcttaccc

SEQ ID NO: 249949 - DNA, 20 bp, Artificial Sequence
  Description of Artificial Sequence: Synthetic oligonucleotide
  Target: ATXN1; (+) strand; PAM type: YTN; PAM sequence: TTG
ttgcttaccccaatatccca

SEQ ID NO: 249950 - DNA, 20 bp, Artificial Sequence
  Description of Artificial Sequence: Synthetic oligonucleotide
  Target: ATXN1; (+) strand; PAM type: YTN; PAM sequence: TTG
cttaccccaatatcccactt

SEQ ID NO: 249951 - DNA, 20 bp, Artificial Sequence
  Description of Artificial Sequence: Synthetic oligonucleotide
  Target: ATXN1; (+) strand; PAM type: YTN; PAM sequence: CTT
accccaatatcccactttcc

SEQ ID NO: 249952 - DNA, 20 bp, Artificial Sequence
  Description of Artificial Sequence: Synthetic oligonucleotide
  Target: ATXN1; (+) strand; PAM type: YTN; PAM sequence: TTA
ccccaatatcccactttcct

SEQ ID NO: 249953 - DNA, 20 bp, Artificial Sequence
  Description of Artificial Sequence: Synthetic oligonucleotide
  Target: ATXN1; (+) strand; PAM type: YTN; PAM sequence: CTT
tccttcttttccttagaagt

SEQ ID NO: 249954 - DNA, 20 bp, Artificial Sequence
  Description of Artificial Sequence: Synthetic oligonucleotide
  Target: ATXN1; (+) strand; PAM type: YTN; PAM sequence: TTT
ccttcttttccttagaagta

SEQ ID NO: 249955 - DNA, 20 bp, Artificial Sequence
  Description of Artificial Sequence: Synthetic oligonucleotide
  Target: ATXN1; (+) strand; PAM type: YTN; PAM sequence: TTC
cttcttttccttagaagtag

SEQ ID NO: 249956 - DNA, 20 bp, Artificial Sequence
  Description of Artificial Sequence: Synthetic oligonucleotide
  Target: ATXN1; (+) strand; PAM type: YTN; PAM sequence: CTT
cttttccttagaagtagaaa

SEQ ID NO: 249957 - DNA, 20 bp, Artificial Sequence
  Description of Artificial Sequence: Synthetic oligonucleotide
  Target: ATXN1; (+) strand; PAM type: YTN; PAM sequence: TTC
ttttccttagaagtagaaac

SEQ ID NO: 249958 - DNA, 20 bp, Artificial Sequence
  Description of Artificial Sequence: Synthetic oligonucleotide
  Target: ATXN1; (+) strand; PAM type: YTN; PAM sequence: CTT
ttccttagaagtagaaacct

SEQ ID NO: 249959 - DNA, 20 bp, Artificial Sequence
  Description of Artificial Sequence: Synthetic oligonucleotide
  Target: ATXN1; (+) strand; PAM type: YTN; PAM sequence: TTT
tccttagaagtagaaacctt

SEQ ID NO: 249960 - DNA, 20 bp, Artificial Sequence
  Description of Artificial Sequence: Synthetic oligonucleotide
  Target: ATXN1; (+) strand; PAM type: YTN; PAM sequence: TTT
ccttagaagtagaaaccttg

SEQ ID NO: 249961 - DNA, 20 bp, Artificial Sequence
  Description of Artificial Sequence: Synthetic oligonucleotide
  Target: ATXN1; (+) strand; PAM type: YTN; PAM sequence: TTC
cttagaagtagaaaccttgg

SEQ ID NO: 249962 - DNA, 20 bp, Artificial Sequence
  Description of Artificial Sequence: Synthetic oligonucleotide
  Target: ATXN1; (+) strand; PAM type: YTN; PAM sequence: CTT
agaagtagaaaccttggttt

SEQ ID NO: 249963 - DNA, 20 bp, Artificial Sequence
  Description of Artificial Sequence: Synthetic oligonucleotide
  Target: ATXN1; (+) strand; PAM type: YTN; PAM sequence: TTA
gaagtagaaaccttggtttt

SEQ ID NO: 249964 - DNA, 20 bp, Artificial Sequence
  Description of Artificial Sequence: Synthetic oligonucleotide
  Target: ATXN1; (+) strand; PAM type: YTN; PAM sequence: CTT
ggttttgaggtagacacatt

SEQ ID NO: 249965 - DNA, 20 bp, Artificial Sequence
  Description of Artificial Sequence: Synthetic oligonucleotide
  Target: ATXN1; (+) strand; PAM type: YTN; PAM sequence: TTG
gttttgaggtagacacattg

SEQ ID NO: 249966 - DNA, 20 bp, Artificial Sequence
  Description of Artificial Sequence: Synthetic oligonucleotide
  Target: ATXN1; (+) strand; PAM type: YTN; PAM sequence: TTT
tgaggtagacacattgctgc

SEQ ID NO: 249967 - DNA, 20 bp, Artificial Sequence
  Description of Artificial Sequence: Synthetic oligonucleotide
  Target: ATXN1; (+) strand; PAM type: YTN; PAM sequence: TTT
gaggtagacacattgctgcc

SEQ ID NO: 249968 - DNA, 20 bp, Artificial Sequence
  Description of Artificial Sequence: Synthetic oligonucleotide
  Target: ATXN1; (+) strand; PAM type: YTN; PAM sequence: TTG
aggtagacacattgctgccc

SEQ ID NO: 249969 - DNA, 20 bp, Artificial Sequence
  Description of Artificial Sequence: Synthetic oligonucleotide
  Target: ATXN1; (+) strand; PAM type: YTN; PAM sequence: TTG
ctgcccaactgaatgacctg

SEQ ID NO: 249970 - DNA, 20 bp, Artificial Sequence
  Description of Artificial Sequence: Synthetic oligonucleotide
  Target: ATXN1; (+) strand; PAM type: YTN; PAM sequence: CTG
cccaactgaatgacctgatc

SEQ ID NO: 249971 - DNA, 20 bp, Artificial Sequence
  Description of Artificial Sequence: Synthetic oligonucleotide
  Target: ATXN1; (+) strand; PAM type: YTN; PAM sequence: CTG
aatgacctgatcttcttctt

SEQ ID NO: 249972 - DNA, 20 bp, Artificial Sequence
  Description of Artificial Sequence: Synthetic oligonucleotide
  Target: ATXN1; (+) strand; PAM type: YTN; PAM sequence: CTG
atcttcttcttgccttgcaa

SEQ ID NO: 249973 - DNA, 20 bp, Artificial Sequence
  Description of Artificial Sequence: Synthetic oligonucleotide
  Target: ATXN1; (+) strand; PAM type: YTN; PAM sequence: CTT
cttcttgccttgcaagaagg

SEQ ID NO: 249974 - DNA, 20 bp, Artificial Sequence
  Description of Artificial Sequence: Synthetic oligonucleotide
  Target: ATXN1; (+) strand; PAM type: YTN; PAM sequence: TTC
ttcttgccttgcaagaaggt

SEQ ID NO: 249975 - DNA, 20 bp, Artificial Sequence
  Description of Artificial Sequence: Synthetic oligonucleotide
  Target: ATXN1; (+) strand; PAM type: YTN; PAM sequence: CTT
cttgccttgcaagaaggtat

SEQ ID NO: 249976 - DNA, 20 bp, Artificial Sequence
  Description of Artificial Sequence: Synthetic oligonucleotide
  Target: ATXN1; (+) strand; PAM type: YTN; PAM sequence: TTC
ttgccttgcaagaaggtatg

SEQ ID NO: 249977 - DNA, 20 bp, Artificial Sequence
  Description of Artificial Sequence: Synthetic oligonucleotide
  Target: ATXN1; (+) strand; PAM type: YTN; PAM sequence: CTT
gccttgcaagaaggtatgcc

SEQ ID NO: 249978 - DNA, 20 bp, Artificial Sequence
  Description of Artificial Sequence: Synthetic oligonucleotide
  Target: ATXN1; (+) strand; PAM type: YTN; PAM sequence: TTG
ccttgcaagaaggtatgcct

SEQ ID NO: 249979 - DNA, 20 bp, Artificial Sequence
  Description of Artificial Sequence: Synthetic oligonucleotide
  Target: ATXN1; (+) strand; PAM type: YTN; PAM sequence: CTT
gcaagaaggtatgcctagac

SEQ ID NO: 249980 - DNA, 20 bp, Artificial Sequence
  Description of Artificial Sequence: Synthetic oligonucleotide
  Target: ATXN1; (+) strand; PAM type: YTN; PAM sequence: TTG
caagaaggtatgcctagact

SEQ ID NO: 249981 - DNA, 20 bp, Artificial Sequence
  Description of Artificial Sequence: Synthetic oligonucleotide
  Target: ATXN1; (+) strand; PAM type: YTN; PAM sequence: CTA
gacttgcaagaaggtatgcc

SEQ ID NO: 249982 - DNA, 20 bp, Artificial Sequence
  Description of Artificial Sequence: Synthetic oligonucleotide
  Target: ATXN1; (+) strand; PAM type: YTN; PAM sequence: CTT
gcaagaaggtatgcctagcc

SEQ ID NO: 249983 - DNA, 20 bp, Artificial Sequence
  Description of Artificial Sequence: Synthetic oligonucleotide
  Target: ATXN1; (+) strand; PAM type: YTN; PAM sequence: TTG
caagaaggtatgcctagcct

SEQ ID NO: 249984 - DNA, 20 bp, Artificial Sequence
  Description of Artificial Sequence: Synthetic oligonucleotide
  Target: ATXN1; (+) strand; PAM type: YTN; PAM sequence: CTA
gccttgcagctaggtatgcc

SEQ ID NO: 249985 - DNA, 20 bp, Artificial Sequence
  Description of Artificial Sequence: Synthetic oligonucleotide
  Target: ATXN1; (+) strand; PAM type: YTN; PAM sequence: CTT
gcagctaggtatgcctagac

SEQ ID NO: 249986 - DNA, 20 bp, Artificial Sequence
  Description of Artificial Sequence: Synthetic oligonucleotide
  Target: ATXN1; (+) strand; PAM type: YTN; PAM sequence: TTG
cagctaggtatgcctagact

SEQ ID NO: 249987 - DNA, 20 bp, Artificial Sequence
  Description of Artificial Sequence: Synthetic oligonucleotide
  Target: ATXN1; (+) strand; PAM type: YTN; PAM sequence: CTA
ggtatgcctagactaaattc

SEQ ID NO: 249988 - DNA, 20 bp, Artificial Sequence
  Description of Artificial Sequence: Synthetic oligonucleotide
  Target: ATXN1; (+) strand; PAM type: YTN; PAM sequence: CTA
gactaaattcttgttgacat

SEQ ID NO: 249989 - DNA, 20 bp, Artificial Sequence
  Description of Artificial Sequence: Synthetic oligonucleotide
  Target: ATXN1; (+) strand; PAM type: YTN; PAM sequence: CTA
aattcttgttgacatgaagt

SEQ ID NO: 249990 - DNA, 20 bp, Artificial Sequence
  Description of Artificial Sequence: Synthetic oligonucleotide
  Target: ATXN1; (+) strand; PAM type: YTN; PAM sequence: TTC
ttgttgacatgaagtaaaca

SEQ ID NO: 249991 - DNA, 20 bp, Artificial Sequence
  Description of Artificial Sequence: Synthetic oligonucleotide
  Target: ATXN1; (+) strand; PAM type: YTN; PAM sequence: CTT
gttgacatgaagtaaacaaa

SEQ ID NO: 249992 - DNA, 20 bp, Artificial Sequence
  Description of Artificial Sequence: Synthetic oligonucleotide
  Target: ATXN1; (+) strand; PAM type: YTN; PAM sequence: TTG
ttgacatgaagtaaacaaaa

SEQ ID NO: 249993 - DNA, 20 bp, Artificial Sequence
  Description of Artificial Sequence: Synthetic oligonucleotide
  Target: ATXN1; (+) strand; PAM type: YTN; PAM sequence: TTG
acatgaagtaaacaaaaatg

SEQ ID NO: 249994 - DNA, 20 bp, Artificial Sequence
  Description of Artificial Sequence: Synthetic oligonucleotide
  Target: ATXN1; (+) strand; PAM type: YTN; PAM sequence: TTC
ctctggcaagtgtctttgga

SEQ ID NO: 249995 - DNA, 20 bp, Artificial Sequence
  Description of Artificial Sequence: Synthetic oligonucleotide
  Target: ATXN1; (+) strand; PAM type: YTN; PAM sequence: CTC
tggcaagtgtctttggaaag

SEQ ID NO: 249996 - DNA, 20 bp, Artificial Sequence
  Description of Artificial Sequence: Synthetic oligonucleotide
  Target: ATXN1; (+) strand; PAM type: YTN; PAM sequence: CTG
gcaagtgtctttggaaaggg

SEQ ID NO: 249997 - DNA, 20 bp, Artificial Sequence
  Description of Artificial Sequence: Synthetic oligonucleotide
  Target: ATXN1; (+) strand; PAM type: YTN; PAM sequence: CTT
tggaaagggggtaggtcctt

SEQ ID NO: 249998 - DNA, 20 bp, Artificial Sequence
  Description of Artificial Sequence: Synthetic oligonucleotide
  Target: ATXN1; (+) strand; PAM type: YTN; PAM sequence: TTT
ggaaagggggtaggtccttc

SEQ ID NO: 249999 - DNA, 20 bp, Artificial Sequence
  Description of Artificial Sequence: Synthetic oligonucleotide
  Target: ATXN1; (+) strand; PAM type: YTN; PAM sequence: TTG
gaaagggggtaggtccttcg

SEQ ID NO: 250000 - DNA, 20 bp, Artificial Sequence
  Description of Artificial Sequence: Synthetic oligonucleotide
  Target: ATXN1; (+) strand; PAM type: YTN; PAM sequence: CTT
cgtctcttcctcctttctgc

SEQ ID NO: 250001 - DNA, 20 bp, Artificial Sequence
  Description of Artificial Sequence: Synthetic oligonucleotide
  Target: ATXN1; (+) strand; PAM type: YTN; PAM sequence: TTC
gtctcttcctcctttctgct

SEQ ID NO: 250002 - DNA, 20 bp, Artificial Sequence
  Description of Artificial Sequence: Synthetic oligonucleotide
  Target: ATXN1; (+) strand; PAM type: YTN; PAM sequence: CTC
ttcctcctttctgctttctg

SEQ ID NO: 250003 - DNA, 20 bp, Artificial Sequence
  Description of Artificial Sequence: Synthetic oligonucleotide
  Target: ATXN1; (+) strand; PAM type: YTN; PAM sequence: CTT
cctcctttctgctttctgga

SEQ ID NO: 250004 - DNA, 20 bp, Artificial Sequence
  Description of Artificial Sequence: Synthetic oligonucleotide
  Target: ATXN1; (+) strand; PAM type: YTN; PAM sequence: TTC
ctcctttctgctttctggaa

SEQ ID NO: 250005 - DNA, 20 bp, Artificial Sequence
  Description of Artificial Sequence: Synthetic oligonucleotide
  Target: ATXN1; (+) strand; PAM type: YTN; PAM sequence: CTC
ctttctgctttctggaatgg

SEQ ID NO: 250006 - DNA, 20 bp, Artificial Sequence
  Description of Artificial Sequence: Synthetic oligonucleotide
  Target: ATXN1; (+) strand; PAM type: YTN; PAM sequence: CTT
tctgctttctggaatggtaa

SEQ ID NO: 250007 - DNA, 20 bp, Artificial Sequence
  Description of Artificial Sequence: Synthetic oligonucleotide
  Target: ATXN1; (+) strand; PAM type: YTN; PAM sequence: TTT
ctgctttctggaatggtaat

SEQ ID NO: 250008 - DNA, 20 bp, Artificial Sequence
  Description of Artificial Sequence: Synthetic oligonucleotide
  Target: ATXN1; (+) strand; PAM type: YTN; PAM sequence: TTC
tgctttctggaatggtaatg

SEQ ID NO: 250009 - DNA, 20 bp, Artificial Sequence
  Description of Artificial Sequence: Synthetic oligonucleotide
  Target: ATXN1; (+) strand; PAM type: YTN; PAM sequence: CTG
ctttctggaatggtaatgtt

SEQ ID NO: 250010 - DNA, 20 bp, Artificial Sequence
  Description of Artificial Sequence: Synthetic oligonucleotide
  Target: ATXN1; (+) strand; PAM type: YTN; PAM sequence: CTT
tctggaatggtaatgttaaa

SEQ ID NO: 250011 - DNA, 20 bp, Artificial Sequence
  Description of Artificial Sequence: Synthetic oligonucleotide
  Target: ATXN1; (+) strand; PAM type: YTN; PAM sequence: TTT
ctggaatggtaatgttaaag

SEQ ID NO: 250012 - DNA, 20 bp, Artificial Sequence
  Description of Artificial Sequence: Synthetic oligonucleotide
  Target: ATXN1; (+) strand; PAM type: YTN; PAM sequence: TTC
tggaatggtaatgttaaagg

SEQ ID NO: 250013 - DNA, 20 bp, Artificial Sequence
  Description of Artificial Sequence: Synthetic oligonucleotide
  Target: ATXN1; (+) strand; PAM type: YTN; PAM sequence: CTG
gaatggtaatgttaaaggct

SEQ ID NO: 250014 - DNA, 20 bp, Artificial Sequence
  Description of Artificial Sequence: Synthetic oligonucleotide
  Target: ATXN1; (+) strand; PAM type: YTN; PAM sequence: TTA
aaggctagagctatgcagcc

SEQ ID NO: 250015 - DNA, 20 bp, Artificial Sequence
  Description of Artificial Sequence: Synthetic oligonucleotide
  Target: ATXN1; (+) strand; PAM type: YTN; PAM sequence: CTA
gagctatgcagccatcttgt

SEQ ID NO: 250016 - DNA, 20 bp, Artificial Sequence
  Description of Artificial Sequence: Synthetic oligonucleotide
  Target: ATXN1; (+) strand; PAM type: YTN; PAM sequence: CTA
tgcagccatcttgtatgtga

SEQ ID NO: 250017 - DNA, 20 bp, Artificial Sequence
  Description of Artificial Sequence: Synthetic oligonucleotide
  Target: ATXN1; (+) strand; PAM type: YTN; PAM sequence: CTT
gtatgtgagacataggctga

SEQ ID NO: 250018 - DNA, 20 bp, Artificial Sequence
  Description of Artificial Sequence: Synthetic oligonucleotide
  Target: ATXN1; (+) strand; PAM type: YTN; PAM sequence: TTG
tatgtgagacataggctgag

SEQ ID NO: 250019 - DNA, 20 bp, Artificial Sequence
  Description of Artificial Sequence: Synthetic oligonucleotide
  Target: ATXN1; (+) strand; PAM type: YTN; PAM sequence: CTG
aggcgggtgcatcacttgag

SEQ ID NO: 250020 - DNA, 20 bp, Artificial Sequence
  Description of Artificial Sequence: Synthetic oligonucleotide
  Target: ATXN1; (+) strand; PAM type: YTN; PAM sequence: CTT
gaggtcaggagttcgagacc

SEQ ID NO: 250021 - DNA, 20 bp, Artificial Sequence
  Description of Artificial Sequence: Synthetic oligonucleotide
  Target: ATXN1; (+) strand; PAM type: YTN; PAM sequence: TTG
aggtcaggagttcgagacca

SEQ ID NO: 250022 - DNA, 20 bp, Artificial Sequence
  Description of Artificial Sequence: Synthetic oligonucleotide
  Target: ATXN1; (+) strand; PAM type: YTN; PAM sequence: TTC
gagaccagcttggccaacat

SEQ ID NO: 250023 - DNA, 20 bp, Artificial Sequence
  Description of Artificial Sequence: Synthetic oligonucleotide
  Target: ATXN1; (+) strand; PAM type: YTN; PAM sequence: CTT
ggccaacatgtgaaaccctg

SEQ ID NO: 250024 - DNA, 20 bp, Artificial Sequence
  Description of Artificial Sequence: Synthetic oligonucleotide
  Target: ATXN1; (+) strand; PAM type: YTN; PAM sequence: TTG
gccaacatgtgaaaccctgt

SEQ ID NO: 250025 - DNA, 20 bp, Artificial Sequence
  Description of Artificial Sequence: Synthetic oligonucleotide
  Target: ATXN1; (+) strand; PAM type: YTN; PAM sequence: CTG
tctctactaaaaaatacata

SEQ ID NO: 250026 - DNA, 20 bp, Artificial Sequence
  Description of Artificial Sequence: Synthetic oligonucleotide
  Target: ATXN1; (+) strand; PAM type: YTN; PAM sequence: CTC
tactaaaaaatacataaaaa

SEQ ID NO: 250027 - DNA, 20 bp, Artificial Sequence
  Description of Artificial Sequence: Synthetic oligonucleotide
  Target: ATXN1; (+) strand; PAM type: YTN; PAM sequence: CTA
ctaaaaaatacataaaaatt

SEQ ID NO: 250028 - DNA, 20 bp, Artificial Sequence
  Description of Artificial Sequence: Synthetic oligonucleotide
  Target: ATXN1; (+) strand; PAM type: YTN; PAM sequence: CTA
aaaaatacataaaaattagc

SEQ ID NO: 250029 - DNA, 20 bp, Artificial Sequence
  Description of Artificial Sequence: Synthetic oligonucleotide
  Target: ATXN1; (+) strand; PAM type: YTN; PAM sequence: TTA
gccagacatgttggtgcgca

SEQ ID NO: 250030 - DNA, 20 bp, Artificial Sequence
  Description of Artificial Sequence: Synthetic oligonucleotide
  Target: ATXN1; (+) strand; PAM type: YTN; PAM sequence: TTG
gtgcgcacctgtagtcccag

SEQ ID NO: 250031 - DNA, 20 bp, Artificial Sequence
  Description of Artificial Sequence: Synthetic oligonucleotide
  Target: ATXN1; (+) strand; PAM type: YTN; PAM sequence: CTG
tagtcccagttactcgggag

SEQ ID NO: 250032 - DNA, 20 bp, Artificial Sequence
  Description of Artificial Sequence: Synthetic oligonucleotide
  Target: ATXN1; (+) strand; PAM type: YTN; PAM sequence: TTA
ctcgggagcctgaggcagga

SEQ ID NO: 250033 - DNA, 20 bp, Artificial Sequence
  Description of Artificial Sequence: Synthetic oligonucleotide
  Target: ATXN1; (+) strand; PAM type: YTN; PAM sequence: CTC
gggagcctgaggcaggacaa

SEQ ID NO: 250034 - DNA, 20 bp, Artificial Sequence
  Description of Artificial Sequence: Synthetic oligonucleotide
  Target: ATXN1; (+) strand; PAM type: YTN; PAM sequence: CTG
aggcaggacaattgctcgaa

SEQ ID NO: 250035 - DNA, 20 bp, Artificial Sequence
  Description of Artificial Sequence: Synthetic oligonucleotide
  Target: ATXN1; (+) strand; PAM type: YTN; PAM sequence: TTG
ctcgaacccaagaggaagag

SEQ ID NO: 250036 - DNA, 20 bp, Artificial Sequence
  Description of Artificial Sequence: Synthetic oligonucleotide
  Target: ATXN1; (+) strand; PAM type: YTN; PAM sequence: CTC
gaacccaagaggaagaggtt

SEQ ID NO: 250037 - DNA, 20 bp, Artificial Sequence
  Description of Artificial Sequence: Synthetic oligonucleotide
  Target: ATXN1; (+) strand; PAM type: YTN; PAM sequence: TTG
cagtgagctgaaatcatgcc

SEQ ID NO: 250038 - DNA, 20 bp, Artificial Sequence
  Description of Artificial Sequence: Synthetic oligonucleotide
  Target: ATXN1; (+) strand; PAM type: YTN; PAM sequence: CTG
aaatcatgccactgcactcc

SEQ ID NO: 250039 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggagacag

SEQ ID NO: 250040 - DNA, 20 bp, Artificial Sequence
  Description of Artificial Sequence: Synthetic oligonucleotide
  Target: ATXN1; (+) strand; PAM type: YTN; PAM sequence: CTC
cagcctgggagacagagcaa

SEQ ID NO: 250041 - DNA, 20 bp, Artificial Sequence
  Description of Artificial Sequence: Synthetic oligonucleotide
  Target: ATXN1; (+) strand; PAM type: YTN; PAM sequence: CTG
ggagacagagcaagaatctg

SEQ ID NO: 250042 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaaaaaaagaaag

SEQ ID NO: 250043 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaagaaagaaaa

SEQ ID NO: 250044 - DNA, 20 bp, Artificial Sequence
  Description of Artificial Sequence: Synthetic oligonucleotide
  Target: ATXN1; (+) strand; PAM type: YTN; PAM sequence: CTA
cagcatggcagaatagaaag

SEQ ID NO: 250045 - DNA, 20 bp, Artificial Sequence
  Description of Artificial Sequence: Synthetic oligonucleotide
  Target: ATXN1; (+) strand; PAM type: YTN; PAM sequence: TTT
ctgagcctgtgcagtgacca

SEQ ID NO: 250046 - DNA, 20 bp, Artificial Sequence
  Description of Artificial Sequence: Synthetic oligonucleotide
  Target: ATXN1; (+) strand; PAM type: YTN; PAM sequence: TTC
tgagcctgtgcagtgaccat

SEQ ID NO: 250047 - DNA, 20 bp, Artificial Sequence
  Description of Artificial Sequence: Synthetic oligonucleotide
  Target: ATXN1; (+) strand; PAM type: YTN; PAM sequence: CTG
agcctgtgcagtgaccataa

SEQ ID NO: 250048 - DNA, 20 bp, Artificial Sequence
  Description of Artificial Sequence: Synthetic oligonucleotide
  Target: ATXN1; (+) strand; PAM type: YTN; PAM sequence: CTG
tgcagtgaccataatcaccc

SEQ ID NO: 250049 - DNA, 20 bp, Artificial Sequence
  Description of Artificial Sequence: Synthetic oligonucleotide
  Target: ATXN1; (+) strand; PAM type: YTN; PAM sequence: CTG
gactgcttacctctcaaaac

SEQ ID NO: 250050 - DNA, 20 bp, Artificial Sequence
  Description of Artificial Sequence: Synthetic oligonucleotide
  Target: ATXN1; (+) strand; PAM type: YTN; PAM sequence: CTG
cttacctctcaaaaccactt

SEQ ID NO: 250051 - DNA, 20 bp, Artificial Sequence
  Description of Artificial Sequence: Synthetic oligonucleotide
  Target: ATXN1; (+) strand; PAM type: YTN; PAM sequence: CTT
acctctcaaaaccactttta

SEQ ID NO: 250052 - DNA, 20 bp, Artificial Sequence
  Description of Artificial Sequence: Synthetic oligonucleotide
  Target: ATXN1; (+) strand; PAM type: YTN; PAM sequence: TTA
cctctcaaaaccacttttat

SEQ ID NO: 250053 - DNA, 20 bp, Artificial Sequence
  Description of Artificial Sequence: Synthetic oligonucleotide
  Target: ATXN1; (+) strand; PAM type: YTN; PAM sequence: CTC
tcaaaaccacttttatgtga

SEQ ID NO: 250054 - DNA, 20 bp, Artificial Sequence
  Description of Artificial Sequence: Synthetic oligonucleotide
  Target: ATXN1; (+) strand; PAM type: YTN; PAM sequence: CTC
aaaaccacttttatgtgaga

SEQ ID NO: 250055 - DNA, 20 bp, Artificial Sequence
  Description of Artificial Sequence: Synthetic oligonucleotide
  Target: ATXN1; (+) strand; PAM type: YTN; PAM sequence: CTT
ttatgtgagagaaaaataaa

SEQ ID NO: 250056 - DNA, 20 bp, Artificial Sequence
  Description of Artificial Sequence: Synthetic oligonucleotide
  Target: ATXN1; (+) strand; PAM type: YTN; PAM sequence: TTT
tatgtgagagaaaaataaat

SEQ ID NO: 250057 - DNA, 20 bp, Artificial Sequence
  Description of Artificial Sequence: Synthetic oligonucleotide
  Target: ATXN1; (+) strand; PAM type: YTN; PAM sequence: TTT
atgtgagagaaaaataaatg

SEQ ID NO: 250058 - DNA, 20 bp, Artificial Sequence
  Description of Artificial Sequence: Synthetic oligonucleotide
  Target: ATXN1; (+) strand; PAM type: YTN; PAM sequence: TTA
tgtgagagaaaaataaatgt

SEQ ID NO: 250059 - DNA, 20 bp, Artificial Sequence
  Description of Artificial Sequence: Synthetic oligonucleotide
  Target: ATXN1; (+) strand; PAM type: YTN; PAM sequence: CTA
tttctttggcttgacttctt

SEQ ID NO: 250060 - DNA, 20 bp, Artificial Sequence
  Description of Artificial Sequence: Synthetic oligonucleotide
  Target: ATXN1; (+) strand; PAM type: YTN; PAM sequence: TTT
ctttggcttgacttcttctt

SEQ ID NO: 250061 - DNA, 20 bp, Artificial Sequence
  Description of Artificial Sequence: Synthetic oligonucleotide
  Target: ATXN1; (+) strand; PAM type: YTN; PAM sequence: TTC
tttggcttgacttcttcttc

SEQ ID NO: 250062 - DNA, 20 bp, Artificial Sequence
  Description of Artificial Sequence: Synthetic oligonucleotide
  Target: ATXN1; (+) strand; PAM type: YTN; PAM sequence: CTT
tggcttgacttcttcttctt

SEQ ID NO: 250063 - DNA, 20 bp, Artificial Sequence
  Description of Artificial Sequence: Synthetic oligonucleotide
  Target: ATXN1; (+) strand; PAM type: YTN; PAM sequence: TTT
ggcttgacttcttcttcttt

SEQ ID NO: 250064 - DNA, 20 bp, Artificial Sequence
  Description of Artificial Sequence: Synthetic oligonucleotide
  Target: ATXN1; (+) strand; PAM type: YTN; PAM sequence: TTG
gcttgacttcttcttctttt

SEQ ID NO: 250065 - DNA, 20 bp, Artificial Sequence
  Description of Artificial Sequence: Synthetic oligonucleotide
  Target: ATXN1; (+) strand; PAM type: YTN; PAM sequence: CTT
gacttcttcttctttttttt

SEQ ID NO: 250066 - DNA, 20 bp, Artificial Sequence
  Description of Artificial Sequence: Synthetic oligonucleotide
  Target: ATXN1; (+) strand; PAM type: YTN; PAM sequence: TTG
acttcttcttcttttttttt

SEQ ID NO: 250067 - DNA, 20 bp, Artificial Sequence
  Description of Artificial Sequence: Synthetic oligonucleotide
  Target: ATXN1; (+) strand; PAM type: YTN; PAM sequence: CTT
cttcttcttttttttttttt

SEQ ID NO: 250068 - DNA, 20 bp, Artificial Sequence
  Description of Artificial Sequence: Synthetic oligonucleotide
  Target: ATXN1; (+) strand; PAM type: YTN; PAM sequence: TTC
ttcttctttttttttttttt

SEQ ID NO: 250069 - DNA, 20 bp, Artificial Sequence
  Description of Artificial Sequence: Synthetic oligonucleotide
  Target: ATXN1; (+) strand; PAM type: YTN; PAM sequence: CTT
cttctttttttttttttttt

SEQ ID NO: 250070 - DNA, 20 bp, Artificial Sequence
  Description of Artificial Sequence: Synthetic oligonucleotide
  Target: ATXN1; (+) strand; PAM type: YTN; PAM sequence: TTC
ttcttttttttttttttttt

SEQ ID NO: 250071 - DNA, 20 bp, Artificial Sequence
  Description of Artificial Sequence: Synthetic oligonucleotide
  Target: ATXN1; (+) strand; PAM type: YTN; PAM sequence: CTT
cttttttttttttttttttt

SEQ ID NO: 250072 - DNA, 20 bp, Artificial Sequence
  Description of Artificial Sequence: Synthetic oligonucleotide
  Target: ATXN1; (+) strand; PAM type: YTN; PAM sequence: TTC
tttttttttttttttttttt

SEQ ID NO: 250073 - DNA, 20 bp, Artificial Sequence
  Description of Artificial Sequence: Synthetic oligonucleotide
  Target: ATXN1; (+) strand; PAM type: YTN; PAM sequence: CTT
tttttttttttttttttttt

SEQ ID NO: 250074 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 250075 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 250076 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttg

SEQ ID NO: 250077 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttgg

SEQ ID NO: 250078 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttggt

SEQ ID NO: 250079 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttggtg

SEQ ID NO: 250080 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttggtga

SEQ ID NO: 250081 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttggtgat

SEQ ID NO: 250082 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttggtgata

SEQ ID NO: 250083 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttggtgatat

SEQ ID NO: 250084 - DNA, 20 bp, Artificial Sequence
  Description of Artificial Sequence: Synthetic oligonucleotide
  Target: ATXN1; (+) strand; PAM type: YTN; PAM sequence: TTT
tttttttttttggtgatatg

SEQ ID NO: 250085 - DNA, 20 bp, Artificial Sequence
  Description of Artificial Sequence: Synthetic oligonucleotide
  Target: ATXN1; (+) strand; PAM type: YTN; PAM sequence: TTT
ttttttttttggtgatatgg

SEQ ID NO: 250086 - DNA, 20 bp, Artificial Sequence
  Description of Artificial Sequence: Synthetic oligonucleotide
  Target: ATXN1; (+) strand; PAM type: YTN; PAM sequence: TTT
tttttttttggtgatatgga

SEQ ID NO: 250087 - DNA, 20 bp, Artificial Sequence
  Description of Artificial Sequence: Synthetic oligonucleotide
  Target: ATXN1; (+) strand; PAM type: YTN; PAM sequence: TTT
ttttttttggtgatatggaa

SEQ ID NO: 250088 - DNA, 20 bp, Artificial Sequence
  Description of Artificial Sequence: Synthetic oligonucleotide
  Target: ATXN1; (+) strand; PAM type: YTN; PAM sequence: TTT
tttttttggtgatatggaac

SEQ ID NO: 250089 - DNA, 20 bp, Artificial Sequence
  Description of Artificial Sequence: Synthetic oligonucleotide
  Target: ATXN1; (+) strand; PAM type: YTN; PAM sequence: TTT
ttttttggtgatatggaact

SEQ ID NO: 250090 - DNA, 20 bp, Artificial Sequence
  Description of Artificial Sequence: Synthetic oligonucleotide
  Target: ATXN1; (+) strand; PAM type: YTN; PAM sequence: TTT
tttttggtgatatggaactg

SEQ ID NO: 250091 - DNA, 20 bp, Artificial Sequence
  Description of Artificial Sequence: Synthetic oligonucleotide
  Target: ATXN1; (+) strand; PAM type: YTN; PAM sequence: TTT
ttttggtgatatggaactga

SEQ ID NO: 250092 - DNA, 20 bp, Artificial Sequence
  Description of Artificial Sequence: Synthetic oligonucleotide
  Target: ATXN1; (+) strand; PAM type: YTN; PAM sequence: TTT
tttggtgatatggaactgaa

SEQ ID NO: 250093 - DNA, 20 bp, Artificial Sequence
  Description of Artificial Sequence: Synthetic oligonucleotide
  Target: ATXN1; (+) strand; PAM type: YTN; PAM sequence: TTT
ttggtgatatggaactgaac

SEQ ID NO: 250094 - DNA, 20 bp, Artificial Sequence
  Description of Artificial Sequence: Synthetic oligonucleotide
  Target: ATXN1; (+) strand; PAM type: YTN; PAM sequence: TTT
tggtgatatggaactgaacc

SEQ ID NO: 250095 - DNA, 20 bp, Artificial Sequence
  Description of Artificial Sequence: Synthetic oligonucleotide
  Target: ATXN1; (+) strand; PAM type: YTN; PAM sequence: TTT
ggtgatatggaactgaacct

SEQ ID NO: 250096 - DNA, 20 bp, Artificial Sequence
  Description of Artificial Sequence: Synthetic oligonucleotide
  Target: ATXN1; (+) strand; PAM type: YTN; PAM sequence: TTG
gtgatatggaactgaaccta

SEQ ID NO: 250097 - DNA, 20 bp, Artificial Sequence
  Description of Artificial Sequence: Synthetic oligonucleotide
  Target: ATXN1; (+) strand; PAM type: YTN; PAM sequence: CTG
aacctaatcctaactgttac

SEQ ID NO: 250098 - DNA, 20 bp, Artificial Sequence
  Description of Artificial Sequence: Synthetic oligonucleotide
  Target: ATXN1; (+) strand; PAM type: YTN; PAM sequence: CTA
atcctaactgttacaaatag

SEQ ID NO: 250099 - DNA, 20 bp, Artificial Sequence
  Description of Artificial Sequence: Synthetic oligonucleotide
  Target: ATXN1; (+) strand; PAM type: YTN; PAM sequence: CTA
actgttacaaatagacctta

SEQ ID NO: 250100 - DNA, 20 bp, Artificial Sequence
  Description of Artificial Sequence: Synthetic oligonucleotide
  Target: ATXN1; (+) strand; PAM type: YTN; PAM sequence: CTG
ttacaaatagaccttagagg

SEQ ID NO: 250101 - DNA, 20 bp, Artificial Sequence
  Description of Artificial Sequence: Synthetic oligonucleotide
  Target: ATXN1; (+) strand; PAM type: YTN; PAM sequence: TTA
caaatagaccttagaggtca

SEQ ID NO: 250102 - DNA, 20 bp, Artificial Sequence
  Description of Artificial Sequence: Synthetic oligonucleotide
  Target: ATXN1; (+) strand; PAM type: YTN; PAM sequence: CTT
agaggtcataatagacttca

SEQ ID NO: 250103 - DNA, 20 bp, Artificial Sequence
  Description of Artificial Sequence: Synthetic oligonucleotide
  Target: ATXN1; (+) strand; PAM type: YTN; PAM sequence: TTA
gaggtcataatagacttcat

SEQ ID NO: 250104 - DNA, 20 bp, Artificial Sequence
  Description of Artificial Sequence: Synthetic oligonucleotide
  Target: ATXN1; (+) strand; PAM type: YTN; PAM sequence: CTT
cattttacagattaggaaac

SEQ ID NO: 250105 - DNA, 20 bp, Artificial Sequence
  Description of Artificial Sequence: Synthetic oligonucleotide
  Target: ATXN1; (+) strand; PAM type: YTN; PAM sequence: TTC
attttacagattaggaaact

SEQ ID NO: 250106 - DNA, 20 bp, Artificial Sequence
  Description of Artificial Sequence: Synthetic oligonucleotide
  Target: ATXN1; (+) strand; PAM type: YTN; PAM sequence: TTT
tacagattaggaaactaatg

SEQ ID NO: 250107 - DNA, 20 bp, Artificial Sequence
  Description of Artificial Sequence: Synthetic oligonucleotide
  Target: ATXN1; (+) strand; PAM type: YTN; PAM sequence: TTT
acagattaggaaactaatga

SEQ ID NO: 250108 - DNA, 20 bp, Artificial Sequence
  Description of Artificial Sequence: Synthetic oligonucleotide
  Target: ATXN1; (+) strand; PAM type: YTN; PAM sequence: TTA
cagattaggaaactaatgat

SEQ ID NO: 250109 - DNA, 20 bp, Artificial Sequence
  Description of Artificial Sequence: Synthetic oligonucleotide
  Target: ATXN1; (+) strand; PAM type: YTN; PAM sequence: TTA
ggaaactaatgattaaagat

SEQ ID NO: 250110 - DNA, 20 bp, Artificial Sequence
  Description of Artificial Sequence: Synthetic oligonucleotide
  Target: ATXN1; (+) strand; PAM type: YTN; PAM sequence: CTA
atgattaaagatcaactttg

SEQ ID NO: 250111 - DNA, 20 bp, Artificial Sequence
  Description of Artificial Sequence: Synthetic oligonucleotide
  Target: ATXN1; (+) strand; PAM type: YTN; PAM sequence: TTA
aagatcaactttgataaatg

SEQ ID NO: 250112 - DNA, 20 bp, Artificial Sequence
  Description of Artificial Sequence: Synthetic oligonucleotide
  Target: ATXN1; (+) strand; PAM type: YTN; PAM sequence: CTT
tgataaatgtctcaatcggg

SEQ ID NO: 250113 - DNA, 20 bp, Artificial Sequence
  Description of Artificial Sequence: Synthetic oligonucleotide
  Target: ATXN1; (+) strand; PAM type: YTN; PAM sequence: TTT
gataaatgtctcaatcggga

SEQ ID NO: 250114 - DNA, 20 bp, Artificial Sequence
  Description of Artificial Sequence: Synthetic oligonucleotide
  Target: ATXN1; (+) strand; PAM type: YTN; PAM sequence: TTG
ataaatgtctcaatcgggaa

SEQ ID NO: 250115 - DNA, 20 bp, Artificial Sequence
  Description of Artificial Sequence: Synthetic oligonucleotide
  Target: ATXN1; (+) strand; PAM type: YTN; PAM sequence: CTC
aatcgggaagcagagttggc

SEQ ID NO: 250116 - DNA, 20 bp, Artificial Sequence
  Description of Artificial Sequence: Synthetic oligonucleotide
  Target: ATXN1; (+) strand; PAM type: YTN; PAM sequence: TTG
gcaaattaattacacttctg

SEQ ID NO: 250117 - DNA, 20 bp, Artificial Sequence
  Description of Artificial Sequence: Synthetic oligonucleotide
  Target: ATXN1; (+) strand; PAM type: YTN; PAM sequence: TTA
attacacttctgtttaatct

SEQ ID NO: 250118 - DNA, 20 bp, Artificial Sequence
  Description of Artificial Sequence: Synthetic oligonucleotide
  Target: ATXN1; (+) strand; PAM type: YTN; PAM sequence: TTA
cacttctgtttaatcttctt

SEQ ID NO: 250119 - DNA, 20 bp, Artificial Sequence
  Description of Artificial Sequence: Synthetic oligonucleotide
  Target: ATXN1; (+) strand; PAM type: YTN; PAM sequence: CTT
ctgtttaatcttctttttct

SEQ ID NO: 250120 - DNA, 20 bp, Artificial Sequence
  Description of Artificial Sequence: Synthetic oligonucleotide
  Target: ATXN1; (+) strand; PAM type: YTN; PAM sequence: TTC
tgtttaatcttctttttcta

SEQ ID NO: 250121 - DNA, 20 bp, Artificial Sequence
  Description of Artificial Sequence: Synthetic oligonucleotide
  Target: ATXN1; (+) strand; PAM type: YTN; PAM sequence: CTG
tttaatcttctttttctaaa

SEQ ID NO: 250122 - DNA, 20 bp, Artificial Sequence
  Description of Artificial Sequence: Synthetic oligonucleotide
  Target: ATXN1; (+) strand; PAM type: YTN; PAM sequence: TTT
aatcttctttttctaaagat

SEQ ID NO: 250123 - DNA, 20 bp, Artificial Sequence
  Description of Artificial Sequence: Synthetic oligonucleotide
  Target: ATXN1; (+) strand; PAM type: YTN; PAM sequence: TTA
atcttctttttctaaagata

SEQ ID NO: 250124 - DNA, 20 bp, Artificial Sequence
  Description of Artificial Sequence: Synthetic oligonucleotide
  Target: ATXN1; (+) strand; PAM type: YTN; PAM sequence: CTT
ctttttctaaagatagatga

SEQ ID NO: 250125 - DNA, 20 bp, Artificial Sequence
  Description of Artificial Sequence: Synthetic oligonucleotide
  Target: ATXN1; (+) strand; PAM type: YTN; PAM sequence: TTC
tttttctaaagatagatgat

SEQ ID NO: 250126 - DNA, 20 bp, Artificial Sequence
  Description of Artificial Sequence: Synthetic oligonucleotide
  Target: ATXN1; (+) strand; PAM type: YTN; PAM sequence: CTT
tttctaaagatagatgatga

SEQ ID NO: 250127 - DNA, 20 bp, Artificial Sequence
  Description of Artificial Sequence: Synthetic oligonucleotide
  Target: ATXN1; (+) strand; PAM type: YTN; PAM sequence: TTT
ttctaaagatagatgatgaa

SEQ ID NO: 250128 - DNA, 20 bp, Artificial Sequence
  Description of Artificial Sequence: Synthetic oligonucleotide
  Target: ATXN1; (+) strand; PAM type: YTN; PAM sequence: TTT
tctaaagatagatgatgaag

SEQ ID NO: 250129 - DNA, 20 bp, Artificial Sequence
  Description of Artificial Sequence: Synthetic oligonucleotide
  Target: ATXN1; (+) strand; PAM type: YTN; PAM sequence: TTT
ctaaagatagatgatgaagg

SEQ ID NO: 250130 - DNA, 20 bp, Artificial Sequence
  Description of Artificial Sequence: Synthetic oligonucleotide
  Target: ATXN1; (+) strand; PAM type: YTN; PAM sequence: TTC
taaagatagatgatgaaggt

SEQ ID NO: 250131 - DNA, 20 bp, Artificial Sequence
  Description of Artificial Sequence: Synthetic oligonucleotide
  Target: ATXN1; (+) strand; PAM type: YTN; PAM sequence: CTA
aagatagatgatgaaggttc

SEQ ID NO: 250132 - DNA, 20 bp, Artificial Sequence
  Description of Artificial Sequence: Synthetic oligonucleotide
  Target: ATXN1; (+) strand; PAM type: YTN; PAM sequence: TTC
tattttatatgcctatcagt

SEQ ID NO: 250133 - DNA, 20 bp, Artificial Sequence
  Description of Artificial Sequence: Synthetic oligonucleotide
  Target: ATXN1; (+) strand; PAM type: YTN; PAM sequence: CTA
ttttatatgcctatcagtat

SEQ ID NO: 250134 - DNA, 20 bp, Artificial Sequence
  Description of Artificial Sequence: Synthetic oligonucleotide
  Target: ATXN1; (+) strand; PAM type: YTN; PAM sequence: TTT
tatatgcctatcagtatctg

SEQ ID NO: 250135 - DNA, 20 bp, Artificial Sequence
  Description of Artificial Sequence: Synthetic oligonucleotide
  Target: ATXN1; (+) strand; PAM type: YTN; PAM sequence: TTT
atatgcctatcagtatctgc

SEQ ID NO: 250136 - DNA, 20 bp, Artificial Sequence
  Description of Artificial Sequence: Synthetic oligonucleotide
  Target: ATXN1; (+) strand; PAM type: YTN; PAM sequence: TTA
tatgcctatcagtatctgct

SEQ ID NO: 250137 - DNA, 20 bp, Artificial Sequence
  Description of Artificial Sequence: Synthetic oligonucleotide
  Target: ATXN1; (+) strand; PAM type: YTN; PAM sequence: CTA
tcagtatctgctaaatgaat

SEQ ID NO: 250138 - DNA, 20 bp, Artificial Sequence
  Description of Artificial Sequence: Synthetic oligonucleotide
  Target: ATXN1; (+) strand; PAM type: YTN; PAM sequence: CTG
ctaaatgaatacggttttat

SEQ ID NO: 250139 - DNA, 20 bp, Artificial Sequence
  Description of Artificial Sequence: Synthetic oligonucleotide
  Target: ATXN1; (+) strand; PAM type: YTN; PAM sequence: CTA
aatgaatacggttttatatt

SEQ ID NO: 250140 - DNA, 20 bp, Artificial Sequence
  Description of Artificial Sequence: Synthetic oligonucleotide
  Target: ATXN1; (+) strand; PAM type: YTN; PAM sequence: TTT
tatatttcacatgtctgtga

SEQ ID NO: 250141 - DNA, 20 bp, Artificial Sequence
  Description of Artificial Sequence: Synthetic oligonucleotide
  Target: ATXN1; (+) strand; PAM type: YTN; PAM sequence: TTT
atatttcacatgtctgtgaa

SEQ ID NO: 250142 - DNA, 20 bp, Artificial Sequence
  Description of Artificial Sequence: Synthetic oligonucleotide
  Target: ATXN1; (+) strand; PAM type: YTN; PAM sequence: TTA
tatttcacatgtctgtgaat

SEQ ID NO: 250143 - DNA, 20 bp, Artificial Sequence
  Description of Artificial Sequence: Synthetic oligonucleotide
  Target: ATXN1; (+) strand; PAM type: YTN; PAM sequence: TTT
cacatgtctgtgaatttctg

SEQ ID NO: 250144 - DNA, 20 bp, Artificial Sequence
  Description of Artificial Sequence: Synthetic oligonucleotide
  Target: ATXN1; (+) strand; PAM type: YTN; PAM sequence: TTC
acatgtctgtgaatttctga

SEQ ID NO: 250145 - DNA, 20 bp, Artificial Sequence
  Description of Artificial Sequence: Synthetic oligonucleotide
  Target: ATXN1; (+) strand; PAM type: YTN; PAM sequence: CTG
tgaatttctgaacctctgag

SEQ ID NO: 250146 - DNA, 20 bp, Artificial Sequence
  Description of Artificial Sequence: Synthetic oligonucleotide
  Target: ATXN1; (+) strand; PAM type: YTN; PAM sequence: TTT
ctgaacctctgaggtcttcc

SEQ ID NO: 250147 - DNA, 20 bp, Artificial Sequence
  Description of Artificial Sequence: Synthetic oligonucleotide
  Target: ATXN1; (+) strand; PAM type: YTN; PAM sequence: TTC
tgaacctctgaggtcttcca

SEQ ID NO: 250148 - DNA, 20 bp, Artificial Sequence
  Description of Artificial Sequence: Synthetic oligonucleotide
  Target: ATXN1; (+) strand; PAM type: YTN; PAM sequence: CTG
aacctctgaggtcttccaac

SEQ ID NO: 250149 - DNA, 20 bp, Artificial Sequence
  Description of Artificial Sequence: Synthetic oligonucleotide
  Target: ATXN1; (+) strand; PAM type: YTN; PAM sequence: CTC
tgaggtcttccaactggcac

SEQ ID NO: 250150 - DNA, 20 bp, Artificial Sequence
  Description of Artificial Sequence: Synthetic oligonucleotide
  Target: ATXN1; (+) strand; PAM type: YTN; PAM sequence: CTG
aggtcttccaactggcacat

SEQ ID NO: 250151 - DNA, 20 bp, Artificial Sequence
  Description of Artificial Sequence: Synthetic oligonucleotide
  Target: ATXN1; (+) strand; PAM type: YTN; PAM sequence: CTT
ccaactggcacatctaatcc

SEQ ID NO: 250152 - DNA, 20 bp, Artificial Sequence
  Description of Artificial Sequence: Synthetic oligonucleotide
  Target: ATXN1; (+) strand; PAM type: YTN; PAM sequence: TTC
caactggcacatctaatccc

SEQ ID NO: 250153 - DNA, 20 bp, Artificial Sequence
  Description of Artificial Sequence: Synthetic oligonucleotide
  Target: ATXN1; (+) strand; PAM type: YTN; PAM sequence: CTG
gcacatctaatcccaagtca

SEQ ID NO: 250154 - DNA, 20 bp, Artificial Sequence
  Description of Artificial Sequence: Synthetic oligonucleotide
  Target: ATXN1; (+) strand; PAM type: YTN; PAM sequence: CTA
atcccaagtcacacatattc

SEQ ID NO: 250155 - DNA, 20 bp, Artificial Sequence
  Description of Artificial Sequence: Synthetic oligonucleotide
  Target: ATXN1; (+) strand; PAM type: YTN; PAM sequence: TTC
aaggaataagctattaaata

SEQ ID NO: 250156 - DNA, 20 bp, Artificial Sequence
  Description of Artificial Sequence: Synthetic oligonucleotide
  Target: ATXN1; (+) strand; PAM type: YTN; PAM sequence: CTA
ttaaataataaaaaatgtga

SEQ ID NO: 250157 - DNA, 20 bp, Artificial Sequence
  Description of Artificial Sequence: Synthetic oligonucleotide
  Target: ATXN1; (+) strand; PAM type: YTN; PAM sequence: TTA
aataataaaaaatgtgatga

SEQ ID NO: 250158 - DNA, 20 bp, Artificial Sequence
  Description of Artificial Sequence: Synthetic oligonucleotide
  Target: ATXN1; (+) strand; PAM type: YTN; PAM sequence: CTT
gagaaaattttcttttcctg

SEQ ID NO: 250159 - DNA, 20 bp, Artificial Sequence
  Description of Artificial Sequence: Synthetic oligonucleotide
  Target: ATXN1; (+) strand; PAM type: YTN; PAM sequence: TTG
agaaaattttcttttcctgc

SEQ ID NO: 250160 - DNA, 20 bp, Artificial Sequence
  Description of Artificial Sequence: Synthetic oligonucleotide
  Target: ATXN1; (+) strand; PAM type: YTN; PAM sequence: TTT
tcttttcctgctatgttcat

SEQ ID NO: 250161 - DNA, 20 bp, Artificial Sequence
  Description of Artificial Sequence: Synthetic oligonucleotide
  Target: ATXN1; (+) strand; PAM type: YTN; PAM sequence: TTT
cttttcctgctatgttcatt

SEQ ID NO: 250162 - DNA, 20 bp, Artificial Sequence
  Description of Artificial Sequence: Synthetic oligonucleotide
  Target: ATXN1; (+) strand; PAM type: YTN; PAM sequence: TTC
ttttcctgctatgttcatta

SEQ ID NO: 250163 - DNA, 20 bp, Artificial Sequence
  Description of Artificial Sequence: Synthetic oligonucleotide
  Target: ATXN1; (+) strand; PAM type: YTN; PAM sequence: CTT
ttcctgctatgttcattaga

SEQ ID NO: 250164 - DNA, 20 bp, Artificial Sequence
  Description of Artificial Sequence: Synthetic oligonucleotide
  Target: ATXN1; (+) strand; PAM type: YTN; PAM sequence: TTT
tcctgctatgttcattagat

SEQ ID NO: 250165 - DNA, 20 bp, Artificial Sequence
  Description of Artificial Sequence: Synthetic oligonucleotide
  Target: ATXN1; (+) strand; PAM type: YTN; PAM sequence: TTT
cctgctatgttcattagatt

SEQ ID NO: 250166 - DNA, 20 bp, Artificial Sequence
  Description of Artificial Sequence: Synthetic oligonucleotide
  Target: ATXN1; (+) strand; PAM type: YTN; PAM sequence: TTC
ctgctatgttcattagattc

SEQ ID NO: 250167 - DNA, 20 bp, Artificial Sequence
  Description of Artificial Sequence: Synthetic oligonucleotide
  Target: ATXN1; (+) strand; PAM type: YTN; PAM sequence: CTG
ctatgttcattagattccac

SEQ ID NO: 250168 - DNA, 20 bp, Artificial Sequence
  Description of Artificial Sequence: Synthetic oligonucleotide
  Target: ATXN1; (+) strand; PAM type: YTN; PAM sequence: CTA
tgttcattagattccacatg

SEQ ID NO: 250169 - DNA, 20 bp, Artificial Sequence
  Description of Artificial Sequence: Synthetic oligonucleotide
  Target: ATXN1; (+) strand; PAM type: YTN; PAM sequence: TTC
attagattccacatgtctta

SEQ ID NO: 250170 - DNA, 20 bp, Artificial Sequence
  Description of Artificial Sequence: Synthetic oligonucleotide
  Target: ATXN1; (+) strand; PAM type: YTN; PAM sequence: TTA
gattccacatgtcttaatct

SEQ ID NO: 250171 - DNA, 20 bp, Artificial Sequence
  Description of Artificial Sequence: Synthetic oligonucleotide
  Target: ATXN1; (+) strand; PAM type: YTN; PAM sequence: TTC
cacatgtcttaatctgcatc

SEQ ID NO: 250172 - DNA, 20 bp, Artificial Sequence
  Description of Artificial Sequence: Synthetic oligonucleotide
  Target: ATXN1; (+) strand; PAM type: YTN; PAM sequence: CTT
aatctgcatcttagtacata

SEQ ID NO: 250173 - DNA, 20 bp, Artificial Sequence
  Description of Artificial Sequence: Synthetic oligonucleotide
  Target: ATXN1; (+) strand; PAM type: YTN; PAM sequence: TTA
atctgcatcttagtacataa

SEQ ID NO: 250174 - DNA, 20 bp, Artificial Sequence
  Description of Artificial Sequence: Synthetic oligonucleotide
  Target: ATXN1; (+) strand; PAM type: YTN; PAM sequence: CTG
catcttagtacataaatcta

SEQ ID NO: 250175 - DNA, 20 bp, Artificial Sequence
  Description of Artificial Sequence: Synthetic oligonucleotide
  Target: ATXN1; (+) strand; PAM type: YTN; PAM sequence: CTT
agtacataaatctacaaaac

SEQ ID NO: 250176 - DNA, 20 bp, Artificial Sequence
  Description of Artificial Sequence: Synthetic oligonucleotide
  Target: ATXN1; (+) strand; PAM type: YTN; PAM sequence: TTA
gtacataaatctacaaaact

SEQ ID NO: 250177 - DNA, 20 bp, Artificial Sequence
  Description of Artificial Sequence: Synthetic oligonucleotide
  Target: ATXN1; (+) strand; PAM type: YTN; PAM sequence: CTA
caaaactatattaattttca

SEQ ID NO: 250178 - DNA, 20 bp, Artificial Sequence
  Description of Artificial Sequence: Synthetic oligonucleotide
  Target: ATXN1; (+) strand; PAM type: YTN; PAM sequence: CTA
tattaattttcactggtatt

SEQ ID NO: 250179 - DNA, 20 bp, Artificial Sequence
  Description of Artificial Sequence: Synthetic oligonucleotide
  Target: ATXN1; (+) strand; PAM type: YTN; PAM sequence: TTA
attttcactggtattttaga

SEQ ID NO: 250180 - DNA, 20 bp, Artificial Sequence
  Description of Artificial Sequence: Synthetic oligonucleotide
  Target: ATXN1; (+) strand; PAM type: YTN; PAM sequence: TTT
tcactggtattttagaaagt

SEQ ID NO: 250181 - DNA, 20 bp, Artificial Sequence
  Description of Artificial Sequence: Synthetic oligonucleotide
  Target: ATXN1; (+) strand; PAM type: YTN; PAM sequence: TTT
cactggtattttagaaagtg

SEQ ID NO: 250182 - DNA, 20 bp, Artificial Sequence
  Description of Artificial Sequence: Synthetic oligonucleotide
  Target: ATXN1; (+) strand; PAM type: YTN; PAM sequence: TTC
actggtattttagaaagtgc

SEQ ID NO: 250183 - DNA, 20 bp, Artificial Sequence
  Description of Artificial Sequence: Synthetic oligonucleotide
  Target: ATXN1; (+) strand; PAM type: YTN; PAM sequence: CTG
gtattttagaaagtgctaaa

SEQ ID NO: 250184 - DNA, 20 bp, Artificial Sequence
  Description of Artificial Sequence: Synthetic oligonucleotide
  Target: ATXN1; (+) strand; PAM type: YTN; PAM sequence: TTT
tagaaagtgctaaatggaga

SEQ ID NO: 250185 - DNA, 20 bp, Artificial Sequence
  Description of Artificial Sequence: Synthetic oligonucleotide
  Target: ATXN1; (+) strand; PAM type: YTN; PAM sequence: TTT
agaaagtgctaaatggagat

SEQ ID NO: 250186 - DNA, 20 bp, Artificial Sequence
  Description of Artificial Sequence: Synthetic oligonucleotide
  Target: ATXN1; (+) strand; PAM type: YTN; PAM sequence: TTA
gaaagtgctaaatggagatt

SEQ ID NO: 250187 - DNA, 20 bp, Artificial Sequence
  Description of Artificial Sequence: Synthetic oligonucleotide
  Target: ATXN1; (+) strand; PAM type: YTN; PAM sequence: CTA
aatggagattttcaaatttg

SEQ ID NO: 250188 - DNA, 20 bp, Artificial Sequence
  Description of Artificial Sequence: Synthetic oligonucleotide
  Target: ATXN1; (+) strand; PAM type: YTN; PAM sequence: TTT
tcaaatttgggtgaaaagtc

SEQ ID NO: 250189 - DNA, 20 bp, Artificial Sequence
  Description of Artificial Sequence: Synthetic oligonucleotide
  Target: ATXN1; (+) strand; PAM type: YTN; PAM sequence: TTT
caaatttgggtgaaaagtca

SEQ ID NO: 250190 - DNA, 20 bp, Artificial Sequence
  Description of Artificial Sequence: Synthetic oligonucleotide
  Target: ATXN1; (+) strand; PAM type: YTN; PAM sequence: TTC
aaatttgggtgaaaagtcag

SEQ ID NO: 250191 - DNA, 20 bp, Artificial Sequence
  Description of Artificial Sequence: Synthetic oligonucleotide
  Target: ATXN1; (+) strand; PAM type: YTN; PAM sequence: TTT
gggtgaaaagtcagtatctg

SEQ ID NO: 250192 - DNA, 20 bp, Artificial Sequence
  Description of Artificial Sequence: Synthetic oligonucleotide
  Target: ATXN1; (+) strand; PAM type: YTN; PAM sequence: TTG
ggtgaaaagtcagtatctgg

SEQ ID NO: 250193 - DNA, 20 bp, Artificial Sequence
  Description of Artificial Sequence: Synthetic oligonucleotide
  Target: ATXN1; (+) strand; PAM type: YTN; PAM sequence: CTG
gaatgttgaaaggtatcttt

SEQ ID NO: 250194 - DNA, 20 bp, Artificial Sequence
  Description of Artificial Sequence: Synthetic oligonucleotide
  Target: ATXN1; (+) strand; PAM type: YTN; PAM sequence: TTG
aaaggtatctttacttcaat

SEQ ID NO: 250195 - DNA, 20 bp, Artificial Sequence
  Description of Artificial Sequence: Synthetic oligonucleotide
  Target: ATXN1; (+) strand; PAM type: YTN; PAM sequence: CTT
tacttcaatatgtgtgcaag

SEQ ID NO: 250196 - DNA, 20 bp, Artificial Sequence
  Description of Artificial Sequence: Synthetic oligonucleotide
  Target: ATXN1; (+) strand; PAM type: YTN; PAM sequence: TTT
acttcaatatgtgtgcaaga

SEQ ID NO: 250197 - DNA, 20 bp, Artificial Sequence
  Description of Artificial Sequence: Synthetic oligonucleotide
  Target: ATXN1; (+) strand; PAM type: YTN; PAM sequence: TTA
cttcaatatgtgtgcaagat

SEQ ID NO: 250198 - DNA, 20 bp, Artificial Sequence
  Description of Artificial Sequence: Synthetic oligonucleotide
  Target: ATXN1; (+) strand; PAM type: YTN; PAM sequence: CTT
caatatgtgtgcaagataat

SEQ ID NO: 250199 - DNA, 20 bp, Artificial Sequence
  Description of Artificial Sequence: Synthetic oligonucleotide
  Target: ATXN1; (+) strand; PAM type: YTN; PAM sequence: TTC
aatatgtgtgcaagataatc

SEQ ID NO: 250200 - DNA, 20 bp, Artificial Sequence
  Description of Artificial Sequence: Synthetic oligonucleotide
  Target: ATXN1; (+) strand; PAM type: YTN; PAM sequence: CTA
tgctgtagctgtaaaatata

SEQ ID NO: 250201 - DNA, 20 bp, Artificial Sequence
  Description of Artificial Sequence: Synthetic oligonucleotide
  Target: ATXN1; (+) strand; PAM type: YTN; PAM sequence: CTG
tagctgtaaaatatatccct

SEQ ID NO: 250202 - DNA, 20 bp, Artificial Sequence
  Description of Artificial Sequence: Synthetic oligonucleotide
  Target: ATXN1; (+) strand; PAM type: YTN; PAM sequence: CTG
taaaatatatccctggatgc

SEQ ID NO: 250203 - DNA, 20 bp, Artificial Sequence
  Description of Artificial Sequence: Synthetic oligonucleotide
  Target: ATXN1; (+) strand; PAM type: YTN; PAM sequence: CTG
gatgcttttacagaataata

SEQ ID NO: 250204 - DNA, 20 bp, Artificial Sequence
  Description of Artificial Sequence: Synthetic oligonucleotide
  Target: ATXN1; (+) strand; PAM type: YTN; PAM sequence: CTT
ttacagaataatactgaaac

SEQ ID NO: 250205 - DNA, 20 bp, Artificial Sequence
  Description of Artificial Sequence: Synthetic oligonucleotide
  Target: ATXN1; (+) strand; PAM type: YTN; PAM sequence: TTT
tacagaataatactgaaaca

SEQ ID NO: 250206 - DNA, 20 bp, Artificial Sequence
  Description of Artificial Sequence: Synthetic oligonucleotide
  Target: ATXN1; (+) strand; PAM type: YTN; PAM sequence: TTT
acagaataatactgaaacac

SEQ ID NO: 250207 - DNA, 20 bp, Artificial Sequence
  Description of Artificial Sequence: Synthetic oligonucleotide
  Target: ATXN1; (+) strand; PAM type: YTN; PAM sequence: TTA
cagaataatactgaaacact

SEQ ID NO: 250208 - DNA, 20 bp, Artificial Sequence
  Description of Artificial Sequence: Synthetic oligonucleotide
  Target: ATXN1; (+) strand; PAM type: YTN; PAM sequence: CTG
aaacactctctgaaactaat

SEQ ID NO: 250209 - DNA, 20 bp, Artificial Sequence
  Description of Artificial Sequence: Synthetic oligonucleotide
  Target: ATXN1; (+) strand; PAM type: YTN; PAM sequence: CTC
tctgaaactaatggatattg

SEQ ID NO: 250210 - DNA, 20 bp, Artificial Sequence
  Description of Artificial Sequence: Synthetic oligonucleotide
  Target: ATXN1; (+) strand; PAM type: YTN; PAM sequence: CTC
tgaaactaatggatattgct

SEQ ID NO: 250211 - DNA, 20 bp, Artificial Sequence
  Description of Artificial Sequence: Synthetic oligonucleotide
  Target: ATXN1; (+) strand; PAM type: YTN; PAM sequence: CTG
aaactaatggatattgctaa

SEQ ID NO: 250212 - DNA, 20 bp, Artificial Sequence
  Description of Artificial Sequence: Synthetic oligonucleotide
  Target: ATXN1; (+) strand; PAM type: YTN; PAM sequence: CTA
atggatattgctaaactgac

SEQ ID NO: 250213 - DNA, 20 bp, Artificial Sequence
  Description of Artificial Sequence: Synthetic oligonucleotide
  Target: ATXN1; (+) strand; PAM type: YTN; PAM sequence: TTG
ctaaactgacaaaactcact

SEQ ID NO: 250214 - DNA, 20 bp, Artificial Sequence
  Description of Artificial Sequence: Synthetic oligonucleotide
  Target: ATXN1; (+) strand; PAM type: YTN; PAM sequence: CTA
aactgacaaaactcacttat

SEQ ID NO: 250215 - DNA, 20 bp, Artificial Sequence
  Description of Artificial Sequence: Synthetic oligonucleotide
  Target: ATXN1; (+) strand; PAM type: YTN; PAM sequence: CTG
acaaaactcacttattaaat

SEQ ID NO: 250216 - DNA, 20 bp, Artificial Sequence
  Description of Artificial Sequence: Synthetic oligonucleotide
  Target: ATXN1; (+) strand; PAM type: YTN; PAM sequence: CTC
acttattaaattcaattaat

SEQ ID NO: 250217 - DNA, 20 bp, Artificial Sequence
  Description of Artificial Sequence: Synthetic oligonucleotide
  Target: ATXN1; (+) strand; PAM type: YTN; PAM sequence: CTT
attaaattcaattaatgggg

SEQ ID NO: 250218 - DNA, 20 bp, Artificial Sequence
  Description of Artificial Sequence: Synthetic oligonucleotide
  Target: ATXN1; (+) strand; PAM type: YTN; PAM sequence: TTA
ttaaattcaattaatgggga

SEQ ID NO: 250219 - DNA, 20 bp, Artificial Sequence
  Description of Artificial Sequence: Synthetic oligonucleotide
  Target: ATXN1; (+) strand; PAM type: YTN; PAM sequence: TTA
aattcaattaatggggacca

SEQ ID NO: 250220 - DNA, 20 bp, Artificial Sequence
  Description of Artificial Sequence: Synthetic oligonucleotide
  Target: ATXN1; (+) strand; PAM type: YTN; PAM sequence: TTC
aattaatggggaccaataaa

SEQ ID NO: 250221 - DNA, 20 bp, Artificial Sequence
  Description of Artificial Sequence: Synthetic oligonucleotide
  Target: ATXN1; (+) strand; PAM type: YTN; PAM sequence: TTA
atggggaccaataaattaac

SEQ ID NO: 250222 - DNA, 20 bp, Artificial Sequence
  Description of Artificial Sequence: Synthetic oligonucleotide
  Target: ATXN1; (+) strand; PAM type: YTN; PAM sequence: TTA
accgcctcttcctggtgttc

SEQ ID NO: 250223 - DNA, 20 bp, Artificial Sequence
  Description of Artificial Sequence: Synthetic oligonucleotide
  Target: ATXN1; (+) strand; PAM type: YTN; PAM sequence: CTC
ttcctggtgttcgtccgtgc

SEQ ID NO: 250224 - DNA, 20 bp, Artificial Sequence
  Description of Artificial Sequence: Synthetic oligonucleotide
  Target: ATXN1; (+) strand; PAM type: YTN; PAM sequence: CTT
cctggtgttcgtccgtgccc

SEQ ID NO: 250225 - DNA, 20 bp, Artificial Sequence
  Description of Artificial Sequence: Synthetic oligonucleotide
  Target: ATXN1; (+) strand; PAM type: YTN; PAM sequence: TTC
ctggtgttcgtccgtgcccc

SEQ ID NO: 250226 - DNA, 20 bp, Artificial Sequence
  Description of Artificial Sequence: Synthetic oligonucleotide
  Target: ATXN1; (+) strand; PAM type: YTN; PAM sequence: CTG
gtgttcgtccgtgccccctc

SEQ ID NO: 250227 - DNA, 20 bp, Artificial Sequence
  Description of Artificial Sequence: Synthetic oligonucleotide
  Target: ATXN1; (+) strand; PAM type: YTN; PAM sequence: TTC
gtccgtgccccctcccaatc

SEQ ID NO: 250228 - DNA, 20 bp, Artificial Sequence
  Description of Artificial Sequence: Synthetic oligonucleotide
  Target: ATXN1; (+) strand; PAM type: YTN; PAM sequence: CTC
ccaatcttcactcccacaaa

SEQ ID NO: 250229 - DNA, 20 bp, Artificial Sequence
  Description of Artificial Sequence: Synthetic oligonucleotide
  Target: ATXN1; (+) strand; PAM type: YTN; PAM sequence: CTT
cactcccacaaatcatgcac

SEQ ID NO: 250230 - DNA, 20 bp, Artificial Sequence
  Description of Artificial Sequence: Synthetic oligonucleotide
  Target: ATXN1; (+) strand; PAM type: YTN; PAM sequence: TTC
actcccacaaatcatgcact

SEQ ID NO: 250231 - DNA, 20 bp, Artificial Sequence
  Description of Artificial Sequence: Synthetic oligonucleotide
  Target: ATXN1; (+) strand; PAM type: YTN; PAM sequence: CTC
ccacaaatcatgcactagcc

SEQ ID NO: 250232 - DNA, 20 bp, Artificial Sequence
  Description of Artificial Sequence: Synthetic oligonucleotide
  Target: ATXN1; (+) strand; PAM type: YTN; PAM sequence: CTA
gccattaaaaatagaaggaa

SEQ ID NO: 250233 - DNA, 20 bp, Artificial Sequence
  Description of Artificial Sequence: Synthetic oligonucleotide
  Target: ATXN1; (+) strand; PAM type: YTN; PAM sequence: TTA
aaaatagaaggaaactttct

SEQ ID NO: 250234 - DNA, 20 bp, Artificial Sequence
  Description of Artificial Sequence: Synthetic oligonucleotide
  Target: ATXN1; (+) strand; PAM type: YTN; PAM sequence: CTT
tcttcctctatgttaaagta

SEQ ID NO: 250235 - DNA, 20 bp, Artificial Sequence
  Description of Artificial Sequence: Synthetic oligonucleotide
  Target: ATXN1; (+) strand; PAM type: YTN; PAM sequence: TTT
cttcctctatgttaaagtaa

SEQ ID NO: 250236 - DNA, 20 bp, Artificial Sequence
  Description of Artificial Sequence: Synthetic oligonucleotide
  Target: ATXN1; (+) strand; PAM type: YTN; PAM sequence: TTC
ttcctctatgttaaagtaac

SEQ ID NO: 250237 - DNA, 20 bp, Artificial Sequence
  Description of Artificial Sequence: Synthetic oligonucleotide
  Target: ATXN1; (+) strand; PAM type: YTN; PAM sequence: CTT
cctctatgttaaagtaactt

SEQ ID NO: 250238 - DNA, 20 bp, Artificial Sequence
  Description of Artificial Sequence: Synthetic oligonucleotide
  Target: ATXN1; (+) strand; PAM type: YTN; PAM sequence: TTC
ctctatgttaaagtaacttg

SEQ ID NO: 250239 - DNA, 20 bp, Artificial Sequence
  Description of Artificial Sequence: Synthetic oligonucleotide
  Target: ATXN1; (+) strand; PAM type: YTN; PAM sequence: CTC
tatgttaaagtaacttgaaa

SEQ ID NO: 250240 - DNA, 20 bp, Artificial Sequence
  Description of Artificial Sequence: Synthetic oligonucleotide
  Target: ATXN1; (+) strand; PAM type: YTN; PAM sequence: CTA
tgttaaagtaacttgaaatc

SEQ ID NO: 250241 - DNA, 20 bp, Artificial Sequence
  Description of Artificial Sequence: Synthetic oligonucleotide
  Target: ATXN1; (+) strand; PAM type: YTN; PAM sequence: TTA
aagtaacttgaaatcatcta

SEQ ID NO: 250242 - DNA, 20 bp, Artificial Sequence
  Description of Artificial Sequence: Synthetic oligonucleotide
  Target: ATXN1; (+) strand; PAM type: YTN; PAM sequence: CTT
gaaatcatctaccttgtctt

SEQ ID NO: 250243 - DNA, 20 bp, Artificial Sequence
  Description of Artificial Sequence: Synthetic oligonucleotide
  Target: ATXN1; (+) strand; PAM type: YTN; PAM sequence: TTG
aaatcatctaccttgtcttc

SEQ ID NO: 250244 - DNA, 20 bp, Artificial Sequence
  Description of Artificial Sequence: Synthetic oligonucleotide
  Target: ATXN1; (+) strand; PAM type: YTN; PAM sequence: CTA
ccttgtcttctaaaactcct

SEQ ID NO: 250245 - DNA, 20 bp, Artificial Sequence
  Description of Artificial Sequence: Synthetic oligonucleotide
  Target: ATXN1; (+) strand; PAM type: YTN; PAM sequence: CTT
gtcttctaaaactcctctct

SEQ ID NO: 250246 - DNA, 20 bp, Artificial Sequence
  Description of Artificial Sequence: Synthetic oligonucleotide
  Target: ATXN1; (+) strand; PAM type: YTN; PAM sequence: TTG
tcttctaaaactcctctctt

SEQ ID NO: 250247 - DNA, 20 bp, Artificial Sequence
  Description of Artificial Sequence: Synthetic oligonucleotide
  Target: ATXN1; (+) strand; PAM type: YTN; PAM sequence: CTT
ctaaaactcctctcttgttg

SEQ ID NO: 250248 - DNA, 20 bp, Artificial Sequence
  Description of Artificial Sequence: Synthetic oligonucleotide
  Target: ATXN1; (+) strand; PAM type: YTN; PAM sequence: TTC
taaaactcctctcttgttgc

SEQ ID NO: 250249 - DNA, 20 bp, Artificial Sequence
  Description of Artificial Sequence: Synthetic oligonucleotide
  Target: ATXN1; (+) strand; PAM type: YTN; PAM sequence: CTA
aaactcctctcttgttgctt

SEQ ID NO: 250250 - DNA, 20 bp, Artificial Sequence
  Description of Artificial Sequence: Synthetic oligonucleotide
  Target: ATXN1; (+) strand; PAM type: YTN; PAM sequence: CTC
ctctcttgttgctttctaaa

SEQ ID NO: 250251 - DNA, 20 bp, Artificial Sequence
  Description of Artificial Sequence: Synthetic oligonucleotide
  Target: ATXN1; (+) strand; PAM type: YTN; PAM sequence: CTC
tcttgttgctttctaaatat

SEQ ID NO: 250252 - DNA, 20 bp, Artificial Sequence
  Description of Artificial Sequence: Synthetic oligonucleotide
  Target: ATXN1; (+) strand; PAM type: YTN; PAM sequence: CTC
ttgttgctttctaaatatcc

SEQ ID NO: 250253 - DNA, 20 bp, Artificial Sequence
  Description of Artificial Sequence: Synthetic oligonucleotide
  Target: ATXN1; (+) strand; PAM type: YTN; PAM sequence: CTT
gttgctttctaaatatccaa

SEQ ID NO: 250254 - DNA, 20 bp, Artificial Sequence
  Description of Artificial Sequence: Synthetic oligonucleotide
  Target: ATXN1; (+) strand; PAM type: YTN; PAM sequence: TTG
ttgctttctaaatatccaaa

SEQ ID NO: 250255 - DNA, 20 bp, Artificial Sequence
  Description of Artificial Sequence: Synthetic oligonucleotide
  Target: ATXN1; (+) strand; PAM type: YTN; PAM sequence: TTG
ctttctaaatatccaaatgg

SEQ ID NO: 250256 - DNA, 20 bp, Artificial Sequence
  Description of Artificial Sequence: Synthetic oligonucleotide
  Target: ATXN1; (+) strand; PAM type: YTN; PAM sequence: CTT
tctaaatatccaaatggaaa

SEQ ID NO: 250257 - DNA, 20 bp, Artificial Sequence
  Description of Artificial Sequence: Synthetic oligonucleotide
  Target: ATXN1; (+) strand; PAM type: YTN; PAM sequence: TTT
ctaaatatccaaatggaaaa

SEQ ID NO: 250258 - DNA, 20 bp, Artificial Sequence
  Description of Artificial Sequence: Synthetic oligonucleotide
  Target: ATXN1; (+) strand; PAM type: YTN; PAM sequence: TTC
taaatatccaaatggaaaat

SEQ ID NO: 250259 - DNA, 20 bp, Artificial Sequence
  Description of Artificial Sequence: Synthetic oligonucleotide
  Target: ATXN1; (+) strand; PAM type: YTN; PAM sequence: CTA
aatatccaaatggaaaatga

SEQ ID NO: 250260 - DNA, 20 bp, Artificial Sequence
  Description of Artificial Sequence: Synthetic oligonucleotide
  Target: ATXN1; (+) strand; PAM type: YTN; PAM sequence: CTG
gaggaatgggcagtatgtgg

SEQ ID NO: 250261 - DNA, 20 bp, Artificial Sequence
  Description of Artificial Sequence: Synthetic oligonucleotide
  Target: ATXN1; (+) strand; PAM type: YTN; PAM sequence: TTT
cccctattctactagtctcc

SEQ ID NO: 250262 - DNA, 20 bp, Artificial Sequence
  Description of Artificial Sequence: Synthetic oligonucleotide
  Target: ATXN1; (+) strand; PAM type: YTN; PAM sequence: TTC
ccctattctactagtctcca

SEQ ID NO: 250263 - DNA, 20 bp, Artificial Sequence
  Description of Artificial Sequence: Synthetic oligonucleotide
  Target: ATXN1; (+) strand; PAM type: YTN; PAM sequence: CTA
ttctactagtctccaaccca

SEQ ID NO: 250264 - DNA, 20 bp, Artificial Sequence
  Description of Artificial Sequence: Synthetic oligonucleotide
  Target: ATXN1; (+) strand; PAM type: YTN; PAM sequence: TTC
tactagtctccaacccacac

SEQ ID NO: 250265 - DNA, 20 bp, Artificial Sequence
  Description of Artificial Sequence: Synthetic oligonucleotide
  Target: ATXN1; (+) strand; PAM type: YTN; PAM sequence: CTA
ctagtctccaacccacacag

SEQ ID NO: 250266 - DNA, 20 bp, Artificial Sequence
  Description of Artificial Sequence: Synthetic oligonucleotide
  Target: ATXN1; (+) strand; PAM type: YTN; PAM sequence: CTA
gtctccaacccacacagaca

SEQ ID NO: 250267 - DNA, 20 bp, Artificial Sequence
  Description of Artificial Sequence: Synthetic oligonucleotide
  Target: ATXN1; (+) strand; PAM type: YTN; PAM sequence: CTC
caacccacacagacaaagaa

SEQ ID NO: 250268 - DNA, 20 bp, Artificial Sequence
  Description of Artificial Sequence: Synthetic oligonucleotide
  Target: ATXN1; (+) strand; PAM type: YTN; PAM sequence: TTC
ttccctccttcgtacctcca

SEQ ID NO: 250269 - DNA, 20 bp, Artificial Sequence
  Description of Artificial Sequence: Synthetic oligonucleotide
  Target: ATXN1; (+) strand; PAM type: YTN; PAM sequence: CTT
ccctccttcgtacctccacc

SEQ ID NO: 250270 - DNA, 20 bp, Artificial Sequence
  Description of Artificial Sequence: Synthetic oligonucleotide
  Target: ATXN1; (+) strand; PAM type: YTN; PAM sequence: TTC
cctccttcgtacctccaccc

SEQ ID NO: 250271 - DNA, 20 bp, Artificial Sequence
  Description of Artificial Sequence: Synthetic oligonucleotide
  Target: ATXN1; (+) strand; PAM type: YTN; PAM sequence: CTC
cttcgtacctccacccacat

SEQ ID NO: 250272 - DNA, 20 bp, Artificial Sequence
  Description of Artificial Sequence: Synthetic oligonucleotide
  Target: ATXN1; (+) strand; PAM type: YTN; PAM sequence: CTT
cgtacctccacccacatgga

SEQ ID NO: 250273 - DNA, 20 bp, Artificial Sequence
  Description of Artificial Sequence: Synthetic oligonucleotide
  Target: ATXN1; (+) strand; PAM type: YTN; PAM sequence: TTC
gtacctccacccacatggat

SEQ ID NO: 250274 - DNA, 20 bp, Artificial Sequence
  Description of Artificial Sequence: Synthetic oligonucleotide
  Target: ATXN1; (+) strand; PAM type: YTN; PAM sequence: CTC
cacccacatggatgaataaa

SEQ ID NO: 250275 - DNA, 20 bp, Artificial Sequence
  Description of Artificial Sequence: Synthetic oligonucleotide
  Target: ATXN1; (+) strand; PAM type: YTN; PAM sequence: CTG
atctccaacagaggttcttc

SEQ ID NO: 250276 - DNA, 20 bp, Artificial Sequence
  Description of Artificial Sequence: Synthetic oligonucleotide
  Target: ATXN1; (+) strand; PAM type: YTN; PAM sequence: CTC
caacagaggttcttcctttg

SEQ ID NO: 250277 - DNA, 20 bp, Artificial Sequence
  Description of Artificial Sequence: Synthetic oligonucleotide
  Target: ATXN1; (+) strand; PAM type: YTN; PAM sequence: TTC
ttcctttgggccttccctca

SEQ ID NO: 250278 - DNA, 20 bp, Artificial Sequence
  Description of Artificial Sequence: Synthetic oligonucleotide
  Target: ATXN1; (+) strand; PAM type: YTN; PAM sequence: CTT
cctttgggccttccctcacg

SEQ ID NO: 250279 - DNA, 20 bp, Artificial Sequence
  Description of Artificial Sequence: Synthetic oligonucleotide
  Target: ATXN1; (+) strand; PAM type: YTN; PAM sequence: TTC
ctttgggccttccctcacgg

SEQ ID NO: 250280 - DNA, 20 bp, Artificial Sequence
  Description of Artificial Sequence: Synthetic oligonucleotide
  Target: ATXN1; (+) strand; PAM type: YTN; PAM sequence: CTT
tgggccttccctcacggtta

SEQ ID NO: 250281 - DNA, 20 bp, Artificial Sequence
  Description of Artificial Sequence: Synthetic oligonucleotide
  Target: ATXN1; (+) strand; PAM type: YTN; PAM sequence: TTT
gggccttccctcacggttat

SEQ ID NO: 250282 - DNA, 20 bp, Artificial Sequence
  Description of Artificial Sequence: Synthetic oligonucleotide
  Target: ATXN1; (+) strand; PAM type: YTN; PAM sequence: TTG
ggccttccctcacggttatg

SEQ ID NO: 250283 - DNA, 20 bp, Artificial Sequence
  Description of Artificial Sequence: Synthetic oligonucleotide
  Target: ATXN1; (+) strand; PAM type: YTN; PAM sequence: CTT
ccctcacggttatggcccaa

SEQ ID NO: 250284 - DNA, 20 bp, Artificial Sequence
  Description of Artificial Sequence: Synthetic oligonucleotide
  Target: ATXN1; (+) strand; PAM type: YTN; PAM sequence: TTC
cctcacggttatggcccaaa

SEQ ID NO: 250285 - DNA, 20 bp, Artificial Sequence
  Description of Artificial Sequence: Synthetic oligonucleotide
  Target: ATXN1; (+) strand; PAM type: YTN; PAM sequence: CTC
acggttatggcccaaaaagc

SEQ ID NO: 250286 - DNA, 20 bp, Artificial Sequence
  Description of Artificial Sequence: Synthetic oligonucleotide
  Target: ATXN1; (+) strand; PAM type: YTN; PAM sequence: TTA
tggcccaaaaagctagaaag

SEQ ID NO: 250287 - DNA, 20 bp, Artificial Sequence
  Description of Artificial Sequence: Synthetic oligonucleotide
  Target: ATXN1; (+) strand; PAM type: YTN; PAM sequence: CTA
gaaaggacaatgggcatcct

SEQ ID NO: 250288 - DNA, 20 bp, Artificial Sequence
  Description of Artificial Sequence: Synthetic oligonucleotide
  Target: ATXN1; (+) strand; PAM type: YTN; PAM sequence: CTT
tcagataaagaaatacgcta

SEQ ID NO: 250289 - DNA, 20 bp, Artificial Sequence
  Description of Artificial Sequence: Synthetic oligonucleotide
  Target: ATXN1; (+) strand; PAM type: YTN; PAM sequence: TTT
cagataaagaaatacgctac

SEQ ID NO: 250290 - DNA, 20 bp, Artificial Sequence
  Description of Artificial Sequence: Synthetic oligonucleotide
  Target: ATXN1; (+) strand; PAM type: YTN; PAM sequence: TTC
agataaagaaatacgctaca

SEQ ID NO: 250291 - DNA, 20 bp, Artificial Sequence
  Description of Artificial Sequence: Synthetic oligonucleotide
  Target: ATXN1; (+) strand; PAM type: YTN; PAM sequence: CTA
cagaaatgagcagcagaatc

SEQ ID NO: 250292 - DNA, 20 bp, Artificial Sequence
  Description of Artificial Sequence: Synthetic oligonucleotide
  Target: ATXN1; (+) strand; PAM type: YTN; PAM sequence: CTG
aactctgcaataaattttta

SEQ ID NO: 250293 - DNA, 20 bp, Artificial Sequence
  Description of Artificial Sequence: Synthetic oligonucleotide
  Target: ATXN1; (+) strand; PAM type: YTN; PAM sequence: CTC
tgcaataaatttttactcat

SEQ ID NO: 250294 - DNA, 20 bp, Artificial Sequence
  Description of Artificial Sequence: Synthetic oligonucleotide
  Target: ATXN1; (+) strand; PAM type: YTN; PAM sequence: CTG
caataaatttttactcatgc

SEQ ID NO: 250295 - DNA, 20 bp, Artificial Sequence
  Description of Artificial Sequence: Synthetic oligonucleotide
  Target: ATXN1; (+) strand; PAM type: YTN; PAM sequence: TTT
ttactcatgcggtaaatgcc

SEQ ID NO: 250296 - DNA, 20 bp, Artificial Sequence
  Description of Artificial Sequence: Synthetic oligonucleotide
  Target: ATXN1; (+) strand; PAM type: YTN; PAM sequence: TTT
tactcatgcggtaaatgccc

SEQ ID NO: 250297 - DNA, 20 bp, Artificial Sequence
  Description of Artificial Sequence: Synthetic oligonucleotide
  Target: ATXN1; (+) strand; PAM type: YTN; PAM sequence: TTT
actcatgcggtaaatgccca

SEQ ID NO: 250298 - DNA, 20 bp, Artificial Sequence
  Description of Artificial Sequence: Synthetic oligonucleotide
  Target: ATXN1; (+) strand; PAM type: YTN; PAM sequence: TTA
ctcatgcggtaaatgcccat

SEQ ID NO: 250299 - DNA, 20 bp, Artificial Sequence
  Description of Artificial Sequence: Synthetic oligonucleotide
  Target: ATXN1; (+) strand; PAM type: YTN; PAM sequence: CTC
atgcggtaaatgcccatgga

SEQ ID NO: 250300 - DNA, 20 bp, Artificial Sequence
  Description of Artificial Sequence: Synthetic oligonucleotide
  Target: ATXN1; (+) strand; PAM type: YTN; PAM sequence: TTA
acctctagcatttgcacgca

SEQ ID NO: 250301 - DNA, 20 bp, Artificial Sequence
  Description of Artificial Sequence: Synthetic oligonucleotide
  Target: ATXN1; (+) strand; PAM type: YTN; PAM sequence: CTC
tagcatttgcacgcagccac

SEQ ID NO: 250302 - DNA, 20 bp, Artificial Sequence
  Description of Artificial Sequence: Synthetic oligonucleotide
  Target: ATXN1; (+) strand; PAM type: YTN; PAM sequence: CTA
gcatttgcacgcagccaccc

SEQ ID NO: 250303 - DNA, 20 bp, Artificial Sequence
  Description of Artificial Sequence: Synthetic oligonucleotide
  Target: ATXN1; (+) strand; PAM type: YTN; PAM sequence: TTT
gcacgcagccacccgttcgc

SEQ ID NO: 250304 - DNA, 20 bp, Artificial Sequence
  Description of Artificial Sequence: Synthetic oligonucleotide
  Target: ATXN1; (+) strand; PAM type: YTN; PAM sequence: TTG
cacgcagccacccgttcgct

SEQ ID NO: 250305 - DNA, 20 bp, Artificial Sequence
  Description of Artificial Sequence: Synthetic oligonucleotide
  Target: ATXN1; (+) strand; PAM type: YTN; PAM sequence: TTC
gctcttggctcctggtaagc

SEQ ID NO: 250306 - DNA, 20 bp, Artificial Sequence
  Description of Artificial Sequence: Synthetic oligonucleotide
  Target: ATXN1; (+) strand; PAM type: YTN; PAM sequence: CTC
ttggctcctggtaagcactt

SEQ ID NO: 250307 - DNA, 20 bp, Artificial Sequence
  Description of Artificial Sequence: Synthetic oligonucleotide
  Target: ATXN1; (+) strand; PAM type: YTN; PAM sequence: CTT
ggctcctggtaagcacttac

SEQ ID NO: 250308 - DNA, 20 bp, Artificial Sequence
  Description of Artificial Sequence: Synthetic oligonucleotide
  Target: ATXN1; (+) strand; PAM type: YTN; PAM sequence: TTG
gctcctggtaagcacttaca

SEQ ID NO: 250309 - DNA, 20 bp, Artificial Sequence
  Description of Artificial Sequence: Synthetic oligonucleotide
  Target: ATXN1; (+) strand; PAM type: YTN; PAM sequence: CTC
ctggtaagcacttacaggca

SEQ ID NO: 250310 - DNA, 20 bp, Artificial Sequence
  Description of Artificial Sequence: Synthetic oligonucleotide
  Target: ATXN1; (+) strand; PAM type: YTN; PAM sequence: CTG
gtaagcacttacaggcattt

SEQ ID NO: 250311 - DNA, 20 bp, Artificial Sequence
  Description of Artificial Sequence: Synthetic oligonucleotide
  Target: ATXN1; (+) strand; PAM type: YTN; PAM sequence: CTT
acaggcatttaaagatgtgc

SEQ ID NO: 250312 - DNA, 20 bp, Artificial Sequence
  Description of Artificial Sequence: Synthetic oligonucleotide
  Target: ATXN1; (+) strand; PAM type: YTN; PAM sequence: TTA
caggcatttaaagatgtgca

SEQ ID NO: 250313 - DNA, 20 bp, Artificial Sequence
  Description of Artificial Sequence: Synthetic oligonucleotide
  Target: ATXN1; (+) strand; PAM type: YTN; PAM sequence: TTT
aaagatgtgcaaagggtata

SEQ ID NO: 250314 - DNA, 20 bp, Artificial Sequence
  Description of Artificial Sequence: Synthetic oligonucleotide
  Target: ATXN1; (+) strand; PAM type: YTN; PAM sequence: TTA
aagatgtgcaaagggtataa

SEQ ID NO: 250315 - DNA, 20 bp, Artificial Sequence
  Description of Artificial Sequence: Synthetic oligonucleotide
  Target: ATXN1; (+) strand; PAM type: YTN; PAM sequence: CTT
caatgctctctgcccctcat

SEQ ID NO: 250316 - DNA, 20 bp, Artificial Sequence
  Description of Artificial Sequence: Synthetic oligonucleotide
  Target: ATXN1; (+) strand; PAM type: YTN; PAM sequence: TTC
aatgctctctgcccctcata

SEQ ID NO: 250317 - DNA, 20 bp, Artificial Sequence
  Description of Artificial Sequence: Synthetic oligonucleotide
  Target: ATXN1; (+) strand; PAM type: YTN; PAM sequence: CTC
tctgcccctcataagcatct

SEQ ID NO: 250318 - DNA, 20 bp, Artificial Sequence
  Description of Artificial Sequence: Synthetic oligonucleotide
  Target: ATXN1; (+) strand; PAM type: YTN; PAM sequence: CTC
tgcccctcataagcatctct

SEQ ID NO: 250319 - DNA, 20 bp, Artificial Sequence
  Description of Artificial Sequence: Synthetic oligonucleotide
  Target: ATXN1; (+) strand; PAM type: YTN; PAM sequence: CTG
cccctcataagcatctctga

SEQ ID NO: 250320 - DNA, 20 bp, Artificial Sequence
  Description of Artificial Sequence: Synthetic oligonucleotide
  Target: ATXN1; (+) strand; PAM type: YTN; PAM sequence: CTC
ataagcatctctgataatat

SEQ ID NO: 250321 - DNA, 20 bp, Artificial Sequence
  Description of Artificial Sequence: Synthetic oligonucleotide
  Target: ATXN1; (+) strand; PAM type: YTN; PAM sequence: CTC
tgataatatccaacatctac

SEQ ID NO: 250322 - DNA, 20 bp, Artificial Sequence
  Description of Artificial Sequence: Synthetic oligonucleotide
  Target: ATXN1; (+) strand; PAM type: YTN; PAM sequence: CTG
ataatatccaacatctactt

SEQ ID NO: 250323 - DNA, 20 bp, Artificial Sequence
  Description of Artificial Sequence: Synthetic oligonucleotide
  Target: ATXN1; (+) strand; PAM type: YTN; PAM sequence: CTA
cttaaatgctagcttacctt

SEQ ID NO: 250324 - DNA, 20 bp, Artificial Sequence
  Description of Artificial Sequence: Synthetic oligonucleotide
  Target: ATXN1; (+) strand; PAM type: YTN; PAM sequence: CTT
aaatgctagcttaccttaaa

SEQ ID NO: 250325 - DNA, 20 bp, Artificial Sequence
  Description of Artificial Sequence: Synthetic oligonucleotide
  Target: ATXN1; (+) strand; PAM type: YTN; PAM sequence: TTA
aatgctagcttaccttaaag

SEQ ID NO: 250326 - DNA, 20 bp, Artificial Sequence
  Description of Artificial Sequence: Synthetic oligonucleotide
  Target: ATXN1; (+) strand; PAM type: YTN; PAM sequence: CTA
gcttaccttaaagataaact

SEQ ID NO: 250327 - DNA, 20 bp, Artificial Sequence
  Description of Artificial Sequence: Synthetic oligonucleotide
  Target: ATXN1; (+) strand; PAM type: YTN; PAM sequence: CTT
accttaaagataaactctcc

SEQ ID NO: 250328 - DNA, 20 bp, Artificial Sequence
  Description of Artificial Sequence: Synthetic oligonucleotide
  Target: ATXN1; (+) strand; PAM type: YTN; PAM sequence: TTA
ccttaaagataaactctcct

SEQ ID NO: 250329 - DNA, 20 bp, Artificial Sequence
  Description of Artificial Sequence: Synthetic oligonucleotide
  Target: ATXN1; (+) strand; PAM type: YTN; PAM sequence: CTT
aaagataaactctccttctt

SEQ ID NO: 250330 - DNA, 20 bp, Artificial Sequence
  Description of Artificial Sequence: Synthetic oligonucleotide
  Target: ATXN1; (+) strand; PAM type: YTN; PAM sequence: TTA
aagataaactctccttcttt

SEQ ID NO: 250331 - DNA, 20 bp, Artificial Sequence
  Description of Artificial Sequence: Synthetic oligonucleotide
  Target: ATXN1; (+) strand; PAM type: YTN; PAM sequence: CTC
tccttctttatttcattcca

SEQ ID NO: 250332 - DNA, 20 bp, Artificial Sequence
  Description of Artificial Sequence: Synthetic oligonucleotide
  Target: ATXN1; (+) strand; PAM type: YTN; PAM sequence: CTC
cttctttatttcattccacc

SEQ ID NO: 250333 - DNA, 20 bp, Artificial Sequence
  Description of Artificial Sequence: Synthetic oligonucleotide
  Target: ATXN1; (+) strand; PAM type: YTN; PAM sequence: CTT
ctttatttcattccaccagg

SEQ ID NO: 250334 - DNA, 20 bp, Artificial Sequence
  Description of Artificial Sequence: Synthetic oligonucleotide
  Target: ATXN1; (+) strand; PAM type: YTN; PAM sequence: TTC
tttatttcattccaccagga

SEQ ID NO: 250335 - DNA, 20 bp, Artificial Sequence
  Description of Artificial Sequence: Synthetic oligonucleotide
  Target: ATXN1; (+) strand; PAM type: YTN; PAM sequence: CTT
tatttcattccaccaggact

SEQ ID NO: 250336 - DNA, 20 bp, Artificial Sequence
  Description of Artificial Sequence: Synthetic oligonucleotide
  Target: ATXN1; (+) strand; PAM type: YTN; PAM sequence: TTT
atttcattccaccaggactg

SEQ ID NO: 250337 - DNA, 20 bp, Artificial Sequence
  Description of Artificial Sequence: Synthetic oligonucleotide
  Target: ATXN1; (+) strand; PAM type: YTN; PAM sequence: TTA
tttcattccaccaggactga

SEQ ID NO: 250338 - DNA, 20 bp, Artificial Sequence
  Description of Artificial Sequence: Synthetic oligonucleotide
  Target: ATXN1; (+) strand; PAM type: YTN; PAM sequence: TTT
cattccaccaggactgaacc

SEQ ID NO: 250339 - DNA, 20 bp, Artificial Sequence
  Description of Artificial Sequence: Synthetic oligonucleotide
  Target: ATXN1; (+) strand; PAM type: YTN; PAM sequence: TTC
attccaccaggactgaaccc

SEQ ID NO: 250340 - DNA, 20 bp, Artificial Sequence
  Description of Artificial Sequence: Synthetic oligonucleotide
  Target: ATXN1; (+) strand; PAM type: YTN; PAM sequence: TTC
caccaggactgaaccctgac

SEQ ID NO: 250341 - DNA, 20 bp, Artificial Sequence
  Description of Artificial Sequence: Synthetic oligonucleotide
  Target: ATXN1; (+) strand; PAM type: YTN; PAM sequence: CTG
aaccctgacttgggactatt

SEQ ID NO: 250342 - DNA, 20 bp, Artificial Sequence
  Description of Artificial Sequence: Synthetic oligonucleotide
  Target: ATXN1; (+) strand; PAM type: YTN; PAM sequence: CTG
acttgggactatttgccttg

SEQ ID NO: 250343 - DNA, 20 bp, Artificial Sequence
  Description of Artificial Sequence: Synthetic oligonucleotide
  Target: ATXN1; (+) strand; PAM type: YTN; PAM sequence: CTT
gggactatttgccttgaaaa

SEQ ID NO: 250344 - DNA, 20 bp, Artificial Sequence
  Description of Artificial Sequence: Synthetic oligonucleotide
  Target: ATXN1; (+) strand; PAM type: YTN; PAM sequence: TTG
ggactatttgccttgaaaaa

SEQ ID NO: 250345 - DNA, 20 bp, Artificial Sequence
  Description of Artificial Sequence: Synthetic oligonucleotide
  Target: ATXN1; (+) strand; PAM type: YTN; PAM sequence: CTA
tttgccttgaaaaatgagtt

SEQ ID NO: 250346 - DNA, 20 bp, Artificial Sequence
  Description of Artificial Sequence: Synthetic oligonucleotide
  Target: ATXN1; (+) strand; PAM type: YTN; PAM sequence: TTT
gccttgaaaaatgagttttc

SEQ ID NO: 250347 - DNA, 20 bp, Artificial Sequence
  Description of Artificial Sequence: Synthetic oligonucleotide
  Target: ATXN1; (+) strand; PAM type: YTN; PAM sequence: TTG
ccttgaaaaatgagttttct

SEQ ID NO: 250348 - DNA, 20 bp, Artificial Sequence
  Description of Artificial Sequence: Synthetic oligonucleotide
  Target: ATXN1; (+) strand; PAM type: YTN; PAM sequence: CTT
gaaaaatgagttttctccag

SEQ ID NO: 250349 - DNA, 20 bp, Artificial Sequence
  Description of Artificial Sequence: Synthetic oligonucleotide
  Target: ATXN1; (+) strand; PAM type: YTN; PAM sequence: TTG
aaaaatgagttttctccagc

SEQ ID NO: 250350 - DNA, 20 bp, Artificial Sequence
  Description of Artificial Sequence: Synthetic oligonucleotide
  Target: ATXN1; (+) strand; PAM type: YTN; PAM sequence: TTT
tctccagctctgcagaggat

SEQ ID NO: 250351 - DNA, 20 bp, Artificial Sequence
  Description of Artificial Sequence: Synthetic oligonucleotide
  Target: ATXN1; (+) strand; PAM type: YTN; PAM sequence: TTT
ctccagctctgcagaggatg

SEQ ID NO: 250352 - DNA, 20 bp, Artificial Sequence
  Description of Artificial Sequence: Synthetic oligonucleotide
  Target: ATXN1; (+) strand; PAM type: YTN; PAM sequence: TTC
tccagctctgcagaggatgg

SEQ ID NO: 250353 - DNA, 20 bp, Artificial Sequence
  Description of Artificial Sequence: Synthetic oligonucleotide
  Target: ATXN1; (+) strand; PAM type: YTN; PAM sequence: CTC
cagctctgcagaggatggct

SEQ ID NO: 250354 - DNA, 20 bp, Artificial Sequence
  Description of Artificial Sequence: Synthetic oligonucleotide
  Target: ATXN1; (+) strand; PAM type: YTN; PAM sequence: CTC
tgcagaggatggctgctgtg

SEQ ID NO: 250355 - DNA, 20 bp, Artificial Sequence
  Description of Artificial Sequence: Synthetic oligonucleotide
  Target: ATXN1; (+) strand; PAM type: YTN; PAM sequence: CTG
cagaggatggctgctgtgta

SEQ ID NO: 250356 - DNA, 20 bp, Artificial Sequence
  Description of Artificial Sequence: Synthetic oligonucleotide
  Target: ATXN1; (+) strand; PAM type: YTN; PAM sequence: CTG
ctgtgtataatggtctctga

SEQ ID NO: 250357 - DNA, 20 bp, Artificial Sequence
  Description of Artificial Sequence: Synthetic oligonucleotide
  Target: ATXN1; (+) strand; PAM type: YTN; PAM sequence: CTG
tgtataatggtctctgaaat

SEQ ID NO: 250358 - DNA, 20 bp, Artificial Sequence
  Description of Artificial Sequence: Synthetic oligonucleotide
  Target: ATXN1; (+) strand; PAM type: YTN; PAM sequence: CTC
tgaaatgctaacggaagcca

SEQ ID NO: 250359 - DNA, 20 bp, Artificial Sequence
  Description of Artificial Sequence: Synthetic oligonucleotide
  Target: ATXN1; (+) strand; PAM type: YTN; PAM sequence: CTG
aaatgctaacggaagccaag

SEQ ID NO: 250360 - DNA, 20 bp, Artificial Sequence
  Description of Artificial Sequence: Synthetic oligonucleotide
  Target: ATXN1; (+) strand; PAM type: YTN; PAM sequence: CTA
acggaagccaagaaatcacc

SEQ ID NO: 250361 - DNA, 20 bp, Artificial Sequence
  Description of Artificial Sequence: Synthetic oligonucleotide
  Target: ATXN1; (+) strand; PAM type: YTN; PAM sequence: CTG
acatgaactatgaagctatt

SEQ ID NO: 250362 - DNA, 20 bp, Artificial Sequence
  Description of Artificial Sequence: Synthetic oligonucleotide
  Target: ATXN1; (+) strand; PAM type: YTN; PAM sequence: CTA
tgaagctattagttatgaaa

SEQ ID NO: 250363 - DNA, 20 bp, Artificial Sequence
  Description of Artificial Sequence: Synthetic oligonucleotide
  Target: ATXN1; (+) strand; PAM type: YTN; PAM sequence: CTA
ttagttatgaaaagcaatat

SEQ ID NO: 250364 - DNA, 20 bp, Artificial Sequence
  Description of Artificial Sequence: Synthetic oligonucleotide
  Target: ATXN1; (+) strand; PAM type: YTN; PAM sequence: TTA
gttatgaaaagcaatatcga

SEQ ID NO: 250365 - DNA, 20 bp, Artificial Sequence
  Description of Artificial Sequence: Synthetic oligonucleotide
  Target: ATXN1; (+) strand; PAM type: YTN; PAM sequence: TTA
tgaaaagcaatatcgatatt

SEQ ID NO: 250366 - DNA, 20 bp, Artificial Sequence
  Description of Artificial Sequence: Synthetic oligonucleotide
  Target: ATXN1; (+) strand; PAM type: YTN; PAM sequence: TTT
accttctaactcttcatgct

SEQ ID NO: 250367 - DNA, 20 bp, Artificial Sequence
  Description of Artificial Sequence: Synthetic oligonucleotide
  Target: ATXN1; (+) strand; PAM type: YTN; PAM sequence: TTA
ccttctaactcttcatgctg

SEQ ID NO: 250368 - DNA, 20 bp, Artificial Sequence
  Description of Artificial Sequence: Synthetic oligonucleotide
  Target: ATXN1; (+) strand; PAM type: YTN; PAM sequence: CTT
ctaactcttcatgctggagg

SEQ ID NO: 250369 - DNA, 20 bp, Artificial Sequence
  Description of Artificial Sequence: Synthetic oligonucleotide
  Target: ATXN1; (+) strand; PAM type: YTN; PAM sequence: TTC
taactcttcatgctggaggg

SEQ ID NO: 250370 - DNA, 20 bp, Artificial Sequence
  Description of Artificial Sequence: Synthetic oligonucleotide
  Target: ATXN1; (+) strand; PAM type: YTN; PAM sequence: CTA
actcttcatgctggagggta

SEQ ID NO: 250371 - DNA, 20 bp, Artificial Sequence
  Description of Artificial Sequence: Synthetic oligonucleotide
  Target: ATXN1; (+) strand; PAM type: YTN; PAM sequence: CTC
ttcatgctggagggtaaagc

SEQ ID NO: 250372 - DNA, 20 bp, Artificial Sequence
  Description of Artificial Sequence: Synthetic oligonucleotide
  Target: ATXN1; (+) strand; PAM type: YTN; PAM sequence: CTT
catgctggagggtaaagcag

SEQ ID NO: 250373 - DNA, 20 bp, Artificial Sequence
  Description of Artificial Sequence: Synthetic oligonucleotide
  Target: ATXN1; (+) strand; PAM type: YTN; PAM sequence: TTC
atgctggagggtaaagcagc

SEQ ID NO: 250374 - DNA, 20 bp, Artificial Sequence
  Description of Artificial Sequence: Synthetic oligonucleotide
  Target: ATXN1; (+) strand; PAM type: YTN; PAM sequence: CTG
gagggtaaagcagcacaacc

SEQ ID NO: 250375 - DNA, 20 bp, Artificial Sequence
  Description of Artificial Sequence: Synthetic oligonucleotide
  Target: ATXN1; (+) strand; PAM type: YTN; PAM sequence: CTG
gacgtgcctggtgccgagcc

SEQ ID NO: 250376 - DNA, 20 bp, Artificial Sequence
  Description of Artificial Sequence: Synthetic oligonucleotide
  Target: ATXN1; (+) strand; PAM type: YTN; PAM sequence: CTG
gtgccgagccaacataaaga

SEQ ID NO: 250377 - DNA, 20 bp, Artificial Sequence
  Description of Artificial Sequence: Synthetic oligonucleotide
  Target: ATXN1; (+) strand; PAM type: YTN; PAM sequence: CTG
catcttccctcctctaccat

SEQ ID NO: 250378 - DNA, 20 bp, Artificial Sequence
  Description of Artificial Sequence: Synthetic oligonucleotide
  Target: ATXN1; (+) strand; PAM type: YTN; PAM sequence: CTT
ccctcctctaccatttttga

SEQ ID NO: 250379 - DNA, 20 bp, Artificial Sequence
  Description of Artificial Sequence: Synthetic oligonucleotide
  Target: ATXN1; (+) strand; PAM type: YTN; PAM sequence: TTC
cctcctctaccatttttgaa

SEQ ID NO: 250380 - DNA, 20 bp, Artificial Sequence
  Description of Artificial Sequence: Synthetic oligonucleotide
  Target: ATXN1; (+) strand; PAM type: YTN; PAM sequence: CTC
ctctaccatttttgaaatgg

SEQ ID NO: 250381 - DNA, 20 bp, Artificial Sequence
  Description of Artificial Sequence: Synthetic oligonucleotide
  Target: ATXN1; (+) strand; PAM type: YTN; PAM sequence: CTC
taccatttttgaaatggaaa

SEQ ID NO: 250382 - DNA, 20 bp, Artificial Sequence
  Description of Artificial Sequence: Synthetic oligonucleotide
  Target: ATXN1; (+) strand; PAM type: YTN; PAM sequence: CTA
ccatttttgaaatggaaata

SEQ ID NO: 250383 - DNA, 20 bp, Artificial Sequence
  Description of Artificial Sequence: Synthetic oligonucleotide
  Target: ATXN1; (+) strand; PAM type: YTN; PAM sequence: TTT
ttgaaatggaaataatgctt

SEQ ID NO: 250384 - DNA, 20 bp, Artificial Sequence
  Description of Artificial Sequence: Synthetic oligonucleotide
  Target: ATXN1; (+) strand; PAM type: YTN; PAM sequence: TTT
tgaaatggaaataatgctta

SEQ ID NO: 250385 - DNA, 20 bp, Artificial Sequence
  Description of Artificial Sequence: Synthetic oligonucleotide
  Target: ATXN1; (+) strand; PAM type: YTN; PAM sequence: TTT
gaaatggaaataatgcttat

SEQ ID NO: 250386 - DNA, 20 bp, Artificial Sequence
  Description of Artificial Sequence: Synthetic oligonucleotide
  Target: ATXN1; (+) strand; PAM type: YTN; PAM sequence: TTG
aaatggaaataatgcttatg

SEQ ID NO: 250387 - DNA, 20 bp, Artificial Sequence
  Description of Artificial Sequence: Synthetic oligonucleotide
  Target: ATXN1; (+) strand; PAM type: YTN; PAM sequence: CTT
atggtggtaataatgtggtg

SEQ ID NO: 250388 - DNA, 20 bp, Artificial Sequence
  Description of Artificial Sequence: Synthetic oligonucleotide
  Target: ATXN1; (+) strand; PAM type: YTN; PAM sequence: TTA
tggtggtaataatgtggtga

SEQ ID NO: 250389 - DNA, 20 bp, Artificial Sequence
  Description of Artificial Sequence: Synthetic oligonucleotide
  Target: ATXN1; (+) strand; PAM type: YTN; PAM sequence: CTG
tcgttcaaagccccttcaca

SEQ ID NO: 250390 - DNA, 20 bp, Artificial Sequence
  Description of Artificial Sequence: Synthetic oligonucleotide
  Target: ATXN1; (+) strand; PAM type: YTN; PAM sequence: TTC
aaagccccttcacacacatt

SEQ ID NO: 250391 - DNA, 20 bp, Artificial Sequence
  Description of Artificial Sequence: Synthetic oligonucleotide
  Target: ATXN1; (+) strand; PAM type: YTN; PAM sequence: CTT
cacacacattatgatctgat

SEQ ID NO: 250392 - DNA, 20 bp, Artificial Sequence
  Description of Artificial Sequence: Synthetic oligonucleotide
  Target: ATXN1; (+) strand; PAM type: YTN; PAM sequence: TTC
acacacattatgatctgatc

SEQ ID NO: 250393 - DNA, 20 bp, Artificial Sequence
  Description of Artificial Sequence: Synthetic oligonucleotide
  Target: ATXN1; (+) strand; PAM type: YTN; PAM sequence: TTA
tgatctgatctgctcctccc

SEQ ID NO: 250394 - DNA, 20 bp, Artificial Sequence
  Description of Artificial Sequence: Synthetic oligonucleotide
  Target: ATXN1; (+) strand; PAM type: YTN; PAM sequence: CTG
atctgctcctcccaggaatc

SEQ ID NO: 250395 - DNA, 20 bp, Artificial Sequence
  Description of Artificial Sequence: Synthetic oligonucleotide
  Target: ATXN1; (+) strand; PAM type: YTN; PAM sequence: CTG
ctcctcccaggaatcctgca

SEQ ID NO: 250396 - DNA, 20 bp, Artificial Sequence
  Description of Artificial Sequence: Synthetic oligonucleotide
  Target: ATXN1; (+) strand; PAM type: YTN; PAM sequence: CTC
ctcccaggaatcctgcatga

SEQ ID NO: 250397 - DNA, 20 bp, Artificial Sequence
  Description of Artificial Sequence: Synthetic oligonucleotide
  Target: ATXN1; (+) strand; PAM type: YTN; PAM sequence: CTC
ccaggaatcctgcatgaggt

SEQ ID NO: 250398 - DNA, 20 bp, Artificial Sequence
  Description of Artificial Sequence: Synthetic oligonucleotide
  Target: ATXN1; (+) strand; PAM type: YTN; PAM sequence: CTG
catgaggtggatatcatgaa

SEQ ID NO: 250399 - DNA, 20 bp, Artificial Sequence
  Description of Artificial Sequence: Synthetic oligonucleotide
  Target: ATXN1; (+) strand; PAM type: YTN; PAM sequence: TTA
taatgtccagaagcaggaac

SEQ ID NO: 250400 - DNA, 20 bp, Artificial Sequence
  Description of Artificial Sequence: Synthetic oligonucleotide
  Target: ATXN1; (+) strand; PAM type: YTN; PAM sequence: CTG
atgtagaaagttaagtgatg

SEQ ID NO: 250401 - DNA, 20 bp, Artificial Sequence
  Description of Artificial Sequence: Synthetic oligonucleotide
  Target: ATXN1; (+) strand; PAM type: YTN; PAM sequence: TTA
agtgatgttctccaggcgac

SEQ ID NO: 250402 - DNA, 20 bp, Artificial Sequence
  Description of Artificial Sequence: Synthetic oligonucleotide
  Target: ATXN1; (+) strand; PAM type: YTN; PAM sequence: TTC
tccaggcgaccccgacagag

SEQ ID NO: 250403 - DNA, 20 bp, Artificial Sequence
  Description of Artificial Sequence: Synthetic oligonucleotide
  Target: ATXN1; (+) strand; PAM type: YTN; PAM sequence: CTC
caggcgaccccgacagagcc

SEQ ID NO: 250404 - DNA, 20 bp, Artificial Sequence
  Description of Artificial Sequence: Synthetic oligonucleotide
  Target: ATXN1; (+) strand; PAM type: YTN; PAM sequence: CTG
gcagggctgctgctttgacc

SEQ ID NO: 250405 - DNA, 20 bp, Artificial Sequence
  Description of Artificial Sequence: Synthetic oligonucleotide
  Target: ATXN1; (+) strand; PAM type: YTN; PAM sequence: CTG
ctgctttgaccctggagttg

SEQ ID NO: 250406 - DNA, 20 bp, Artificial Sequence
  Description of Artificial Sequence: Synthetic oligonucleotide
  Target: ATXN1; (+) strand; PAM type: YTN; PAM sequence: CTG
ctttgaccctggagttgaga

SEQ ID NO: 250407 - DNA, 20 bp, Artificial Sequence
  Description of Artificial Sequence: Synthetic oligonucleotide
  Target: ATXN1; (+) strand; PAM type: YTN; PAM sequence: CTT
tgaccctggagttgagagga

SEQ ID NO: 250408 - DNA, 20 bp, Artificial Sequence
  Description of Artificial Sequence: Synthetic oligonucleotide
  Target: ATXN1; (+) strand; PAM type: YTN; PAM sequence: TTT
gaccctggagttgagaggaa

SEQ ID NO: 250409 - DNA, 20 bp, Artificial Sequence
  Description of Artificial Sequence: Synthetic oligonucleotide
  Target: ATXN1; (+) strand; PAM type: YTN; PAM sequence: TTG
accctggagttgagaggaat

SEQ ID NO: 250410 - DNA, 20 bp, Artificial Sequence
  Description of Artificial Sequence: Synthetic oligonucleotide
  Target: ATXN1; (+) strand; PAM type: YTN; PAM sequence: CTG
gagttgagaggaattgttct

SEQ ID NO: 250411 - DNA, 20 bp, Artificial Sequence
  Description of Artificial Sequence: Synthetic oligonucleotide
  Target: ATXN1; (+) strand; PAM type: YTN; PAM sequence: TTG
agaggaattgttctttccac

SEQ ID NO: 250412 - DNA, 20 bp, Artificial Sequence
  Description of Artificial Sequence: Synthetic oligonucleotide
  Target: ATXN1; (+) strand; PAM type: YTN; PAM sequence: TTG
ttctttccacatcaaccccc

SEQ ID NO: 250413 - DNA, 20 bp, Artificial Sequence
  Description of Artificial Sequence: Synthetic oligonucleotide
  Target: ATXN1; (+) strand; PAM type: YTN; PAM sequence: TTC
tttccacatcaacccccgcc

SEQ ID NO: 250414 - DNA, 20 bp, Artificial Sequence
  Description of Artificial Sequence: Synthetic oligonucleotide
  Target: ATXN1; (+) strand; PAM type: YTN; PAM sequence: CTT
tccacatcaacccccgccgg

SEQ ID NO: 250415 - DNA, 20 bp, Artificial Sequence
  Description of Artificial Sequence: Synthetic oligonucleotide
  Target: ATXN1; (+) strand; PAM type: YTN; PAM sequence: TTT
ccacatcaacccccgccgga

SEQ ID NO: 250416 - DNA, 20 bp, Artificial Sequence
  Description of Artificial Sequence: Synthetic oligonucleotide
  Target: ATXN1; (+) strand; PAM type: YTN; PAM sequence: TTC
cacatcaacccccgccggac

SEQ ID NO: 250417 - DNA, 20 bp, Artificial Sequence
  Description of Artificial Sequence: Synthetic oligonucleotide
  Target: ATXN1; (+) strand; PAM type: YTN; PAM sequence: TTT
caaaaatgcaactgtttttc

SEQ ID NO: 250418 - DNA, 20 bp, Artificial Sequence
  Description of Artificial Sequence: Synthetic oligonucleotide
  Target: ATXN1; (+) strand; PAM type: YTN; PAM sequence: TTC
aaaaatgcaactgtttttca

SEQ ID NO: 250419 - DNA, 20 bp, Artificial Sequence
  Description of Artificial Sequence: Synthetic oligonucleotide
  Target: ATXN1; (+) strand; PAM type: YTN; PAM sequence: CTG
tttttcatttgggtctatct

SEQ ID NO: 250420 - DNA, 20 bp, Artificial Sequence
  Description of Artificial Sequence: Synthetic oligonucleotide
  Target: ATXN1; (+) strand; PAM type: YTN; PAM sequence: TTT
ttcatttgggtctatctttt

SEQ ID NO: 250421 - DNA, 20 bp, Artificial Sequence
  Description of Artificial Sequence: Synthetic oligonucleotide
  Target: ATXN1; (+) strand; PAM type: YTN; PAM sequence: TTT
tcatttgggtctatcttttc

SEQ ID NO: 250422 - DNA, 20 bp, Artificial Sequence
  Description of Artificial Sequence: Synthetic oligonucleotide
  Target: ATXN1; (+) strand; PAM type: YTN; PAM sequence: TTT
catttgggtctatcttttct

SEQ ID NO: 250423 - DNA, 20 bp, Artificial Sequence
  Description of Artificial Sequence: Synthetic oligonucleotide
  Target: ATXN1; (+) strand; PAM type: YTN; PAM sequence: TTC
atttgggtctatcttttctt

SEQ ID NO: 250424 - DNA, 20 bp, Artificial Sequence
  Description of Artificial Sequence: Synthetic oligonucleotide
  Target: ATXN1; (+) strand; PAM type: YTN; PAM sequence: TTT
gggtctatcttttctttgct

SEQ ID NO: 250425 - DNA, 20 bp, Artificial Sequence
  Description of Artificial Sequence: Synthetic oligonucleotide
  Target: ATXN1; (+) strand; PAM type: YTN; PAM sequence: TTG
ggtctatcttttctttgcta

SEQ ID NO: 250426 - DNA, 20 bp, Artificial Sequence
  Description of Artificial Sequence: Synthetic oligonucleotide
  Target: ATXN1; (+) strand; PAM type: YTN; PAM sequence: CTA
tcttttctttgctaatagta

SEQ ID NO: 250427 - DNA, 20 bp, Artificial Sequence
  Description of Artificial Sequence: Synthetic oligonucleotide
  Target: ATXN1; (+) strand; PAM type: YTN; PAM sequence: CTT
ttctttgctaatagtaatca

SEQ ID NO: 250428 - DNA, 20 bp, Artificial Sequence
  Description of Artificial Sequence: Synthetic oligonucleotide
  Target: ATXN1; (+) strand; PAM type: YTN; PAM sequence: TTT
tctttgctaatagtaatcaa

SEQ ID NO: 250429 - DNA, 20 bp, Artificial Sequence
  Description of Artificial Sequence: Synthetic oligonucleotide
  Target: ATXN1; (+) strand; PAM type: YTN; PAM sequence: TTT
ctttgctaatagtaatcaaa

SEQ ID NO: 250430 - DNA, 20 bp, Artificial Sequence
  Description of Artificial Sequence: Synthetic oligonucleotide
  Target: ATXN1; (+) strand; PAM type: YTN; PAM sequence: TTC
tttgctaatagtaatcaaag

SEQ ID NO: 250431 - DNA, 20 bp, Artificial Sequence
  Description of Artificial Sequence: Synthetic oligonucleotide
  Target: ATXN1; (+) strand; PAM type: YTN; PAM sequence: CTT
tgctaatagtaatcaaagat

SEQ ID NO: 250432 - DNA, 20 bp, Artificial Sequence
  Description of Artificial Sequence: Synthetic oligonucleotide
  Target: ATXN1; (+) strand; PAM type: YTN; PAM sequence: TTT
gctaatagtaatcaaagatc

SEQ ID NO: 250433 - DNA, 20 bp, Artificial Sequence
  Description of Artificial Sequence: Synthetic oligonucleotide
  Target: ATXN1; (+) strand; PAM type: YTN; PAM sequence: TTG
ctaatagtaatcaaagatct

SEQ ID NO: 250434 - DNA, 20 bp, Artificial Sequence
  Description of Artificial Sequence: Synthetic oligonucleotide
  Target: ATXN1; (+) strand; PAM type: YTN; PAM sequence: CTA
atagtaatcaaagatctaaa

SEQ ID NO: 250435 - DNA, 20 bp, Artificial Sequence
  Description of Artificial Sequence: Synthetic oligonucleotide
  Target: ATXN1; (+) strand; PAM type: YTN; PAM sequence: CTA
aaagctacagatttatcaaa

SEQ ID NO: 250436 - DNA, 20 bp, Artificial Sequence
  Description of Artificial Sequence: Synthetic oligonucleotide
  Target: ATXN1; (+) strand; PAM type: YTN; PAM sequence: CTA
cagatttatcaaagaactga

SEQ ID NO: 250437 - DNA, 20 bp, Artificial Sequence
  Description of Artificial Sequence: Synthetic oligonucleotide
  Target: ATXN1; (+) strand; PAM type: YTN; PAM sequence: TTT
atcaaagaactgaagctact

SEQ ID NO: 250438 - DNA, 20 bp, Artificial Sequence
  Description of Artificial Sequence: Synthetic oligonucleotide
  Target: ATXN1; (+) strand; PAM type: YTN; PAM sequence: TTA
tcaaagaactgaagctacta

SEQ ID NO: 250439 - DNA, 20 bp, Artificial Sequence
  Description of Artificial Sequence: Synthetic oligonucleotide
  Target: ATXN1; (+) strand; PAM type: YTN; PAM sequence: CTG
aagctactaaaattgtttgc

SEQ ID NO: 250440 - DNA, 20 bp, Artificial Sequence
  Description of Artificial Sequence: Synthetic oligonucleotide
  Target: ATXN1; (+) strand; PAM type: YTN; PAM sequence: CTA
ctaaaattgtttgcagtgtc

SEQ ID NO: 250441 - DNA, 20 bp, Artificial Sequence
  Description of Artificial Sequence: Synthetic oligonucleotide
  Target: ATXN1; (+) strand; PAM type: YTN; PAM sequence: CTA
aaattgtttgcagtgtcgtg

SEQ ID NO: 250442 - DNA, 20 bp, Artificial Sequence
  Description of Artificial Sequence: Synthetic oligonucleotide
  Target: ATXN1; (+) strand; PAM type: YTN; PAM sequence: TTG
tttgcagtgtcgtgaaagaa

SEQ ID NO: 250443 - DNA, 20 bp, Artificial Sequence
  Description of Artificial Sequence: Synthetic oligonucleotide
  Target: ATXN1; (+) strand; PAM type: YTN; PAM sequence: TTT
gcagtgtcgtgaaagaaact

SEQ ID NO: 250444 - DNA, 20 bp, Artificial Sequence
  Description of Artificial Sequence: Synthetic oligonucleotide
  Target: ATXN1; (+) strand; PAM type: YTN; PAM sequence: TTG
cagtgtcgtgaaagaaactg

SEQ ID NO: 250445 - DNA, 20 bp, Artificial Sequence
  Description of Artificial Sequence: Synthetic oligonucleotide
  Target: ATXN1; (+) strand; PAM type: YTN; PAM sequence: CTG
gcaaacacgattttaagaaa

SEQ ID NO: 250446 - DNA, 20 bp, Artificial Sequence
  Description of Artificial Sequence: Synthetic oligonucleotide
  Target: ATXN1; (+) strand; PAM type: YTN; PAM sequence: TTT
taagaaaagaggcaactgtg

SEQ ID NO: 250447 - DNA, 20 bp, Artificial Sequence
  Description of Artificial Sequence: Synthetic oligonucleotide
  Target: ATXN1; (+) strand; PAM type: YTN; PAM sequence: TTT
aagaaaagaggcaactgtga

SEQ ID NO: 250448 - DNA, 20 bp, Artificial Sequence
  Description of Artificial Sequence: Synthetic oligonucleotide
  Target: ATXN1; (+) strand; PAM type: YTN; PAM sequence: TTA
agaaaagaggcaactgtgac

SEQ ID NO: 250449 - DNA, 20 bp, Artificial Sequence
  Description of Artificial Sequence: Synthetic oligonucleotide
  Target: ATXN1; (+) strand; PAM type: YTN; PAM sequence: CTG
tgacagaagaaataaaaact

SEQ ID NO: 250450 - DNA, 20 bp, Artificial Sequence
  Description of Artificial Sequence: Synthetic oligonucleotide
  Target: ATXN1; (+) strand; PAM type: YTN; PAM sequence: CTT
gtgtttaggttatcttcaaa

SEQ ID NO: 250451 - DNA, 20 bp, Artificial Sequence
  Description of Artificial Sequence: Synthetic oligonucleotide
  Target: ATXN1; (+) strand; PAM type: YTN; PAM sequence: TTG
tgtttaggttatcttcaaaa

SEQ ID NO: 250452 - DNA, 20 bp, Artificial Sequence
  Description of Artificial Sequence: Synthetic oligonucleotide
  Target: ATXN1; (+) strand; PAM type: YTN; PAM sequence: TTT
aggttatcttcaaaactaat

SEQ ID NO: 250453 - DNA, 20 bp, Artificial Sequence
  Description of Artificial Sequence: Synthetic oligonucleotide
  Target: ATXN1; (+) strand; PAM type: YTN; PAM sequence: TTA
ggttatcttcaaaactaata

SEQ ID NO: 250454 - DNA, 20 bp, Artificial Sequence
  Description of Artificial Sequence: Synthetic oligonucleotide
  Target: ATXN1; (+) strand; PAM type: YTN; PAM sequence: TTA
tcttcaaaactaatatttct

SEQ ID NO: 250455 - DNA, 20 bp, Artificial Sequence
  Description of Artificial Sequence: Synthetic oligonucleotide
  Target: ATXN1; (+) strand; PAM type: YTN; PAM sequence: CTT
caaaactaatatttctaatg

SEQ ID NO: 250456 - DNA, 20 bp, Artificial Sequence
  Description of Artificial Sequence: Synthetic oligonucleotide
  Target: ATXN1; (+) strand; PAM type: YTN; PAM sequence: TTC
aaaactaatatttctaatgt

SEQ ID NO: 250457 - DNA, 20 bp, Artificial Sequence
  Description of Artificial Sequence: Synthetic oligonucleotide
  Target: ATXN1; (+) strand; PAM type: YTN; PAM sequence: CTA
atatttctaatgtacaatgc

SEQ ID NO: 250458 - DNA, 20 bp, Artificial Sequence
  Description of Artificial Sequence: Synthetic oligonucleotide
  Target: ATXN1; (+) strand; PAM type: YTN; PAM sequence: TTT
ctaatgtacaatgcacaact

SEQ ID NO: 250459 - DNA, 20 bp, Artificial Sequence
  Description of Artificial Sequence: Synthetic oligonucleotide
  Target: ATXN1; (+) strand; PAM type: YTN; PAM sequence: TTC
taatgtacaatgcacaacta

SEQ ID NO: 250460 - DNA, 20 bp, Artificial Sequence
  Description of Artificial Sequence: Synthetic oligonucleotide
  Target: ATXN1; (+) strand; PAM type: YTN; PAM sequence: CTA
atgtacaatgcacaactaag

SEQ ID NO: 250461 - DNA, 20 bp, Artificial Sequence
  Description of Artificial Sequence: Synthetic oligonucleotide
  Target: ATXN1; (+) strand; PAM type: YTN; PAM sequence: CTA
agatagcttttttctgatat

SEQ ID NO: 250462 - DNA, 20 bp, Artificial Sequence
  Description of Artificial Sequence: Synthetic oligonucleotide
  Target: ATXN1; (+) strand; PAM type: YTN; PAM sequence: CTT
ttttctgatataaaaataaa

SEQ ID NO: 250463 - DNA, 20 bp, Artificial Sequence
  Description of Artificial Sequence: Synthetic oligonucleotide
  Target: ATXN1; (+) strand; PAM type: YTN; PAM sequence: TTT
tttctgatataaaaataaag

SEQ ID NO: 250464 - DNA, 20 bp, Artificial Sequence
  Description of Artificial Sequence: Synthetic oligonucleotide
  Target: ATXN1; (+) strand; PAM type: YTN; PAM sequence: TTT
ttctgatataaaaataaagt

SEQ ID NO: 250465 - DNA, 20 bp, Artificial Sequence
  Description of Artificial Sequence: Synthetic oligonucleotide
  Target: ATXN1; (+) strand; PAM type: YTN; PAM sequence: TTT
tctgatataaaaataaagtg

SEQ ID NO: 250466 - DNA, 20 bp, Artificial Sequence
  Description of Artificial Sequence: Synthetic oligonucleotide
  Target: ATXN1; (+) strand; PAM type: YTN; PAM sequence: TTT
ctgatataaaaataaagtgt

SEQ ID NO: 250467 - DNA, 20 bp, Artificial Sequence
  Description of Artificial Sequence: Synthetic oligonucleotide
  Target: ATXN1; (+) strand; PAM type: YTN; PAM sequence: TTC
tgatataaaaataaagtgtg

SEQ ID NO: 250468 - DNA, 20 bp, Artificial Sequence
  Description of Artificial Sequence: Synthetic oligonucleotide
  Target: ATXN1; (+) strand; PAM type: YTN; PAM sequence: CTG
atataaaaataaagtgtgat

SEQ ID NO: 250469 - DNA, 20 bp, Artificial Sequence
  Description of Artificial Sequence: Synthetic oligonucleotide
  Target: ATXN1; (+) strand; PAM type: YTN; PAM sequence: CTT
aaaaaatataaaactgctcc

SEQ ID NO: 250470 - DNA, 20 bp, Artificial Sequence
  Description of Artificial Sequence: Synthetic oligonucleotide
  Target: ATXN1; (+) strand; PAM type: YTN; PAM sequence: TTA
aaaaatataaaactgctcct

SEQ ID NO: 250471 - DNA, 20 bp, Artificial Sequence
  Description of Artificial Sequence: Synthetic oligonucleotide
  Target: ATXN1; (+) strand; PAM type: YTN; PAM sequence: CTG
ctcctaatatctccaacatg

SEQ ID NO: 250472 - DNA, 20 bp, Artificial Sequence
  Description of Artificial Sequence: Synthetic oligonucleotide
  Target: ATXN1; (+) strand; PAM type: YTN; PAM sequence: CTC
ctaatatctccaacatgata

SEQ ID NO: 250473 - DNA, 20 bp, Artificial Sequence
  Description of Artificial Sequence: Synthetic oligonucleotide
  Target: ATXN1; (+) strand; PAM type: YTN; PAM sequence: CTA
atatctccaacatgatatat

SEQ ID NO: 250474 - DNA, 20 bp, Artificial Sequence
  Description of Artificial Sequence: Synthetic oligonucleotide
  Target: ATXN1; (+) strand; PAM type: YTN; PAM sequence: CTC
caacatgatatatccactat

SEQ ID NO: 250475 - DNA, 20 bp, Artificial Sequence
  Description of Artificial Sequence: Synthetic oligonucleotide
  Target: ATXN1; (+) strand; PAM type: YTN; PAM sequence: CTA
tttacattttgattgtattt

SEQ ID NO: 250476 - DNA, 20 bp, Artificial Sequence
  Description of Artificial Sequence: Synthetic oligonucleotide
  Target: ATXN1; (+) strand; PAM type: YTN; PAM sequence: TTT
acattttgattgtattttgg

SEQ ID NO: 250477 - DNA, 20 bp, Artificial Sequence
  Description of Artificial Sequence: Synthetic oligonucleotide
  Target: ATXN1; (+) strand; PAM type: YTN; PAM sequence: TTA
cattttgattgtattttggc

SEQ ID NO: 250478 - DNA, 20 bp, Artificial Sequence
  Description of Artificial Sequence: Synthetic oligonucleotide
  Target: ATXN1; (+) strand; PAM type: YTN; PAM sequence: TTT
tgattgtattttggcatata

SEQ ID NO: 250479 - DNA, 20 bp, Artificial Sequence
  Description of Artificial Sequence: Synthetic oligonucleotide
  Target: ATXN1; (+) strand; PAM type: YTN; PAM sequence: TTT
gattgtattttggcatatat

SEQ ID NO: 250480 - DNA, 20 bp, Artificial Sequence
  Description of Artificial Sequence: Synthetic oligonucleotide
  Target: ATXN1; (+) strand; PAM type: YTN; PAM sequence: TTG
attgtattttggcatatata

SEQ ID NO: 250481 - DNA, 20 bp, Artificial Sequence
  Description of Artificial Sequence: Synthetic oligonucleotide
  Target: ATXN1; (+) strand; PAM type: YTN; PAM sequence: TTG
tattttggcatatatatata

SEQ ID NO: 250482 - DNA, 20 bp, Artificial Sequence
  Description of Artificial Sequence: Synthetic oligonucleotide
  Target: ATXN1; (+) strand; PAM type: YTN; PAM sequence: TTT
tggcatatatatataatttt

SEQ ID NO: 250483 - DNA, 20 bp, Artificial Sequence
  Description of Artificial Sequence: Synthetic oligonucleotide
  Target: ATXN1; (+) strand; PAM type: YTN; PAM sequence: TTT
ggcatatatatataattttc

SEQ ID NO: 250484 - DNA, 20 bp, Artificial Sequence
  Description of Artificial Sequence: Synthetic oligonucleotide
  Target: ATXN1; (+) strand; PAM type: YTN; PAM sequence: TTG
gcatatatatataattttct

SEQ ID NO: 250485 - DNA, 20 bp, Artificial Sequence
  Description of Artificial Sequence: Synthetic oligonucleotide
  Target: ATXN1; (+) strand; PAM type: YTN; PAM sequence: TTT
tcttttttaaagctcacata

SEQ ID NO: 250486 - DNA, 20 bp, Artificial Sequence
  Description of Artificial Sequence: Synthetic oligonucleotide
  Target: ATXN1; (+) strand; PAM type: YTN; PAM sequence: TTT
cttttttaaagctcacatat

SEQ ID NO: 250487 - DNA, 20 bp, Artificial Sequence
  Description of Artificial Sequence: Synthetic oligonucleotide
  Target: ATXN1; (+) strand; PAM type: YTN; PAM sequence: TTC
ttttttaaagctcacatata

SEQ ID NO: 250488 - DNA, 20 bp, Artificial Sequence
  Description of Artificial Sequence: Synthetic oligonucleotide
  Target: ATXN1; (+) strand; PAM type: YTN; PAM sequence: CTT
ttttaaagctcacatatatc

SEQ ID NO: 250489 - DNA, 20 bp, Artificial Sequence
  Description of Artificial Sequence: Synthetic oligonucleotide
  Target: ATXN1; (+) strand; PAM type: YTN; PAM sequence: TTT
tttaaagctcacatatatct

SEQ ID NO: 250490 - DNA, 20 bp, Artificial Sequence
  Description of Artificial Sequence: Synthetic oligonucleotide
  Target: ATXN1; (+) strand; PAM type: YTN; PAM sequence: TTT
ttaaagctcacatatatcta

SEQ ID NO: 250491 - DNA, 20 bp, Artificial Sequence
  Description of Artificial Sequence: Synthetic oligonucleotide
  Target: ATXN1; (+) strand; PAM type: YTN; PAM sequence: TTT
taaagctcacatatatctat

SEQ ID NO: 250492 - DNA, 20 bp, Artificial Sequence
  Description of Artificial Sequence: Synthetic oligonucleotide
  Target: ATXN1; (+) strand; PAM type: YTN; PAM sequence: TTT
aaagctcacatatatctatg

SEQ ID NO: 250493 - DNA, 20 bp, Artificial Sequence
  Description of Artificial Sequence: Synthetic oligonucleotide
  Target: ATXN1; (+) strand; PAM type: YTN; PAM sequence: TTA
aagctcacatatatctatgc

SEQ ID NO: 250494 - DNA, 20 bp, Artificial Sequence
  Description of Artificial Sequence: Synthetic oligonucleotide
  Target: ATXN1; (+) strand; PAM type: YTN; PAM sequence: CTC
acatatatctatgcatgttt

SEQ ID NO: 250495 - DNA, 20 bp, Artificial Sequence
  Description of Artificial Sequence: Synthetic oligonucleotide
  Target: ATXN1; (+) strand; PAM type: YTN; PAM sequence: CTA
tgcatgtttacaaagttaga

SEQ ID NO: 250496 - DNA, 20 bp, Artificial Sequence
  Description of Artificial Sequence: Synthetic oligonucleotide
  Target: ATXN1; (+) strand; PAM type: YTN; PAM sequence: TTT
acaaagttagaataattctg

SEQ ID NO: 250497 - DNA, 20 bp, Artificial Sequence
  Description of Artificial Sequence: Synthetic oligonucleotide
  Target: ATXN1; (+) strand; PAM type: YTN; PAM sequence: TTA
caaagttagaataattctga

SEQ ID NO: 250498 - DNA, 20 bp, Artificial Sequence
  Description of Artificial Sequence: Synthetic oligonucleotide
  Target: ATXN1; (+) strand; PAM type: YTN; PAM sequence: TTA
gaataattctgaatatataa

SEQ ID NO: 250499 - DNA, 20 bp, Artificial Sequence
  Description of Artificial Sequence: Synthetic oligonucleotide
  Target: ATXN1; (+) strand; PAM type: YTN; PAM sequence: TTC
tgaatatataattttgaatc

SEQ ID NO: 250500 - DNA, 20 bp, Artificial Sequence
  Description of Artificial Sequence: Synthetic oligonucleotide
  Target: ATXN1; (+) strand; PAM type: YTN; PAM sequence: CTG
aatatataattttgaatcag

SEQ ID NO: 250501 - DNA, 20 bp, Artificial Sequence
  Description of Artificial Sequence: Synthetic oligonucleotide
  Target: ATXN1; (+) strand; PAM type: YTN; PAM sequence: TTT
tgaatcagttctttcactta

SEQ ID NO: 250502 - DNA, 20 bp, Artificial Sequence
  Description of Artificial Sequence: Synthetic oligonucleotide
  Target: ATXN1; (+) strand; PAM type: YTN; PAM sequence: TTT
gaatcagttctttcacttaa

SEQ ID NO: 250503 - DNA, 20 bp, Artificial Sequence
  Description of Artificial Sequence: Synthetic oligonucleotide
  Target: ATXN1; (+) strand; PAM type: YTN; PAM sequence: TTG
aatcagttctttcacttaac

SEQ ID NO: 250504 - DNA, 20 bp, Artificial Sequence
  Description of Artificial Sequence: Synthetic oligonucleotide
  Target: ATXN1; (+) strand; PAM type: YTN; PAM sequence: TTC
tttcacttaacattgtattg

SEQ ID NO: 250505 - DNA, 20 bp, Artificial Sequence
  Description of Artificial Sequence: Synthetic oligonucleotide
  Target: ATXN1; (+) strand; PAM type: YTN; PAM sequence: CTT
tcacttaacattgtattgta

SEQ ID NO: 250506 - DNA, 20 bp, Artificial Sequence
  Description of Artificial Sequence: Synthetic oligonucleotide
  Target: ATXN1; (+) strand; PAM type: YTN; PAM sequence: TTT
cacttaacattgtattgtaa

SEQ ID NO: 250507 - DNA, 20 bp, Artificial Sequence
  Description of Artificial Sequence: Synthetic oligonucleotide
  Target: ATXN1; (+) strand; PAM type: YTN; PAM sequence: TTC
acttaacattgtattgtaac

SEQ ID NO: 250508 - DNA, 20 bp, Artificial Sequence
  Description of Artificial Sequence: Synthetic oligonucleotide
  Target: ATXN1; (+) strand; PAM type: YTN; PAM sequence: CTT
aacattgtattgtaactaga

SEQ ID NO: 250509 - DNA, 20 bp, Artificial Sequence
  Description of Artificial Sequence: Synthetic oligonucleotide
  Target: ATXN1; (+) strand; PAM type: YTN; PAM sequence: TTA
acattgtattgtaactagaa

SEQ ID NO: 250510 - DNA, 20 bp, Artificial Sequence
  Description of Artificial Sequence: Synthetic oligonucleotide
  Target: ATXN1; (+) strand; PAM type: YTN; PAM sequence: TTG
tattgtaactagaattataa

SEQ ID NO: 250511 - DNA, 20 bp, Artificial Sequence
  Description of Artificial Sequence: Synthetic oligonucleotide
  Target: ATXN1; (+) strand; PAM type: YTN; PAM sequence: TTG
taactagaattataaactag

SEQ ID NO: 250512 - DNA, 20 bp, Artificial Sequence
  Description of Artificial Sequence: Synthetic oligonucleotide
  Target: ATXN1; (+) strand; PAM type: YTN; PAM sequence: CTA
gaattataaactagtttttt

SEQ ID NO: 250513 - DNA, 20 bp, Artificial Sequence
  Description of Artificial Sequence: Synthetic oligonucleotide
  Target: ATXN1; (+) strand; PAM type: YTN; PAM sequence: TTA
taaactagttttttaaagct

SEQ ID NO: 250514 - DNA, 20 bp, Artificial Sequence
  Description of Artificial Sequence: Synthetic oligonucleotide
  Target: ATXN1; (+) strand; PAM type: YTN; PAM sequence: CTA
gttttttaaagctagttaaa

SEQ ID NO: 250515 - DNA, 20 bp, Artificial Sequence
  Description of Artificial Sequence: Synthetic oligonucleotide
  Target: ATXN1; (+) strand; PAM type: YTN; PAM sequence: TTT
tttaaagctagttaaaggaa

SEQ ID NO: 250516 - DNA, 20 bp, Artificial Sequence
  Description of Artificial Sequence: Synthetic oligonucleotide
  Target: ATXN1; (+) strand; PAM type: YTN; PAM sequence: TTT
ttaaagctagttaaaggaag

SEQ ID NO: 250517 - DNA, 20 bp, Artificial Sequence
  Description of Artificial Sequence: Synthetic oligonucleotide
  Target: ATXN1; (+) strand; PAM type: YTN; PAM sequence: TTT
taaagctagttaaaggaaga

SEQ ID NO: 250518 - DNA, 20 bp, Artificial Sequence
  Description of Artificial Sequence: Synthetic oligonucleotide
  Target: ATXN1; (+) strand; PAM type: YTN; PAM sequence: TTT
aaagctagttaaaggaagaa

SEQ ID NO: 250519 - DNA, 20 bp, Artificial Sequence
  Description of Artificial Sequence: Synthetic oligonucleotide
  Target: ATXN1; (+) strand; PAM type: YTN; PAM sequence: TTA
aagctagttaaaggaagaat

SEQ ID NO: 250520 - DNA, 20 bp, Artificial Sequence
  Description of Artificial Sequence: Synthetic oligonucleotide
  Target: ATXN1; (+) strand; PAM type: YTN; PAM sequence: CTA
gttaaaggaagaatgaagta

SEQ ID NO: 250521 - DNA, 20 bp, Artificial Sequence
  Description of Artificial Sequence: Synthetic oligonucleotide
  Target: ATXN1; (+) strand; PAM type: YTN; PAM sequence: TTA
aaggaagaatgaagtaaagc

SEQ ID NO: 250522 - DNA, 20 bp, Artificial Sequence
  Description of Artificial Sequence: Synthetic oligonucleotide
  Target: ATXN1; (+) strand; PAM type: YTN; PAM sequence: CTT
aaactacagtttgtaactaa

SEQ ID NO: 250523 - DNA, 20 bp, Artificial Sequence
  Description of Artificial Sequence: Synthetic oligonucleotide
  Target: ATXN1; (+) strand; PAM type: YTN; PAM sequence: TTA
aactacagtttgtaactaac

SEQ ID NO: 250524 - DNA, 20 bp, Artificial Sequence
  Description of Artificial Sequence: Synthetic oligonucleotide
  Target: ATXN1; (+) strand; PAM type: YTN; PAM sequence: CTA
cagtttgtaactaactgtaa

SEQ ID NO: 250525 - DNA, 20 bp, Artificial Sequence
  Description of Artificial Sequence: Synthetic oligonucleotide
  Target: ATXN1; (+) strand; PAM type: YTN; PAM sequence: TTT
gtaactaactgtaaaatcca

SEQ ID NO: 250526 - DNA, 20 bp, Artificial Sequence
  Description of Artificial Sequence: Synthetic oligonucleotide
  Target: ATXN1; (+) strand; PAM type: YTN; PAM sequence: TTG
taactaactgtaaaatccaa

SEQ ID NO: 250527 - DNA, 20 bp, Artificial Sequence
  Description of Artificial Sequence: Synthetic oligonucleotide
  Target: ATXN1; (+) strand; PAM type: YTN; PAM sequence: CTA
actgtaaaatccaaaagcac

SEQ ID NO: 250528 - DNA, 20 bp, Artificial Sequence
  Description of Artificial Sequence: Synthetic oligonucleotide
  Target: ATXN1; (+) strand; PAM type: YTN; PAM sequence: CTG
taaaatccaaaagcacttgg

SEQ ID NO: 250529 - DNA, 20 bp, Artificial Sequence
  Description of Artificial Sequence: Synthetic oligonucleotide
  Target: ATXN1; (+) strand; PAM type: YTN; PAM sequence: CTT
ggcaaatggtaaggaatttg

SEQ ID NO: 250530 - DNA, 20 bp, Artificial Sequence
  Description of Artificial Sequence: Synthetic oligonucleotide
  Target: ATXN1; (+) strand; PAM type: YTN; PAM sequence: TTG
gcaaatggtaaggaatttgg

SEQ ID NO: 250531 - DNA, 20 bp, Artificial Sequence
  Description of Artificial Sequence: Synthetic oligonucleotide
  Target: ATXN1; (+) strand; PAM type: YTN; PAM sequence: TTT
ggacacataaattaatggag

SEQ ID NO: 250532 - DNA, 20 bp, Artificial Sequence
  Description of Artificial Sequence: Synthetic oligonucleotide
  Target: ATXN1; (+) strand; PAM type: YTN; PAM sequence: TTG
gacacataaattaatggagc

SEQ ID NO: 250533 - DNA, 20 bp, Artificial Sequence
  Description of Artificial Sequence: Synthetic oligonucleotide
  Target: ATXN1; (+) strand; PAM type: YTN; PAM sequence: TTA
atggagctaaatattaatca

SEQ ID NO: 250534 - DNA, 20 bp, Artificial Sequence
  Description of Artificial Sequence: Synthetic oligonucleotide
  Target: ATXN1; (+) strand; PAM type: YTN; PAM sequence: CTA
aatattaatcagtgagcaaa

SEQ ID NO: 250535 - DNA, 20 bp, Artificial Sequence
  Description of Artificial Sequence: Synthetic oligonucleotide
  Target: ATXN1; (+) strand; PAM type: YTN; PAM sequence: TTA
atcagtgagcaaatattaat

SEQ ID NO: 250536 - DNA, 20 bp, Artificial Sequence
  Description of Artificial Sequence: Synthetic oligonucleotide
  Target: ATXN1; (+) strand; PAM type: YTN; PAM sequence: TTA
attgagtcttaaagagctga

SEQ ID NO: 250537 - DNA, 20 bp, Artificial Sequence
  Description of Artificial Sequence: Synthetic oligonucleotide
  Target: ATXN1; (+) strand; PAM type: YTN; PAM sequence: TTG
agtcttaaagagctgaaatt

SEQ ID NO: 250538 - DNA, 20 bp, Artificial Sequence
  Description of Artificial Sequence: Synthetic oligonucleotide
  Target: ATXN1; (+) strand; PAM type: YTN; PAM sequence: CTT
aaagagctgaaattattcta

SEQ ID NO: 250539 - DNA, 20 bp, Artificial Sequence
  Description of Artificial Sequence: Synthetic oligonucleotide
  Target: ATXN1; (+) strand; PAM type: YTN; PAM sequence: TTA
aagagctgaaattattctag

SEQ ID NO: 250540 - DNA, 20 bp, Artificial Sequence
  Description of Artificial Sequence: Synthetic oligonucleotide
  Target: ATXN1; (+) strand; PAM type: YTN; PAM sequence: CTG
aaattattctaggagccatg

SEQ ID NO: 250541 - DNA, 20 bp, Artificial Sequence
  Description of Artificial Sequence: Synthetic oligonucleotide
  Target: ATXN1; (+) strand; PAM type: YTN; PAM sequence: TTA
ttctaggagccatgcctggg

SEQ ID NO: 250542 - DNA, 20 bp, Artificial Sequence
  Description of Artificial Sequence: Synthetic oligonucleotide
  Target: ATXN1; (+) strand; PAM type: YTN; PAM sequence: TTC
taggagccatgcctgggatg

SEQ ID NO: 250543 - DNA, 20 bp, Artificial Sequence
  Description of Artificial Sequence: Synthetic oligonucleotide
  Target: ATXN1; (+) strand; PAM type: YTN; PAM sequence: CTA
ggagccatgcctgggatgtc

SEQ ID NO: 250544 - DNA, 20 bp, Artificial Sequence
  Description of Artificial Sequence: Synthetic oligonucleotide
  Target: ATXN1; (+) strand; PAM type: YTN; PAM sequence: CTG
ggatgtcgtggtggctaaga

SEQ ID NO: 250545 - DNA, 20 bp, Artificial Sequence
  Description of Artificial Sequence: Synthetic oligonucleotide
  Target: ATXN1; (+) strand; PAM type: YTN; PAM sequence: CTA
agatggagtccctactattg

SEQ ID NO: 250546 - DNA, 20 bp, Artificial Sequence
  Description of Artificial Sequence: Synthetic oligonucleotide
  Target: ATXN1; (+) strand; PAM type: YTN; PAM sequence: CTA
ctattgggagcatagagtgt

SEQ ID NO: 250547 - DNA, 20 bp, Artificial Sequence
  Description of Artificial Sequence: Synthetic oligonucleotide
  Target: ATXN1; (+) strand; PAM type: YTN; PAM sequence: CTA
ttgggagcatagagtgtcag

SEQ ID NO: 250548 - DNA, 20 bp, Artificial Sequence
  Description of Artificial Sequence: Synthetic oligonucleotide
  Target: ATXN1; (+) strand; PAM type: YTN; PAM sequence: TTG
ggagcatagagtgtcagaaa

SEQ ID NO: 250549 - DNA, 20 bp, Artificial Sequence
  Description of Artificial Sequence: Synthetic oligonucleotide
  Target: ATXN1; (+) strand; PAM type: YTN; PAM sequence: TTA
agagaatgcaataaattcca

SEQ ID NO: 250550 - DNA, 20 bp, Artificial Sequence
  Description of Artificial Sequence: Synthetic oligonucleotide
  Target: ATXN1; (+) strand; PAM type: YTN; PAM sequence: TTC
cagtagagatgggctcaatt

SEQ ID NO: 250551 - DNA, 20 bp, Artificial Sequence
  Description of Artificial Sequence: Synthetic oligonucleotide
  Target: ATXN1; (+) strand; PAM type: YTN; PAM sequence: CTC
aatttgctttcacaccaact

SEQ ID NO: 250552 - DNA, 20 bp, Artificial Sequence
  Description of Artificial Sequence: Synthetic oligonucleotide
  Target: ATXN1; (+) strand; PAM type: YTN; PAM sequence: TTT
gctttcacaccaactagaat

SEQ ID NO: 250553 - DNA, 20 bp, Artificial Sequence
  Description of Artificial Sequence: Synthetic oligonucleotide
  Target: ATXN1; (+) strand; PAM type: YTN; PAM sequence: TTG
ctttcacaccaactagaatg

SEQ ID NO: 250554 - DNA, 20 bp, Artificial Sequence
  Description of Artificial Sequence: Synthetic oligonucleotide
  Target: ATXN1; (+) strand; PAM type: YTN; PAM sequence: CTT
tcacaccaactagaatggtg

SEQ ID NO: 250555 - DNA, 20 bp, Artificial Sequence
  Description of Artificial Sequence: Synthetic oligonucleotide
  Target: ATXN1; (+) strand; PAM type: YTN; PAM sequence: TTT
cacaccaactagaatggtgt

SEQ ID NO: 250556 - DNA, 20 bp, Artificial Sequence
  Description of Artificial Sequence: Synthetic oligonucleotide
  Target: ATXN1; (+) strand; PAM type: YTN; PAM sequence: TTC
acaccaactagaatggtgtg

SEQ ID NO: 250557 - DNA, 20 bp, Artificial Sequence
  Description of Artificial Sequence: Synthetic oligonucleotide
  Target: ATXN1; (+) strand; PAM type: YTN; PAM sequence: CTA
gaatggtgtgaaagaatggt

SEQ ID NO: 250558 - DNA, 20 bp, Artificial Sequence
  Description of Artificial Sequence: Synthetic oligonucleotide
  Target: ATXN1; (+) strand; PAM type: YTN; PAM sequence: TTT
gcaaagcaaatgaatgatgc

SEQ ID NO: 250559 - DNA, 20 bp, Artificial Sequence
  Description of Artificial Sequence: Synthetic oligonucleotide
  Target: ATXN1; (+) strand; PAM type: YTN; PAM sequence: TTG
caaagcaaatgaatgatgca

SEQ ID NO: 250560 - DNA, 20 bp, Artificial Sequence
  Description of Artificial Sequence: Synthetic oligonucleotide
  Target: ATXN1; (+) strand; PAM type: YTN; PAM sequence: CTA
agaatagcacttaatttact

SEQ ID NO: 250561 - DNA, 20 bp, Artificial Sequence
  Description of Artificial Sequence: Synthetic oligonucleotide
  Target: ATXN1; (+) strand; PAM type: YTN; PAM sequence: CTT
aatttacttacaagaaggaa

SEQ ID NO: 250562 - DNA, 20 bp, Artificial Sequence
  Description of Artificial Sequence: Synthetic oligonucleotide
  Target: ATXN1; (+) strand; PAM type: YTN; PAM sequence: TTA
atttacttacaagaaggaac

SEQ ID NO: 250563 - DNA, 20 bp, Artificial Sequence
  Description of Artificial Sequence: Synthetic oligonucleotide
  Target: ATXN1; (+) strand; PAM type: YTN; PAM sequence: TTT
acttacaagaaggaactgtt

SEQ ID NO: 250564 - DNA, 20 bp, Artificial Sequence
  Description of Artificial Sequence: Synthetic oligonucleotide
  Target: ATXN1; (+) strand; PAM type: YTN; PAM sequence: TTA
cttacaagaaggaactgttt

SEQ ID NO: 250565 - DNA, 20 bp, Artificial Sequence
  Description of Artificial Sequence: Synthetic oligonucleotide
  Target: ATXN1; (+) strand; PAM type: YTN; PAM sequence: CTT
acaagaaggaactgttttaa

SEQ ID NO: 250566 - DNA, 20 bp, Artificial Sequence
  Description of Artificial Sequence: Synthetic oligonucleotide
  Target: ATXN1; (+) strand; PAM type: YTN; PAM sequence: TTA
caagaaggaactgttttaat

SEQ ID NO: 250567 - DNA, 20 bp, Artificial Sequence
  Description of Artificial Sequence: Synthetic oligonucleotide
  Target: ATXN1; (+) strand; PAM type: YTN; PAM sequence: CTG
ttttaattggtttaaaaata

SEQ ID NO: 250568 - DNA, 20 bp, Artificial Sequence
  Description of Artificial Sequence: Synthetic oligonucleotide
  Target: ATXN1; (+) strand; PAM type: YTN; PAM sequence: TTT
taattggtttaaaaatactc

SEQ ID NO: 250569 - DNA, 20 bp, Artificial Sequence
  Description of Artificial Sequence: Synthetic oligonucleotide
  Target: ATXN1; (+) strand; PAM type: YTN; PAM sequence: TTT
aattggtttaaaaatactca

SEQ ID NO: 250570 - DNA, 20 bp, Artificial Sequence
  Description of Artificial Sequence: Synthetic oligonucleotide
  Target: ATXN1; (+) strand; PAM type: YTN; PAM sequence: TTA
attggtttaaaaatactcac

SEQ ID NO: 250571 - DNA, 20 bp, Artificial Sequence
  Description of Artificial Sequence: Synthetic oligonucleotide
  Target: ATXN1; (+) strand; PAM type: YTN; PAM sequence: TTG
gtttaaaaatactcactaca

SEQ ID NO: 250572 - DNA, 20 bp, Artificial Sequence
  Description of Artificial Sequence: Synthetic oligonucleotide
  Target: ATXN1; (+) strand; PAM type: YTN; PAM sequence: TTT
aaaaatactcactacacaca

SEQ ID NO: 250573 - DNA, 20 bp, Artificial Sequence
  Description of Artificial Sequence: Synthetic oligonucleotide
  Target: ATXN1; (+) strand; PAM type: YTN; PAM sequence: TTA
aaaatactcactacacacaa

SEQ ID NO: 250574 - DNA, 20 bp, Artificial Sequence
  Description of Artificial Sequence: Synthetic oligonucleotide
  Target: ATXN1; (+) strand; PAM type: YTN; PAM sequence: CTC
actacacacaaatattttgt

SEQ ID NO: 250575 - DNA, 20 bp, Artificial Sequence
  Description of Artificial Sequence: Synthetic oligonucleotide
  Target: ATXN1; (+) strand; PAM type: YTN; PAM sequence: CTA
cacacaaatattttgttaat

SEQ ID NO: 250576 - DNA, 20 bp, Artificial Sequence
  Description of Artificial Sequence: Synthetic oligonucleotide
  Target: ATXN1; (+) strand; PAM type: YTN; PAM sequence: TTT
tgttaattaaaaatgagtac

SEQ ID NO: 250577 - DNA, 20 bp, Artificial Sequence
  Description of Artificial Sequence: Synthetic oligonucleotide
  Target: ATXN1; (+) strand; PAM type: YTN; PAM sequence: TTT
gttaattaaaaatgagtacc

SEQ ID NO: 250578 - DNA, 20 bp, Artificial Sequence
  Description of Artificial Sequence: Synthetic oligonucleotide
  Target: ATXN1; (+) strand; PAM type: YTN; PAM sequence: TTG
ttaattaaaaatgagtacct

SEQ ID NO: 250579 - DNA, 20 bp, Artificial Sequence
  Description of Artificial Sequence: Synthetic oligonucleotide
  Target: ATXN1; (+) strand; PAM type: YTN; PAM sequence: TTA
attaaaaatgagtacctatt

SEQ ID NO: 250580 - DNA, 20 bp, Artificial Sequence
  Description of Artificial Sequence: Synthetic oligonucleotide
  Target: ATXN1; (+) strand; PAM type: YTN; PAM sequence: TTA
aaaatgagtacctatttgaa

SEQ ID NO: 250581 - DNA, 20 bp, Artificial Sequence
  Description of Artificial Sequence: Synthetic oligonucleotide
  Target: ATXN1; (+) strand; PAM type: YTN; PAM sequence: CTA
tttgaacacttatgtgaact

SEQ ID NO: 250582 - DNA, 20 bp, Artificial Sequence
  Description of Artificial Sequence: Synthetic oligonucleotide
  Target: ATXN1; (+) strand; PAM type: YTN; PAM sequence: TTT
gaacacttatgtgaactaaa

SEQ ID NO: 250583 - DNA, 20 bp, Artificial Sequence
  Description of Artificial Sequence: Synthetic oligonucleotide
  Target: ATXN1; (+) strand; PAM type: YTN; PAM sequence: TTG
aacacttatgtgaactaaat

SEQ ID NO: 250584 - DNA, 20 bp, Artificial Sequence
  Description of Artificial Sequence: Synthetic oligonucleotide
  Target: ATXN1; (+) strand; PAM type: YTN; PAM sequence: CTT
atgtgaactaaataggagct

SEQ ID NO: 250585 - DNA, 20 bp, Artificial Sequence
  Description of Artificial Sequence: Synthetic oligonucleotide
  Target: ATXN1; (+) strand; PAM type: YTN; PAM sequence: TTA
tgtgaactaaataggagcta

SEQ ID NO: 250586 - DNA, 20 bp, Artificial Sequence
  Description of Artificial Sequence: Synthetic oligonucleotide
  Target: ATXN1; (+) strand; PAM type: YTN; PAM sequence: CTA
aataggagctaatacatgag

SEQ ID NO: 250587 - DNA, 20 bp, Artificial Sequence
  Description of Artificial Sequence: Synthetic oligonucleotide
  Target: ATXN1; (+) strand; PAM type: YTN; PAM sequence: CTA
atacatgagataaaaattat

SEQ ID NO: 250588 - DNA, 20 bp, Artificial Sequence
  Description of Artificial Sequence: Synthetic oligonucleotide
  Target: ATXN1; (+) strand; PAM type: YTN; PAM sequence: TTA
tgtagttacaattttttttt

SEQ ID NO: 250589 - DNA, 20 bp, Artificial Sequence
  Description of Artificial Sequence: Synthetic oligonucleotide
  Target: ATXN1; (+) strand; PAM type: YTN; PAM sequence: TTA
caatttttttttttttttgc

SEQ ID NO: 250590 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgcttttca

SEQ ID NO: 250591 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgcttttcat

SEQ ID NO: 250592 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgcttttcatt

SEQ ID NO: 250593 - DNA, 20 bp, Artificial Sequence
  Description of Artificial Sequence: Synthetic oligonucleotide
  Target: ATXN1; (+) strand; PAM type: YTN; PAM sequence: TTT
tttttttttgcttttcatta

SEQ ID NO: 250594 - DNA, 20 bp, Artificial Sequence
  Description of Artificial Sequence: Synthetic oligonucleotide
  Target: ATXN1; (+) strand; PAM type: YTN; PAM sequence: TTT
ttttttttgcttttcattaa

SEQ ID NO: 250595 - DNA, 20 bp, Artificial Sequence
  Description of Artificial Sequence: Synthetic oligonucleotide
  Target: ATXN1; (+) strand; PAM type: YTN; PAM sequence: TTT
tttttttgcttttcattaat

SEQ ID NO: 250596 - DNA, 20 bp, Artificial Sequence
  Description of Artificial Sequence: Synthetic oligonucleotide
  Target: ATXN1; (+) strand; PAM type: YTN; PAM sequence: TTT
ttttttgcttttcattaatt

SEQ ID NO: 250597 - DNA, 20 bp, Artificial Sequence
  Description of Artificial Sequence: Synthetic oligonucleotide
  Target: ATXN1; (+) strand; PAM type: YTN; PAM sequence: TTT
tttttgcttttcattaattg

SEQ ID NO: 250598 - DNA, 20 bp, Artificial Sequence
  Description of Artificial Sequence: Synthetic oligonucleotide
  Target: ATXN1; (+) strand; PAM type: YTN; PAM sequence: TTT
ttttgcttttcattaattga

SEQ ID NO: 250599 - DNA, 20 bp, Artificial Sequence
  Description of Artificial Sequence: Synthetic oligonucleotide
  Target: ATXN1; (+) strand; PAM type: YTN; PAM sequence: TTT
tttgcttttcattaattgaa

SEQ ID NO: 250600 - DNA, 20 bp, Artificial Sequence
  Description of Artificial Sequence: Synthetic oligonucleotide
  Target: ATXN1; (+) strand; PAM type: YTN; PAM sequence: TTT
ttgcttttcattaattgaat

SEQ ID NO: 250601 - DNA, 20 bp, Artificial Sequence
  Description of Artificial Sequence: Synthetic oligonucleotide
  Target: ATXN1; (+) strand; PAM type: YTN; PAM sequence: TTT
tgcttttcattaattgaatc

SEQ ID NO: 250602 - DNA, 20 bp, Artificial Sequence
  Description of Artificial Sequence: Synthetic oligonucleotide
  Target: ATXN1; (+) strand; PAM type: YTN; PAM sequence: TTT
gcttttcattaattgaatca

SEQ ID NO: 250603 - DNA, 20 bp, Artificial Sequence
  Description of Artificial Sequence: Synthetic oligonucleotide
  Target: ATXN1; (+) strand; PAM type: YTN; PAM sequence: TTG
cttttcattaattgaatcag

SEQ ID NO: 250604 - DNA, 20 bp, Artificial Sequence
  Description of Artificial Sequence: Synthetic oligonucleotide
  Target: ATXN1; (+) strand; PAM type: YTN; PAM sequence: CTT
ttcattaattgaatcagact

SEQ ID NO: 250605 - DNA, 20 bp, Artificial Sequence
  Description of Artificial Sequence: Synthetic oligonucleotide
  Target: ATXN1; (+) strand; PAM type: YTN; PAM sequence: TTT
tcattaattgaatcagactg

SEQ ID NO: 250606 - DNA, 20 bp, Artificial Sequence
  Description of Artificial Sequence: Synthetic oligonucleotide
  Target: ATXN1; (+) strand; PAM type: YTN; PAM sequence: TTT
cattaattgaatcagactgg

SEQ ID NO: 250607 - DNA, 20 bp, Artificial Sequence
  Description of Artificial Sequence: Synthetic oligonucleotide
  Target: ATXN1; (+) strand; PAM type: YTN; PAM sequence: TTC
attaattgaatcagactgga

SEQ ID NO: 250608 - DNA, 20 bp, Artificial Sequence
  Description of Artificial Sequence: Synthetic oligonucleotide
  Target: ATXN1; (+) strand; PAM type: YTN; PAM sequence: TTA
attgaatcagactggacttt

SEQ ID NO: 250609 - DNA, 20 bp, Artificial Sequence
  Description of Artificial Sequence: Synthetic oligonucleotide
  Target: ATXN1; (+) strand; PAM type: YTN; PAM sequence: TTG
aatcagactggactttctcc

SEQ ID NO: 250610 - DNA, 20 bp, Artificial Sequence
  Description of Artificial Sequence: Synthetic oligonucleotide
  Target: ATXN1; (+) strand; PAM type: YTN; PAM sequence: CTG
gactttctccaagcatgtga

SEQ ID NO: 250611 - DNA, 20 bp, Artificial Sequence
  Description of Artificial Sequence: Synthetic oligonucleotide
  Target: ATXN1; (+) strand; PAM type: YTN; PAM sequence: CTT
tctccaagcatgtgaatgag

SEQ ID NO: 250612 - DNA, 20 bp, Artificial Sequence
  Description of Artificial Sequence: Synthetic oligonucleotide
  Target: ATXN1; (+) strand; PAM type: YTN; PAM sequence: TTT
ctccaagcatgtgaatgagt

SEQ ID NO: 250613 - DNA, 20 bp, Artificial Sequence
  Description of Artificial Sequence: Synthetic oligonucleotide
  Target: ATXN1; (+) strand; PAM type: YTN; PAM sequence: TTC
tccaagcatgtgaatgagtg

SEQ ID NO: 250614 - DNA, 20 bp, Artificial Sequence
  Description of Artificial Sequence: Synthetic oligonucleotide
  Target: ATXN1; (+) strand; PAM type: YTN; PAM sequence: CTC
caagcatgtgaatgagtgag

SEQ ID NO: 250615 - DNA, 20 bp, Artificial Sequence
  Description of Artificial Sequence: Synthetic oligonucleotide
  Target: ATXN1; (+) strand; PAM type: YTN; PAM sequence: TTT
attgtaccatgcaaaaactt

SEQ ID NO: 250616 - DNA, 20 bp, Artificial Sequence
  Description of Artificial Sequence: Synthetic oligonucleotide
  Target: ATXN1; (+) strand; PAM type: YTN; PAM sequence: TTA
ttgtaccatgcaaaaactta

SEQ ID NO: 250617 - DNA, 20 bp, Artificial Sequence
  Description of Artificial Sequence: Synthetic oligonucleotide
  Target: ATXN1; (+) strand; PAM type: YTN; PAM sequence: TTG
taccatgcaaaaacttagga

SEQ ID NO: 250618 - DNA, 20 bp, Artificial Sequence
  Description of Artificial Sequence: Synthetic oligonucleotide
  Target: ATXN1; (+) strand; PAM type: YTN; PAM sequence: CTT
aggatctttacaggttttat

SEQ ID NO: 250619 - DNA, 20 bp, Artificial Sequence
  Description of Artificial Sequence: Synthetic oligonucleotide
  Target: ATXN1; (+) strand; PAM type: YTN; PAM sequence: TTA
ggatctttacaggttttatt

SEQ ID NO: 250620 - DNA, 20 bp, Artificial Sequence
  Description of Artificial Sequence: Synthetic oligonucleotide
  Target: ATXN1; (+) strand; PAM type: YTN; PAM sequence: CTT
tacaggttttattatttgta

SEQ ID NO: 250621 - DNA, 20 bp, Artificial Sequence
  Description of Artificial Sequence: Synthetic oligonucleotide
  Target: ATXN1; (+) strand; PAM type: YTN; PAM sequence: TTT
acaggttttattatttgtat

SEQ ID NO: 250622 - DNA, 20 bp, Artificial Sequence
  Description of Artificial Sequence: Synthetic oligonucleotide
  Target: ATXN1; (+) strand; PAM type: YTN; PAM sequence: TTA
caggttttattatttgtatt

SEQ ID NO: 250623 - DNA, 20 bp, Artificial Sequence
  Description of Artificial Sequence: Synthetic oligonucleotide
  Target: ATXN1; (+) strand; PAM type: YTN; PAM sequence: TTT
tattatttgtatttaacact

SEQ ID NO: 250624 - DNA, 20 bp, Artificial Sequence
  Description of Artificial Sequence: Synthetic oligonucleotide
  Target: ATXN1; (+) strand; PAM type: YTN; PAM sequence: TTT
attatttgtatttaacacta

SEQ ID NO: 250625 - DNA, 20 bp, Artificial Sequence
  Description of Artificial Sequence: Synthetic oligonucleotide
  Target: ATXN1; (+) strand; PAM type: YTN; PAM sequence: TTA
ttatttgtatttaacactag

SEQ ID NO: 250626 - DNA, 20 bp, Artificial Sequence
  Description of Artificial Sequence: Synthetic oligonucleotide
  Target: ATXN1; (+) strand; PAM type: YTN; PAM sequence: TTA
tttgtatttaacactagttc

SEQ ID NO: 250627 - DNA, 20 bp, Artificial Sequence
  Description of Artificial Sequence: Synthetic oligonucleotide
  Target: ATXN1; (+) strand; PAM type: YTN; PAM sequence: TTT
gtatttaacactagttccat

SEQ ID NO: 250628 - DNA, 20 bp, Artificial Sequence
  Description of Artificial Sequence: Synthetic oligonucleotide
  Target: ATXN1; (+) strand; PAM type: YTN; PAM sequence: TTG
tatttaacactagttccatt

SEQ ID NO: 250629 - DNA, 20 bp, Artificial Sequence
  Description of Artificial Sequence: Synthetic oligonucleotide
  Target: ATXN1; (+) strand; PAM type: YTN; PAM sequence: TTT
aacactagttccatttcagc

SEQ ID NO: 250630 - DNA, 20 bp, Artificial Sequence
  Description of Artificial Sequence: Synthetic oligonucleotide
  Target: ATXN1; (+) strand; PAM type: YTN; PAM sequence: TTA
acactagttccatttcagct

SEQ ID NO: 250631 - DNA, 20 bp, Artificial Sequence
  Description of Artificial Sequence: Synthetic oligonucleotide
  Target: ATXN1; (+) strand; PAM type: YTN; PAM sequence: CTA
gttccatttcagctggtcag

SEQ ID NO: 250632 - DNA, 20 bp, Artificial Sequence
  Description of Artificial Sequence: Synthetic oligonucleotide
  Target: ATXN1; (+) strand; PAM type: YTN; PAM sequence: TTC
catttcagctggtcagataa

SEQ ID NO: 250633 - DNA, 20 bp, Artificial Sequence
  Description of Artificial Sequence: Synthetic oligonucleotide
  Target: ATXN1; (+) strand; PAM type: YTN; PAM sequence: TTT
cagctggtcagataagaaga

SEQ ID NO: 250634 - DNA, 20 bp, Artificial Sequence
  Description of Artificial Sequence: Synthetic oligonucleotide
  Target: ATXN1; (+) strand; PAM type: YTN; PAM sequence: TTC
agctggtcagataagaagaa

SEQ ID NO: 250635 - DNA, 20 bp, Artificial Sequence
  Description of Artificial Sequence: Synthetic oligonucleotide
  Target: ATXN1; (+) strand; PAM type: YTN; PAM sequence: CTG
gtcagataagaagaaatgtg

SEQ ID NO: 250636 - DNA, 20 bp, Artificial Sequence
  Description of Artificial Sequence: Synthetic oligonucleotide
  Target: ATXN1; (+) strand; PAM type: YTN; PAM sequence: TTA
atctgctcttaaaaaaaaga

SEQ ID NO: 250637 - DNA, 20 bp, Artificial Sequence
  Description of Artificial Sequence: Synthetic oligonucleotide
  Target: ATXN1; (+) strand; PAM type: YTN; PAM sequence: CTG
ctcttaaaaaaaagaaacca

SEQ ID NO: 250638 - DNA, 20 bp, Artificial Sequence
  Description of Artificial Sequence: Synthetic oligonucleotide
  Target: ATXN1; (+) strand; PAM type: YTN; PAM sequence: CTC
ttaaaaaaaagaaaccaata

SEQ ID NO: 250639 - DNA, 20 bp, Artificial Sequence
  Description of Artificial Sequence: Synthetic oligonucleotide
  Target: ATXN1; (+) strand; PAM type: YTN; PAM sequence: CTT
aaaaaaaagaaaccaatatt

SEQ ID NO: 250640 - DNA, 20 bp, Artificial Sequence
  Description of Artificial Sequence: Synthetic oligonucleotide
  Target: ATXN1; (+) strand; PAM type: YTN; PAM sequence: TTA
aaaaaaagaaaccaatattt

SEQ ID NO: 250641 - DNA, 20 bp, Artificial Sequence
  Description of Artificial Sequence: Synthetic oligonucleotide
  Target: ATXN1; (+) strand; PAM type: YTN; PAM sequence: TTT
gacctgaattgatacaagtg

SEQ ID NO: 250642 - DNA, 20 bp, Artificial Sequence
  Description of Artificial Sequence: Synthetic oligonucleotide
  Target: ATXN1; (+) strand; PAM type: YTN; PAM sequence: TTG
acctgaattgatacaagtgt

SEQ ID NO: 250643 - DNA, 20 bp, Artificial Sequence
  Description of Artificial Sequence: Synthetic oligonucleotide
  Target: ATXN1; (+) strand; PAM type: YTN; PAM sequence: CTG
aattgatacaagtgttttct

SEQ ID NO: 250644 - DNA, 20 bp, Artificial Sequence
  Description of Artificial Sequence: Synthetic oligonucleotide
  Target: ATXN1; (+) strand; PAM type: YTN; PAM sequence: TTG
atacaagtgttttctttttt

SEQ ID NO: 250645 - DNA, 20 bp, Artificial Sequence
  Description of Artificial Sequence: Synthetic oligonucleotide
  Target: ATXN1; (+) strand; PAM type: YTN; PAM sequence: TTT
tcttttttttgagccgagac

SEQ ID NO: 250646 - DNA, 20 bp, Artificial Sequence
  Description of Artificial Sequence: Synthetic oligonucleotide
  Target: ATXN1; (+) strand; PAM type: YTN; PAM sequence: TTT
cttttttttgagccgagaca

SEQ ID NO: 250647 - DNA, 20 bp, Artificial Sequence
  Description of Artificial Sequence: Synthetic oligonucleotide
  Target: ATXN1; (+) strand; PAM type: YTN; PAM sequence: TTC
ttttttttgagccgagacag

SEQ ID NO: 250648 - DNA, 20 bp, Artificial Sequence
  Description of Artificial Sequence: Synthetic oligonucleotide
  Target: ATXN1; (+) strand; PAM type: YTN; PAM sequence: CTT
ttttttgagccgagacaggg

SEQ ID NO: 250649 - DNA, 20 bp, Artificial Sequence
  Description of Artificial Sequence: Synthetic oligonucleotide
  Target: ATXN1; (+) strand; PAM type: YTN; PAM sequence: TTT
tttttgagccgagacagggt

SEQ ID NO: 250650 - DNA, 20 bp, Artificial Sequence
  Description of Artificial Sequence: Synthetic oligonucleotide
  Target: ATXN1; (+) strand; PAM type: YTN; PAM sequence: TTT
ttttgagccgagacagggtc

SEQ ID NO: 250651 - DNA, 20 bp, Artificial Sequence
  Description of Artificial Sequence: Synthetic oligonucleotide
  Target: ATXN1; (+) strand; PAM type: YTN; PAM sequence: TTT
tttgagccgagacagggtct

SEQ ID NO: 250652 - DNA, 20 bp, Artificial Sequence
  Description of Artificial Sequence: Synthetic oligonucleotide
  Target: ATXN1; (+) strand; PAM type: YTN; PAM sequence: TTT
ttgagccgagacagggtctt

SEQ ID NO: 250653 - DNA, 20 bp, Artificial Sequence
  Description of Artificial Sequence: Synthetic oligonucleotide
  Target: ATXN1; (+) strand; PAM type: YTN; PAM sequence: TTT
tgagccgagacagggtcttg

SEQ ID NO: 250654 - DNA, 20 bp, Artificial Sequence
  Description of Artificial Sequence: Synthetic oligonucleotide
  Target: ATXN1; (+) strand; PAM type: YTN; PAM sequence: TTT
gagccgagacagggtcttgc

SEQ ID NO: 250655 - DNA, 20 bp, Artificial Sequence
  Description of Artificial Sequence: Synthetic oligonucleotide
  Target: ATXN1; (+) strand; PAM type: YTN; PAM sequence: TTG
agccgagacagggtcttgct

SEQ ID NO: 250656 - DNA, 20 bp, Artificial Sequence
  Description of Artificial Sequence: Synthetic oligonucleotide
  Target: ATXN1; (+) strand; PAM type: YTN; PAM sequence: CTT
gctctgttgcatctagagtg

SEQ ID NO: 250657 - DNA, 20 bp, Artificial Sequence
  Description of Artificial Sequence: Synthetic oligonucleotide
  Target: ATXN1; (+) strand; PAM type: YTN; PAM sequence: TTG
ctctgttgcatctagagtgc

SEQ ID NO: 250658 - DNA, 20 bp, Artificial Sequence
  Description of Artificial Sequence: Synthetic oligonucleotide
  Target: ATXN1; (+) strand; PAM type: YTN; PAM sequence: CTC
tgttgcatctagagtgcagt

SEQ ID NO: 250659 - DNA, 20 bp, Artificial Sequence
  Description of Artificial Sequence: Synthetic oligonucleotide
  Target: ATXN1; (+) strand; PAM type: YTN; PAM sequence: CTG
ttgcatctagagtgcagtgg

SEQ ID NO: 250660 - DNA, 20 bp, Artificial Sequence
  Description of Artificial Sequence: Synthetic oligonucleotide
  Target: ATXN1; (+) strand; PAM type: YTN; PAM sequence: TTG
catctagagtgcagtggtgc

SEQ ID NO: 250661 - DNA, 20 bp, Artificial Sequence
  Description of Artificial Sequence: Synthetic oligonucleotide
  Target: ATXN1; (+) strand; PAM type: YTN; PAM sequence: CTA
gagtgcagtggtgcaatcat

SEQ ID NO: 250662 - DNA, 20 bp, Artificial Sequence
  Description of Artificial Sequence: Synthetic oligonucleotide
  Target: ATXN1; (+) strand; PAM type: YTN; PAM sequence: CTC
actgcagtctcaaactgctg

SEQ ID NO: 250663 - DNA, 20 bp, Artificial Sequence
  Description of Artificial Sequence: Synthetic oligonucleotide
  Target: ATXN1; (+) strand; PAM type: YTN; PAM sequence: CTG
cagtctcaaactgctggctc

SEQ ID NO: 250664 - DNA, 20 bp, Artificial Sequence
  Description of Artificial Sequence: Synthetic oligonucleotide
  Target: ATXN1; (+) strand; PAM type: YTN; PAM sequence: CTC
aaactgctggctcaagtgat

SEQ ID NO: 250665 - DNA, 20 bp, Artificial Sequence
  Description of Artificial Sequence: Synthetic oligonucleotide
  Target: ATXN1; (+) strand; PAM type: YTN; PAM sequence: CTG
ctggctcaagtgatcctccc

SEQ ID NO: 250666 - DNA, 20 bp, Artificial Sequence
  Description of Artificial Sequence: Synthetic oligonucleotide
  Target: ATXN1; (+) strand; PAM type: YTN; PAM sequence: CTG
gctcaagtgatcctcccatc

SEQ ID NO: 250667 - DNA, 20 bp, Artificial Sequence
  Description of Artificial Sequence: Synthetic oligonucleotide
  Target: ATXN1; (+) strand; PAM type: YTN; PAM sequence: CTC
aagtgatcctcccatctcag

SEQ ID NO: 250668 - DNA, 20 bp, Artificial Sequence
  Description of Artificial Sequence: Synthetic oligonucleotide
  Target: ATXN1; (+) strand; PAM type: YTN; PAM sequence: CTC
ccatctcagcttcctgagta

SEQ ID NO: 250669 - DNA, 20 bp, Artificial Sequence
  Description of Artificial Sequence: Synthetic oligonucleotide
  Target: ATXN1; (+) strand; PAM type: YTN; PAM sequence: CTC
agcttcctgagtagctggga

SEQ ID NO: 250670 - DNA, 20 bp, Artificial Sequence
  Description of Artificial Sequence: Synthetic oligonucleotide
  Target: ATXN1; (+) strand; PAM type: YTN; PAM sequence: CTT
cctgagtagctgggactaca

SEQ ID NO: 250671 - DNA, 20 bp, Artificial Sequence
  Description of Artificial Sequence: Synthetic oligonucleotide
  Target: ATXN1; (+) strand; PAM type: YTN; PAM sequence: TTC
ctgagtagctgggactacag

SEQ ID NO: 250672 - DNA, 20 bp, Artificial Sequence
  Description of Artificial Sequence: Synthetic oligonucleotide
  Target: ATXN1; (+) strand; PAM type: YTN; PAM sequence: CTG
agtagctgggactacaggca

SEQ ID NO: 250673 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcatgccacta

SEQ ID NO: 250674 - DNA, 20 bp, Artificial Sequence
  Description of Artificial Sequence: Synthetic oligonucleotide
  Target: ATXN1; (+) strand; PAM type: YTN; PAM sequence: CTA
caggcatgccactatgcctg

SEQ ID NO: 250675 - DNA, 20 bp, Artificial Sequence
  Description of Artificial Sequence: Synthetic oligonucleotide
  Target: ATXN1; (+) strand; PAM type: YTN; PAM sequence: CTA
tgcctggttatttattttta

SEQ ID NO: 250676 - DNA, 20 bp, Artificial Sequence
  Description of Artificial Sequence: Synthetic oligonucleotide
  Target: ATXN1; (+) strand; PAM type: YTN; PAM sequence: CTG
gttatttatttttattttta

SEQ ID NO: 250677 - DNA, 20 bp, Artificial Sequence
  Description of Artificial Sequence: Synthetic oligonucleotide
  Target: ATXN1; (+) strand; PAM type: YTN; PAM sequence: TTA
tttatttttatttttatttt

SEQ ID NO: 250678 - DNA, 20 bp, Artificial Sequence
  Description of Artificial Sequence: Synthetic oligonucleotide
  Target: ATXN1; (+) strand; PAM type: YTN; PAM sequence: TTT
atttttatttttatttttat

SEQ ID NO: 250679 - DNA, 20 bp, Artificial Sequence
  Description of Artificial Sequence: Synthetic oligonucleotide
  Target: ATXN1; (+) strand; PAM type: YTN; PAM sequence: TTA
tttttatttttatttttatt

SEQ ID NO: 250680 - DNA, 20 bp, Artificial Sequence
  Description of Artificial Sequence: Synthetic oligonucleotide
  Target: ATXN1; (+) strand; PAM type: YTN; PAM sequence: TTT
ttatttttatttttattttt

SEQ ID NO: 250681 - DNA, 20 bp, Artificial Sequence
  Description of Artificial Sequence: Synthetic oligonucleotide
  Target: ATXN1; (+) strand; PAM type: YTN; PAM sequence: TTT
tatttttatttttattttta

SEQ ID NO: 250682 - DNA, 20 bp, Artificial Sequence
  Description of Artificial Sequence: Synthetic oligonucleotide
  Target: ATXN1; (+) strand; PAM type: YTN; PAM sequence: TTT
atttttatttttatttttat

SEQ ID NO: 250683 - DNA, 20 bp, Artificial Sequence
  Description of Artificial Sequence: Synthetic oligonucleotide
  Target: ATXN1; (+) strand; PAM type: YTN; PAM sequence: TTA
tttttatttttatttttatt

SEQ ID NO: 250684 - DNA, 20 bp, Artificial Sequence
  Description of Artificial Sequence: Synthetic oligonucleotide
  Target: ATXN1; (+) strand; PAM type: YTN; PAM sequence: TTT
ttatttttatttttattttt

SEQ ID NO: 250685 - DNA, 20 bp, Artificial Sequence
  Description of Artificial Sequence: Synthetic oligonucleotide
  Target: ATXN1; (+) strand; PAM type: YTN; PAM sequence: TTT
tatttttatttttattttta

SEQ ID NO: 250686 - DNA, 20 bp, Artificial Sequence
  Description of Artificial Sequence: Synthetic oligonucleotide
  Target: ATXN1; (+) strand; PAM type: YTN; PAM sequence: TTT
atttttatttttatttttat

SEQ ID NO: 250687 - DNA, 20 bp, Artificial Sequence
  Description of Artificial Sequence: Synthetic oligonucleotide
  Target: ATXN1; (+) strand; PAM type: YTN; PAM sequence: TTA
tttttatttttatttttatt

SEQ ID NO: 250688 - DNA, 20 bp, Artificial Sequence
  Description of Artificial Sequence: Synthetic oligonucleotide
  Target: ATXN1; (+) strand; PAM type: YTN; PAM sequence: TTT
ttatttttatttttattttt

SEQ ID NO: 250689 - DNA, 20 bp, Artificial Sequence
  Description of Artificial Sequence: Synthetic oligonucleotide
  Target: ATXN1; (+) strand; PAM type: YTN; PAM sequence: TTT
tatttttatttttatttttt

SEQ ID NO: 250690 - DNA, 20 bp, Artificial Sequence
  Description of Artificial Sequence: Synthetic oligonucleotide
  Target: ATXN1; (+) strand; PAM type: YTN; PAM sequence: TTT
atttttatttttattttttt

SEQ ID NO: 250691 - DNA, 20 bp, Artificial Sequence
  Description of Artificial Sequence: Synthetic oligonucleotide
  Target: ATXN1; (+) strand; PAM type: YTN; PAM sequence: TTA
tttttatttttatttttttc

SEQ ID NO: 250692 - DNA, 20 bp, Artificial Sequence
  Description of Artificial Sequence: Synthetic oligonucleotide
  Target: ATXN1; (+) strand; PAM type: YTN; PAM sequence: TTT
ttatttttatttttttcagt

SEQ ID NO: 250693 - DNA, 20 bp, Artificial Sequence
  Description of Artificial Sequence: Synthetic oligonucleotide
  Target: ATXN1; (+) strand; PAM type: YTN; PAM sequence: TTT
tatttttatttttttcagta

SEQ ID NO: 250694 - DNA, 20 bp, Artificial Sequence
  Description of Artificial Sequence: Synthetic oligonucleotide
  Target: ATXN1; (+) strand; PAM type: YTN; PAM sequence: TTT
atttttatttttttcagtag

SEQ ID NO: 250695 - DNA, 20 bp, Artificial Sequence
  Description of Artificial Sequence: Synthetic oligonucleotide
  Target: ATXN1; (+) strand; PAM type: YTN; PAM sequence: TTA
tttttatttttttcagtaga

SEQ ID NO: 250696 - DNA, 20 bp, Artificial Sequence
  Description of Artificial Sequence: Synthetic oligonucleotide
  Target: ATXN1; (+) strand; PAM type: YTN; PAM sequence: TTT
ttatttttttcagtagagat

SEQ ID NO: 250697 - DNA, 20 bp, Artificial Sequence
  Description of Artificial Sequence: Synthetic oligonucleotide
  Target: ATXN1; (+) strand; PAM type: YTN; PAM sequence: TTT
tatttttttcagtagagatt

SEQ ID NO: 250698 - DNA, 20 bp, Artificial Sequence
  Description of Artificial Sequence: Synthetic oligonucleotide
  Target: ATXN1; (+) strand; PAM type: YTN; PAM sequence: TTT
atttttttcagtagagattg

SEQ ID NO: 250699 - DNA, 20 bp, Artificial Sequence
  Description of Artificial Sequence: Synthetic oligonucleotide
  Target: ATXN1; (+) strand; PAM type: YTN; PAM sequence: TTA
tttttttcagtagagattgg

SEQ ID NO: 250700 - DNA, 20 bp, Artificial Sequence
  Description of Artificial Sequence: Synthetic oligonucleotide
  Target: ATXN1; (+) strand; PAM type: YTN; PAM sequence: TTT
ttttcagtagagattgggtc

SEQ ID NO: 250701 - DNA, 20 bp, Artificial Sequence
  Description of Artificial Sequence: Synthetic oligonucleotide
  Target: ATXN1; (+) strand; PAM type: YTN; PAM sequence: TTT
tttcagtagagattgggtct

SEQ ID NO: 250702 - DNA, 20 bp, Artificial Sequence
  Description of Artificial Sequence: Synthetic oligonucleotide
  Target: ATXN1; (+) strand; PAM type: YTN; PAM sequence: TTT
ttcagtagagattgggtctt

SEQ ID NO: 250703 - DNA, 20 bp, Artificial Sequence
  Description of Artificial Sequence: Synthetic oligonucleotide
  Target: ATXN1; (+) strand; PAM type: YTN; PAM sequence: TTT
tcagtagagattgggtcttg

SEQ ID NO: 250704 - DNA, 20 bp, Artificial Sequence
  Description of Artificial Sequence: Synthetic oligonucleotide
  Target: ATXN1; (+) strand; PAM type: YTN; PAM sequence: TTT
cagtagagattgggtcttgc

SEQ ID NO: 250705 - DNA, 20 bp, Artificial Sequence
  Description of Artificial Sequence: Synthetic oligonucleotide
  Target: ATXN1; (+) strand; PAM type: YTN; PAM sequence: TTC
agtagagattgggtcttgct

SEQ ID NO: 250706 - DNA, 20 bp, Artificial Sequence
  Description of Artificial Sequence: Synthetic oligonucleotide
  Target: ATXN1; (+) strand; PAM type: YTN; PAM sequence: TTG
ggtcttgctatggtacctag

SEQ ID NO: 250707 - DNA, 20 bp, Artificial Sequence
  Description of Artificial Sequence: Synthetic oligonucleotide
  Target: ATXN1; (+) strand; PAM type: YTN; PAM sequence: CTT
gctatggtacctaggctggt

SEQ ID NO: 250708 - DNA, 20 bp, Artificial Sequence
  Description of Artificial Sequence: Synthetic oligonucleotide
  Target: ATXN1; (+) strand; PAM type: YTN; PAM sequence: TTG
ctatggtacctaggctggtc

SEQ ID NO: 250709 - DNA, 20 bp, Artificial Sequence
  Description of Artificial Sequence: Synthetic oligonucleotide
  Target: ATXN1; (+) strand; PAM type: YTN; PAM sequence: CTA
tggtacctaggctggtctca

SEQ ID NO: 250710 - DNA, 20 bp, Artificial Sequence
  Description of Artificial Sequence: Synthetic oligonucleotide
  Target: ATXN1; (+) strand; PAM type: YTN; PAM sequence: CTA
ggctggtctcaaaatcctgg

SEQ ID NO: 250711 - DNA, 20 bp, Artificial Sequence
  Description of Artificial Sequence: Synthetic oligonucleotide
  Target: ATXN1; (+) strand; PAM type: YTN; PAM sequence: CTG
gtctcaaaatcctgggctca

SEQ ID NO: 250712 - DNA, 20 bp, Artificial Sequence
  Description of Artificial Sequence: Synthetic oligonucleotide
  Target: ATXN1; (+) strand; PAM type: YTN; PAM sequence: CTC
aaaatcctgggctcaagtga

SEQ ID NO: 250713 - DNA, 20 bp, Artificial Sequence
  Description of Artificial Sequence: Synthetic oligonucleotide
  Target: ATXN1; (+) strand; PAM type: YTN; PAM sequence: CTG
ggctcaagtgatcctcctgc

SEQ ID NO: 250714 - DNA, 20 bp, Artificial Sequence
  Description of Artificial Sequence: Synthetic oligonucleotide
  Target: ATXN1; (+) strand; PAM type: YTN; PAM sequence: CTC
aagtgatcctcctgccttag

SEQ ID NO: 250715 - DNA, 20 bp, Artificial Sequence
  Description of Artificial Sequence: Synthetic oligonucleotide
  Target: ATXN1; (+) strand; PAM type: YTN; PAM sequence: CTC
ctgccttagcctcccaaagt

SEQ ID NO: 250716 - DNA, 20 bp, Artificial Sequence
  Description of Artificial Sequence: Synthetic oligonucleotide
  Target: ATXN1; (+) strand; PAM type: YTN; PAM sequence: CTG
ccttagcctcccaaagtgct

SEQ ID NO: 250717 - DNA, 20 bp, Artificial Sequence
  Description of Artificial Sequence: Synthetic oligonucleotide
  Target: ATXN1; (+) strand; PAM type: YTN; PAM sequence: CTT
agcctcccaaagtgctggaa

SEQ ID NO: 250718 - DNA, 20 bp, Artificial Sequence
  Description of Artificial Sequence: Synthetic oligonucleotide
  Target: ATXN1; (+) strand; PAM type: YTN; PAM sequence: TTA
gcctcccaaagtgctggaat

SEQ ID NO: 250719 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctggaattacag

SEQ ID NO: 250720 - DNA, 20 bp, Artificial Sequence
  Description of Artificial Sequence: Synthetic oligonucleotide
  Target: ATXN1; (+) strand; PAM type: YTN; PAM sequence: CTG
gaattacaggcatgagccac

SEQ ID NO: 250721 - DNA, 20 bp, Artificial Sequence
  Description of Artificial Sequence: Synthetic oligonucleotide
  Target: ATXN1; (+) strand; PAM type: YTN; PAM sequence: TTA
caggcatgagccaccatgcc

SEQ ID NO: 250722 - DNA, 20 bp, Artificial Sequence
  Description of Artificial Sequence: Synthetic oligonucleotide
  Target: ATXN1; (+) strand; PAM type: YTN; PAM sequence: TTT
taatttggtttaatcccaaa

SEQ ID NO: 250723 - DNA, 20 bp, Artificial Sequence
  Description of Artificial Sequence: Synthetic oligonucleotide
  Target: ATXN1; (+) strand; PAM type: YTN; PAM sequence: TTT
aatttggtttaatcccaaat

SEQ ID NO: 250724 - DNA, 20 bp, Artificial Sequence
  Description of Artificial Sequence: Synthetic oligonucleotide
  Target: ATXN1; (+) strand; PAM type: YTN; PAM sequence: TTA
atttggtttaatcccaaatg

SEQ ID NO: 250725 - DNA, 20 bp, Artificial Sequence
  Description of Artificial Sequence: Synthetic oligonucleotide
  Target: ATXN1; (+) strand; PAM type: YTN; PAM sequence: TTT
ggtttaatcccaaatgtcta

SEQ ID NO: 250726 - DNA, 20 bp, Artificial Sequence
  Description of Artificial Sequence: Synthetic oligonucleotide
  Target: ATXN1; (+) strand; PAM type: YTN; PAM sequence: TTG
gtttaatcccaaatgtctac

SEQ ID NO: 250727 - DNA, 20 bp, Artificial Sequence
  Description of Artificial Sequence: Synthetic oligonucleotide
  Target: ATXN1; (+) strand; PAM type: YTN; PAM sequence: TTT
aatcccaaatgtctacagag

SEQ ID NO: 250728 - DNA, 20 bp, Artificial Sequence
  Description of Artificial Sequence: Synthetic oligonucleotide
  Target: ATXN1; (+) strand; PAM type: YTN; PAM sequence: TTA
atcccaaatgtctacagagg

SEQ ID NO: 250729 - DNA, 20 bp, Artificial Sequence
  Description of Artificial Sequence: Synthetic oligonucleotide
  Target: ATXN1; (+) strand; PAM type: YTN; PAM sequence: CTA
cagaggtcacaggactttac

SEQ ID NO: 250730 - DNA, 20 bp, Artificial Sequence
  Description of Artificial Sequence: Synthetic oligonucleotide
  Target: ATXN1; (+) strand; PAM type: YTN; PAM sequence: CTT
tacatatttctttgacttct

SEQ ID NO: 250731 - DNA, 20 bp, Artificial Sequence
  Description of Artificial Sequence: Synthetic oligonucleotide
  Target: ATXN1; (+) strand; PAM type: YTN; PAM sequence: TTT
acatatttctttgacttctt

SEQ ID NO: 250732 - DNA, 20 bp, Artificial Sequence
  Description of Artificial Sequence: Synthetic oligonucleotide
  Target: ATXN1; (+) strand; PAM type: YTN; PAM sequence: TTA
catatttctttgacttcttt

SEQ ID NO: 250733 - DNA, 20 bp, Artificial Sequence
  Description of Artificial Sequence: Synthetic oligonucleotide
  Target: ATXN1; (+) strand; PAM type: YTN; PAM sequence: TTT
ctttgacttctttctctact

SEQ ID NO: 250734 - DNA, 20 bp, Artificial Sequence
  Description of Artificial Sequence: Synthetic oligonucleotide
  Target: ATXN1; (+) strand; PAM type: YTN; PAM sequence: TTC
tttgacttctttctctactg

SEQ ID NO: 250735 - DNA, 20 bp, Artificial Sequence
  Description of Artificial Sequence: Synthetic oligonucleotide
  Target: ATXN1; (+) strand; PAM type: YTN; PAM sequence: CTT
tgacttctttctctactgga

SEQ ID NO: 250736 - DNA, 20 bp, Artificial Sequence
  Description of Artificial Sequence: Synthetic oligonucleotide
  Target: ATXN1; (+) strand; PAM type: YTN; PAM sequence: TTT
gacttctttctctactggat

SEQ ID NO: 250737 - DNA, 20 bp, Artificial Sequence
  Description of Artificial Sequence: Synthetic oligonucleotide
  Target: ATXN1; (+) strand; PAM type: YTN; PAM sequence: TTG
acttctttctctactggatc

SEQ ID NO: 250738 - DNA, 20 bp, Artificial Sequence
  Description of Artificial Sequence: Synthetic oligonucleotide
  Target: ATXN1; (+) strand; PAM type: YTN; PAM sequence: CTT
ctttctctactggatcatgt

SEQ ID NO: 250739 - DNA, 20 bp, Artificial Sequence
  Description of Artificial Sequence: Synthetic oligonucleotide
  Target: ATXN1; (+) strand; PAM type: YTN; PAM sequence: TTC
tttctctactggatcatgtg

SEQ ID NO: 250740 - DNA, 20 bp, Artificial Sequence
  Description of Artificial Sequence: Synthetic oligonucleotide
  Target: ATXN1; (+) strand; PAM type: YTN; PAM sequence: CTT
tctctactggatcatgtgtt

SEQ ID NO: 250741 - DNA, 20 bp, Artificial Sequence
  Description of Artificial Sequence: Synthetic oligonucleotide
  Target: ATXN1; (+) strand; PAM type: YTN; PAM sequence: TTT
ctctactggatcatgtgtta

SEQ ID NO: 250742 - DNA, 20 bp, Artificial Sequence
  Description of Artificial Sequence: Synthetic oligonucleotide
  Target: ATXN1; (+) strand; PAM type: YTN; PAM sequence: TTC
tctactggatcatgtgttat

SEQ ID NO: 250743 - DNA, 20 bp, Artificial Sequence
  Description of Artificial Sequence: Synthetic oligonucleotide
  Target: ATXN1; (+) strand; PAM type: YTN; PAM sequence: CTC
tactggatcatgtgttattg

SEQ ID NO: 250744 - DNA, 20 bp, Artificial Sequence
  Description of Artificial Sequence: Synthetic oligonucleotide
  Target: ATXN1; (+) strand; PAM type: YTN; PAM sequence: CTA
ctggatcatgtgttattgta

SEQ ID NO: 250745 - DNA, 20 bp, Artificial Sequence
  Description of Artificial Sequence: Synthetic oligonucleotide
  Target: ATXN1; (+) strand; PAM type: YTN; PAM sequence: CTG
gatcatgtgttattgtaaaa

SEQ ID NO: 250746 - DNA, 20 bp, Artificial Sequence
  Description of Artificial Sequence: Synthetic oligonucleotide
  Target: ATXN1; (+) strand; PAM type: YTN; PAM sequence: TTA
ttgtaaaatttctttatgtg

SEQ ID NO: 250747 - DNA, 20 bp, Artificial Sequence
  Description of Artificial Sequence: Synthetic oligonucleotide
  Target: ATXN1; (+) strand; PAM type: YTN; PAM sequence: TTG
taaaatttctttatgtgtga

SEQ ID NO: 250748 - DNA, 20 bp, Artificial Sequence
  Description of Artificial Sequence: Synthetic oligonucleotide
  Target: ATXN1; (+) strand; PAM type: YTN; PAM sequence: TTT
ctttatgtgtgattaaaccc

SEQ ID NO: 250749 - DNA, 20 bp, Artificial Sequence
  Description of Artificial Sequence: Synthetic oligonucleotide
  Target: ATXN1; (+) strand; PAM type: YTN; PAM sequence: TTC
tttatgtgtgattaaaccca

SEQ ID NO: 250750 - DNA, 20 bp, Artificial Sequence
  Description of Artificial Sequence: Synthetic oligonucleotide
  Target: ATXN1; (+) strand; PAM type: YTN; PAM sequence: CTT
tatgtgtgattaaacccagg

SEQ ID NO: 250751 - DNA, 20 bp, Artificial Sequence
  Description of Artificial Sequence: Synthetic oligonucleotide
  Target: ATXN1; (+) strand; PAM type: YTN; PAM sequence: TTT
atgtgtgattaaacccaggg

SEQ ID NO: 250752 - DNA, 20 bp, Artificial Sequence
  Description of Artificial Sequence: Synthetic oligonucleotide
  Target: ATXN1; (+) strand; PAM type: YTN; PAM sequence: TTA
tgtgtgattaaacccagggc

SEQ ID NO: 250753 - DNA, 20 bp, Artificial Sequence
  Description of Artificial Sequence: Synthetic oligonucleotide
  Target: ATXN1; (+) strand; PAM type: YTN; PAM sequence: TTA
aacccagggcaagccagagt

SEQ ID NO: 250754 - DNA, 20 bp, Artificial Sequence
  Description of Artificial Sequence: Synthetic oligonucleotide
  Target: ATXN1; (+) strand; PAM type: YTN; PAM sequence: TTA
catgtatgtgatattgttga

SEQ ID NO: 250755 - DNA, 20 bp, Artificial Sequence
  Description of Artificial Sequence: Synthetic oligonucleotide
  Target: ATXN1; (+) strand; PAM type: YTN; PAM sequence: TTG
ttgatacacatttttaaaat

SEQ ID NO: 250756 - DNA, 20 bp, Artificial Sequence
  Description of Artificial Sequence: Synthetic oligonucleotide
  Target: ATXN1; (+) strand; PAM type: YTN; PAM sequence: TTG
atacacatttttaaaattgc

SEQ ID NO: 250757 - DNA, 20 bp, Artificial Sequence
  Description of Artificial Sequence: Synthetic oligonucleotide
  Target: ATXN1; (+) strand; PAM type: YTN; PAM sequence: TTT
ttaaaattgctttttagaaa

SEQ ID NO: 250758 - DNA, 20 bp, Artificial Sequence
  Description of Artificial Sequence: Synthetic oligonucleotide
  Target: ATXN1; (+) strand; PAM type: YTN; PAM sequence: TTT
taaaattgctttttagaaaa

SEQ ID NO: 250759 - DNA, 20 bp, Artificial Sequence
  Description of Artificial Sequence: Synthetic oligonucleotide
  Target: ATXN1; (+) strand; PAM type: YTN; PAM sequence: TTT
aaaattgctttttagaaaat

SEQ ID NO: 250760 - DNA, 20 bp, Artificial Sequence
  Description of Artificial Sequence: Synthetic oligonucleotide
  Target: ATXN1; (+) strand; PAM type: YTN; PAM sequence: TTA
aaattgctttttagaaaatc

SEQ ID NO: 250761 - DNA, 20 bp, Artificial Sequence
  Description of Artificial Sequence: Synthetic oligonucleotide
  Target: ATXN1; (+) strand; PAM type: YTN; PAM sequence: TTG
ctttttagaaaatcaacaaa

SEQ ID NO: 250762 - DNA, 20 bp, Artificial Sequence
  Description of Artificial Sequence: Synthetic oligonucleotide
  Target: ATXN1; (+) strand; PAM type: YTN; PAM sequence: CTT
tttagaaaatcaacaaatta

SEQ ID NO: 250763 - DNA, 20 bp, Artificial Sequence
  Description of Artificial Sequence: Synthetic oligonucleotide
  Target: ATXN1; (+) strand; PAM type: YTN; PAM sequence: TTT
ttagaaaatcaacaaattaa

SEQ ID NO: 250764 - DNA, 20 bp, Artificial Sequence
  Description of Artificial Sequence: Synthetic oligonucleotide
  Target: ATXN1; (+) strand; PAM type: YTN; PAM sequence: TTT
tagaaaatcaacaaattaag

SEQ ID NO: 250765 - DNA, 20 bp, Artificial Sequence
  Description of Artificial Sequence: Synthetic oligonucleotide
  Target: ATXN1; (+) strand; PAM type: YTN; PAM sequence: TTT
agaaaatcaacaaattaagg

SEQ ID NO: 250766 - DNA, 20 bp, Artificial Sequence
  Description of Artificial Sequence: Synthetic oligonucleotide
  Target: ATXN1; (+) strand; PAM type: YTN; PAM sequence: TTA
gaaaatcaacaaattaaggc

SEQ ID NO: 250767 - DNA, 20 bp, Artificial Sequence
  Description of Artificial Sequence: Synthetic oligonucleotide
  Target: ATXN1; (+) strand; PAM type: YTN; PAM sequence: TTA
aggcactttgcaaatccaat

SEQ ID NO: 250768 - DNA, 20 bp, Artificial Sequence
  Description of Artificial Sequence: Synthetic oligonucleotide
  Target: ATXN1; (+) strand; PAM type: YTN; PAM sequence: CTT
tgcaaatccaatctattttt

SEQ ID NO: 250769 - DNA, 20 bp, Artificial Sequence
  Description of Artificial Sequence: Synthetic oligonucleotide
  Target: ATXN1; (+) strand; PAM type: YTN; PAM sequence: TTT
gcaaatccaatctatttttc

SEQ ID NO: 250770 - DNA, 20 bp, Artificial Sequence
  Description of Artificial Sequence: Synthetic oligonucleotide
  Target: ATXN1; (+) strand; PAM type: YTN; PAM sequence: TTG
caaatccaatctatttttct

SEQ ID NO: 250771 - DNA, 20 bp, Artificial Sequence
  Description of Artificial Sequence: Synthetic oligonucleotide
  Target: ATXN1; (+) strand; PAM type: YTN; PAM sequence: CTA
tttttcttttataaaacagg

SEQ ID NO: 250772 - DNA, 20 bp, Artificial Sequence
  Description of Artificial Sequence: Synthetic oligonucleotide
  Target: ATXN1; (+) strand; PAM type: YTN; PAM sequence: TTT
ttcttttataaaacaggaag

SEQ ID NO: 250773 - DNA, 20 bp, Artificial Sequence
  Description of Artificial Sequence: Synthetic oligonucleotide
  Target: ATXN1; (+) strand; PAM type: YTN; PAM sequence: TTT
tcttttataaaacaggaagg

SEQ ID NO: 250774 - DNA, 20 bp, Artificial Sequence
  Description of Artificial Sequence: Synthetic oligonucleotide
  Target: ATXN1; (+) strand; PAM type: YTN; PAM sequence: TTT
cttttataaaacaggaagga

SEQ ID NO: 250775 - DNA, 20 bp, Artificial Sequence
  Description of Artificial Sequence: Synthetic oligonucleotide
  Target: ATXN1; (+) strand; PAM type: YTN; PAM sequence: TTC
ttttataaaacaggaaggaa

SEQ ID NO: 250776 - DNA, 20 bp, Artificial Sequence
  Description of Artificial Sequence: Synthetic oligonucleotide
  Target: ATXN1; (+) strand; PAM type: YTN; PAM sequence: CTT
ttataaaacaggaaggaata

SEQ ID NO: 250777 - DNA, 20 bp, Artificial Sequence
  Description of Artificial Sequence: Synthetic oligonucleotide
  Target: ATXN1; (+) strand; PAM type: YTN; PAM sequence: TTT
tataaaacaggaaggaatat

SEQ ID NO: 250778 - DNA, 20 bp, Artificial Sequence
  Description of Artificial Sequence: Synthetic oligonucleotide
  Target: ATXN1; (+) strand; PAM type: YTN; PAM sequence: TTT
ataaaacaggaaggaatatt

SEQ ID NO: 250779 - DNA, 20 bp, Artificial Sequence
  Description of Artificial Sequence: Synthetic oligonucleotide
  Target: ATXN1; (+) strand; PAM type: YTN; PAM sequence: TTA
taaaacaggaaggaatatta

SEQ ID NO: 250780 - DNA, 20 bp, Artificial Sequence
  Description of Artificial Sequence: Synthetic oligonucleotide
  Target: ATXN1; (+) strand; PAM type: YTN; PAM sequence: TTA
gaaacacaggaagttgaaca

SEQ ID NO: 250781 - DNA, 20 bp, Artificial Sequence
  Description of Artificial Sequence: Synthetic oligonucleotide
  Target: ATXN1; (+) strand; PAM type: YTN; PAM sequence: TTG
aacatctcagtaaatgccaa

SEQ ID NO: 250782 - DNA, 20 bp, Artificial Sequence
  Description of Artificial Sequence: Synthetic oligonucleotide
  Target: ATXN1; (+) strand; PAM type: YTN; PAM sequence: CTC
agtaaatgccaagaaggaga

SEQ ID NO: 250783 - DNA, 20 bp, Artificial Sequence
  Description of Artificial Sequence: Synthetic oligonucleotide
  Target: ATXN1; (+) strand; PAM type: YTN; PAM sequence: TTG
tgccttggaggaaaggttgg

SEQ ID NO: 250784 - DNA, 20 bp, Artificial Sequence
  Description of Artificial Sequence: Synthetic oligonucleotide
  Target: ATXN1; (+) strand; PAM type: YTN; PAM sequence: CTT
ggaggaaaggttggcatgga

SEQ ID NO: 250785 - DNA, 20 bp, Artificial Sequence
  Description of Artificial Sequence: Synthetic oligonucleotide
  Target: ATXN1; (+) strand; PAM type: YTN; PAM sequence: TTG
gaggaaaggttggcatggag

SEQ ID NO: 250786 - DNA, 20 bp, Artificial Sequence
  Description of Artificial Sequence: Synthetic oligonucleotide
  Target: ATXN1; (+) strand; PAM type: YTN; PAM sequence: TTG
gcatggagccagtatccttc

SEQ ID NO: 250787 - DNA, 20 bp, Artificial Sequence
  Description of Artificial Sequence: Synthetic oligonucleotide
  Target: ATXN1; (+) strand; PAM type: YTN; PAM sequence: CTT
ctgtgcccttggtctcacca

SEQ ID NO: 250788 - DNA, 20 bp, Artificial Sequence
  Description of Artificial Sequence: Synthetic oligonucleotide
  Target: ATXN1; (+) strand; PAM type: YTN; PAM sequence: TTC
tgtgcccttggtctcaccag

SEQ ID NO: 250789 - DNA, 20 bp, Artificial Sequence
  Description of Artificial Sequence: Synthetic oligonucleotide
  Target: ATXN1; (+) strand; PAM type: YTN; PAM sequence: CTG
tgcccttggtctcaccagac

SEQ ID NO: 250790 - DNA, 20 bp, Artificial Sequence
  Description of Artificial Sequence: Synthetic oligonucleotide
  Target: ATXN1; (+) strand; PAM type: YTN; PAM sequence: CTT
ggtctcaccagacccagggc

SEQ ID NO: 250791 - DNA, 20 bp, Artificial Sequence
  Description of Artificial Sequence: Synthetic oligonucleotide
  Target: ATXN1; (+) strand; PAM type: YTN; PAM sequence: TTG
gtctcaccagacccagggcc

SEQ ID NO: 250792 - DNA, 20 bp, Artificial Sequence
  Description of Artificial Sequence: Synthetic oligonucleotide
  Target: ATXN1; (+) strand; PAM type: YTN; PAM sequence: CTC
accagacccagggccagacc

SEQ ID NO: 250793 - DNA, 20 bp, Artificial Sequence
  Description of Artificial Sequence: Synthetic oligonucleotide
  Target: ATXN1; (+) strand; PAM type: YTN; PAM sequence: TTA
aaagaagccagagatatgga

SEQ ID NO: 250794 - DNA, 20 bp, Artificial Sequence
  Description of Artificial Sequence: Synthetic oligonucleotide
  Target: ATXN1; (+) strand; PAM type: YTN; PAM sequence: TTG
agagggaacagaaaagaagt

SEQ ID NO: 250795 - DNA, 20 bp, Artificial Sequence
  Description of Artificial Sequence: Synthetic oligonucleotide
  Target: ATXN1; (+) strand; PAM type: YTN; PAM sequence: TTG
gtgggtgagctgtggagaaa

SEQ ID NO: 250796 - DNA, 20 bp, Artificial Sequence
  Description of Artificial Sequence: Synthetic oligonucleotide
  Target: ATXN1; (+) strand; PAM type: YTN; PAM sequence: CTG
tggagaaactgcaaaccgag

SEQ ID NO: 250797 - DNA, 20 bp, Artificial Sequence
  Description of Artificial Sequence: Synthetic oligonucleotide
  Target: ATXN1; (+) strand; PAM type: YTN; PAM sequence: CTG
caaaccgagtgaaagccctc

SEQ ID NO: 250798 - DNA, 20 bp, Artificial Sequence
  Description of Artificial Sequence: Synthetic oligonucleotide
  Target: ATXN1; (+) strand; PAM type: YTN; PAM sequence: CTC
taacactgaaatgcaataag

SEQ ID NO: 250799 - DNA, 20 bp, Artificial Sequence
  Description of Artificial Sequence: Synthetic oligonucleotide
  Target: ATXN1; (+) strand; PAM type: YTN; PAM sequence: CTA
acactgaaatgcaataagac

SEQ ID NO: 250800 - DNA, 20 bp, Artificial Sequence
  Description of Artificial Sequence: Synthetic oligonucleotide
  Target: ATXN1; (+) strand; PAM type: YTN; PAM sequence: CTG
aaatgcaataagactgcatt

SEQ ID NO: 250801 - DNA, 20 bp, Artificial Sequence
  Description of Artificial Sequence: Synthetic oligonucleotide
  Target: ATXN1; (+) strand; PAM type: YTN; PAM sequence: CTG
cattactccatcccatgctc

SEQ ID NO: 250802 - DNA, 20 bp, Artificial Sequence
  Description of Artificial Sequence: Synthetic oligonucleotide
  Target: ATXN1; (+) strand; PAM type: YTN; PAM sequence: TTA
ctccatcccatgctcagccc

SEQ ID NO: 250803 - DNA, 20 bp, Artificial Sequence
  Description of Artificial Sequence: Synthetic oligonucleotide
  Target: ATXN1; (+) strand; PAM type: YTN; PAM sequence: CTC
catcccatgctcagccccaa

SEQ ID NO: 250804 - DNA, 20 bp, Artificial Sequence
  Description of Artificial Sequence: Synthetic oligonucleotide
  Target: ATXN1; (+) strand; PAM type: YTN; PAM sequence: CTC
agccccaaccatgcccattt

SEQ ID NO: 250805 - DNA, 20 bp, Artificial Sequence
  Description of Artificial Sequence: Synthetic oligonucleotide
  Target: ATXN1; (+) strand; PAM type: YTN; PAM sequence: TTT
ggataaaatggattccattt

SEQ ID NO: 250806 - DNA, 20 bp, Artificial Sequence
  Description of Artificial Sequence: Synthetic oligonucleotide
  Target: ATXN1; (+) strand; PAM type: YTN; PAM sequence: TTG
gataaaatggattccatttg

SEQ ID NO: 250807 - DNA, 20 bp, Artificial Sequence
  Description of Artificial Sequence: Synthetic oligonucleotide
  Target: ATXN1; (+) strand; PAM type: YTN; PAM sequence: TTC
catttggtaatggttggcaa

SEQ ID NO: 250808 - DNA, 20 bp, Artificial Sequence
  Description of Artificial Sequence: Synthetic oligonucleotide
  Target: ATXN1; (+) strand; PAM type: YTN; PAM sequence: TTT
ggtaatggttggcaataact

SEQ ID NO: 250809 - DNA, 20 bp, Artificial Sequence
  Description of Artificial Sequence: Synthetic oligonucleotide
  Target: ATXN1; (+) strand; PAM type: YTN; PAM sequence: TTG
gtaatggttggcaataactg

SEQ ID NO: 250810 - DNA, 20 bp, Artificial Sequence
  Description of Artificial Sequence: Synthetic oligonucleotide
  Target: ATXN1; (+) strand; PAM type: YTN; PAM sequence: TTG
gcaataactgtcatttctga

SEQ ID NO: 250811 - DNA, 20 bp, Artificial Sequence
  Description of Artificial Sequence: Synthetic oligonucleotide
  Target: ATXN1; (+) strand; PAM type: YTN; PAM sequence: CTG
tcatttctgaaatgccaagg

SEQ ID NO: 250812 - DNA, 20 bp, Artificial Sequence
  Description of Artificial Sequence: Synthetic oligonucleotide
  Target: ATXN1; (+) strand; PAM type: YTN; PAM sequence: TTT
ctgaaatgccaagggcccac

SEQ ID NO: 250813 - DNA, 20 bp, Artificial Sequence
  Description of Artificial Sequence: Synthetic oligonucleotide
  Target: ATXN1; (+) strand; PAM type: YTN; PAM sequence: TTC
tgaaatgccaagggcccaca

SEQ ID NO: 250814 - DNA, 20 bp, Artificial Sequence
  Description of Artificial Sequence: Synthetic oligonucleotide
  Target: ATXN1; (+) strand; PAM type: YTN; PAM sequence: CTG
aaatgccaagggcccacata

SEQ ID NO: 250815 - DNA, 20 bp, Artificial Sequence
  Description of Artificial Sequence: Synthetic oligonucleotide
  Target: ATXN1; (+) strand; PAM type: YTN; PAM sequence: TTG
acacctttatagtagtattt

SEQ ID NO: 250816 - DNA, 20 bp, Artificial Sequence
  Description of Artificial Sequence: Synthetic oligonucleotide
  Target: ATXN1; (+) strand; PAM type: YTN; PAM sequence: CTT
tatagtagtatttatagctc

SEQ ID NO: 250817 - DNA, 20 bp, Artificial Sequence
  Description of Artificial Sequence: Synthetic oligonucleotide
  Target: ATXN1; (+) strand; PAM type: YTN; PAM sequence: TTT
atagtagtatttatagctca

SEQ ID NO: 250818 - DNA, 20 bp, Artificial Sequence
  Description of Artificial Sequence: Synthetic oligonucleotide
  Target: ATXN1; (+) strand; PAM type: YTN; PAM sequence: TTA
tagtagtatttatagctcag

SEQ ID NO: 250819 - DNA, 20 bp, Artificial Sequence
  Description of Artificial Sequence: Synthetic oligonucleotide
  Target: ATXN1; (+) strand; PAM type: YTN; PAM sequence: TTT
atagctcagacactttaaaa

SEQ ID NO: 250820 - DNA, 20 bp, Artificial Sequence
  Description of Artificial Sequence: Synthetic oligonucleotide
  Target: ATXN1; (+) strand; PAM type: YTN; PAM sequence: TTA
tagctcagacactttaaaac

SEQ ID NO: 250821 - DNA, 20 bp, Artificial Sequence
  Description of Artificial Sequence: Synthetic oligonucleotide
  Target: ATXN1; (+) strand; PAM type: YTN; PAM sequence: CTC
agacactttaaaacatgact

SEQ ID NO: 250822 - DNA, 20 bp, Artificial Sequence
  Description of Artificial Sequence: Synthetic oligonucleotide
  Target: ATXN1; (+) strand; PAM type: YTN; PAM sequence: CTT
taaaacatgactgtgggctg

SEQ ID NO: 250823 - DNA, 20 bp, Artificial Sequence
  Description of Artificial Sequence: Synthetic oligonucleotide
  Target: ATXN1; (+) strand; PAM type: YTN; PAM sequence: TTT
aaaacatgactgtgggctgg

SEQ ID NO: 250824 - DNA, 20 bp, Artificial Sequence
  Description of Artificial Sequence: Synthetic oligonucleotide
  Target: ATXN1; (+) strand; PAM type: YTN; PAM sequence: TTA
aaacatgactgtgggctggg

SEQ ID NO: 250825 - DNA, 20 bp, Artificial Sequence
  Description of Artificial Sequence: Synthetic oligonucleotide
  Target: ATXN1; (+) strand; PAM type: YTN; PAM sequence: CTG
tgggctgggcacagtggctc

SEQ ID NO: 250826 - DNA, 20 bp, Artificial Sequence
  Description of Artificial Sequence: Synthetic oligonucleotide
  Target: ATXN1; (+) strand; PAM type: YTN; PAM sequence: CTG
ggcacagtggctcatgtctg

SEQ ID NO: 250827 - DNA, 20 bp, Artificial Sequence
  Description of Artificial Sequence: Synthetic oligonucleotide
  Target: ATXN1; (+) strand; PAM type: YTN; PAM sequence: CTC
atgtctgtaatccaagctct

SEQ ID NO: 250828 - DNA, 20 bp, Artificial Sequence
  Description of Artificial Sequence: Synthetic oligonucleotide
  Target: ATXN1; (+) strand; PAM type: YTN; PAM sequence: CTG
taatccaagctctttgggag

SEQ ID NO: 250829 - DNA, 20 bp, Artificial Sequence
  Description of Artificial Sequence: Synthetic oligonucleotide
  Target: ATXN1; (+) strand; PAM type: YTN; PAM sequence: CTC
tttgggagtctgaggcagaa

SEQ ID NO: 250830 - DNA, 20 bp, Artificial Sequence
  Description of Artificial Sequence: Synthetic oligonucleotide
  Target: ATXN1; (+) strand; PAM type: YTN; PAM sequence: CTT
tgggagtctgaggcagaagg

SEQ ID NO: 250831 - DNA, 20 bp, Artificial Sequence
  Description of Artificial Sequence: Synthetic oligonucleotide
  Target: ATXN1; (+) strand; PAM type: YTN; PAM sequence: TTT
gggagtctgaggcagaagga

SEQ ID NO: 250832 - DNA, 20 bp, Artificial Sequence
  Description of Artificial Sequence: Synthetic oligonucleotide
  Target: ATXN1; (+) strand; PAM type: YTN; PAM sequence: TTG
ggagtctgaggcagaaggat

SEQ ID NO: 250833 - DNA, 20 bp, Artificial Sequence
  Description of Artificial Sequence: Synthetic oligonucleotide
  Target: ATXN1; (+) strand; PAM type: YTN; PAM sequence: CTG
aggcagaaggatcacttgag

SEQ ID NO: 250834 - DNA, 20 bp, Artificial Sequence
  Description of Artificial Sequence: Synthetic oligonucleotide
  Target: ATXN1; (+) strand; PAM type: YTN; PAM sequence: CTT
gagcccaggagtttgagacc

SEQ ID NO: 250835 - DNA, 20 bp, Artificial Sequence
  Description of Artificial Sequence: Synthetic oligonucleotide
  Target: ATXN1; (+) strand; PAM type: YTN; PAM sequence: TTG
agcccaggagtttgagacca

SEQ ID NO: 250836 - DNA, 20 bp, Artificial Sequence
  Description of Artificial Sequence: Synthetic oligonucleotide
  Target: ATXN1; (+) strand; PAM type: YTN; PAM sequence: TTT
gagaccagcctgggcaaccc

SEQ ID NO: 250837 - DNA, 20 bp, Artificial Sequence
  Description of Artificial Sequence: Synthetic oligonucleotide
  Target: ATXN1; (+) strand; PAM type: YTN; PAM sequence: TTG
agaccagcctgggcaaccca

SEQ ID NO: 250838 - DNA, 20 bp, Artificial Sequence
  Description of Artificial Sequence: Synthetic oligonucleotide
  Target: ATXN1; (+) strand; PAM type: YTN; PAM sequence: CTG
ggcaacccagtgagaactca

SEQ ID NO: 250839 - DNA, 20 bp, Artificial Sequence
  Description of Artificial Sequence: Synthetic oligonucleotide
  Target: ATXN1; (+) strand; PAM type: YTN; PAM sequence: CTC
atctctacaaaaaaaaggta

SEQ ID NO: 250840 - DNA, 20 bp, Artificial Sequence
  Description of Artificial Sequence: Synthetic oligonucleotide
  Target: ATXN1; (+) strand; PAM type: YTN; PAM sequence: CTC
tacaaaaaaaaggtaaaaat

SEQ ID NO: 250841 - DNA, 20 bp, Artificial Sequence
  Description of Artificial Sequence: Synthetic oligonucleotide
  Target: ATXN1; (+) strand; PAM type: YTN; PAM sequence: CTA
caaaaaaaaggtaaaaatta

SEQ ID NO: 250842 - DNA, 20 bp, Artificial Sequence
  Description of Artificial Sequence: Synthetic oligonucleotide
  Target: ATXN1; (+) strand; PAM type: YTN; PAM sequence: TTA
gctgggcgtggtggcacatg

SEQ ID NO: 250843 - DNA, 20 bp, Artificial Sequence
  Description of Artificial Sequence: Synthetic oligonucleotide
  Target: ATXN1; (+) strand; PAM type: YTN; PAM sequence: CTG
ggcgtggtggcacatgtcta

SEQ ID NO: 250844 - DNA, 20 bp, Artificial Sequence
  Description of Artificial Sequence: Synthetic oligonucleotide
  Target: ATXN1; (+) strand; PAM type: YTN; PAM sequence: CTA
tagtccttgctactagggag

SEQ ID NO: 250845 - DNA, 20 bp, Artificial Sequence
  Description of Artificial Sequence: Synthetic oligonucleotide
  Target: ATXN1; (+) strand; PAM type: YTN; PAM sequence: CTT
gctactagggaggctgaggc

SEQ ID NO: 250846 - DNA, 20 bp, Artificial Sequence
  Description of Artificial Sequence: Synthetic oligonucleotide
  Target: ATXN1; (+) strand; PAM type: YTN; PAM sequence: TTG
ctactagggaggctgaggca

SEQ ID NO: 250847 - DNA, 20 bp, Artificial Sequence
  Description of Artificial Sequence: Synthetic oligonucleotide
  Target: ATXN1; (+) strand; PAM type: YTN; PAM sequence: CTA
ctagggaggctgaggcagga

SEQ ID NO: 250848 - DNA, 20 bp, Artificial Sequence
  Description of Artificial Sequence: Synthetic oligonucleotide
  Target: ATXN1; (+) strand; PAM type: YTN; PAM sequence: CTA
gggaggctgaggcaggagga

SEQ ID NO: 250849 - DNA, 20 bp, Artificial Sequence
  Description of Artificial Sequence: Synthetic oligonucleotide
  Target: ATXN1; (+) strand; PAM type: YTN; PAM sequence: CTG
aggcaggaggatcacttgag

SEQ ID NO: 250850 - DNA, 20 bp, Artificial Sequence
  Description of Artificial Sequence: Synthetic oligonucleotide
  Target: ATXN1; (+) strand; PAM type: YTN; PAM sequence: CTT
gagcctgggagacagaggct

SEQ ID NO: 250851 - DNA, 20 bp, Artificial Sequence
  Description of Artificial Sequence: Synthetic oligonucleotide
  Target: ATXN1; (+) strand; PAM type: YTN; PAM sequence: TTG
agcctgggagacagaggcta

SEQ ID NO: 250852 - DNA, 20 bp, Artificial Sequence
  Description of Artificial Sequence: Synthetic oligonucleotide
  Target: ATXN1; (+) strand; PAM type: YTN; PAM sequence: CTG
ggagacagaggctataggga

SEQ ID NO: 250853 - DNA, 20 bp, Artificial Sequence
  Description of Artificial Sequence: Synthetic oligonucleotide
  Target: ATXN1; (+) strand; PAM type: YTN; PAM sequence: CTA
tagggagctgtgattgcaca

SEQ ID NO: 250854 - DNA, 20 bp, Artificial Sequence
  Description of Artificial Sequence: Synthetic oligonucleotide
  Target: ATXN1; (+) strand; PAM type: YTN; PAM sequence: CTG
tgattgcacactgcactcca

SEQ ID NO: 250855 - DNA, 20 bp, Artificial Sequence
  Description of Artificial Sequence: Synthetic oligonucleotide
  Target: ATXN1; (+) strand; PAM type: YTN; PAM sequence: TTG
cacactgcactccagctgga

SEQ ID NO: 250856 - DNA, 20 bp, Artificial Sequence
  Description of Artificial Sequence: Synthetic oligonucleotide
  Target: ATXN1; (+) strand; PAM type: YTN; PAM sequence: CTG
cactccagctggacagcaaa

SEQ ID NO: 250857 - DNA, 20 bp, Artificial Sequence
  Description of Artificial Sequence: Synthetic oligonucleotide
  Target: ATXN1; (+) strand; PAM type: YTN; PAM sequence: CTC
cagctggacagcaaagtgag

SEQ ID NO: 250858 - DNA, 20 bp, Artificial Sequence
  Description of Artificial Sequence: Synthetic oligonucleotide
  Target: ATXN1; (+) strand; PAM type: YTN; PAM sequence: CTG
gacagcaaagtgagacactg

SEQ ID NO: 250859 - DNA, 20 bp, Artificial Sequence
  Description of Artificial Sequence: Synthetic oligonucleotide
  Target: ATXN1; (+) strand; PAM type: YTN; PAM sequence: CTG
tatcaaaataaataaataaa

SEQ ID NO: 250860 - DNA, 20 bp, Artificial Sequence
  Description of Artificial Sequence: Synthetic oligonucleotide
  Target: ATXN1; (+) strand; PAM type: YTN; PAM sequence: CTG
tggtagagtagagaatgtag

SEQ ID NO: 250861 - DNA, 20 bp, Artificial Sequence
  Description of Artificial Sequence: Synthetic oligonucleotide
  Target: ATXN1; (+) strand; PAM type: YTN; PAM sequence: TTT
atgtggtaggaaggggacat

SEQ ID NO: 250862 - DNA, 20 bp, Artificial Sequence
  Description of Artificial Sequence: Synthetic oligonucleotide
  Target: ATXN1; (+) strand; PAM type: YTN; PAM sequence: TTA
tgtggtaggaaggggacatg

SEQ ID NO: 250863 - DNA, 20 bp, Artificial Sequence
  Description of Artificial Sequence: Synthetic oligonucleotide
  Target: ATXN1; (+) strand; PAM type: YTN; PAM sequence: TTG
aacaagaggcccaagtggag

SEQ ID NO: 250864 - DNA, 20 bp, Artificial Sequence
  Description of Artificial Sequence: Synthetic oligonucleotide
  Target: ATXN1; (+) strand; PAM type: YTN; PAM sequence: CTG
ttaactccatggaggaggtt

SEQ ID NO: 250865 - DNA, 20 bp, Artificial Sequence
  Description of Artificial Sequence: Synthetic oligonucleotide
  Target: ATXN1; (+) strand; PAM type: YTN; PAM sequence: TTA
actccatggaggaggtttct

SEQ ID NO: 250866 - DNA, 20 bp, Artificial Sequence
  Description of Artificial Sequence: Synthetic oligonucleotide
  Target: ATXN1; (+) strand; PAM type: YTN; PAM sequence: CTC
catggaggaggtttctgggg

SEQ ID NO: 250867 - DNA, 20 bp, Artificial Sequence
  Description of Artificial Sequence: Synthetic oligonucleotide
  Target: ATXN1; (+) strand; PAM type: YTN; PAM sequence: TTT
ctggggatgtcccaggccat

SEQ ID NO: 250868 - DNA, 20 bp, Artificial Sequence
  Description of Artificial Sequence: Synthetic oligonucleotide
  Target: ATXN1; (+) strand; PAM type: YTN; PAM sequence: TTC
tggggatgtcccaggccatg

SEQ ID NO: 250869 - DNA, 20 bp, Artificial Sequence
  Description of Artificial Sequence: Synthetic oligonucleotide
  Target: ATXN1; (+) strand; PAM type: YTN; PAM sequence: CTG
gggatgtcccaggccatgtt

SEQ ID NO: 250870 - DNA, 20 bp, Artificial Sequence
  Description of Artificial Sequence: Synthetic oligonucleotide
  Target: ATXN1; (+) strand; PAM type: YTN; PAM sequence: TTG
cctgagaacatgtctgcctg

SEQ ID NO: 250871 - DNA, 20 bp, Artificial Sequence
  Description of Artificial Sequence: Synthetic oligonucleotide
  Target: ATXN1; (+) strand; PAM type: YTN; PAM sequence: CTG
agaacatgtctgcctgagac

SEQ ID NO: 250872 - DNA, 20 bp, Artificial Sequence
  Description of Artificial Sequence: Synthetic oligonucleotide
  Target: ATXN1; (+) strand; PAM type: YTN; PAM sequence: CTG
cctgagactcattctattcc

SEQ ID NO: 250873 - DNA, 20 bp, Artificial Sequence
  Description of Artificial Sequence: Synthetic oligonucleotide
  Target: ATXN1; (+) strand; PAM type: YTN; PAM sequence: CTG
agactcattctattcctgaa

SEQ ID NO: 250874 - DNA, 20 bp, Artificial Sequence
  Description of Artificial Sequence: Synthetic oligonucleotide
  Target: ATXN1; (+) strand; PAM type: YTN; PAM sequence: CTC
attctattcctgaaagtctg

SEQ ID NO: 250875 - DNA, 20 bp, Artificial Sequence
  Description of Artificial Sequence: Synthetic oligonucleotide
  Target: ATXN1; (+) strand; PAM type: YTN; PAM sequence: TTC
tattcctgaaagtctgaaac

SEQ ID NO: 250876 - DNA, 20 bp, Artificial Sequence
  Description of Artificial Sequence: Synthetic oligonucleotide
  Target: ATXN1; (+) strand; PAM type: YTN; PAM sequence: CTA
ttcctgaaagtctgaaacca

SEQ ID NO: 250877 - DNA, 20 bp, Artificial Sequence
  Description of Artificial Sequence: Synthetic oligonucleotide
  Target: ATXN1; (+) strand; PAM type: YTN; PAM sequence: TTC
ctgaaagtctgaaaccatca

SEQ ID NO: 250878 - DNA, 20 bp, Artificial Sequence
  Description of Artificial Sequence: Synthetic oligonucleotide
  Target: ATXN1; (+) strand; PAM type: YTN; PAM sequence: CTG
aaagtctgaaaccatcagtt

SEQ ID NO: 250879 - DNA, 20 bp, Artificial Sequence
  Description of Artificial Sequence: Synthetic oligonucleotide
  Target: ATXN1; (+) strand; PAM type: YTN; PAM sequence: CTG
aaaccatcagttgtattctt

SEQ ID NO: 250880 - DNA, 20 bp, Artificial Sequence
  Description of Artificial Sequence: Synthetic oligonucleotide
  Target: ATXN1; (+) strand; PAM type: YTN; PAM sequence: TTG
tattcttacattgattatgg

SEQ ID NO: 250881 - DNA, 20 bp, Artificial Sequence
  Description of Artificial Sequence: Synthetic oligonucleotide
  Target: ATXN1; (+) strand; PAM type: YTN; PAM sequence: TTC
ttacattgattatggttcaa

SEQ ID NO: 250882 - DNA, 20 bp, Artificial Sequence
  Description of Artificial Sequence: Synthetic oligonucleotide
  Target: ATXN1; (+) strand; PAM type: YTN; PAM sequence: CTT
acattgattatggttcaatg

SEQ ID NO: 250883 - DNA, 20 bp, Artificial Sequence
  Description of Artificial Sequence: Synthetic oligonucleotide
  Target: ATXN1; (+) strand; PAM type: YTN; PAM sequence: TTA
cattgattatggttcaatgg

SEQ ID NO: 250884 - DNA, 20 bp, Artificial Sequence
  Description of Artificial Sequence: Synthetic oligonucleotide
  Target: ATXN1; (+) strand; PAM type: YTN; PAM sequence: TTG
attatggttcaatggtatgg

SEQ ID NO: 250885 - DNA, 20 bp, Artificial Sequence
  Description of Artificial Sequence: Synthetic oligonucleotide
  Target: ATXN1; (+) strand; PAM type: YTN; PAM sequence: TTA
tggttcaatggtatggtttc

SEQ ID NO: 250886 - DNA, 20 bp, Artificial Sequence
  Description of Artificial Sequence: Synthetic oligonucleotide
  Target: ATXN1; (+) strand; PAM type: YTN; PAM sequence: TTC
aatggtatggtttctccgta

SEQ ID NO: 250887 - DNA, 20 bp, Artificial Sequence
  Description of Artificial Sequence: Synthetic oligonucleotide
  Target: ATXN1; (+) strand; PAM type: YTN; PAM sequence: TTT
ctccgtataaacgtcctggc

SEQ ID NO: 250888 - DNA, 20 bp, Artificial Sequence
  Description of Artificial Sequence: Synthetic oligonucleotide
  Target: ATXN1; (+) strand; PAM type: YTN; PAM sequence: TTC
tccgtataaacgtcctggcc

SEQ ID NO: 250889 - DNA, 20 bp, Artificial Sequence
  Description of Artificial Sequence: Synthetic oligonucleotide
  Target: ATXN1; (+) strand; PAM type: YTN; PAM sequence: CTC
cgtataaacgtcctggccac

SEQ ID NO: 250890 - DNA, 20 bp, Artificial Sequence
  Description of Artificial Sequence: Synthetic oligonucleotide
  Target: ATXN1; (+) strand; PAM type: YTN; PAM sequence: CTG
gccaccatttagaaatgatc

SEQ ID NO: 250891 - DNA, 20 bp, Artificial Sequence
  Description of Artificial Sequence: Synthetic oligonucleotide
  Target: ATXN1; (+) strand; PAM type: YTN; PAM sequence: TTT
agaaatgatccataatttct

SEQ ID NO: 250892 - DNA, 20 bp, Artificial Sequence
  Description of Artificial Sequence: Synthetic oligonucleotide
  Target: ATXN1; (+) strand; PAM type: YTN; PAM sequence: TTA
gaaatgatccataatttctt

SEQ ID NO: 250893 - DNA, 20 bp, Artificial Sequence
  Description of Artificial Sequence: Synthetic oligonucleotide
  Target: ATXN1; (+) strand; PAM type: YTN; PAM sequence: TTT
cttgtttgggtcttagtttt

SEQ ID NO: 250894 - DNA, 20 bp, Artificial Sequence
  Description of Artificial Sequence: Synthetic oligonucleotide
  Target: ATXN1; (+) strand; PAM type: YTN; PAM sequence: TTC
ttgtttgggtcttagttttt

SEQ ID NO: 250895 - DNA, 20 bp, Artificial Sequence
  Description of Artificial Sequence: Synthetic oligonucleotide
  Target: ATXN1; (+) strand; PAM type: YTN; PAM sequence: CTT
gtttgggtcttagtttttcc

SEQ ID NO: 250896 - DNA, 20 bp, Artificial Sequence
  Description of Artificial Sequence: Synthetic oligonucleotide
  Target: ATXN1; (+) strand; PAM type: YTN; PAM sequence: TTG
tttgggtcttagtttttcca

SEQ ID NO: 250897 - DNA, 20 bp, Artificial Sequence
  Description of Artificial Sequence: Synthetic oligonucleotide
  Target: ATXN1; (+) strand; PAM type: YTN; PAM sequence: TTT
gggtcttagtttttccactt

SEQ ID NO: 250898 - DNA, 20 bp, Artificial Sequence
  Description of Artificial Sequence: Synthetic oligonucleotide
  Target: ATXN1; (+) strand; PAM type: YTN; PAM sequence: TTG
ggtcttagtttttccactta

SEQ ID NO: 250899 - DNA, 20 bp, Artificial Sequence
  Description of Artificial Sequence: Synthetic oligonucleotide
  Target: ATXN1; (+) strand; PAM type: YTN; PAM sequence: CTT
agtttttccacttatacaat

SEQ ID NO: 250900 - DNA, 20 bp, Artificial Sequence
  Description of Artificial Sequence: Synthetic oligonucleotide
  Target: ATXN1; (+) strand; PAM type: YTN; PAM sequence: TTA
gtttttccacttatacaatt

SEQ ID NO: 250901 - DNA, 20 bp, Artificial Sequence
  Description of Artificial Sequence: Synthetic oligonucleotide
  Target: ATXN1; (+) strand; PAM type: YTN; PAM sequence: TTT
ttccacttatacaatttttt

SEQ ID NO: 250902 - DNA, 20 bp, Artificial Sequence
  Description of Artificial Sequence: Synthetic oligonucleotide
  Target: ATXN1; (+) strand; PAM type: YTN; PAM sequence: TTT
tccacttatacaatttttta

SEQ ID NO: 250903 - DNA, 20 bp, Artificial Sequence
  Description of Artificial Sequence: Synthetic oligonucleotide
  Target: ATXN1; (+) strand; PAM type: YTN; PAM sequence: TTT
ccacttatacaattttttac

SEQ ID NO: 250904 - DNA, 20 bp, Artificial Sequence
  Description of Artificial Sequence: Synthetic oligonucleotide
  Target: ATXN1; (+) strand; PAM type: YTN; PAM sequence: TTC
cacttatacaattttttact

SEQ ID NO: 250905 - DNA, 20 bp, Artificial Sequence
  Description of Artificial Sequence: Synthetic oligonucleotide
  Target: ATXN1; (+) strand; PAM type: YTN; PAM sequence: CTT
atacaattttttacttattt

SEQ ID NO: 250906 - DNA, 20 bp, Artificial Sequence
  Description of Artificial Sequence: Synthetic oligonucleotide
  Target: ATXN1; (+) strand; PAM type: YTN; PAM sequence: TTA
tacaattttttacttatttt

SEQ ID NO: 250907 - DNA, 20 bp, Artificial Sequence
  Description of Artificial Sequence: Synthetic oligonucleotide
  Target: ATXN1; (+) strand; PAM type: YTN; PAM sequence: TTT
tttacttattttattttcta

SEQ ID NO: 250908 - DNA, 20 bp, Artificial Sequence
  Description of Artificial Sequence: Synthetic oligonucleotide
  Target: ATXN1; (+) strand; PAM type: YTN; PAM sequence: TTT
ttacttattttattttctat

SEQ ID NO: 250909 - DNA, 20 bp, Artificial Sequence
  Description of Artificial Sequence: Synthetic oligonucleotide
  Target: ATXN1; (+) strand; PAM type: YTN; PAM sequence: TTT
tacttattttattttctatc

SEQ ID NO: 250910 - DNA, 20 bp, Artificial Sequence
  Description of Artificial Sequence: Synthetic oligonucleotide
  Target: ATXN1; (+) strand; PAM type: YTN; PAM sequence: TTT
acttattttattttctatct

SEQ ID NO: 250911 - DNA, 20 bp, Artificial Sequence
  Description of Artificial Sequence: Synthetic oligonucleotide
  Target: ATXN1; (+) strand; PAM type: YTN; PAM sequence: TTA
cttattttattttctatctg

SEQ ID NO: 250912 - DNA, 20 bp, Artificial Sequence
  Description of Artificial Sequence: Synthetic oligonucleotide
  Target: ATXN1; (+) strand; PAM type: YTN; PAM sequence: CTT
attttattttctatctgctt

SEQ ID NO: 250913 - DNA, 20 bp, Artificial Sequence
  Description of Artificial Sequence: Synthetic oligonucleotide
  Target: ATXN1; (+) strand; PAM type: YTN; PAM sequence: TTA
ttttattttctatctgcttc

SEQ ID NO: 250914 - DNA, 20 bp, Artificial Sequence
  Description of Artificial Sequence: Synthetic oligonucleotide
  Target: ATXN1; (+) strand; PAM type: YTN; PAM sequence: TTT
tattttctatctgcttcacg

SEQ ID NO: 250915 - DNA, 20 bp, Artificial Sequence
  Description of Artificial Sequence: Synthetic oligonucleotide
  Target: ATXN1; (+) strand; PAM type: YTN; PAM sequence: TTT
attttctatctgcttcacgg

SEQ ID NO: 250916 - DNA, 20 bp, Artificial Sequence
  Description of Artificial Sequence: Synthetic oligonucleotide
  Target: ATXN1; (+) strand; PAM type: YTN; PAM sequence: TTA
ttttctatctgcttcacggg

SEQ ID NO: 250917 - DNA, 20 bp, Artificial Sequence
  Description of Artificial Sequence: Synthetic oligonucleotide
  Target: ATXN1; (+) strand; PAM type: YTN; PAM sequence: TTT
tctatctgcttcacgggcat

SEQ ID NO: 250918 - DNA, 20 bp, Artificial Sequence
  Description of Artificial Sequence: Synthetic oligonucleotide
  Target: ATXN1; (+) strand; PAM type: YTN; PAM sequence: TTT
ctatctgcttcacgggcata

SEQ ID NO: 250919 - DNA, 20 bp, Artificial Sequence
  Description of Artificial Sequence: Synthetic oligonucleotide
  Target: ATXN1; (+) strand; PAM type: YTN; PAM sequence: TTC
tatctgcttcacgggcatat

SEQ ID NO: 250920 - DNA, 20 bp, Artificial Sequence
  Description of Artificial Sequence: Synthetic oligonucleotide
  Target: ATXN1; (+) strand; PAM type: YTN; PAM sequence: CTA
tctgcttcacgggcatatta

SEQ ID NO: 250921 - DNA, 20 bp, Artificial Sequence
  Description of Artificial Sequence: Synthetic oligonucleotide
  Target: ATXN1; (+) strand; PAM type: YTN; PAM sequence: CTG
cttcacgggcatattaatgt

SEQ ID NO: 250922 - DNA, 20 bp, Artificial Sequence
  Description of Artificial Sequence: Synthetic oligonucleotide
  Target: ATXN1; (+) strand; PAM type: YTN; PAM sequence: CTT
cacgggcatattaatgtgta

SEQ ID NO: 250923 - DNA, 20 bp, Artificial Sequence
  Description of Artificial Sequence: Synthetic oligonucleotide
  Target: ATXN1; (+) strand; PAM type: YTN; PAM sequence: TTC
acgggcatattaatgtgtat

SEQ ID NO: 250924 - DNA, 20 bp, Artificial Sequence
  Description of Artificial Sequence: Synthetic oligonucleotide
  Target: ATXN1; (+) strand; PAM type: YTN; PAM sequence: TTA
atgtgtatggttaacaagca

SEQ ID NO: 250925 - DNA, 20 bp, Artificial Sequence
  Description of Artificial Sequence: Synthetic oligonucleotide
  Target: ATXN1; (+) strand; PAM type: YTN; PAM sequence: TTA
acaagcaatcattagcagtt

SEQ ID NO: 250926 - DNA, 20 bp, Artificial Sequence
  Description of Artificial Sequence: Synthetic oligonucleotide
  Target: ATXN1; (+) strand; PAM type: YTN; PAM sequence: TTA
gcagttaccaagtgaaagac

SEQ ID NO: 250927 - DNA, 20 bp, Artificial Sequence
  Description of Artificial Sequence: Synthetic oligonucleotide
  Target: ATXN1; (+) strand; PAM type: YTN; PAM sequence: TTA
ccaagtgaaagacaaatggc

SEQ ID NO: 250928 - DNA, 20 bp, Artificial Sequence
  Description of Artificial Sequence: Synthetic oligonucleotide
  Target: ATXN1; (+) strand; PAM type: YTN; PAM sequence: CTT
ttgatctgtcccacacacgt

SEQ ID NO: 250929 - DNA, 20 bp, Artificial Sequence
  Description of Artificial Sequence: Synthetic oligonucleotide
  Target: ATXN1; (+) strand; PAM type: YTN; PAM sequence: TTT
tgatctgtcccacacacgtg

SEQ ID NO: 250930 - DNA, 20 bp, Artificial Sequence
  Description of Artificial Sequence: Synthetic oligonucleotide
  Target: ATXN1; (+) strand; PAM type: YTN; PAM sequence: TTT
gatctgtcccacacacgtgt

SEQ ID NO: 250931 - DNA, 20 bp, Artificial Sequence
  Description of Artificial Sequence: Synthetic oligonucleotide
  Target: ATXN1; (+) strand; PAM type: YTN; PAM sequence: TTG
atctgtcccacacacgtgtc

SEQ ID NO: 250932 - DNA, 20 bp, Artificial Sequence
  Description of Artificial Sequence: Synthetic oligonucleotide
  Target: ATXN1; (+) strand; PAM type: YTN; PAM sequence: CTG
tcccacacacgtgtcttggt

SEQ ID NO: 250933 - DNA, 20 bp, Artificial Sequence
  Description of Artificial Sequence: Synthetic oligonucleotide
  Target: ATXN1; (+) strand; PAM type: YTN; PAM sequence: CTT
ggtgaaggtattcaggccac

SEQ ID NO: 250934 - DNA, 20 bp, Artificial Sequence
  Description of Artificial Sequence: Synthetic oligonucleotide
  Target: ATXN1; (+) strand; PAM type: YTN; PAM sequence: TTG
gtgaaggtattcaggccact

SEQ ID NO: 250935 - DNA, 20 bp, Artificial Sequence
  Description of Artificial Sequence: Synthetic oligonucleotide
  Target: ATXN1; (+) strand; PAM type: YTN; PAM sequence: TTC
aggccactccaggggccagt

SEQ ID NO: 250936 - DNA, 20 bp, Artificial Sequence
  Description of Artificial Sequence: Synthetic oligonucleotide
  Target: ATXN1; (+) strand; PAM type: YTN; PAM sequence: CTC
caggggccagtctggaagcc

SEQ ID NO: 250937 - DNA, 20 bp, Artificial Sequence
  Description of Artificial Sequence: Synthetic oligonucleotide
  Target: ATXN1; (+) strand; PAM type: YTN; PAM sequence: CTG
gaagccatatctgatcaggt

SEQ ID NO: 250938 - DNA, 20 bp, Artificial Sequence
  Description of Artificial Sequence: Synthetic oligonucleotide
  Target: ATXN1; (+) strand; PAM type: YTN; PAM sequence: CTG
atcaggttagggcatgatat

SEQ ID NO: 250939 - DNA, 20 bp, Artificial Sequence
  Description of Artificial Sequence: Synthetic oligonucleotide
  Target: ATXN1; (+) strand; PAM type: YTN; PAM sequence: TTA
gggcatgatatagtttggct

SEQ ID NO: 250940 - DNA, 20 bp, Artificial Sequence
  Description of Artificial Sequence: Synthetic oligonucleotide
  Target: ATXN1; (+) strand; PAM type: YTN; PAM sequence: TTT
ggctgtgtccccacccaagt

SEQ ID NO: 250941 - DNA, 20 bp, Artificial Sequence
  Description of Artificial Sequence: Synthetic oligonucleotide
  Target: ATXN1; (+) strand; PAM type: YTN; PAM sequence: TTG
gctgtgtccccacccaagtg

SEQ ID NO: 250942 - DNA, 20 bp, Artificial Sequence
  Description of Artificial Sequence: Synthetic oligonucleotide
  Target: ATXN1; (+) strand; PAM type: YTN; PAM sequence: CTG
tgtccccacccaagtgtcat

SEQ ID NO: 250943 - DNA, 20 bp, Artificial Sequence
  Description of Artificial Sequence: Synthetic oligonucleotide
  Target: ATXN1; (+) strand; PAM type: YTN; PAM sequence: CTG
aatcgtagctcccacaattc

SEQ ID NO: 250944 - DNA, 20 bp, Artificial Sequence
  Description of Artificial Sequence: Synthetic oligonucleotide
  Target: ATXN1; (+) strand; PAM type: YTN; PAM sequence: CTC
ccacaattcccacatattgt

SEQ ID NO: 250945 - DNA, 20 bp, Artificial Sequence
  Description of Artificial Sequence: Synthetic oligonucleotide
  Target: ATXN1; (+) strand; PAM type: YTN; PAM sequence: TTC
ccacatattgtaggagggac

SEQ ID NO: 250946 - DNA, 20 bp, Artificial Sequence
  Description of Artificial Sequence: Synthetic oligonucleotide
  Target: ATXN1; (+) strand; PAM type: YTN; PAM sequence: TTG
taggagggacctgctgggag

SEQ ID NO: 250947 - DNA, 20 bp, Artificial Sequence
  Description of Artificial Sequence: Synthetic oligonucleotide
  Target: ATXN1; (+) strand; PAM type: YTN; PAM sequence: CTG
ctgggagacaactgaataat

SEQ ID NO: 250948 - DNA, 20 bp, Artificial Sequence
  Description of Artificial Sequence: Synthetic oligonucleotide
  Target: ATXN1; (+) strand; PAM type: YTN; PAM sequence: CTG
ggagacaactgaataatggg

SEQ ID NO: 250949 - DNA, 20 bp, Artificial Sequence
  Description of Artificial Sequence: Synthetic oligonucleotide
  Target: ATXN1; (+) strand; PAM type: YTN; PAM sequence: CTG
aataatgggggcagtttccc

SEQ ID NO: 250950 - DNA, 20 bp, Artificial Sequence
  Description of Artificial Sequence: Synthetic oligonucleotide
  Target: ATXN1; (+) strand; PAM type: YTN; PAM sequence: TTT
cccccatactgttctcgtgg

SEQ ID NO: 250951 - DNA, 20 bp, Artificial Sequence
  Description of Artificial Sequence: Synthetic oligonucleotide
  Target: ATXN1; (+) strand; PAM type: YTN; PAM sequence: TTC
ccccatactgttctcgtggt

SEQ ID NO: 250952 - DNA, 20 bp, Artificial Sequence
  Description of Artificial Sequence: Synthetic oligonucleotide
  Target: ATXN1; (+) strand; PAM type: YTN; PAM sequence: CTG
ttctcgtggtagtgaataag

SEQ ID NO: 250953 - DNA, 20 bp, Artificial Sequence
  Description of Artificial Sequence: Synthetic oligonucleotide
  Target: ATXN1; (+) strand; PAM type: YTN; PAM sequence: TTC
tcgtggtagtgaataagtct

SEQ ID NO: 250954 - DNA, 20 bp, Artificial Sequence
  Description of Artificial Sequence: Synthetic oligonucleotide
  Target: ATXN1; (+) strand; PAM type: YTN; PAM sequence: CTC
gtggtagtgaataagtctca

SEQ ID NO: 250955 - DNA, 20 bp, Artificial Sequence
  Description of Artificial Sequence: Synthetic oligonucleotide
  Target: ATXN1; (+) strand; PAM type: YTN; PAM sequence: CTC
acgagatctgattgttttat

SEQ ID NO: 250956 - DNA, 20 bp, Artificial Sequence
  Description of Artificial Sequence: Synthetic oligonucleotide
  Target: ATXN1; (+) strand; PAM type: YTN; PAM sequence: CTG
attgttttataagaggtttc

SEQ ID NO: 250957 - DNA, 20 bp, Artificial Sequence
  Description of Artificial Sequence: Synthetic oligonucleotide
  Target: ATXN1; (+) strand; PAM type: YTN; PAM sequence: TTG
ttttataagaggtttcccct

SEQ ID NO: 250958 - DNA, 20 bp, Artificial Sequence
  Description of Artificial Sequence: Synthetic oligonucleotide
  Target: ATXN1; (+) strand; PAM type: YTN; PAM sequence: TTT
tataagaggtttcccctttt

SEQ ID NO: 250959 - DNA, 20 bp, Artificial Sequence
  Description of Artificial Sequence: Synthetic oligonucleotide
  Target: ATXN1; (+) strand; PAM type: YTN; PAM sequence: TTT
ataagaggtttccccttttg

SEQ ID NO: 250960 - DNA, 20 bp, Artificial Sequence
  Description of Artificial Sequence: Synthetic oligonucleotide
  Target: ATXN1; (+) strand; PAM type: YTN; PAM sequence: TTA
taagaggtttccccttttga

SEQ ID NO: 250961 - DNA, 20 bp, Artificial Sequence
  Description of Artificial Sequence: Synthetic oligonucleotide
  Target: ATXN1; (+) strand; PAM type: YTN; PAM sequence: TTT
ccccttttgattgcctctca

SEQ ID NO: 250962 - DNA, 20 bp, Artificial Sequence
  Description of Artificial Sequence: Synthetic oligonucleotide
  Target: ATXN1; (+) strand; PAM type: YTN; PAM sequence: TTC
cccttttgattgcctctcat

SEQ ID NO: 250963 - DNA, 20 bp, Artificial Sequence
  Description of Artificial Sequence: Synthetic oligonucleotide
  Target: ATXN1; (+) strand; PAM type: YTN; PAM sequence: CTT
ttgattgcctctcattttct

SEQ ID NO: 250964 - DNA, 20 bp, Artificial Sequence
  Description of Artificial Sequence: Synthetic oligonucleotide
  Target: ATXN1; (+) strand; PAM type: YTN; PAM sequence: TTT
tgattgcctctcattttctc

SEQ ID NO: 250965 - DNA, 20 bp, Artificial Sequence
  Description of Artificial Sequence: Synthetic oligonucleotide
  Target: ATXN1; (+) strand; PAM type: YTN; PAM sequence: TTT
gattgcctctcattttctct

SEQ ID NO: 250966 - DNA, 20 bp, Artificial Sequence
  Description of Artificial Sequence: Synthetic oligonucleotide
  Target: ATXN1; (+) strand; PAM type: YTN; PAM sequence: TTG
attgcctctcattttctctt

SEQ ID NO: 250967 - DNA, 20 bp, Artificial Sequence
  Description of Artificial Sequence: Synthetic oligonucleotide
  Target: ATXN1; (+) strand; PAM type: YTN; PAM sequence: TTG
cctctcattttctcttgcct

SEQ ID NO: 250968 - DNA, 20 bp, Artificial Sequence
  Description of Artificial Sequence: Synthetic oligonucleotide
  Target: ATXN1; (+) strand; PAM type: YTN; PAM sequence: CTC
tcattttctcttgcctgctg

SEQ ID NO: 250969 - DNA, 20 bp, Artificial Sequence
  Description of Artificial Sequence: Synthetic oligonucleotide
  Target: ATXN1; (+) strand; PAM type: YTN; PAM sequence: CTC
attttctcttgcctgctgcc

SEQ ID NO: 250970 - DNA, 20 bp, Artificial Sequence
  Description of Artificial Sequence: Synthetic oligonucleotide
  Target: ATXN1; (+) strand; PAM type: YTN; PAM sequence: TTT
tctcttgcctgctgccatgt

SEQ ID NO: 250971 - DNA, 20 bp, Artificial Sequence
  Description of Artificial Sequence: Synthetic oligonucleotide
  Target: ATXN1; (+) strand; PAM type: YTN; PAM sequence: TTT
ctcttgcctgctgccatgta

SEQ ID NO: 250972 - DNA, 20 bp, Artificial Sequence
  Description of Artificial Sequence: Synthetic oligonucleotide
  Target: ATXN1; (+) strand; PAM type: YTN; PAM sequence: TTC
tcttgcctgctgccatgtaa

SEQ ID NO: 250973 - DNA, 20 bp, Artificial Sequence
  Description of Artificial Sequence: Synthetic oligonucleotide
  Target: ATXN1; (+) strand; PAM type: YTN; PAM sequence: CTC
ttgcctgctgccatgtaaga

SEQ ID NO: 250974 - DNA, 20 bp, Artificial Sequence
  Description of Artificial Sequence: Synthetic oligonucleotide
  Target: ATXN1; (+) strand; PAM type: YTN; PAM sequence: CTT
gcctgctgccatgtaagaca

SEQ ID NO: 250975 - DNA, 20 bp, Artificial Sequence
  Description of Artificial Sequence: Synthetic oligonucleotide
  Target: ATXN1; (+) strand; PAM type: YTN; PAM sequence: TTG
cctgctgccatgtaagacat

SEQ ID NO: 250976 - DNA, 20 bp, Artificial Sequence
  Description of Artificial Sequence: Synthetic oligonucleotide
  Target: ATXN1; (+) strand; PAM type: YTN; PAM sequence: CTG
ctgccatgtaagacatgcct

SEQ ID NO: 250977 - DNA, 20 bp, Artificial Sequence
  Description of Artificial Sequence: Synthetic oligonucleotide
  Target: ATXN1; (+) strand; PAM type: YTN; PAM sequence: CTG
ccatgtaagacatgcctttt

SEQ ID NO: 250978 - DNA, 20 bp, Artificial Sequence
  Description of Artificial Sequence: Synthetic oligonucleotide
  Target: ATXN1; (+) strand; PAM type: YTN; PAM sequence: CTT
ttgccttccaccatgattgt

SEQ ID NO: 250979 - DNA, 20 bp, Artificial Sequence
  Description of Artificial Sequence: Synthetic oligonucleotide
  Target: ATXN1; (+) strand; PAM type: YTN; PAM sequence: TTT
tgccttccaccatgattgtg

SEQ ID NO: 250980 - DNA, 20 bp, Artificial Sequence
  Description of Artificial Sequence: Synthetic oligonucleotide
  Target: ATXN1; (+) strand; PAM type: YTN; PAM sequence: TTT
gccttccaccatgattgtga

SEQ ID NO: 250981 - DNA, 20 bp, Artificial Sequence
  Description of Artificial Sequence: Synthetic oligonucleotide
  Target: ATXN1; (+) strand; PAM type: YTN; PAM sequence: TTG
ccttccaccatgattgtgaa

SEQ ID NO: 250982 - DNA, 20 bp, Artificial Sequence
  Description of Artificial Sequence: Synthetic oligonucleotide
  Target: ATXN1; (+) strand; PAM type: YTN; PAM sequence: CTT
ccaccatgattgtgaagcct

SEQ ID NO: 250983 - DNA, 20 bp, Artificial Sequence
  Description of Artificial Sequence: Synthetic oligonucleotide
  Target: ATXN1; (+) strand; PAM type: YTN; PAM sequence: TTC
caccatgattgtgaagcctc

SEQ ID NO: 250984 - DNA, 20 bp, Artificial Sequence
  Description of Artificial Sequence: Synthetic oligonucleotide
  Target: ATXN1; (+) strand; PAM type: YTN; PAM sequence: TTG
tgaagcctccccagccacgt

SEQ ID NO: 250985 - DNA, 20 bp, Artificial Sequence
  Description of Artificial Sequence: Synthetic oligonucleotide
  Target: ATXN1; (+) strand; PAM type: YTN; PAM sequence: CTC
cccagccacgtggaactgtg

SEQ ID NO: 250986 - DNA, 20 bp, Artificial Sequence
  Description of Artificial Sequence: Synthetic oligonucleotide
  Target: ATXN1; (+) strand; PAM type: YTN; PAM sequence: CTG
tgagtccattaaacctcttt

SEQ ID NO: 250987 - DNA, 20 bp, Artificial Sequence
  Description of Artificial Sequence: Synthetic oligonucleotide
  Target: ATXN1; (+) strand; PAM type: YTN; PAM sequence: TTA
aacctctttttctttataaa

SEQ ID NO: 250988 - DNA, 20 bp, Artificial Sequence
  Description of Artificial Sequence: Synthetic oligonucleotide
  Target: ATXN1; (+) strand; PAM type: YTN; PAM sequence: CTC
tttttctttataaattacct

SEQ ID NO: 250989 - DNA, 20 bp, Artificial Sequence
  Description of Artificial Sequence: Synthetic oligonucleotide
  Target: ATXN1; (+) strand; PAM type: YTN; PAM sequence: CTT
tttctttataaattacctag

SEQ ID NO: 250990 - DNA, 20 bp, Artificial Sequence
  Description of Artificial Sequence: Synthetic oligonucleotide
  Target: ATXN1; (+) strand; PAM type: YTN; PAM sequence: TTT
ttctttataaattacctagg

SEQ ID NO: 250991 - DNA, 20 bp, Artificial Sequence
  Description of Artificial Sequence: Synthetic oligonucleotide
  Target: ATXN1; (+) strand; PAM type: YTN; PAM sequence: TTT
tctttataaattacctaggc

SEQ ID NO: 250992 - DNA, 20 bp, Artificial Sequence
  Description of Artificial Sequence: Synthetic oligonucleotide
  Target: ATXN1; (+) strand; PAM type: YTN; PAM sequence: TTT
ctttataaattacctaggct

SEQ ID NO: 250993 - DNA, 20 bp, Artificial Sequence
  Description of Artificial Sequence: Synthetic oligonucleotide
  Target: ATXN1; (+) strand; PAM type: YTN; PAM sequence: TTC
tttataaattacctaggctt

SEQ ID NO: 250994 - DNA, 20 bp, Artificial Sequence
  Description of Artificial Sequence: Synthetic oligonucleotide
  Target: ATXN1; (+) strand; PAM type: YTN; PAM sequence: CTT
tataaattacctaggcttgg

SEQ ID NO: 250995 - DNA, 20 bp, Artificial Sequence
  Description of Artificial Sequence: Synthetic oligonucleotide
  Target: ATXN1; (+) strand; PAM type: YTN; PAM sequence: TTT
ataaattacctaggcttggg

SEQ ID NO: 250996 - DNA, 20 bp, Artificial Sequence
  Description of Artificial Sequence: Synthetic oligonucleotide
  Target: ATXN1; (+) strand; PAM type: YTN; PAM sequence: TTA
taaattacctaggcttgggt

SEQ ID NO: 250997 - DNA, 20 bp, Artificial Sequence
  Description of Artificial Sequence: Synthetic oligonucleotide
  Target: ATXN1; (+) strand; PAM type: YTN; PAM sequence: TTA
cctaggcttgggtatgtctt

SEQ ID NO: 250998 - DNA, 20 bp, Artificial Sequence
  Description of Artificial Sequence: Synthetic oligonucleotide
  Target: ATXN1; (+) strand; PAM type: YTN; PAM sequence: CTA
ggcttgggtatgtctttatt

SEQ ID NO: 250999 - DNA, 20 bp, Artificial Sequence
  Description of Artificial Sequence: Synthetic oligonucleotide
  Target: ATXN1; (+) strand; PAM type: YTN; PAM sequence: CTT
gggtatgtctttattagcag

SEQ ID NO: 251000 - DNA, 20 bp, Artificial Sequence
  Description of Artificial Sequence: Synthetic oligonucleotide
  Target: ATXN1; (+) strand; PAM type: YTN; PAM sequence: TTG
ggtatgtctttattagcagc

SEQ ID NO: 251001 - DNA, 20 bp, Artificial Sequence
  Description of Artificial Sequence: Synthetic oligonucleotide
  Target: ATXN1; (+) strand; PAM type: YTN; PAM sequence: CTT
tattagcagcatgaaaacag

SEQ ID NO: 251002 - DNA, 20 bp, Artificial Sequence
  Description of Artificial Sequence: Synthetic oligonucleotide
  Target: ATXN1; (+) strand; PAM type: YTN; PAM sequence: TTT
attagcagcatgaaaacaga

SEQ ID NO: 251003 - DNA, 20 bp, Artificial Sequence
  Description of Artificial Sequence: Synthetic oligonucleotide
  Target: ATXN1; (+) strand; PAM type: YTN; PAM sequence: TTA
ttagcagcatgaaaacagac

SEQ ID NO: 251004 - DNA, 20 bp, Artificial Sequence
  Description of Artificial Sequence: Synthetic oligonucleotide
  Target: ATXN1; (+) strand; PAM type: YTN; PAM sequence: TTA
gcagcatgaaaacagactaa

SEQ ID NO: 251005 - DNA, 20 bp, Artificial Sequence
  Description of Artificial Sequence: Synthetic oligonucleotide
  Target: ATXN1; (+) strand; PAM type: YTN; PAM sequence: CTA
atacagggcatcacacccaa

SEQ ID NO: 251006 - DNA, 20 bp, Artificial Sequence
  Description of Artificial Sequence: Synthetic oligonucleotide
  Target: ATXN1; (+) strand; PAM type: YTN; PAM sequence: TTA
gacctgtttctcctctactt

SEQ ID NO: 251007 - DNA, 20 bp, Artificial Sequence
  Description of Artificial Sequence: Synthetic oligonucleotide
  Target: ATXN1; (+) strand; PAM type: YTN; PAM sequence: CTG
tttctcctctacttccatat

SEQ ID NO: 251008 - DNA, 20 bp, Artificial Sequence
  Description of Artificial Sequence: Synthetic oligonucleotide
  Target: ATXN1; (+) strand; PAM type: YTN; PAM sequence: TTT
ctcctctacttccatatgaa

SEQ ID NO: 251009 - DNA, 20 bp, Artificial Sequence
  Description of Artificial Sequence: Synthetic oligonucleotide
  Target: ATXN1; (+) strand; PAM type: YTN; PAM sequence: TTC
tcctctacttccatatgaac

SEQ ID NO: 251010 - DNA, 20 bp, Artificial Sequence
  Description of Artificial Sequence: Synthetic oligonucleotide
  Target: ATXN1; (+) strand; PAM type: YTN; PAM sequence: CTC
ctctacttccatatgaactc

SEQ ID NO: 251011 - DNA, 20 bp, Artificial Sequence
  Description of Artificial Sequence: Synthetic oligonucleotide
  Target: ATXN1; (+) strand; PAM type: YTN; PAM sequence: CTC
tacttccatatgaactctgt

SEQ ID NO: 251012 - DNA, 20 bp, Artificial Sequence
  Description of Artificial Sequence: Synthetic oligonucleotide
  Target: ATXN1; (+) strand; PAM type: YTN; PAM sequence: CTA
cttccatatgaactctgtaa

SEQ ID NO: 251013 - DNA, 20 bp, Artificial Sequence
  Description of Artificial Sequence: Synthetic oligonucleotide
  Target: ATXN1; (+) strand; PAM type: YTN; PAM sequence: CTT
ccatatgaactctgtaatgc

SEQ ID NO: 251014 - DNA, 20 bp, Artificial Sequence
  Description of Artificial Sequence: Synthetic oligonucleotide
  Target: ATXN1; (+) strand; PAM type: YTN; PAM sequence: TTC
catatgaactctgtaatgct

SEQ ID NO: 251015 - DNA, 20 bp, Artificial Sequence
  Description of Artificial Sequence: Synthetic oligonucleotide
  Target: ATXN1; (+) strand; PAM type: YTN; PAM sequence: CTC
tgtaatgcttttcctattgc

SEQ ID NO: 251016 - DNA, 20 bp, Artificial Sequence
  Description of Artificial Sequence: Synthetic oligonucleotide
  Target: ATXN1; (+) strand; PAM type: YTN; PAM sequence: CTG
taatgcttttcctattgctg

SEQ ID NO: 251017 - DNA, 20 bp, Artificial Sequence
  Description of Artificial Sequence: Synthetic oligonucleotide
  Target: ATXN1; (+) strand; PAM type: YTN; PAM sequence: CTT
ttcctattgctgataacaac

SEQ ID NO: 251018 - DNA, 20 bp, Artificial Sequence
  Description of Artificial Sequence: Synthetic oligonucleotide
  Target: ATXN1; (+) strand; PAM type: YTN; PAM sequence: TTT
tcctattgctgataacaacc

SEQ ID NO: 251019 - DNA, 20 bp, Artificial Sequence
  Description of Artificial Sequence: Synthetic oligonucleotide
  Target: ATXN1; (+) strand; PAM type: YTN; PAM sequence: TTT
cctattgctgataacaacct

SEQ ID NO: 251020 - DNA, 20 bp, Artificial Sequence
  Description of Artificial Sequence: Synthetic oligonucleotide
  Target: ATXN1; (+) strand; PAM type: YTN; PAM sequence: TTC
ctattgctgataacaacctg

SEQ ID NO: 251021 - DNA, 20 bp, Artificial Sequence
  Description of Artificial Sequence: Synthetic oligonucleotide
  Target: ATXN1; (+) strand; PAM type: YTN; PAM sequence: CTA
ttgctgataacaacctggtt

SEQ ID NO: 251022 - DNA, 20 bp, Artificial Sequence
  Description of Artificial Sequence: Synthetic oligonucleotide
  Target: ATXN1; (+) strand; PAM type: YTN; PAM sequence: TTG
ctgataacaacctggttgca

SEQ ID NO: 251023 - DNA, 20 bp, Artificial Sequence
  Description of Artificial Sequence: Synthetic oligonucleotide
  Target: ATXN1; (+) strand; PAM type: YTN; PAM sequence: CTG
ataacaacctggttgcagac

SEQ ID NO: 251024 - DNA, 20 bp, Artificial Sequence
  Description of Artificial Sequence: Synthetic oligonucleotide
  Target: ATXN1; (+) strand; PAM type: YTN; PAM sequence: CTG
gttgcagaccaacatgttat

SEQ ID NO: 251025 - DNA, 20 bp, Artificial Sequence
  Description of Artificial Sequence: Synthetic oligonucleotide
  Target: ATXN1; (+) strand; PAM type: YTN; PAM sequence: TTG
cagaccaacatgttatatca

SEQ ID NO: 251026 - DNA, 20 bp, Artificial Sequence
  Description of Artificial Sequence: Synthetic oligonucleotide
  Target: ATXN1; (+) strand; PAM type: YTN; PAM sequence: TTA
tatcaatgttctgtaaatag

SEQ ID NO: 251027 - DNA, 20 bp, Artificial Sequence
  Description of Artificial Sequence: Synthetic oligonucleotide
  Target: ATXN1; (+) strand; PAM type: YTN; PAM sequence: TTC
tgtaaataggcacatgttac

SEQ ID NO: 251028 - DNA, 20 bp, Artificial Sequence
  Description of Artificial Sequence: Synthetic oligonucleotide
  Target: ATXN1; (+) strand; PAM type: YTN; PAM sequence: CTG
taaataggcacatgttacat

SEQ ID NO: 251029 - DNA, 20 bp, Artificial Sequence
  Description of Artificial Sequence: Synthetic oligonucleotide
  Target: ATXN1; (+) strand; PAM type: YTN; PAM sequence: TTA
cataaagcaccacggcataa

SEQ ID NO: 251030 - DNA, 20 bp, Artificial Sequence
  Description of Artificial Sequence: Synthetic oligonucleotide
  Target: ATXN1; (+) strand; PAM type: YTN; PAM sequence: TTG
taatgacactctaaaaatgt

SEQ ID NO: 251031 - DNA, 20 bp, Artificial Sequence
  Description of Artificial Sequence: Synthetic oligonucleotide
  Target: ATXN1; (+) strand; PAM type: YTN; PAM sequence: CTC
taaaaatgtagtaatcactc

SEQ ID NO: 251032 - DNA, 20 bp, Artificial Sequence
  Description of Artificial Sequence: Synthetic oligonucleotide
  Target: ATXN1; (+) strand; PAM type: YTN; PAM sequence: CTA
aaaatgtagtaatcactcaa

SEQ ID NO: 251033 - DNA, 20 bp, Artificial Sequence
  Description of Artificial Sequence: Synthetic oligonucleotide
  Target: ATXN1; (+) strand; PAM type: YTN; PAM sequence: CTC
aataaaatccttagcatctg

SEQ ID NO: 251034 - DNA, 20 bp, Artificial Sequence
  Description of Artificial Sequence: Synthetic oligonucleotide
  Target: ATXN1; (+) strand; PAM type: YTN; PAM sequence: CTT
agcatctgctatatacctcg

SEQ ID NO: 251035 - DNA, 20 bp, Artificial Sequence
  Description of Artificial Sequence: Synthetic oligonucleotide
  Target: ATXN1; (+) strand; PAM type: YTN; PAM sequence: TTA
gcatctgctatatacctcga

SEQ ID NO: 251036 - DNA, 20 bp, Artificial Sequence
  Description of Artificial Sequence: Synthetic oligonucleotide
  Target: ATXN1; (+) strand; PAM type: YTN; PAM sequence: CTG
ctatatacctcgaattatac

SEQ ID NO: 251037 - DNA, 20 bp, Artificial Sequence
  Description of Artificial Sequence: Synthetic oligonucleotide
  Target: ATXN1; (+) strand; PAM type: YTN; PAM sequence: CTA
tatacctcgaattataccag

SEQ ID NO: 251038 - DNA, 20 bp, Artificial Sequence
  Description of Artificial Sequence: Synthetic oligonucleotide
  Target: ATXN1; (+) strand; PAM type: YTN; PAM sequence: CTC
gaattataccagaagctttt

SEQ ID NO: 251039 - DNA, 20 bp, Artificial Sequence
  Description of Artificial Sequence: Synthetic oligonucleotide
  Target: ATXN1; (+) strand; PAM type: YTN; PAM sequence: TTA
taccagaagcttttaggata

SEQ ID NO: 251040 - DNA, 20 bp, Artificial Sequence
  Description of Artificial Sequence: Synthetic oligonucleotide
  Target: ATXN1; (+) strand; PAM type: YTN; PAM sequence: CTT
ttaggatatgagcaaaaaaa

SEQ ID NO: 251041 - DNA, 20 bp, Artificial Sequence
  Description of Artificial Sequence: Synthetic oligonucleotide
  Target: ATXN1; (+) strand; PAM type: YTN; PAM sequence: TTT
taggatatgagcaaaaaaaa

SEQ ID NO: 251042 - DNA, 20 bp, Artificial Sequence
  Description of Artificial Sequence: Synthetic oligonucleotide
  Target: ATXN1; (+) strand; PAM type: YTN; PAM sequence: TTT
aggatatgagcaaaaaaaaa

SEQ ID NO: 251043 - DNA, 20 bp, Artificial Sequence
  Description of Artificial Sequence: Synthetic oligonucleotide
  Target: ATXN1; (+) strand; PAM type: YTN; PAM sequence: TTA
ggatatgagcaaaaaaaaaa

SEQ ID NO: 251044 - DNA, 20 bp, Artificial Sequence
  Description of Artificial Sequence: Synthetic oligonucleotide
  Target: ATXN1; (+) strand; PAM type: YTN; PAM sequence: CTG
ctaaaaaggaacttacaatc

SEQ ID NO: 251045 - DNA, 20 bp, Artificial Sequence
  Description of Artificial Sequence: Synthetic oligonucleotide
  Target: ATXN1; (+) strand; PAM type: YTN; PAM sequence: CTA
aaaaggaacttacaatccag

SEQ ID NO: 251046 - DNA, 20 bp, Artificial Sequence
  Description of Artificial Sequence: Synthetic oligonucleotide
  Target: ATXN1; (+) strand; PAM type: YTN; PAM sequence: CTT
acaatccagcttgaagaaat

SEQ ID NO: 251047 - DNA, 20 bp, Artificial Sequence
  Description of Artificial Sequence: Synthetic oligonucleotide
  Target: ATXN1; (+) strand; PAM type: YTN; PAM sequence: TTA
caatccagcttgaagaaata

SEQ ID NO: 251048 - DNA, 20 bp, Artificial Sequence
  Description of Artificial Sequence: Synthetic oligonucleotide
  Target: ATXN1; (+) strand; PAM type: YTN; PAM sequence: CTT
gaagaaataaagcccacaca

SEQ ID NO: 251049 - DNA, 20 bp, Artificial Sequence
  Description of Artificial Sequence: Synthetic oligonucleotide
  Target: ATXN1; (+) strand; PAM type: YTN; PAM sequence: TTG
aagaaataaagcccacacat

SEQ ID NO: 251050 - DNA, 20 bp, Artificial Sequence
  Description of Artificial Sequence: Synthetic oligonucleotide
  Target: ATXN1; (+) strand; PAM type: YTN; PAM sequence: TTA
gggaacaagaccatattcag

SEQ ID NO: 251051 - DNA, 20 bp, Artificial Sequence
  Description of Artificial Sequence: Synthetic oligonucleotide
  Target: ATXN1; (+) strand; PAM type: YTN; PAM sequence: TTC
agttaagtgcaaaaattgaa

SEQ ID NO: 251052 - DNA, 20 bp, Artificial Sequence
  Description of Artificial Sequence: Synthetic oligonucleotide
  Target: ATXN1; (+) strand; PAM type: YTN; PAM sequence: TTA
agtgcaaaaattgaaaagta

SEQ ID NO: 251053 - DNA, 20 bp, Artificial Sequence
  Description of Artificial Sequence: Synthetic oligonucleotide
  Target: ATXN1; (+) strand; PAM type: YTN; PAM sequence: TTG
aaaagtatgctcgattagca

SEQ ID NO: 251054 - DNA, 20 bp, Artificial Sequence
  Description of Artificial Sequence: Synthetic oligonucleotide
  Target: ATXN1; (+) strand; PAM type: YTN; PAM sequence: CTC
gattagcaagctagagggtt

SEQ ID NO: 251055 - DNA, 20 bp, Artificial Sequence
  Description of Artificial Sequence: Synthetic oligonucleotide
  Target: ATXN1; (+) strand; PAM type: YTN; PAM sequence: TTA
gcaagctagagggtttatta

SEQ ID NO: 251056 - DNA, 20 bp, Artificial Sequence
  Description of Artificial Sequence: Synthetic oligonucleotide
  Target: ATXN1; (+) strand; PAM type: YTN; PAM sequence: CTA
gagggtttattagaaataac

SEQ ID NO: 251057 - DNA, 20 bp, Artificial Sequence
  Description of Artificial Sequence: Synthetic oligonucleotide
  Target: ATXN1; (+) strand; PAM type: YTN; PAM sequence: TTT
attagaaataacagtagctt

SEQ ID NO: 251058 - DNA, 20 bp, Artificial Sequence
  Description of Artificial Sequence: Synthetic oligonucleotide
  Target: ATXN1; (+) strand; PAM type: YTN; PAM sequence: TTA
ttagaaataacagtagctta

SEQ ID NO: 251059 - DNA, 20 bp, Artificial Sequence
  Description of Artificial Sequence: Synthetic oligonucleotide
  Target: ATXN1; (+) strand; PAM type: YTN; PAM sequence: TTA
gaaataacagtagcttaaaa

SEQ ID NO: 251060 - DNA, 20 bp, Artificial Sequence
  Description of Artificial Sequence: Synthetic oligonucleotide
  Target: ATXN1; (+) strand; PAM type: YTN; PAM sequence: CTT
aaaaacttccctactataaa

SEQ ID NO: 251061 - DNA, 20 bp, Artificial Sequence
  Description of Artificial Sequence: Synthetic oligonucleotide
  Target: ATXN1; (+) strand; PAM type: YTN; PAM sequence: TTA
aaaacttccctactataaaa

SEQ ID NO: 251062 - DNA, 20 bp, Artificial Sequence
  Description of Artificial Sequence: Synthetic oligonucleotide
  Target: ATXN1; (+) strand; PAM type: YTN; PAM sequence: CTT
ccctactataaaaaccatag

SEQ ID NO: 251063 - DNA, 20 bp, Artificial Sequence
  Description of Artificial Sequence: Synthetic oligonucleotide
  Target: ATXN1; (+) strand; PAM type: YTN; PAM sequence: TTC
cctactataaaaaccatagt

SEQ ID NO: 251064 - DNA, 20 bp, Artificial Sequence
  Description of Artificial Sequence: Synthetic oligonucleotide
  Target: ATXN1; (+) strand; PAM type: YTN; PAM sequence: CTA
ctataaaaaccatagtttaa

SEQ ID NO: 251065 - DNA, 20 bp, Artificial Sequence
  Description of Artificial Sequence: Synthetic oligonucleotide
  Target: ATXN1; (+) strand; PAM type: YTN; PAM sequence: CTA
taaaaaccatagtttaagcc

SEQ ID NO: 251066 - DNA, 20 bp, Artificial Sequence
  Description of Artificial Sequence: Synthetic oligonucleotide
  Target: ATXN1; (+) strand; PAM type: YTN; PAM sequence: TTT
aagcctgctttaacattaga

SEQ ID NO: 251067 - DNA, 20 bp, Artificial Sequence
  Description of Artificial Sequence: Synthetic oligonucleotide
  Target: ATXN1; (+) strand; PAM type: YTN; PAM sequence: TTA
agcctgctttaacattagat

SEQ ID NO: 251068 - DNA, 20 bp, Artificial Sequence
  Description of Artificial Sequence: Synthetic oligonucleotide
  Target: ATXN1; (+) strand; PAM type: YTN; PAM sequence: CTG
ctttaacattagatctggtt

SEQ ID NO: 251069 - DNA, 20 bp, Artificial Sequence
  Description of Artificial Sequence: Synthetic oligonucleotide
  Target: ATXN1; (+) strand; PAM type: YTN; PAM sequence: CTT
taacattagatctggtttcc

SEQ ID NO: 251070 - DNA, 20 bp, Artificial Sequence
  Description of Artificial Sequence: Synthetic oligonucleotide
  Target: ATXN1; (+) strand; PAM type: YTN; PAM sequence: TTT
aacattagatctggtttccc

SEQ ID NO: 251071 - DNA, 20 bp, Artificial Sequence
  Description of Artificial Sequence: Synthetic oligonucleotide
  Target: ATXN1; (+) strand; PAM type: YTN; PAM sequence: TTA
acattagatctggtttccca

SEQ ID NO: 251072 - DNA, 20 bp, Artificial Sequence
  Description of Artificial Sequence: Synthetic oligonucleotide
  Target: ATXN1; (+) strand; PAM type: YTN; PAM sequence: TTA
gatctggtttcccacaactg

SEQ ID NO: 251073 - DNA, 20 bp, Artificial Sequence
  Description of Artificial Sequence: Synthetic oligonucleotide
  Target: ATXN1; (+) strand; PAM type: YTN; PAM sequence: CTG
gtttcccacaactgattaac

SEQ ID NO: 251074 - DNA, 20 bp, Artificial Sequence
  Description of Artificial Sequence: Synthetic oligonucleotide
  Target: ATXN1; (+) strand; PAM type: YTN; PAM sequence: TTT
cccacaactgattaacctga

SEQ ID NO: 251075 - DNA, 20 bp, Artificial Sequence
  Description of Artificial Sequence: Synthetic oligonucleotide
  Target: ATXN1; (+) strand; PAM type: YTN; PAM sequence: TTC
ccacaactgattaacctgaa

SEQ ID NO: 251076 - DNA, 20 bp, Artificial Sequence
  Description of Artificial Sequence: Synthetic oligonucleotide
  Target: ATXN1; (+) strand; PAM type: YTN; PAM sequence: CTG
attaacctgaaaatggttta

SEQ ID NO: 251077 - DNA, 20 bp, Artificial Sequence
  Description of Artificial Sequence: Synthetic oligonucleotide
  Target: ATXN1; (+) strand; PAM type: YTN; PAM sequence: TTA
acctgaaaatggtttagcac

SEQ ID NO: 251078 - DNA, 20 bp, Artificial Sequence
  Description of Artificial Sequence: Synthetic oligonucleotide
  Target: ATXN1; (+) strand; PAM type: YTN; PAM sequence: CTG
aaaatggtttagcacaacac

SEQ ID NO: 251079 - DNA, 20 bp, Artificial Sequence
  Description of Artificial Sequence: Synthetic oligonucleotide
  Target: ATXN1; (+) strand; PAM type: YTN; PAM sequence: TTT
agcacaacactaatccttta

SEQ ID NO: 251080 - DNA, 20 bp, Artificial Sequence
  Description of Artificial Sequence: Synthetic oligonucleotide
  Target: ATXN1; (+) strand; PAM type: YTN; PAM sequence: TTA
gcacaacactaatcctttaa

SEQ ID NO: 251081 - DNA, 20 bp, Artificial Sequence
  Description of Artificial Sequence: Synthetic oligonucleotide
  Target: ATXN1; (+) strand; PAM type: YTN; PAM sequence: CTA
atcctttaatttaacaacct

SEQ ID NO: 251082 - DNA, 20 bp, Artificial Sequence
  Description of Artificial Sequence: Synthetic oligonucleotide
  Target: ATXN1; (+) strand; PAM type: YTN; PAM sequence: CTT
taatttaacaacctataaat

SEQ ID NO: 251083 - DNA, 20 bp, Artificial Sequence
  Description of Artificial Sequence: Synthetic oligonucleotide
  Target: ATXN1; (+) strand; PAM type: YTN; PAM sequence: TTT
aatttaacaacctataaatg

SEQ ID NO: 251084 - DNA, 20 bp, Artificial Sequence
  Description of Artificial Sequence: Synthetic oligonucleotide
  Target: ATXN1; (+) strand; PAM type: YTN; PAM sequence: TTA
atttaacaacctataaatgc

SEQ ID NO: 251085 - DNA, 20 bp, Artificial Sequence
  Description of Artificial Sequence: Synthetic oligonucleotide
  Target: ATXN1; (+) strand; PAM type: YTN; PAM sequence: TTT
aacaacctataaatgccgta

SEQ ID NO: 251086 - DNA, 20 bp, Artificial Sequence
  Description of Artificial Sequence: Synthetic oligonucleotide
  Target: ATXN1; (+) strand; PAM type: YTN; PAM sequence: TTA
acaacctataaatgccgtat

SEQ ID NO: 251087 - DNA, 20 bp, Artificial Sequence
  Description of Artificial Sequence: Synthetic oligonucleotide
  Target: ATXN1; (+) strand; PAM type: YTN; PAM sequence: CTA
taaatgccgtatataacaag

SEQ ID NO: 251088 - DNA, 20 bp, Artificial Sequence
  Description of Artificial Sequence: Synthetic oligonucleotide
  Target: ATXN1; (+) strand; PAM type: YTN; PAM sequence: TTC
cacagagccctttcttggat

SEQ ID NO: 251089 - DNA, 20 bp, Artificial Sequence
  Description of Artificial Sequence: Synthetic oligonucleotide
  Target: ATXN1; (+) strand; PAM type: YTN; PAM sequence: CTT
tcttggattcataatgataa

SEQ ID NO: 251090 - DNA, 20 bp, Artificial Sequence
  Description of Artificial Sequence: Synthetic oligonucleotide
  Target: ATXN1; (+) strand; PAM type: YTN; PAM sequence: TTT
cttggattcataatgataac

SEQ ID NO: 251091 - DNA, 20 bp, Artificial Sequence
  Description of Artificial Sequence: Synthetic oligonucleotide
  Target: ATXN1; (+) strand; PAM type: YTN; PAM sequence: TTC
ttggattcataatgataacc

SEQ ID NO: 251092 - DNA, 20 bp, Artificial Sequence
  Description of Artificial Sequence: Synthetic oligonucleotide
  Target: ATXN1; (+) strand; PAM type: YTN; PAM sequence: CTT
ggattcataatgataacctg

SEQ ID NO: 251093 - DNA, 20 bp, Artificial Sequence
  Description of Artificial Sequence: Synthetic oligonucleotide
  Target: ATXN1; (+) strand; PAM type: YTN; PAM sequence: TTG
gattcataatgataacctgc

SEQ ID NO: 251094 - DNA, 20 bp, Artificial Sequence
  Description of Artificial Sequence: Synthetic oligonucleotide
  Target: ATXN1; (+) strand; PAM type: YTN; PAM sequence: TTC
ataatgataacctgcatcta

SEQ ID NO: 251095 - DNA, 20 bp, Artificial Sequence
  Description of Artificial Sequence: Synthetic oligonucleotide
  Target: ATXN1; (+) strand; PAM type: YTN; PAM sequence: CTG
catctaccacactatccaat

SEQ ID NO: 251096 - DNA, 20 bp, Artificial Sequence
  Description of Artificial Sequence: Synthetic oligonucleotide
  Target: ATXN1; (+) strand; PAM type: YTN; PAM sequence: CTA
ccacactatccaatgttcat

SEQ ID NO: 251097 - DNA, 20 bp, Artificial Sequence
  Description of Artificial Sequence: Synthetic oligonucleotide
  Target: ATXN1; (+) strand; PAM type: YTN; PAM sequence: CTA
tccaatgttcattttaatga

SEQ ID NO: 251098 - DNA, 20 bp, Artificial Sequence
  Description of Artificial Sequence: Synthetic oligonucleotide
  Target: ATXN1; (+) strand; PAM type: YTN; PAM sequence: TTC
attttaatgagcacctctgg

SEQ ID NO: 251099 - DNA, 20 bp, Artificial Sequence
  Description of Artificial Sequence: Synthetic oligonucleotide
  Target: ATXN1; (+) strand; PAM type: YTN; PAM sequence: TTT
taatgagcacctctggactt

SEQ ID NO: 251100 - DNA, 20 bp, Artificial Sequence
  Description of Artificial Sequence: Synthetic oligonucleotide
  Target: ATXN1; (+) strand; PAM type: YTN; PAM sequence: TTT
aatgagcacctctggacttt

SEQ ID NO: 251101 - DNA, 20 bp, Artificial Sequence
  Description of Artificial Sequence: Synthetic oligonucleotide
  Target: ATXN1; (+) strand; PAM type: YTN; PAM sequence: TTA
atgagcacctctggacttta

SEQ ID NO: 251102 - DNA, 20 bp, Artificial Sequence
  Description of Artificial Sequence: Synthetic oligonucleotide
  Target: ATXN1; (+) strand; PAM type: YTN; PAM sequence: CTC
tggactttaatgaacaatct

SEQ ID NO: 251103 - DNA, 20 bp, Artificial Sequence
  Description of Artificial Sequence: Synthetic oligonucleotide
  Target: ATXN1; (+) strand; PAM type: YTN; PAM sequence: CTG
gactttaatgaacaatctta

SEQ ID NO: 251104 - DNA, 20 bp, Artificial Sequence
  Description of Artificial Sequence: Synthetic oligonucleotide
  Target: ATXN1; (+) strand; PAM type: YTN; PAM sequence: CTT
taatgaacaatcttaggtct

SEQ ID NO: 251105 - DNA, 20 bp, Artificial Sequence
  Description of Artificial Sequence: Synthetic oligonucleotide
  Target: ATXN1; (+) strand; PAM type: YTN; PAM sequence: TTT
aatgaacaatcttaggtcta

SEQ ID NO: 251106 - DNA, 20 bp, Artificial Sequence
  Description of Artificial Sequence: Synthetic oligonucleotide
  Target: ATXN1; (+) strand; PAM type: YTN; PAM sequence: TTA
atgaacaatcttaggtctaa

SEQ ID NO: 251107 - DNA, 20 bp, Artificial Sequence
  Description of Artificial Sequence: Synthetic oligonucleotide
  Target: ATXN1; (+) strand; PAM type: YTN; PAM sequence: CTT
aggtctaagtgagcatcaat

SEQ ID NO: 251108 - DNA, 20 bp, Artificial Sequence
  Description of Artificial Sequence: Synthetic oligonucleotide
  Target: ATXN1; (+) strand; PAM type: YTN; PAM sequence: TTA
ggtctaagtgagcatcaatt

SEQ ID NO: 251109 - DNA, 20 bp, Artificial Sequence
  Description of Artificial Sequence: Synthetic oligonucleotide
  Target: ATXN1; (+) strand; PAM type: YTN; PAM sequence: CTA
agtgagcatcaattaaagag

SEQ ID NO: 251110 - DNA, 20 bp, Artificial Sequence
  Description of Artificial Sequence: Synthetic oligonucleotide
  Target: ATXN1; (+) strand; PAM type: YTN; PAM sequence: TTA
aagagaaaatgcctccaaag

SEQ ID NO: 251111 - DNA, 20 bp, Artificial Sequence
  Description of Artificial Sequence: Synthetic oligonucleotide
  Target: ATXN1; (+) strand; PAM type: YTN; PAM sequence: CTC
caaaggtataaatggtgatg

SEQ ID NO: 251112 - DNA, 20 bp, Artificial Sequence
  Description of Artificial Sequence: Synthetic oligonucleotide
  Target: ATXN1; (+) strand; PAM type: YTN; PAM sequence: CTG
ggttagcagggttgaaagga

SEQ ID NO: 251113 - DNA, 20 bp, Artificial Sequence
  Description of Artificial Sequence: Synthetic oligonucleotide
  Target: ATXN1; (+) strand; PAM type: YTN; PAM sequence: TTA
gcagggttgaaaggacacct

SEQ ID NO: 251114 - DNA, 20 bp, Artificial Sequence
  Description of Artificial Sequence: Synthetic oligonucleotide
  Target: ATXN1; (+) strand; PAM type: YTN; PAM sequence: TTG
aaaggacacctgtgagcatc

SEQ ID NO: 251115 - DNA, 20 bp, Artificial Sequence
  Description of Artificial Sequence: Synthetic oligonucleotide
  Target: ATXN1; (+) strand; PAM type: YTN; PAM sequence: CTG
tgagcatcgtgaggtttgga

SEQ ID NO: 251116 - DNA, 20 bp, Artificial Sequence
  Description of Artificial Sequence: Synthetic oligonucleotide
  Target: ATXN1; (+) strand; PAM type: YTN; PAM sequence: TTT
ggatggcaagtgtgccccct

SEQ ID NO: 251117 - DNA, 20 bp, Artificial Sequence
  Description of Artificial Sequence: Synthetic oligonucleotide
  Target: ATXN1; (+) strand; PAM type: YTN; PAM sequence: TTG
gatggcaagtgtgccccctt

SEQ ID NO: 251118 - DNA, 20 bp, Artificial Sequence
  Description of Artificial Sequence: Synthetic oligonucleotide
  Target: ATXN1; (+) strand; PAM type: YTN; PAM sequence: CTT
gatcagcagctcccacctct

SEQ ID NO: 251119 - DNA, 20 bp, Artificial Sequence
  Description of Artificial Sequence: Synthetic oligonucleotide
  Target: ATXN1; (+) strand; PAM type: YTN; PAM sequence: TTG
atcagcagctcccacctctg

SEQ ID NO: 251120 - DNA, 20 bp, Artificial Sequence
  Description of Artificial Sequence: Synthetic oligonucleotide
  Target: ATXN1; (+) strand; PAM type: YTN; PAM sequence: CTC
ccacctctgtctgatataga

SEQ ID NO: 251121 - DNA, 20 bp, Artificial Sequence
  Description of Artificial Sequence: Synthetic oligonucleotide
  Target: ATXN1; (+) strand; PAM type: YTN; PAM sequence: CTC
tgtctgatatagagcgaagc

SEQ ID NO: 251122 - DNA, 20 bp, Artificial Sequence
  Description of Artificial Sequence: Synthetic oligonucleotide
  Target: ATXN1; (+) strand; PAM type: YTN; PAM sequence: CTG
tctgatatagagcgaagctg

SEQ ID NO: 251123 - DNA, 20 bp, Artificial Sequence
  Description of Artificial Sequence: Synthetic oligonucleotide
  Target: ATXN1; (+) strand; PAM type: YTN; PAM sequence: CTG
atatagagcgaagctggggc

SEQ ID NO: 251124 - DNA, 20 bp, Artificial Sequence
  Description of Artificial Sequence: Synthetic oligonucleotide
  Target: ATXN1; (+) strand; PAM type: YTN; PAM sequence: CTG
gggcctgggatgaaagaaga

SEQ ID NO: 251125 - DNA, 20 bp, Artificial Sequence
  Description of Artificial Sequence: Synthetic oligonucleotide
  Target: ATXN1; (+) strand; PAM type: YTN; PAM sequence: CTG
ggatgaaagaagaaagcccc

SEQ ID NO: 251126 - DNA, 20 bp, Artificial Sequence
  Description of Artificial Sequence: Synthetic oligonucleotide
  Target: ATXN1; (+) strand; PAM type: YTN; PAM sequence: TTA
ggggaatgctatagaaggag

SEQ ID NO: 251127 - DNA, 20 bp, Artificial Sequence
  Description of Artificial Sequence: Synthetic oligonucleotide
  Target: ATXN1; (+) strand; PAM type: YTN; PAM sequence: CTA
tagaaggaggaattctgaaa

SEQ ID NO: 251128 - DNA, 20 bp, Artificial Sequence
  Description of Artificial Sequence: Synthetic oligonucleotide
  Target: ATXN1; (+) strand; PAM type: YTN; PAM sequence: TTC
tgaaagaagagaaatacatc

SEQ ID NO: 251129 - DNA, 20 bp, Artificial Sequence
  Description of Artificial Sequence: Synthetic oligonucleotide
  Target: ATXN1; (+) strand; PAM type: YTN; PAM sequence: CTG
aaagaagagaaatacatctg

SEQ ID NO: 251130 - DNA, 20 bp, Artificial Sequence
  Description of Artificial Sequence: Synthetic oligonucleotide
  Target: ATXN1; (+) strand; PAM type: YTN; PAM sequence: CTG
agcaacacagaattgctgca

SEQ ID NO: 251131 - DNA, 20 bp, Artificial Sequence
  Description of Artificial Sequence: Synthetic oligonucleotide
  Target: ATXN1; (+) strand; PAM type: YTN; PAM sequence: TTG
ctgcagagttacctgcacgc

SEQ ID NO: 251132 - DNA, 20 bp, Artificial Sequence
  Description of Artificial Sequence: Synthetic oligonucleotide
  Target: ATXN1; (+) strand; PAM type: YTN; PAM sequence: CTG
cagagttacctgcacgcatt

SEQ ID NO: 251133 - DNA, 20 bp, Artificial Sequence
  Description of Artificial Sequence: Synthetic oligonucleotide
  Target: ATXN1; (+) strand; PAM type: YTN; PAM sequence: TTA
cctgcacgcattcttacagt

SEQ ID NO: 251134 - DNA, 20 bp, Artificial Sequence
  Description of Artificial Sequence: Synthetic oligonucleotide
  Target: ATXN1; (+) strand; PAM type: YTN; PAM sequence: CTG
cacgcattcttacagttttc

SEQ ID NO: 251135 - DNA, 20 bp, Artificial Sequence
  Description of Artificial Sequence: Synthetic oligonucleotide
  Target: ATXN1; (+) strand; PAM type: YTN; PAM sequence: TTC
ttacagttttccaaggacaa

SEQ ID NO: 251136 - DNA, 20 bp, Artificial Sequence
  Description of Artificial Sequence: Synthetic oligonucleotide
  Target: ATXN1; (+) strand; PAM type: YTN; PAM sequence: CTT
acagttttccaaggacaaga

SEQ ID NO: 251137 - DNA, 20 bp, Artificial Sequence
  Description of Artificial Sequence: Synthetic oligonucleotide
  Target: ATXN1; (+) strand; PAM type: YTN; PAM sequence: TTA
cagttttccaaggacaagag

SEQ ID NO: 251138 - DNA, 20 bp, Artificial Sequence
  Description of Artificial Sequence: Synthetic oligonucleotide
  Target: ATXN1; (+) strand; PAM type: YTN; PAM sequence: TTT
tccaaggacaagaggagggt

SEQ ID NO: 251139 - DNA, 20 bp, Artificial Sequence
  Description of Artificial Sequence: Synthetic oligonucleotide
  Target: ATXN1; (+) strand; PAM type: YTN; PAM sequence: TTT
ccaaggacaagaggagggta

SEQ ID NO: 251140 - DNA, 20 bp, Artificial Sequence
  Description of Artificial Sequence: Synthetic oligonucleotide
  Target: ATXN1; (+) strand; PAM type: YTN; PAM sequence: TTC
caaggacaagaggagggtat

SEQ ID NO: 251141 - DNA, 20 bp, Artificial Sequence
  Description of Artificial Sequence: Synthetic oligonucleotide
  Target: ATXN1; (+) strand; PAM type: YTN; PAM sequence: TTA
acccgagcccctgaatatgt

SEQ ID NO: 251142 - DNA, 20 bp, Artificial Sequence
  Description of Artificial Sequence: Synthetic oligonucleotide
  Target: ATXN1; (+) strand; PAM type: YTN; PAM sequence: CTG
aatatgtctaattctgtagg

SEQ ID NO: 251143 - DNA, 20 bp, Artificial Sequence
  Description of Artificial Sequence: Synthetic oligonucleotide
  Target: ATXN1; (+) strand; PAM type: YTN; PAM sequence: CTA
attctgtaggcatgcaaatg

SEQ ID NO: 251144 - DNA, 20 bp, Artificial Sequence
  Description of Artificial Sequence: Synthetic oligonucleotide
  Target: ATXN1; (+) strand; PAM type: YTN; PAM sequence: TTC
tgtaggcatgcaaatgagaa

SEQ ID NO: 251145 - DNA, 20 bp, Artificial Sequence
  Description of Artificial Sequence: Synthetic oligonucleotide
  Target: ATXN1; (+) strand; PAM type: YTN; PAM sequence: CTG
taggcatgcaaatgagaatt

SEQ ID NO: 251146 - DNA, 20 bp, Artificial Sequence
  Description of Artificial Sequence: Synthetic oligonucleotide
  Target: ATXN1; (+) strand; PAM type: YTN; PAM sequence: TTG
gtctgactgactttgcggca

SEQ ID NO: 251147 - DNA, 20 bp, Artificial Sequence
  Description of Artificial Sequence: Synthetic oligonucleotide
  Target: ATXN1; (+) strand; PAM type: YTN; PAM sequence: CTG
actgactttgcggcagcagc

SEQ ID NO: 251148 - DNA, 20 bp, Artificial Sequence
  Description of Artificial Sequence: Synthetic oligonucleotide
  Target: ATXN1; (+) strand; PAM type: YTN; PAM sequence: CTG
actttgcggcagcagctgag

SEQ ID NO: 251149 - DNA, 20 bp, Artificial Sequence
  Description of Artificial Sequence: Synthetic oligonucleotide
  Target: ATXN1; (+) strand; PAM type: YTN; PAM sequence: CTT
tgcggcagcagctgagccct

SEQ ID NO: 251150 - DNA, 20 bp, Artificial Sequence
  Description of Artificial Sequence: Synthetic oligonucleotide
  Target: ATXN1; (+) strand; PAM type: YTN; PAM sequence: TTT
gcggcagcagctgagccctg

SEQ ID NO: 251151 - DNA, 20 bp, Artificial Sequence
  Description of Artificial Sequence: Synthetic oligonucleotide
  Target: ATXN1; (+) strand; PAM type: YTN; PAM sequence: TTG
cggcagcagctgagccctgc

SEQ ID NO: 251152 - DNA, 20 bp, Artificial Sequence
  Description of Artificial Sequence: Synthetic oligonucleotide
  Target: ATXN1; (+) strand; PAM type: YTN; PAM sequence: CTG
agccctgctaacttcccttc

SEQ ID NO: 251153 - DNA, 20 bp, Artificial Sequence
  Description of Artificial Sequence: Synthetic oligonucleotide
  Target: ATXN1; (+) strand; PAM type: YTN; PAM sequence: CTG
ctaacttcccttcagaactc

SEQ ID NO: 251154 - DNA, 20 bp, Artificial Sequence
  Description of Artificial Sequence: Synthetic oligonucleotide
  Target: ATXN1; (+) strand; PAM type: YTN; PAM sequence: CTA
acttcccttcagaactcagc

SEQ ID NO: 251155 - DNA, 20 bp, Artificial Sequence
  Description of Artificial Sequence: Synthetic oligonucleotide
  Target: ATXN1; (+) strand; PAM type: YTN; PAM sequence: CTT
cccttcagaactcagcttgg

SEQ ID NO: 251156 - DNA, 20 bp, Artificial Sequence
  Description of Artificial Sequence: Synthetic oligonucleotide
  Target: ATXN1; (+) strand; PAM type: YTN; PAM sequence: TTC
ccttcagaactcagcttggg

SEQ ID NO: 251157 - DNA, 20 bp, Artificial Sequence
  Description of Artificial Sequence: Synthetic oligonucleotide
  Target: ATXN1; (+) strand; PAM type: YTN; PAM sequence: CTT
cagaactcagcttgggctag

SEQ ID NO: 251158 - DNA, 20 bp, Artificial Sequence
  Description of Artificial Sequence: Synthetic oligonucleotide
  Target: ATXN1; (+) strand; PAM type: YTN; PAM sequence: TTC
agaactcagcttgggctagc

SEQ ID NO: 251159 - DNA, 20 bp, Artificial Sequence
  Description of Artificial Sequence: Synthetic oligonucleotide
  Target: ATXN1; (+) strand; PAM type: YTN; PAM sequence: CTC
agcttgggctagcaaagaaa

SEQ ID NO: 251160 - DNA, 20 bp, Artificial Sequence
  Description of Artificial Sequence: Synthetic oligonucleotide
  Target: ATXN1; (+) strand; PAM type: YTN; PAM sequence: CTT
gggctagcaaagaaaagacg

SEQ ID NO: 251161 - DNA, 20 bp, Artificial Sequence
  Description of Artificial Sequence: Synthetic oligonucleotide
  Target: ATXN1; (+) strand; PAM type: YTN; PAM sequence: TTG
ggctagcaaagaaaagacgc

SEQ ID NO: 251162 - DNA, 20 bp, Artificial Sequence
  Description of Artificial Sequence: Synthetic oligonucleotide
  Target: ATXN1; (+) strand; PAM type: YTN; PAM sequence: CTA
gcaaagaaaagacgcccact

SEQ ID NO: 251163 - DNA, 20 bp, Artificial Sequence
  Description of Artificial Sequence: Synthetic oligonucleotide
  Target: ATXN1; (+) strand; PAM type: YTN; PAM sequence: CTC
acccacctaccccagcagct

SEQ ID NO: 251164 - DNA, 20 bp, Artificial Sequence
  Description of Artificial Sequence: Synthetic oligonucleotide
  Target: ATXN1; (+) strand; PAM type: YTN; PAM sequence: CTA
ccccagcagctttgcagaag

SEQ ID NO: 251165 - DNA, 20 bp, Artificial Sequence
  Description of Artificial Sequence: Synthetic oligonucleotide
  Target: ATXN1; (+) strand; PAM type: YTN; PAM sequence: CTT
tgcagaagtgctgcagggtg

SEQ ID NO: 251166 - DNA, 20 bp, Artificial Sequence
  Description of Artificial Sequence: Synthetic oligonucleotide
  Target: ATXN1; (+) strand; PAM type: YTN; PAM sequence: TTT
gcagaagtgctgcagggtga

SEQ ID NO: 251167 - DNA, 20 bp, Artificial Sequence
  Description of Artificial Sequence: Synthetic oligonucleotide
  Target: ATXN1; (+) strand; PAM type: YTN; PAM sequence: TTG
cagaagtgctgcagggtgaa

SEQ ID NO: 251168 - DNA, 20 bp, Artificial Sequence
  Description of Artificial Sequence: Synthetic oligonucleotide
  Target: ATXN1; (+) strand; PAM type: YTN; PAM sequence: CTG
cagggtgaagacaatgaaga

SEQ ID NO: 251169 - DNA, 20 bp, Artificial Sequence
  Description of Artificial Sequence: Synthetic oligonucleotide
  Target: ATXN1; (+) strand; PAM type: YTN; PAM sequence: CTG
aagaaagccgaggcattctg

SEQ ID NO: 251170 - DNA, 20 bp, Artificial Sequence
  Description of Artificial Sequence: Synthetic oligonucleotide
  Target: ATXN1; (+) strand; PAM type: YTN; PAM sequence: TTC
tgccctctcccagcaaagac

SEQ ID NO: 251171 - DNA, 20 bp, Artificial Sequence
  Description of Artificial Sequence: Synthetic oligonucleotide
  Target: ATXN1; (+) strand; PAM type: YTN; PAM sequence: CTG
ccctctcccagcaaagacag

SEQ ID NO: 251172 - DNA, 20 bp, Artificial Sequence
  Description of Artificial Sequence: Synthetic oligonucleotide
  Target: ATXN1; (+) strand; PAM type: YTN; PAM sequence: CTC
tcccagcaaagacagcctgg

SEQ ID NO: 251173 - DNA, 20 bp, Artificial Sequence
  Description of Artificial Sequence: Synthetic oligonucleotide
  Target: ATXN1; (+) strand; PAM type: YTN; PAM sequence: CTC
ccagcaaagacagcctggac

SEQ ID NO: 251174 - DNA, 20 bp, Artificial Sequence
  Description of Artificial Sequence: Synthetic oligonucleotide
  Target: ATXN1; (+) strand; PAM type: YTN; PAM sequence: CTG
gacgtgttcagaccctatcg

SEQ ID NO: 251175 - DNA, 20 bp, Artificial Sequence
  Description of Artificial Sequence: Synthetic oligonucleotide
  Target: ATXN1; (+) strand; PAM type: YTN; PAM sequence: TTC
agaccctatcgccgcatcaa

SEQ ID NO: 251176 - DNA, 20 bp, Artificial Sequence
  Description of Artificial Sequence: Synthetic oligonucleotide
  Target: ATXN1; (+) strand; PAM type: YTN; PAM sequence: CTA
tcgccgcatcaaaagaagaa

SEQ ID NO: 251177 - DNA, 20 bp, Artificial Sequence
  Description of Artificial Sequence: Synthetic oligonucleotide
  Target: ATXN1; (+) strand; PAM type: YTN; PAM sequence: CTC
tggcatgatcaggaaggcac

SEQ ID NO: 251178 - DNA, 20 bp, Artificial Sequence
  Description of Artificial Sequence: Synthetic oligonucleotide
  Target: ATXN1; (+) strand; PAM type: YTN; PAM sequence: CTG
gcatgatcaggaaggcacct

SEQ ID NO: 251179 - DNA, 20 bp, Artificial Sequence
  Description of Artificial Sequence: Synthetic oligonucleotide
  Target: ATXN1; (+) strand; PAM type: YTN; PAM sequence: CTG
gatttgaaaaggatatatta

SEQ ID NO: 251180 - DNA, 20 bp, Artificial Sequence
  Description of Artificial Sequence: Synthetic oligonucleotide
  Target: ATXN1; (+) strand; PAM type: YTN; PAM sequence: TTT
gaaaaggatatattattgcc

SEQ ID NO: 251181 - DNA, 20 bp, Artificial Sequence
  Description of Artificial Sequence: Synthetic oligonucleotide
  Target: ATXN1; (+) strand; PAM type: YTN; PAM sequence: TTG
aaaaggatatattattgccc

SEQ ID NO: 251182 - DNA, 20 bp, Artificial Sequence
  Description of Artificial Sequence: Synthetic oligonucleotide
  Target: ATXN1; (+) strand; PAM type: YTN; PAM sequence: TTA
ttgcccaagcttaacttcac

SEQ ID NO: 251183 - DNA, 20 bp, Artificial Sequence
  Description of Artificial Sequence: Synthetic oligonucleotide
  Target: ATXN1; (+) strand; PAM type: YTN; PAM sequence: TTG
cccaagcttaacttcactga

SEQ ID NO: 251184 - DNA, 20 bp, Artificial Sequence
  Description of Artificial Sequence: Synthetic oligonucleotide
  Target: ATXN1; (+) strand; PAM type: YTN; PAM sequence: CTT
aacttcactgatttccatga

SEQ ID NO: 251185 - DNA, 20 bp, Artificial Sequence
  Description of Artificial Sequence: Synthetic oligonucleotide
  Target: ATXN1; (+) strand; PAM type: YTN; PAM sequence: TTA
acttcactgatttccatgac

SEQ ID NO: 251186 - DNA, 20 bp, Artificial Sequence
  Description of Artificial Sequence: Synthetic oligonucleotide
  Target: ATXN1; (+) strand; PAM type: YTN; PAM sequence: CTT
cactgatttccatgactaag

SEQ ID NO: 251187 - DNA, 20 bp, Artificial Sequence
  Description of Artificial Sequence: Synthetic oligonucleotide
  Target: ATXN1; (+) strand; PAM type: YTN; PAM sequence: TTC
actgatttccatgactaagc

SEQ ID NO: 251188 - DNA, 20 bp, Artificial Sequence
  Description of Artificial Sequence: Synthetic oligonucleotide
  Target: ATXN1; (+) strand; PAM type: YTN; PAM sequence: CTG
atttccatgactaagccact

SEQ ID NO: 251189 - DNA, 20 bp, Artificial Sequence
  Description of Artificial Sequence: Synthetic oligonucleotide
  Target: ATXN1; (+) strand; PAM type: YTN; PAM sequence: TTT
ccatgactaagccacttgac

SEQ ID NO: 251190 - DNA, 20 bp, Artificial Sequence
  Description of Artificial Sequence: Synthetic oligonucleotide
  Target: ATXN1; (+) strand; PAM type: YTN; PAM sequence: TTC
catgactaagccacttgaca

SEQ ID NO: 251191 - DNA, 20 bp, Artificial Sequence
  Description of Artificial Sequence: Synthetic oligonucleotide
  Target: ATXN1; (+) strand; PAM type: YTN; PAM sequence: CTA
agccacttgacagaaaactc

SEQ ID NO: 251192 - DNA, 20 bp, Artificial Sequence
  Description of Artificial Sequence: Synthetic oligonucleotide
  Target: ATXN1; (+) strand; PAM type: YTN; PAM sequence: CTT
gacagaaaactccttttttt

SEQ ID NO: 251193 - DNA, 20 bp, Artificial Sequence
  Description of Artificial Sequence: Synthetic oligonucleotide
  Target: ATXN1; (+) strand; PAM type: YTN; PAM sequence: TTG
acagaaaactcctttttttc

SEQ ID NO: 251194 - DNA, 20 bp, Artificial Sequence
  Description of Artificial Sequence: Synthetic oligonucleotide
  Target: ATXN1; (+) strand; PAM type: YTN; PAM sequence: CTC
ctttttttcaatttaaactt

SEQ ID NO: 251195 - DNA, 20 bp, Artificial Sequence
  Description of Artificial Sequence: Synthetic oligonucleotide
  Target: ATXN1; (+) strand; PAM type: YTN; PAM sequence: CTT
tttttcaatttaaactttaa

SEQ ID NO: 251196 - DNA, 20 bp, Artificial Sequence
  Description of Artificial Sequence: Synthetic oligonucleotide
  Target: ATXN1; (+) strand; PAM type: YTN; PAM sequence: TTT
ttttcaatttaaactttaag

SEQ ID NO: 251197 - DNA, 20 bp, Artificial Sequence
  Description of Artificial Sequence: Synthetic oligonucleotide
  Target: ATXN1; (+) strand; PAM type: YTN; PAM sequence: TTT
tttcaatttaaactttaaga

SEQ ID NO: 251198 - DNA, 20 bp, Artificial Sequence
  Description of Artificial Sequence: Synthetic oligonucleotide
  Target: ATXN1; (+) strand; PAM type: YTN; PAM sequence: TTT
ttcaatttaaactttaagaa

SEQ ID NO: 251199 - DNA, 20 bp, Artificial Sequence
  Description of Artificial Sequence: Synthetic oligonucleotide
  Target: ATXN1; (+) strand; PAM type: YTN; PAM sequence: TTT
tcaatttaaactttaagaac

SEQ ID NO: 251200 - DNA, 20 bp, Artificial Sequence
  Description of Artificial Sequence: Synthetic oligonucleotide
  Target: ATXN1; (+) strand; PAM type: YTN; PAM sequence: TTT
caatttaaactttaagaact

SEQ ID NO: 251201 - DNA, 20 bp, Artificial Sequence
  Description of Artificial Sequence: Synthetic oligonucleotide
  Target: ATXN1; (+) strand; PAM type: YTN; PAM sequence: TTC
aatttaaactttaagaacta

SEQ ID NO: 251202 - DNA, 20 bp, Artificial Sequence
  Description of Artificial Sequence: Synthetic oligonucleotide
  Target: ATXN1; (+) strand; PAM type: YTN; PAM sequence: TTT
aaactttaagaactacagct

SEQ ID NO: 251203 - DNA, 20 bp, Artificial Sequence
  Description of Artificial Sequence: Synthetic oligonucleotide
  Target: ATXN1; (+) strand; PAM type: YTN; PAM sequence: TTA
aactttaagaactacagctc

SEQ ID NO: 251204 - DNA, 20 bp, Artificial Sequence
  Description of Artificial Sequence: Synthetic oligonucleotide
  Target: ATXN1; (+) strand; PAM type: YTN; PAM sequence: CTT
taagaactacagctctgtta

SEQ ID NO: 251205 - DNA, 20 bp, Artificial Sequence
  Description of Artificial Sequence: Synthetic oligonucleotide
  Target: ATXN1; (+) strand; PAM type: YTN; PAM sequence: TTT
aagaactacagctctgttac

SEQ ID NO: 251206 - DNA, 20 bp, Artificial Sequence
  Description of Artificial Sequence: Synthetic oligonucleotide
  Target: ATXN1; (+) strand; PAM type: YTN; PAM sequence: TTA
agaactacagctctgttact

SEQ ID NO: 251207 - DNA, 20 bp, Artificial Sequence
  Description of Artificial Sequence: Synthetic oligonucleotide
  Target: ATXN1; (+) strand; PAM type: YTN; PAM sequence: CTA
cagctctgttacttagaatc

SEQ ID NO: 251208 - DNA, 20 bp, Artificial Sequence
  Description of Artificial Sequence: Synthetic oligonucleotide
  Target: ATXN1; (+) strand; PAM type: YTN; PAM sequence: CTC
tgttacttagaatccaaagc

SEQ ID NO: 251209 - DNA, 20 bp, Artificial Sequence
  Description of Artificial Sequence: Synthetic oligonucleotide
  Target: ATXN1; (+) strand; PAM type: YTN; PAM sequence: CTG
ttacttagaatccaaagcaa

SEQ ID NO: 251210 - DNA, 20 bp, Artificial Sequence
  Description of Artificial Sequence: Synthetic oligonucleotide
  Target: ATXN1; (+) strand; PAM type: YTN; PAM sequence: TTA
cttagaatccaaagcaaata

SEQ ID NO: 251211 - DNA, 20 bp, Artificial Sequence
  Description of Artificial Sequence: Synthetic oligonucleotide
  Target: ATXN1; (+) strand; PAM type: YTN; PAM sequence: CTT
agaatccaaagcaaatatca

SEQ ID NO: 251212 - DNA, 20 bp, Artificial Sequence
  Description of Artificial Sequence: Synthetic oligonucleotide
  Target: ATXN1; (+) strand; PAM type: YTN; PAM sequence: TTA
gaatccaaagcaaatatcat

SEQ ID NO: 251213 - DNA, 20 bp, Artificial Sequence
  Description of Artificial Sequence: Synthetic oligonucleotide
  Target: ATXN1; (+) strand; PAM type: YTN; PAM sequence: CTC
tgaggaaacagctgtcaaca

SEQ ID NO: 251214 - DNA, 20 bp, Artificial Sequence
  Description of Artificial Sequence: Synthetic oligonucleotide
  Target: ATXN1; (+) strand; PAM type: YTN; PAM sequence: CTG
aggaaacagctgtcaacaac

SEQ ID NO: 251215 - DNA, 20 bp, Artificial Sequence
  Description of Artificial Sequence: Synthetic oligonucleotide
  Target: ATXN1; (+) strand; PAM type: YTN; PAM sequence: CTG
tcaacaactctgcaattcct

SEQ ID NO: 251216 - DNA, 20 bp, Artificial Sequence
  Description of Artificial Sequence: Synthetic oligonucleotide
  Target: ATXN1; (+) strand; PAM type: YTN; PAM sequence: CTC
tgcaattcctttatccacta

SEQ ID NO: 251217 - DNA, 20 bp, Artificial Sequence
  Description of Artificial Sequence: Synthetic oligonucleotide
  Target: ATXN1; (+) strand; PAM type: YTN; PAM sequence: CTG
caattcctttatccactaca

SEQ ID NO: 251218 - DNA, 20 bp, Artificial Sequence
  Description of Artificial Sequence: Synthetic oligonucleotide
  Target: ATXN1; (+) strand; PAM type: YTN; PAM sequence: TTC
ctttatccactacatgctaa

SEQ ID NO: 251219 - DNA, 20 bp, Artificial Sequence
  Description of Artificial Sequence: Synthetic oligonucleotide
  Target: ATXN1; (+) strand; PAM type: YTN; PAM sequence: CTT
tatccactacatgctaacac

SEQ ID NO: 251220 - DNA, 20 bp, Artificial Sequence
  Description of Artificial Sequence: Synthetic oligonucleotide
  Target: ATXN1; (+) strand; PAM type: YTN; PAM sequence: TTT
atccactacatgctaacacc

SEQ ID NO: 251221 - DNA, 20 bp, Artificial Sequence
  Description of Artificial Sequence: Synthetic oligonucleotide
  Target: ATXN1; (+) strand; PAM type: YTN; PAM sequence: TTA
tccactacatgctaacaccc

SEQ ID NO: 251222 - DNA, 20 bp, Artificial Sequence
  Description of Artificial Sequence: Synthetic oligonucleotide
  Target: ATXN1; (+) strand; PAM type: YTN; PAM sequence: CTA
catgctaacacccatcctga

SEQ ID NO: 251223 - DNA, 20 bp, Artificial Sequence
  Description of Artificial Sequence: Synthetic oligonucleotide
  Target: ATXN1; (+) strand; PAM type: YTN; PAM sequence: CTA
acacccatcctgagcccagc

SEQ ID NO: 251224 - DNA, 20 bp, Artificial Sequence
  Description of Artificial Sequence: Synthetic oligonucleotide
  Target: ATXN1; (+) strand; PAM type: YTN; PAM sequence: CTG
agcccagcgaatgtccttct

SEQ ID NO: 251225 - DNA, 20 bp, Artificial Sequence
  Description of Artificial Sequence: Synthetic oligonucleotide
  Target: ATXN1; (+) strand; PAM type: YTN; PAM sequence: CTT
ctatgcctggttacaaagat

SEQ ID NO: 251226 - DNA, 20 bp, Artificial Sequence
  Description of Artificial Sequence: Synthetic oligonucleotide
  Target: ATXN1; (+) strand; PAM type: YTN; PAM sequence: TTC
tatgcctggttacaaagatt

SEQ ID NO: 251227 - DNA, 20 bp, Artificial Sequence
  Description of Artificial Sequence: Synthetic oligonucleotide
  Target: ATXN1; (+) strand; PAM type: YTN; PAM sequence: CTA
tgcctggttacaaagattgg

SEQ ID NO: 251228 - DNA, 20 bp, Artificial Sequence
  Description of Artificial Sequence: Synthetic oligonucleotide
  Target: ATXN1; (+) strand; PAM type: YTN; PAM sequence: CTG
gttacaaagattggggcatt

SEQ ID NO: 251229 - DNA, 20 bp, Artificial Sequence
  Description of Artificial Sequence: Synthetic oligonucleotide
  Target: ATXN1; (+) strand; PAM type: YTN; PAM sequence: TTA
caaagattggggcattacaa

SEQ ID NO: 251230 - DNA, 20 bp, Artificial Sequence
  Description of Artificial Sequence: Synthetic oligonucleotide
  Target: ATXN1; (+) strand; PAM type: YTN; PAM sequence: TTG
gggcattacaaaaattcatc

SEQ ID NO: 251231 - DNA, 20 bp, Artificial Sequence
  Description of Artificial Sequence: Synthetic oligonucleotide
  Target: ATXN1; (+) strand; PAM type: YTN; PAM sequence: TTA
caaaaattcatcattccccc

SEQ ID NO: 251232 - DNA, 20 bp, Artificial Sequence
  Description of Artificial Sequence: Synthetic oligonucleotide
  Target: ATXN1; (+) strand; PAM type: YTN; PAM sequence: TTC
atcattcccccttctctcac

SEQ ID NO: 251233 - DNA, 20 bp, Artificial Sequence
  Description of Artificial Sequence: Synthetic oligonucleotide
  Target: ATXN1; (+) strand; PAM type: YTN; PAM sequence: TTC
ccccttctctcaccctgata

SEQ ID NO: 251234 - DNA, 20 bp, Artificial Sequence
  Description of Artificial Sequence: Synthetic oligonucleotide
  Target: ATXN1; (+) strand; PAM type: YTN; PAM sequence: CTT
ctctcaccctgataatcaca

SEQ ID NO: 251235 - DNA, 20 bp, Artificial Sequence
  Description of Artificial Sequence: Synthetic oligonucleotide
  Target: ATXN1; (+) strand; PAM type: YTN; PAM sequence: TTC
tctcaccctgataatcacag

SEQ ID NO: 251236 - DNA, 20 bp, Artificial Sequence
  Description of Artificial Sequence: Synthetic oligonucleotide
  Target: ATXN1; (+) strand; PAM type: YTN; PAM sequence: CTC
tcaccctgataatcacagta

SEQ ID NO: 251237 - DNA, 20 bp, Artificial Sequence
  Description of Artificial Sequence: Synthetic oligonucleotide
  Target: ATXN1; (+) strand; PAM type: YTN; PAM sequence: CTC
accctgataatcacagtagt

SEQ ID NO: 251238 - DNA, 20 bp, Artificial Sequence
  Description of Artificial Sequence: Synthetic oligonucleotide
  Target: ATXN1; (+) strand; PAM type: YTN; PAM sequence: CTG
ataatcacagtagtttctgg

SEQ ID NO: 251239 - DNA, 20 bp, Artificial Sequence
  Description of Artificial Sequence: Synthetic oligonucleotide
  Target: ATXN1; (+) strand; PAM type: YTN; PAM sequence: TTT
ctgggggacctagatggaac

SEQ ID NO: 251240 - DNA, 20 bp, Artificial Sequence
  Description of Artificial Sequence: Synthetic oligonucleotide
  Target: ATXN1; (+) strand; PAM type: YTN; PAM sequence: TTC
tgggggacctagatggaacc

SEQ ID NO: 251241 - DNA, 20 bp, Artificial Sequence
  Description of Artificial Sequence: Synthetic oligonucleotide
  Target: ATXN1; (+) strand; PAM type: YTN; PAM sequence: CTG
ggggacctagatggaaccct

SEQ ID NO: 251242 - DNA, 20 bp, Artificial Sequence
  Description of Artificial Sequence: Synthetic oligonucleotide
  Target: ATXN1; (+) strand; PAM type: YTN; PAM sequence: CTA
gatggaaccctttattaaat

SEQ ID NO: 251243 - DNA, 20 bp, Artificial Sequence
  Description of Artificial Sequence: Synthetic oligonucleotide
  Target: ATXN1; (+) strand; PAM type: YTN; PAM sequence: CTT
tattaaattttggaacatga

SEQ ID NO: 251244 - DNA, 20 bp, Artificial Sequence
  Description of Artificial Sequence: Synthetic oligonucleotide
  Target: ATXN1; (+) strand; PAM type: YTN; PAM sequence: TTT
attaaattttggaacatgag

SEQ ID NO: 251245 - DNA, 20 bp, Artificial Sequence
  Description of Artificial Sequence: Synthetic oligonucleotide
  Target: ATXN1; (+) strand; PAM type: YTN; PAM sequence: TTA
ttaaattttggaacatgaga

SEQ ID NO: 251246 - DNA, 20 bp, Artificial Sequence
  Description of Artificial Sequence: Synthetic oligonucleotide
  Target: ATXN1; (+) strand; PAM type: YTN; PAM sequence: TTA
aattttggaacatgagaaag

SEQ ID NO: 251247 - DNA, 20 bp, Artificial Sequence
  Description of Artificial Sequence: Synthetic oligonucleotide
  Target: ATXN1; (+) strand; PAM type: YTN; PAM sequence: TTT
tggaacatgagaaaggctgg

SEQ ID NO: 251248 - DNA, 20 bp, Artificial Sequence
  Description of Artificial Sequence: Synthetic oligonucleotide
  Target: ATXN1; (+) strand; PAM type: YTN; PAM sequence: TTT
ggaacatgagaaaggctggg

SEQ ID NO: 251249 - DNA, 20 bp, Artificial Sequence
  Description of Artificial Sequence: Synthetic oligonucleotide
  Target: ATXN1; (+) strand; PAM type: YTN; PAM sequence: TTG
gaacatgagaaaggctgggt

SEQ ID NO: 251250 - DNA, 20 bp, Artificial Sequence
  Description of Artificial Sequence: Synthetic oligonucleotide
  Target: ATXN1; (+) strand; PAM type: YTN; PAM sequence: CTG
ggtggtacccacttgtcatt

SEQ ID NO: 251251 - DNA, 20 bp, Artificial Sequence
  Description of Artificial Sequence: Synthetic oligonucleotide
  Target: ATXN1; (+) strand; PAM type: YTN; PAM sequence: CTT
gtcatttgtaagtgagtgct

SEQ ID NO: 251252 - DNA, 20 bp, Artificial Sequence
  Description of Artificial Sequence: Synthetic oligonucleotide
  Target: ATXN1; (+) strand; PAM type: YTN; PAM sequence: TTG
tcatttgtaagtgagtgctg

SEQ ID NO: 251253 - DNA, 20 bp, Artificial Sequence
  Description of Artificial Sequence: Synthetic oligonucleotide
  Target: ATXN1; (+) strand; PAM type: YTN; PAM sequence: TTT
gtaagtgagtgctggataat

SEQ ID NO: 251254 - DNA, 20 bp, Artificial Sequence
  Description of Artificial Sequence: Synthetic oligonucleotide
  Target: ATXN1; (+) strand; PAM type: YTN; PAM sequence: TTG
taagtgagtgctggataatt

SEQ ID NO: 251255 - DNA, 20 bp, Artificial Sequence
  Description of Artificial Sequence: Synthetic oligonucleotide
  Target: ATXN1; (+) strand; PAM type: YTN; PAM sequence: CTG
gataatttccatcagaccac

SEQ ID NO: 251256 - DNA, 20 bp, Artificial Sequence
  Description of Artificial Sequence: Synthetic oligonucleotide
  Target: ATXN1; (+) strand; PAM type: YTN; PAM sequence: TTT
ccatcagaccacaatgcttg

SEQ ID NO: 251257 - DNA, 20 bp, Artificial Sequence
  Description of Artificial Sequence: Synthetic oligonucleotide
  Target: ATXN1; (+) strand; PAM type: YTN; PAM sequence: TTC
catcagaccacaatgcttgt

SEQ ID NO: 251258 - DNA, 20 bp, Artificial Sequence
  Description of Artificial Sequence: Synthetic oligonucleotide
  Target: ATXN1; (+) strand; PAM type: YTN; PAM sequence: CTT
gtatctttattttttttttt

SEQ ID NO: 251259 - DNA, 20 bp, Artificial Sequence
  Description of Artificial Sequence: Synthetic oligonucleotide
  Target: ATXN1; (+) strand; PAM type: YTN; PAM sequence: TTG
tatctttatttttttttttc

SEQ ID NO: 251260 - DNA, 20 bp, Artificial Sequence
  Description of Artificial Sequence: Synthetic oligonucleotide
  Target: ATXN1; (+) strand; PAM type: YTN; PAM sequence: CTT
tatttttttttttcctgctc

SEQ ID NO: 251261 - DNA, 20 bp, Artificial Sequence
  Description of Artificial Sequence: Synthetic oligonucleotide
  Target: ATXN1; (+) strand; PAM type: YTN; PAM sequence: TTT
atttttttttttcctgctca

SEQ ID NO: 251262 - DNA, 20 bp, Artificial Sequence
  Description of Artificial Sequence: Synthetic oligonucleotide
  Target: ATXN1; (+) strand; PAM type: YTN; PAM sequence: TTA
tttttttttttcctgctcat

SEQ ID NO: 251263 - DNA, 20 bp, Artificial Sequence
  Description of Artificial Sequence: Synthetic oligonucleotide
  Target: ATXN1; (+) strand; PAM type: YTN; PAM sequence: TTT
ttttttttcctgctcattgc

SEQ ID NO: 251264 - DNA, 20 bp, Artificial Sequence
  Description of Artificial Sequence: Synthetic oligonucleotide
  Target: ATXN1; (+) strand; PAM type: YTN; PAM sequence: TTT
tttttttcctgctcattgcc

SEQ ID NO: 251265 - DNA, 20 bp, Artificial Sequence
  Description of Artificial Sequence: Synthetic oligonucleotide
  Target: ATXN1; (+) strand; PAM type: YTN; PAM sequence: TTT
ttttttcctgctcattgcct

SEQ ID NO: 251266 - DNA, 20 bp, Artificial Sequence
  Description of Artificial Sequence: Synthetic oligonucleotide
  Target: ATXN1; (+) strand; PAM type: YTN; PAM sequence: TTT
tttttcctgctcattgcctt

SEQ ID NO: 251267 - DNA, 20 bp, Artificial Sequence
  Description of Artificial Sequence: Synthetic oligonucleotide
  Target: ATXN1; (+) strand; PAM type: YTN; PAM sequence: TTT
ttttcctgctcattgccttc

SEQ ID NO: 251268 - DNA, 20 bp, Artificial Sequence
  Description of Artificial Sequence: Synthetic oligonucleotide
  Target: ATXN1; (+) strand; PAM type: YTN; PAM sequence: TTT
tttcctgctcattgccttcc

SEQ ID NO: 251269 - DNA, 20 bp, Artificial Sequence
  Description of Artificial Sequence: Synthetic oligonucleotide
  Target: ATXN1; (+) strand; PAM type: YTN; PAM sequence: TTT
ttcctgctcattgccttcct

SEQ ID NO: 251270 - DNA, 20 bp, Artificial Sequence
  Description of Artificial Sequence: Synthetic oligonucleotide
  Target: ATXN1; (+) strand; PAM type: YTN; PAM sequence: TTT
tcctgctcattgccttccta

SEQ ID NO: 251271 - DNA, 20 bp, Artificial Sequence
  Description of Artificial Sequence: Synthetic oligonucleotide
  Target: ATXN1; (+) strand; PAM type: YTN; PAM sequence: TTT
cctgctcattgccttcctat

SEQ ID NO: 251272 - DNA, 20 bp, Artificial Sequence
  Description of Artificial Sequence: Synthetic oligonucleotide
  Target: ATXN1; (+) strand; PAM type: YTN; PAM sequence: TTC
ctgctcattgccttcctatg

SEQ ID NO: 251273 - DNA, 20 bp, Artificial Sequence
  Description of Artificial Sequence: Synthetic oligonucleotide
  Target: ATXN1; (+) strand; PAM type: YTN; PAM sequence: CTG
ctcattgccttcctatgata

SEQ ID NO: 251274 - DNA, 20 bp, Artificial Sequence
  Description of Artificial Sequence: Synthetic oligonucleotide
  Target: ATXN1; (+) strand; PAM type: YTN; PAM sequence: CTC
attgccttcctatgatacta

SEQ ID NO: 251275 - DNA, 20 bp, Artificial Sequence
  Description of Artificial Sequence: Synthetic oligonucleotide
  Target: ATXN1; (+) strand; PAM type: YTN; PAM sequence: TTG
ccttcctatgatactaattt

SEQ ID NO: 251276 - DNA, 20 bp, Artificial Sequence
  Description of Artificial Sequence: Synthetic oligonucleotide
  Target: ATXN1; (+) strand; PAM type: YTN; PAM sequence: CTT
cctatgatactaatttaaga

SEQ ID NO: 251277 - DNA, 20 bp, Artificial Sequence
  Description of Artificial Sequence: Synthetic oligonucleotide
  Target: ATXN1; (+) strand; PAM type: YTN; PAM sequence: TTC
ctatgatactaatttaagag

SEQ ID NO: 251278 - DNA, 20 bp, Artificial Sequence
  Description of Artificial Sequence: Synthetic oligonucleotide
  Target: ATXN1; (+) strand; PAM type: YTN; PAM sequence: CTA
tgatactaatttaagagttc

SEQ ID NO: 251279 - DNA, 20 bp, Artificial Sequence
  Description of Artificial Sequence: Synthetic oligonucleotide
  Target: ATXN1; (+) strand; PAM type: YTN; PAM sequence: CTA
atttaagagttctttcaaac

SEQ ID NO: 251280 - DNA, 20 bp, Artificial Sequence
  Description of Artificial Sequence: Synthetic oligonucleotide
  Target: ATXN1; (+) strand; PAM type: YTN; PAM sequence: TTT
aagagttctttcaaacccaa

SEQ ID NO: 251281 - DNA, 20 bp, Artificial Sequence
  Description of Artificial Sequence: Synthetic oligonucleotide
  Target: ATXN1; (+) strand; PAM type: YTN; PAM sequence: TTA
agagttctttcaaacccaaa

SEQ ID NO: 251282 - DNA, 20 bp, Artificial Sequence
  Description of Artificial Sequence: Synthetic oligonucleotide
  Target: ATXN1; (+) strand; PAM type: YTN; PAM sequence: TTC
tttcaaacccaaatttagct

SEQ ID NO: 251283 - DNA, 20 bp, Artificial Sequence
  Description of Artificial Sequence: Synthetic oligonucleotide
  Target: ATXN1; (+) strand; PAM type: YTN; PAM sequence: CTT
tcaaacccaaatttagctct

SEQ ID NO: 251284 - DNA, 20 bp, Artificial Sequence
  Description of Artificial Sequence: Synthetic oligonucleotide
  Target: ATXN1; (+) strand; PAM type: YTN; PAM sequence: TTT
caaacccaaatttagctctg

SEQ ID NO: 251285 - DNA, 20 bp, Artificial Sequence
  Description of Artificial Sequence: Synthetic oligonucleotide
  Target: ATXN1; (+) strand; PAM type: YTN; PAM sequence: TTC
aaacccaaatttagctctgt

SEQ ID NO: 251286 - DNA, 20 bp, Artificial Sequence
  Description of Artificial Sequence: Synthetic oligonucleotide
  Target: ATXN1; (+) strand; PAM type: YTN; PAM sequence: TTT
agctctgtgtgcccacctag

SEQ ID NO: 251287 - DNA, 20 bp, Artificial Sequence
  Description of Artificial Sequence: Synthetic oligonucleotide
  Target: ATXN1; (+) strand; PAM type: YTN; PAM sequence: TTA
gctctgtgtgcccacctaga

SEQ ID NO: 251288 - DNA, 20 bp, Artificial Sequence
  Description of Artificial Sequence: Synthetic oligonucleotide
  Target: ATXN1; (+) strand; PAM type: YTN; PAM sequence: CTC
tgtgtgcccacctagattgc

SEQ ID NO: 251289 - DNA, 20 bp, Artificial Sequence
  Description of Artificial Sequence: Synthetic oligonucleotide
  Target: ATXN1; (+) strand; PAM type: YTN; PAM sequence: CTG
tgtgcccacctagattgctc

SEQ ID NO: 251290 - DNA, 20 bp, Artificial Sequence
  Description of Artificial Sequence: Synthetic oligonucleotide
  Target: ATXN1; (+) strand; PAM type: YTN; PAM sequence: CTA
gattgctctgggaattgaaa

SEQ ID NO: 251291 - DNA, 20 bp, Artificial Sequence
  Description of Artificial Sequence: Synthetic oligonucleotide
  Target: ATXN1; (+) strand; PAM type: YTN; PAM sequence: TTG
ctctgggaattgaaatagtc

SEQ ID NO: 251292 - DNA, 20 bp, Artificial Sequence
  Description of Artificial Sequence: Synthetic oligonucleotide
  Target: ATXN1; (+) strand; PAM type: YTN; PAM sequence: CTC
tgggaattgaaatagtccaa

SEQ ID NO: 251293 - DNA, 20 bp, Artificial Sequence
  Description of Artificial Sequence: Synthetic oligonucleotide
  Target: ATXN1; (+) strand; PAM type: YTN; PAM sequence: CTG
ggaattgaaatagtccaagc

SEQ ID NO: 251294 - DNA, 20 bp, Artificial Sequence
  Description of Artificial Sequence: Synthetic oligonucleotide
  Target: ATXN1; (+) strand; PAM type: YTN; PAM sequence: TTG
aaatagtccaagctatttgc

SEQ ID NO: 251295 - DNA, 20 bp, Artificial Sequence
  Description of Artificial Sequence: Synthetic oligonucleotide
  Target: ATXN1; (+) strand; PAM type: YTN; PAM sequence: CTA
tttgctttggaaaatatact

SEQ ID NO: 251296 - DNA, 20 bp, Artificial Sequence
  Description of Artificial Sequence: Synthetic oligonucleotide
  Target: ATXN1; (+) strand; PAM type: YTN; PAM sequence: TTT
gctttggaaaatatactcca

SEQ ID NO: 251297 - DNA, 20 bp, Artificial Sequence
  Description of Artificial Sequence: Synthetic oligonucleotide
  Target: ATXN1; (+) strand; PAM type: YTN; PAM sequence: TTG
ctttggaaaatatactccat

SEQ ID NO: 251298 - DNA, 20 bp, Artificial Sequence
  Description of Artificial Sequence: Synthetic oligonucleotide
  Target: ATXN1; (+) strand; PAM type: YTN; PAM sequence: CTT
tggaaaatatactccattgt

SEQ ID NO: 251299 - DNA, 20 bp, Artificial Sequence
  Description of Artificial Sequence: Synthetic oligonucleotide
  Target: ATXN1; (+) strand; PAM type: YTN; PAM sequence: TTT
ggaaaatatactccattgtg

SEQ ID NO: 251300 - DNA, 20 bp, Artificial Sequence
  Description of Artificial Sequence: Synthetic oligonucleotide
  Target: ATXN1; (+) strand; PAM type: YTN; PAM sequence: TTG
gaaaatatactccattgtga

SEQ ID NO: 251301 - DNA, 20 bp, Artificial Sequence
  Description of Artificial Sequence: Synthetic oligonucleotide
  Target: ATXN1; (+) strand; PAM type: YTN; PAM sequence: CTC
cattgtgaatgaaaggccta

SEQ ID NO: 251302 - DNA, 20 bp, Artificial Sequence
  Description of Artificial Sequence: Synthetic oligonucleotide
  Target: ATXN1; (+) strand; PAM type: YTN; PAM sequence: TTG
tgaatgaaaggcctatggcc

SEQ ID NO: 251303 - DNA, 20 bp, Artificial Sequence
  Description of Artificial Sequence: Synthetic oligonucleotide
  Target: ATXN1; (+) strand; PAM type: YTN; PAM sequence: CTA
tggccaaggtgtttccttct

SEQ ID NO: 251304 - DNA, 20 bp, Artificial Sequence
  Description of Artificial Sequence: Synthetic oligonucleotide
  Target: ATXN1; (+) strand; PAM type: YTN; PAM sequence: TTT
ccttctggcacaagaaaaga

SEQ ID NO: 251305 - DNA, 20 bp, Artificial Sequence
  Description of Artificial Sequence: Synthetic oligonucleotide
  Target: ATXN1; (+) strand; PAM type: YTN; PAM sequence: TTC
cttctggcacaagaaaagag

SEQ ID NO: 251306 - DNA, 20 bp, Artificial Sequence
  Description of Artificial Sequence: Synthetic oligonucleotide
  Target: ATXN1; (+) strand; PAM type: YTN; PAM sequence: CTT
ctggcacaagaaaagagaaa

SEQ ID NO: 251307 - DNA, 20 bp, Artificial Sequence
  Description of Artificial Sequence: Synthetic oligonucleotide
  Target: ATXN1; (+) strand; PAM type: YTN; PAM sequence: TTC
tggcacaagaaaagagaaaa

SEQ ID NO: 251308 - DNA, 20 bp, Artificial Sequence
  Description of Artificial Sequence: Synthetic oligonucleotide
  Target: ATXN1; (+) strand; PAM type: YTN; PAM sequence: CTG
gcacaagaaaagagaaaaga

SEQ ID NO: 251309 - DNA, 20 bp, Artificial Sequence
  Description of Artificial Sequence: Synthetic oligonucleotide
  Target: ATXN1; (+) strand; PAM type: YTN; PAM sequence: CTG
ataaaaatggactatctgtt

SEQ ID NO: 251310 - DNA, 20 bp, Artificial Sequence
  Description of Artificial Sequence: Synthetic oligonucleotide
  Target: ATXN1; (+) strand; PAM type: YTN; PAM sequence: CTA
tctgttcaattacctacaga

SEQ ID NO: 251311 - DNA, 20 bp, Artificial Sequence
  Description of Artificial Sequence: Synthetic oligonucleotide
  Target: ATXN1; (+) strand; PAM type: YTN; PAM sequence: CTG
ttcaattacctacagatttc

SEQ ID NO: 251312 - DNA, 20 bp, Artificial Sequence
  Description of Artificial Sequence: Synthetic oligonucleotide
  Target: ATXN1; (+) strand; PAM type: YTN; PAM sequence: TTC
aattacctacagatttccca

SEQ ID NO: 251313 - DNA, 20 bp, Artificial Sequence
  Description of Artificial Sequence: Synthetic oligonucleotide
  Target: ATXN1; (+) strand; PAM type: YTN; PAM sequence: TTA
cctacagatttcccactggg

SEQ ID NO: 251314 - DNA, 20 bp, Artificial Sequence
  Description of Artificial Sequence: Synthetic oligonucleotide
  Target: ATXN1; (+) strand; PAM type: YTN; PAM sequence: CTA
cagatttcccactgggcttt

SEQ ID NO: 251315 - DNA, 20 bp, Artificial Sequence
  Description of Artificial Sequence: Synthetic oligonucleotide
  Target: ATXN1; (+) strand; PAM type: YTN; PAM sequence: TTT
cccactgggctttactttag

SEQ ID NO: 251316 - DNA, 20 bp, Artificial Sequence
  Description of Artificial Sequence: Synthetic oligonucleotide
  Target: ATXN1; (+) strand; PAM type: YTN; PAM sequence: TTC
ccactgggctttactttaga

SEQ ID NO: 251317 - DNA, 20 bp, Artificial Sequence
  Description of Artificial Sequence: Synthetic oligonucleotide
  Target: ATXN1; (+) strand; PAM type: YTN; PAM sequence: CTG
ggctttactttagaaagttg

SEQ ID NO: 251318 - DNA, 20 bp, Artificial Sequence
  Description of Artificial Sequence: Synthetic oligonucleotide
  Target: ATXN1; (+) strand; PAM type: YTN; PAM sequence: CTT
tactttagaaagttgtacag

SEQ ID NO: 251319 - DNA, 20 bp, Artificial Sequence
  Description of Artificial Sequence: Synthetic oligonucleotide
  Target: ATXN1; (+) strand; PAM type: YTN; PAM sequence: TTT
actttagaaagttgtacagg

SEQ ID NO: 251320 - DNA, 20 bp, Artificial Sequence
  Description of Artificial Sequence: Synthetic oligonucleotide
  Target: ATXN1; (+) strand; PAM type: YTN; PAM sequence: TTA
ctttagaaagttgtacaggt

SEQ ID NO: 251321 - DNA, 20 bp, Artificial Sequence
  Description of Artificial Sequence: Synthetic oligonucleotide
  Target: ATXN1; (+) strand; PAM type: YTN; PAM sequence: CTT
tagaaagttgtacaggttaa

SEQ ID NO: 251322 - DNA, 20 bp, Artificial Sequence
  Description of Artificial Sequence: Synthetic oligonucleotide
  Target: ATXN1; (+) strand; PAM type: YTN; PAM sequence: TTT
agaaagttgtacaggttaat

SEQ ID NO: 251323 - DNA, 20 bp, Artificial Sequence
  Description of Artificial Sequence: Synthetic oligonucleotide
  Target: ATXN1; (+) strand; PAM type: YTN; PAM sequence: TTA
gaaagttgtacaggttaatg

SEQ ID NO: 251324 - DNA, 20 bp, Artificial Sequence
  Description of Artificial Sequence: Synthetic oligonucleotide
  Target: ATXN1; (+) strand; PAM type: YTN; PAM sequence: TTG
tacaggttaatgctatccac

SEQ ID NO: 251325 - DNA, 20 bp, Artificial Sequence
  Description of Artificial Sequence: Synthetic oligonucleotide
  Target: ATXN1; (+) strand; PAM type: YTN; PAM sequence: TTA
atgctatccacaagccctgg

SEQ ID NO: 251326 - DNA, 20 bp, Artificial Sequence
  Description of Artificial Sequence: Synthetic oligonucleotide
  Target: ATXN1; (+) strand; PAM type: YTN; PAM sequence: CTA
tccacaagccctgggcactg

SEQ ID NO: 251327 - DNA, 20 bp, Artificial Sequence
  Description of Artificial Sequence: Synthetic oligonucleotide
  Target: ATXN1; (+) strand; PAM type: YTN; PAM sequence: CTG
ggcactggtgccccatggca

SEQ ID NO: 251328 - DNA, 20 bp, Artificial Sequence
  Description of Artificial Sequence: Synthetic oligonucleotide
  Target: ATXN1; (+) strand; PAM type: YTN; PAM sequence: CTG
gtgccccatggcacagctgc

SEQ ID NO: 251329 - DNA, 20 bp, Artificial Sequence
  Description of Artificial Sequence: Synthetic oligonucleotide
  Target: ATXN1; (+) strand; PAM type: YTN; PAM sequence: CTG
cctgcgggatggcacatggt

SEQ ID NO: 251330 - DNA, 20 bp, Artificial Sequence
  Description of Artificial Sequence: Synthetic oligonucleotide
  Target: ATXN1; (+) strand; PAM type: YTN; PAM sequence: CTG
cgggatggcacatggtacac

SEQ ID NO: 251331 - DNA, 20 bp, Artificial Sequence
  Description of Artificial Sequence: Synthetic oligonucleotide
  Target: ATXN1; (+) strand; PAM type: YTN; PAM sequence: CTA
atagcacacttattattaga

SEQ ID NO: 251332 - DNA, 20 bp, Artificial Sequence
  Description of Artificial Sequence: Synthetic oligonucleotide
  Target: ATXN1; (+) strand; PAM type: YTN; PAM sequence: CTT
attattagattttctgcatg

SEQ ID NO: 251333 - DNA, 20 bp, Artificial Sequence
  Description of Artificial Sequence: Synthetic oligonucleotide
  Target: ATXN1; (+) strand; PAM type: YTN; PAM sequence: TTA
ttattagattttctgcatgg

SEQ ID NO: 251334 - DNA, 20 bp, Artificial Sequence
  Description of Artificial Sequence: Synthetic oligonucleotide
  Target: ATXN1; (+) strand; PAM type: YTN; PAM sequence: TTA
ttagattttctgcatggtta

SEQ ID NO: 251335 - DNA, 20 bp, Artificial Sequence
  Description of Artificial Sequence: Synthetic oligonucleotide
  Target: ATXN1; (+) strand; PAM type: YTN; PAM sequence: TTA
gattttctgcatggttacat

SEQ ID NO: 251336 - DNA, 20 bp, Artificial Sequence
  Description of Artificial Sequence: Synthetic oligonucleotide
  Target: ATXN1; (+) strand; PAM type: YTN; PAM sequence: TTT
tctgcatggttacataagcc

SEQ ID NO: 251337 - DNA, 20 bp, Artificial Sequence
  Description of Artificial Sequence: Synthetic oligonucleotide
  Target: ATXN1; (+) strand; PAM type: YTN; PAM sequence: TTT
ctgcatggttacataagcct

SEQ ID NO: 251338 - DNA, 20 bp, Artificial Sequence
  Description of Artificial Sequence: Synthetic oligonucleotide
  Target: ATXN1; (+) strand; PAM type: YTN; PAM sequence: TTC
tgcatggttacataagccta

SEQ ID NO: 251339 - DNA, 20 bp, Artificial Sequence
  Description of Artificial Sequence: Synthetic oligonucleotide
  Target: ATXN1; (+) strand; PAM type: YTN; PAM sequence: CTG
catggttacataagcctaca

SEQ ID NO: 251340 - DNA, 20 bp, Artificial Sequence
  Description of Artificial Sequence: Synthetic oligonucleotide
  Target: ATXN1; (+) strand; PAM type: YTN; PAM sequence: TTA
cataagcctacaaaagggaa

SEQ ID NO: 251341 - DNA, 20 bp, Artificial Sequence
  Description of Artificial Sequence: Synthetic oligonucleotide
  Target: ATXN1; (+) strand; PAM type: YTN; PAM sequence: CTA
caaaagggaaaaatgtaaat

SEQ ID NO: 251342 - DNA, 20 bp, Artificial Sequence
  Description of Artificial Sequence: Synthetic oligonucleotide
  Target: ATXN1; (+) strand; PAM type: YTN; PAM sequence: TTC
aagaagatattcttcatgcg

SEQ ID NO: 251343 - DNA, 20 bp, Artificial Sequence
  Description of Artificial Sequence: Synthetic oligonucleotide
  Target: ATXN1; (+) strand; PAM type: YTN; PAM sequence: TTC
ttcatgcggttctcatgaaa

SEQ ID NO: 251344 - DNA, 20 bp, Artificial Sequence
  Description of Artificial Sequence: Synthetic oligonucleotide
  Target: ATXN1; (+) strand; PAM type: YTN; PAM sequence: CTT
catgcggttctcatgaaatc

SEQ ID NO: 251345 - DNA, 20 bp, Artificial Sequence
  Description of Artificial Sequence: Synthetic oligonucleotide
  Target: ATXN1; (+) strand; PAM type: YTN; PAM sequence: TTC
atgcggttctcatgaaatct

SEQ ID NO: 251346 - DNA, 20 bp, Artificial Sequence
  Description of Artificial Sequence: Synthetic oligonucleotide
  Target: ATXN1; (+) strand; PAM type: YTN; PAM sequence: TTC
tcatgaaatctttaatatct

SEQ ID NO: 251347 - DNA, 20 bp, Artificial Sequence
  Description of Artificial Sequence: Synthetic oligonucleotide
  Target: ATXN1; (+) strand; PAM type: YTN; PAM sequence: CTC
atgaaatctttaatatctta

SEQ ID NO: 251348 - DNA, 20 bp, Artificial Sequence
  Description of Artificial Sequence: Synthetic oligonucleotide
  Target: ATXN1; (+) strand; PAM type: YTN; PAM sequence: CTT
taatatcttaagacttagga

SEQ ID NO: 251349 - DNA, 20 bp, Artificial Sequence
  Description of Artificial Sequence: Synthetic oligonucleotide
  Target: ATXN1; (+) strand; PAM type: YTN; PAM sequence: TTT
aatatcttaagacttaggaa

SEQ ID NO: 251350 - DNA, 20 bp, Artificial Sequence
  Description of Artificial Sequence: Synthetic oligonucleotide
  Target: ATXN1; (+) strand; PAM type: YTN; PAM sequence: TTA
atatcttaagacttaggaag

SEQ ID NO: 251351 - DNA, 20 bp, Artificial Sequence
  Description of Artificial Sequence: Synthetic oligonucleotide
  Target: ATXN1; (+) strand; PAM type: YTN; PAM sequence: CTT
aagacttaggaagaactctc

SEQ ID NO: 251352 - DNA, 20 bp, Artificial Sequence
  Description of Artificial Sequence: Synthetic oligonucleotide
  Target: ATXN1; (+) strand; PAM type: YTN; PAM sequence: TTA
agacttaggaagaactctcc

SEQ ID NO: 251353 - DNA, 20 bp, Artificial Sequence
  Description of Artificial Sequence: Synthetic oligonucleotide
  Target: ATXN1; (+) strand; PAM type: YTN; PAM sequence: CTT
aggaagaactctcctggcaa

SEQ ID NO: 251354 - DNA, 20 bp, Artificial Sequence
  Description of Artificial Sequence: Synthetic oligonucleotide
  Target: ATXN1; (+) strand; PAM type: YTN; PAM sequence: TTA
ggaagaactctcctggcaag

SEQ ID NO: 251355 - DNA, 20 bp, Artificial Sequence
  Description of Artificial Sequence: Synthetic oligonucleotide
  Target: ATXN1; (+) strand; PAM type: YTN; PAM sequence: CTC
tcctggcaagatacgatcaa

SEQ ID NO: 251356 - DNA, 20 bp, Artificial Sequence
  Description of Artificial Sequence: Synthetic oligonucleotide
  Target: ATXN1; (+) strand; PAM type: YTN; PAM sequence: CTC
ctggcaagatacgatcaatt

SEQ ID NO: 251357 - DNA, 20 bp, Artificial Sequence
  Description of Artificial Sequence: Synthetic oligonucleotide
  Target: ATXN1; (+) strand; PAM type: YTN; PAM sequence: CTG
gcaagatacgatcaattttc

SEQ ID NO: 251358 - DNA, 20 bp, Artificial Sequence
  Description of Artificial Sequence: Synthetic oligonucleotide
  Target: ATXN1; (+) strand; PAM type: YTN; PAM sequence: TTT
tcatgcttcattaggaaaaa

SEQ ID NO: 251359 - DNA, 20 bp, Artificial Sequence
  Description of Artificial Sequence: Synthetic oligonucleotide
  Target: ATXN1; (+) strand; PAM type: YTN; PAM sequence: TTT
catgcttcattaggaaaaaa

SEQ ID NO: 251360 - DNA, 20 bp, Artificial Sequence
  Description of Artificial Sequence: Synthetic oligonucleotide
  Target: ATXN1; (+) strand; PAM type: YTN; PAM sequence: TTC
atgcttcattaggaaaaaag

SEQ ID NO: 251361 - DNA, 20 bp, Artificial Sequence
  Description of Artificial Sequence: Synthetic oligonucleotide
  Target: ATXN1; (+) strand; PAM type: YTN; PAM sequence: CTT
cattaggaaaaaagcccttt

SEQ ID NO: 251362 - DNA, 20 bp, Artificial Sequence
  Description of Artificial Sequence: Synthetic oligonucleotide
  Target: ATXN1; (+) strand; PAM type: YTN; PAM sequence: TTC
attaggaaaaaagccctttc

SEQ ID NO: 251363 - DNA, 20 bp, Artificial Sequence
  Description of Artificial Sequence: Synthetic oligonucleotide
  Target: ATXN1; (+) strand; PAM type: YTN; PAM sequence: TTA
ggaaaaaagccctttcagta

SEQ ID NO: 251364 - DNA, 20 bp, Artificial Sequence
  Description of Artificial Sequence: Synthetic oligonucleotide
  Target: ATXN1; (+) strand; PAM type: YTN; PAM sequence: CTT
tcagtaatgttacagaaatg

SEQ ID NO: 251365 - DNA, 20 bp, Artificial Sequence
  Description of Artificial Sequence: Synthetic oligonucleotide
  Target: ATXN1; (+) strand; PAM type: YTN; PAM sequence: TTT
cagtaatgttacagaaatgg

SEQ ID NO: 251366 - DNA, 20 bp, Artificial Sequence
  Description of Artificial Sequence: Synthetic oligonucleotide
  Target: ATXN1; (+) strand; PAM type: YTN; PAM sequence: TTC
agtaatgttacagaaatggc

SEQ ID NO: 251367 - DNA, 20 bp, Artificial Sequence
  Description of Artificial Sequence: Synthetic oligonucleotide
  Target: ATXN1; (+) strand; PAM type: YTN; PAM sequence: TTA
cagaaatggctataggcaaa

SEQ ID NO: 251368 - DNA, 20 bp, Artificial Sequence
  Description of Artificial Sequence: Synthetic oligonucleotide
  Target: ATXN1; (+) strand; PAM type: YTN; PAM sequence: CTA
taggcaaaagagagaaaaaa

SEQ ID NO: 251369 - DNA, 20 bp, Artificial Sequence
  Description of Artificial Sequence: Synthetic oligonucleotide
  Target: ATXN1; (+) strand; PAM type: YTN; PAM sequence: TTA
cactctggactgaacaaaac

SEQ ID NO: 251370 - DNA, 20 bp, Artificial Sequence
  Description of Artificial Sequence: Synthetic oligonucleotide
  Target: ATXN1; (+) strand; PAM type: YTN; PAM sequence: CTC
tggactgaacaaaaccccaa

SEQ ID NO: 251371 - DNA, 20 bp, Artificial Sequence
  Description of Artificial Sequence: Synthetic oligonucleotide
  Target: ATXN1; (+) strand; PAM type: YTN; PAM sequence: CTG
gactgaacaaaaccccaagg

SEQ ID NO: 251372 - DNA, 20 bp, Artificial Sequence
  Description of Artificial Sequence: Synthetic oligonucleotide
  Target: ATXN1; (+) strand; PAM type: YTN; PAM sequence: CTG
aacaaaaccccaaggcactt

SEQ ID NO: 251373 - DNA, 20 bp, Artificial Sequence
  Description of Artificial Sequence: Synthetic oligonucleotide
  Target: ATXN1; (+) strand; PAM type: YTN; PAM sequence: CTT
tggactaaatcctttctttg

SEQ ID NO: 251374 - DNA, 20 bp, Artificial Sequence
  Description of Artificial Sequence: Synthetic oligonucleotide
  Target: ATXN1; (+) strand; PAM type: YTN; PAM sequence: TTT
ggactaaatcctttctttgt

SEQ ID NO: 251375 - DNA, 20 bp, Artificial Sequence
  Description of Artificial Sequence: Synthetic oligonucleotide
  Target: ATXN1; (+) strand; PAM type: YTN; PAM sequence: TTG
gactaaatcctttctttgta

SEQ ID NO: 251376 - DNA, 20 bp, Artificial Sequence
  Description of Artificial Sequence: Synthetic oligonucleotide
  Target: ATXN1; (+) strand; PAM type: YTN; PAM sequence: CTA
aatcctttctttgtacccac

SEQ ID NO: 251377 - DNA, 20 bp, Artificial Sequence
  Description of Artificial Sequence: Synthetic oligonucleotide
  Target: ATXN1; (+) strand; PAM type: YTN; PAM sequence: CTT
tctttgtacccacagcatat

SEQ ID NO: 251378 - DNA, 20 bp, Artificial Sequence
  Description of Artificial Sequence: Synthetic oligonucleotide
  Target: ATXN1; (+) strand; PAM type: YTN; PAM sequence: TTT
ctttgtacccacagcatatc

SEQ ID NO: 251379 - DNA, 20 bp, Artificial Sequence
  Description of Artificial Sequence: Synthetic oligonucleotide
  Target: ATXN1; (+) strand; PAM type: YTN; PAM sequence: TTC
tttgtacccacagcatatct

SEQ ID NO: 251380 - DNA, 20 bp, Artificial Sequence
  Description of Artificial Sequence: Synthetic oligonucleotide
  Target: ATXN1; (+) strand; PAM type: YTN; PAM sequence: CTT
tgtacccacagcatatctga

SEQ ID NO: 251381 - DNA, 20 bp, Artificial Sequence
  Description of Artificial Sequence: Synthetic oligonucleotide
  Target: ATXN1; (+) strand; PAM type: YTN; PAM sequence: TTT
gtacccacagcatatctgaa

SEQ ID NO: 251382 - DNA, 20 bp, Artificial Sequence
  Description of Artificial Sequence: Synthetic oligonucleotide
  Target: ATXN1; (+) strand; PAM type: YTN; PAM sequence: TTG
tacccacagcatatctgaaa

SEQ ID NO: 251383 - DNA, 20 bp, Artificial Sequence
  Description of Artificial Sequence: Synthetic oligonucleotide
  Target: ATXN1; (+) strand; PAM type: YTN; PAM sequence: CTG
aaaggagaagcaatgctcac

SEQ ID NO: 251384 - DNA, 20 bp, Artificial Sequence
  Description of Artificial Sequence: Synthetic oligonucleotide
  Target: ATXN1; (+) strand; PAM type: YTN; PAM sequence: CTC
acttggggtgtgtggggatt

SEQ ID NO: 251385 - DNA, 20 bp, Artificial Sequence
  Description of Artificial Sequence: Synthetic oligonucleotide
  Target: ATXN1; (+) strand; PAM type: YTN; PAM sequence: CTT
ggggtgtgtggggattgtat

SEQ ID NO: 251386 - DNA, 20 bp, Artificial Sequence
  Description of Artificial Sequence: Synthetic oligonucleotide
  Target: ATXN1; (+) strand; PAM type: YTN; PAM sequence: TTG
gggtgtgtggggattgtatt

SEQ ID NO: 251387 - DNA, 20 bp, Artificial Sequence
  Description of Artificial Sequence: Synthetic oligonucleotide
  Target: ATXN1; (+) strand; PAM type: YTN; PAM sequence: TTG
tattttgactagcctgtcta

SEQ ID NO: 251388 - DNA, 20 bp, Artificial Sequence
  Description of Artificial Sequence: Synthetic oligonucleotide
  Target: ATXN1; (+) strand; PAM type: YTN; PAM sequence: TTT
tgactagcctgtctacccac

SEQ ID NO: 251389 - DNA, 20 bp, Artificial Sequence
  Description of Artificial Sequence: Synthetic oligonucleotide
  Target: ATXN1; (+) strand; PAM type: YTN; PAM sequence: TTT
gactagcctgtctacccaca

SEQ ID NO: 251390 - DNA, 20 bp, Artificial Sequence
  Description of Artificial Sequence: Synthetic oligonucleotide
  Target: ATXN1; (+) strand; PAM type: YTN; PAM sequence: TTG
actagcctgtctacccacag

SEQ ID NO: 251391 - DNA, 20 bp, Artificial Sequence
  Description of Artificial Sequence: Synthetic oligonucleotide
  Target: ATXN1; (+) strand; PAM type: YTN; PAM sequence: CTA
gcctgtctacccacagaatt

SEQ ID NO: 251392 - DNA, 20 bp, Artificial Sequence
  Description of Artificial Sequence: Synthetic oligonucleotide
  Target: ATXN1; (+) strand; PAM type: YTN; PAM sequence: CTG
tctacccacagaatttcatt

SEQ ID NO: 251393 - DNA, 20 bp, Artificial Sequence
  Description of Artificial Sequence: Synthetic oligonucleotide
  Target: ATXN1; (+) strand; PAM type: YTN; PAM sequence: CTA
cccacagaatttcatttaat

SEQ ID NO: 251394 - DNA, 20 bp, Artificial Sequence
  Description of Artificial Sequence: Synthetic oligonucleotide
  Target: ATXN1; (+) strand; PAM type: YTN; PAM sequence: TTT
catttaatctaggtggagtt

SEQ ID NO: 251395 - DNA, 20 bp, Artificial Sequence
  Description of Artificial Sequence: Synthetic oligonucleotide
  Target: ATXN1; (+) strand; PAM type: YTN; PAM sequence: TTC
atttaatctaggtggagttg

SEQ ID NO: 251396 - DNA, 20 bp, Artificial Sequence
  Description of Artificial Sequence: Synthetic oligonucleotide
  Target: ATXN1; (+) strand; PAM type: YTN; PAM sequence: TTT
aatctaggtggagttgttat

SEQ ID NO: 251397 - DNA, 20 bp, Artificial Sequence
  Description of Artificial Sequence: Synthetic oligonucleotide
  Target: ATXN1; (+) strand; PAM type: YTN; PAM sequence: TTA
atctaggtggagttgttatc

SEQ ID NO: 251398 - DNA, 20 bp, Artificial Sequence
  Description of Artificial Sequence: Synthetic oligonucleotide
  Target: ATXN1; (+) strand; PAM type: YTN; PAM sequence: CTA
ggtggagttgttatcaatct

SEQ ID NO: 251399 - DNA, 20 bp, Artificial Sequence
  Description of Artificial Sequence: Synthetic oligonucleotide
  Target: ATXN1; (+) strand; PAM type: YTN; PAM sequence: TTG
ttatcaatctgtttagtctt

SEQ ID NO: 251400 - DNA, 20 bp, Artificial Sequence
  Description of Artificial Sequence: Synthetic oligonucleotide
  Target: ATXN1; (+) strand; PAM type: YTN; PAM sequence: TTA
tcaatctgtttagtctttca

SEQ ID NO: 251401 - DNA, 20 bp, Artificial Sequence
  Description of Artificial Sequence: Synthetic oligonucleotide
  Target: ATXN1; (+) strand; PAM type: YTN; PAM sequence: CTG
tttagtctttcacaaatttg

SEQ ID NO: 251402 - DNA, 20 bp, Artificial Sequence
  Description of Artificial Sequence: Synthetic oligonucleotide
  Target: ATXN1; (+) strand; PAM type: YTN; PAM sequence: TTT
agtctttcacaaatttgaag

SEQ ID NO: 251403 - DNA, 20 bp, Artificial Sequence
  Description of Artificial Sequence: Synthetic oligonucleotide
  Target: ATXN1; (+) strand; PAM type: YTN; PAM sequence: TTA
gtctttcacaaatttgaagg

SEQ ID NO: 251404 - DNA, 20 bp, Artificial Sequence
  Description of Artificial Sequence: Synthetic oligonucleotide
  Target: ATXN1; (+) strand; PAM type: YTN; PAM sequence: CTT
tcacaaatttgaagggactg

SEQ ID NO: 251405 - DNA, 20 bp, Artificial Sequence
  Description of Artificial Sequence: Synthetic oligonucleotide
  Target: ATXN1; (+) strand; PAM type: YTN; PAM sequence: TTT
cacaaatttgaagggactgt

SEQ ID NO: 251406 - DNA, 20 bp, Artificial Sequence
  Description of Artificial Sequence: Synthetic oligonucleotide
  Target: ATXN1; (+) strand; PAM type: YTN; PAM sequence: TTC
acaaatttgaagggactgta

SEQ ID NO: 251407 - DNA, 20 bp, Artificial Sequence
  Description of Artificial Sequence: Synthetic oligonucleotide
  Target: ATXN1; (+) strand; PAM type: YTN; PAM sequence: TTT
gaagggactgtagcttaaac

SEQ ID NO: 251408 - DNA, 20 bp, Artificial Sequence
  Description of Artificial Sequence: Synthetic oligonucleotide
  Target: ATXN1; (+) strand; PAM type: YTN; PAM sequence: TTG
aagggactgtagcttaaacc

SEQ ID NO: 251409 - DNA, 20 bp, Artificial Sequence
  Description of Artificial Sequence: Synthetic oligonucleotide
  Target: ATXN1; (+) strand; PAM type: YTN; PAM sequence: CTG
tagcttaaaccaacaatcac

SEQ ID NO: 251410 - DNA, 20 bp, Artificial Sequence
  Description of Artificial Sequence: Synthetic oligonucleotide
  Target: ATXN1; (+) strand; PAM type: YTN; PAM sequence: CTT
aaaccaacaatcaccctcaa

SEQ ID NO: 251411 - DNA, 20 bp, Artificial Sequence
  Description of Artificial Sequence: Synthetic oligonucleotide
  Target: ATXN1; (+) strand; PAM type: YTN; PAM sequence: TTA
aaccaacaatcaccctcaaa

SEQ ID NO: 251412 - DNA, 20 bp, Artificial Sequence
  Description of Artificial Sequence: Synthetic oligonucleotide
  Target: ATXN1; (+) strand; PAM type: YTN; PAM sequence: CTC
aaagcattgcaatgatatga

SEQ ID NO: 251413 - DNA, 20 bp, Artificial Sequence
  Description of Artificial Sequence: Synthetic oligonucleotide
  Target: ATXN1; (+) strand; PAM type: YTN; PAM sequence: TTG
caatgatatgaaggaaacag

SEQ ID NO: 251414 - DNA, 20 bp, Artificial Sequence
  Description of Artificial Sequence: Synthetic oligonucleotide
  Target: ATXN1; (+) strand; PAM type: YTN; PAM sequence: CTG
acatggggcctgtggaggtg

SEQ ID NO: 251415 - DNA, 20 bp, Artificial Sequence
  Description of Artificial Sequence: Synthetic oligonucleotide
  Target: ATXN1; (+) strand; PAM type: YTN; PAM sequence: CTG
tggaggtgggaaaatggtgg

SEQ ID NO: 251416 - DNA, 20 bp, Artificial Sequence
  Description of Artificial Sequence: Synthetic oligonucleotide
  Target: ATXN1; (+) strand; PAM type: YTN; PAM sequence: TTG
gagagaggccatatacactt

SEQ ID NO: 251417 - DNA, 20 bp, Artificial Sequence
  Description of Artificial Sequence: Synthetic oligonucleotide
  Target: ATXN1; (+) strand; PAM type: YTN; PAM sequence: CTT
gaatttctgcaaaggcagag

SEQ ID NO: 251418 - DNA, 20 bp, Artificial Sequence
  Description of Artificial Sequence: Synthetic oligonucleotide
  Target: ATXN1; (+) strand; PAM type: YTN; PAM sequence: TTG
aatttctgcaaaggcagagg

SEQ ID NO: 251419 - DNA, 20 bp, Artificial Sequence
  Description of Artificial Sequence: Synthetic oligonucleotide
  Target: ATXN1; (+) strand; PAM type: YTN; PAM sequence: TTT
ctgcaaaggcagaggcaaat

SEQ ID NO: 251420 - DNA, 20 bp, Artificial Sequence
  Description of Artificial Sequence: Synthetic oligonucleotide
  Target: ATXN1; (+) strand; PAM type: YTN; PAM sequence: TTC
tgcaaaggcagaggcaaatt

SEQ ID NO: 251421 - DNA, 20 bp, Artificial Sequence
  Description of Artificial Sequence: Synthetic oligonucleotide
  Target: ATXN1; (+) strand; PAM type: YTN; PAM sequence: CTG
caaaggcagaggcaaattat

SEQ ID NO: 251422 - DNA, 20 bp, Artificial Sequence
  Description of Artificial Sequence: Synthetic oligonucleotide
  Target: ATXN1; (+) strand; PAM type: YTN; PAM sequence: TTA
tgtcaccttcccgctttcct

SEQ ID NO: 251423 - DNA, 20 bp, Artificial Sequence
  Description of Artificial Sequence: Synthetic oligonucleotide
  Target: ATXN1; (+) strand; PAM type: YTN; PAM sequence: CTT
cccgctttccttttcattta

SEQ ID NO: 251424 - DNA, 20 bp, Artificial Sequence
  Description of Artificial Sequence: Synthetic oligonucleotide
  Target: ATXN1; (+) strand; PAM type: YTN; PAM sequence: TTC
ccgctttccttttcatttaa

SEQ ID NO: 251425 - DNA, 20 bp, Artificial Sequence
  Description of Artificial Sequence: Synthetic oligonucleotide
  Target: ATXN1; (+) strand; PAM type: YTN; PAM sequence: CTT
tccttttcatttaaaatcta

SEQ ID NO: 251426 - DNA, 20 bp, Artificial Sequence
  Description of Artificial Sequence: Synthetic oligonucleotide
  Target: ATXN1; (+) strand; PAM type: YTN; PAM sequence: TTT
ccttttcatttaaaatctac

SEQ ID NO: 251427 - DNA, 20 bp, Artificial Sequence
  Description of Artificial Sequence: Synthetic oligonucleotide
  Target: ATXN1; (+) strand; PAM type: YTN; PAM sequence: TTC
cttttcatttaaaatctaca

SEQ ID NO: 251428 - DNA, 20 bp, Artificial Sequence
  Description of Artificial Sequence: Synthetic oligonucleotide
  Target: ATXN1; (+) strand; PAM type: YTN; PAM sequence: CTT
ttcatttaaaatctacagct

SEQ ID NO: 251429 - DNA, 20 bp, Artificial Sequence
  Description of Artificial Sequence: Synthetic oligonucleotide
  Target: ATXN1; (+) strand; PAM type: YTN; PAM sequence: TTT
tcatttaaaatctacagctt

SEQ ID NO: 251430 - DNA, 20 bp, Artificial Sequence
  Description of Artificial Sequence: Synthetic oligonucleotide
  Target: ATXN1; (+) strand; PAM type: YTN; PAM sequence: TTT
catttaaaatctacagcttt

SEQ ID NO: 251431 - DNA, 20 bp, Artificial Sequence
  Description of Artificial Sequence: Synthetic oligonucleotide
  Target: ATXN1; (+) strand; PAM type: YTN; PAM sequence: TTC
atttaaaatctacagctttt

SEQ ID NO: 251432 - DNA, 20 bp, Artificial Sequence
  Description of Artificial Sequence: Synthetic oligonucleotide
  Target: ATXN1; (+) strand; PAM type: YTN; PAM sequence: TTT
aaaatctacagcttttcaag

SEQ ID NO: 251433 - DNA, 20 bp, Artificial Sequence
  Description of Artificial Sequence: Synthetic oligonucleotide
  Target: ATXN1; (+) strand; PAM type: YTN; PAM sequence: TTA
aaatctacagcttttcaaga

SEQ ID NO: 251434 - DNA, 20 bp, Artificial Sequence
  Description of Artificial Sequence: Synthetic oligonucleotide
  Target: ATXN1; (+) strand; PAM type: YTN; PAM sequence: CTA
cagcttttcaagacaatttc

SEQ ID NO: 251435 - DNA, 20 bp, Artificial Sequence
  Description of Artificial Sequence: Synthetic oligonucleotide
  Target: ATXN1; (+) strand; PAM type: YTN; PAM sequence: CTT
ttcaagacaatttcccttta

SEQ ID NO: 251436 - DNA, 20 bp, Artificial Sequence
  Description of Artificial Sequence: Synthetic oligonucleotide
  Target: ATXN1; (+) strand; PAM type: YTN; PAM sequence: TTT
tcaagacaatttccctttat

SEQ ID NO: 251437 - DNA, 20 bp, Artificial Sequence
  Description of Artificial Sequence: Synthetic oligonucleotide
  Target: ATXN1; (+) strand; PAM type: YTN; PAM sequence: TTT
caagacaatttccctttatt

SEQ ID NO: 251438 - DNA, 20 bp, Artificial Sequence
  Description of Artificial Sequence: Synthetic oligonucleotide
  Target: ATXN1; (+) strand; PAM type: YTN; PAM sequence: TTC
aagacaatttccctttattt

SEQ ID NO: 251439 - DNA, 20 bp, Artificial Sequence
  Description of Artificial Sequence: Synthetic oligonucleotide
  Target: ATXN1; (+) strand; PAM type: YTN; PAM sequence: TTT
ccctttatttcaggagaatc

SEQ ID NO: 251440 - DNA, 20 bp, Artificial Sequence
  Description of Artificial Sequence: Synthetic oligonucleotide
  Target: ATXN1; (+) strand; PAM type: YTN; PAM sequence: TTC
cctttatttcaggagaatcg

SEQ ID NO: 251441 - DNA, 20 bp, Artificial Sequence
  Description of Artificial Sequence: Synthetic oligonucleotide
  Target: ATXN1; (+) strand; PAM type: YTN; PAM sequence: CTT
tatttcaggagaatcgagaa

SEQ ID NO: 251442 - DNA, 20 bp, Artificial Sequence
  Description of Artificial Sequence: Synthetic oligonucleotide
  Target: ATXN1; (+) strand; PAM type: YTN; PAM sequence: TTT
atttcaggagaatcgagaat

SEQ ID NO: 251443 - DNA, 20 bp, Artificial Sequence
  Description of Artificial Sequence: Synthetic oligonucleotide
  Target: ATXN1; (+) strand; PAM type: YTN; PAM sequence: TTA
tttcaggagaatcgagaata

SEQ ID NO: 251444 - DNA, 20 bp, Artificial Sequence
  Description of Artificial Sequence: Synthetic oligonucleotide
  Target: ATXN1; (+) strand; PAM type: YTN; PAM sequence: TTT
caggagaatcgagaatacaa

SEQ ID NO: 251445 - DNA, 20 bp, Artificial Sequence
  Description of Artificial Sequence: Synthetic oligonucleotide
  Target: ATXN1; (+) strand; PAM type: YTN; PAM sequence: TTC
aggagaatcgagaatacaaa

SEQ ID NO: 251446 - DNA, 20 bp, Artificial Sequence
  Description of Artificial Sequence: Synthetic oligonucleotide
  Target: ATXN1; (+) strand; PAM type: YTN; PAM sequence: CTT
aagcacatcatttacattat

SEQ ID NO: 251447 - DNA, 20 bp, Artificial Sequence
  Description of Artificial Sequence: Synthetic oligonucleotide
  Target: ATXN1; (+) strand; PAM type: YTN; PAM sequence: TTA
agcacatcatttacattatt

SEQ ID NO: 251448 - DNA, 20 bp, Artificial Sequence
  Description of Artificial Sequence: Synthetic oligonucleotide
  Target: ATXN1; (+) strand; PAM type: YTN; PAM sequence: TTT
acattatttttttctgacac

SEQ ID NO: 251449 - DNA, 20 bp, Artificial Sequence
  Description of Artificial Sequence: Synthetic oligonucleotide
  Target: ATXN1; (+) strand; PAM type: YTN; PAM sequence: TTA
cattatttttttctgacact

SEQ ID NO: 251450 - DNA, 20 bp, Artificial Sequence
  Description of Artificial Sequence: Synthetic oligonucleotide
  Target: ATXN1; (+) strand; PAM type: YTN; PAM sequence: TTA
tttttttctgacacttgaat

SEQ ID NO: 251451 - DNA, 20 bp, Artificial Sequence
  Description of Artificial Sequence: Synthetic oligonucleotide
  Target: ATXN1; (+) strand; PAM type: YTN; PAM sequence: TTT
ttttctgacacttgaatagt

SEQ ID NO: 251452 - DNA, 20 bp, Artificial Sequence
  Description of Artificial Sequence: Synthetic oligonucleotide
  Target: ATXN1; (+) strand; PAM type: YTN; PAM sequence: TTT
tttctgacacttgaatagtt

SEQ ID NO: 251453 - DNA, 20 bp, Artificial Sequence
  Description of Artificial Sequence: Synthetic oligonucleotide
  Target: ATXN1; (+) strand; PAM type: YTN; PAM sequence: TTT
ttctgacacttgaatagttg

SEQ ID NO: 251454 - DNA, 20 bp, Artificial Sequence
  Description of Artificial Sequence: Synthetic oligonucleotide
  Target: ATXN1; (+) strand; PAM type: YTN; PAM sequence: TTT
tctgacacttgaatagttga

SEQ ID NO: 251455 - DNA, 20 bp, Artificial Sequence
  Description of Artificial Sequence: Synthetic oligonucleotide
  Target: ATXN1; (+) strand; PAM type: YTN; PAM sequence: TTT
ctgacacttgaatagttgac

SEQ ID NO: 251456 - DNA, 20 bp, Artificial Sequence
  Description of Artificial Sequence: Synthetic oligonucleotide
  Target: ATXN1; (+) strand; PAM type: YTN; PAM sequence: TTC
tgacacttgaatagttgaca

SEQ ID NO: 251457 - DNA, 20 bp, Artificial Sequence
  Description of Artificial Sequence: Synthetic oligonucleotide
  Target: ATXN1; (+) strand; PAM type: YTN; PAM sequence: CTG
acacttgaatagttgacaaa

SEQ ID NO: 251458 - DNA, 20 bp, Artificial Sequence
  Description of Artificial Sequence: Synthetic oligonucleotide
  Target: ATXN1; (+) strand; PAM type: YTN; PAM sequence: CTT
gaatagttgacaaactctga

SEQ ID NO: 251459 - DNA, 20 bp, Artificial Sequence
  Description of Artificial Sequence: Synthetic oligonucleotide
  Target: ATXN1; (+) strand; PAM type: YTN; PAM sequence: TTG
aatagttgacaaactctgaa

SEQ ID NO: 251460 - DNA, 20 bp, Artificial Sequence
  Description of Artificial Sequence: Synthetic oligonucleotide
  Target: ATXN1; (+) strand; PAM type: YTN; PAM sequence: TTG
acaaactctgaaatcacttc

SEQ ID NO: 251461 - DNA, 20 bp, Artificial Sequence
  Description of Artificial Sequence: Synthetic oligonucleotide
  Target: ATXN1; (+) strand; PAM type: YTN; PAM sequence: CTC
tgaaatcacttcttttaaac

SEQ ID NO: 251462 - DNA, 20 bp, Artificial Sequence
  Description of Artificial Sequence: Synthetic oligonucleotide
  Target: ATXN1; (+) strand; PAM type: YTN; PAM sequence: CTG
aaatcacttcttttaaacct

SEQ ID NO: 251463 - DNA, 20 bp, Artificial Sequence
  Description of Artificial Sequence: Synthetic oligonucleotide
  Target: ATXN1; (+) strand; PAM type: YTN; PAM sequence: CTT
cttttaaacctaatgttgat

SEQ ID NO: 251464 - DNA, 20 bp, Artificial Sequence
  Description of Artificial Sequence: Synthetic oligonucleotide
  Target: ATXN1; (+) strand; PAM type: YTN; PAM sequence: TTC
ttttaaacctaatgttgata

SEQ ID NO: 251465 - DNA, 20 bp, Artificial Sequence
  Description of Artificial Sequence: Synthetic oligonucleotide
  Target: ATXN1; (+) strand; PAM type: YTN; PAM sequence: CTT
ttaaacctaatgttgatacc

SEQ ID NO: 251466 - DNA, 20 bp, Artificial Sequence
  Description of Artificial Sequence: Synthetic oligonucleotide
  Target: ATXN1; (+) strand; PAM type: YTN; PAM sequence: TTT
taaacctaatgttgatacca

SEQ ID NO: 251467 - DNA, 20 bp, Artificial Sequence
  Description of Artificial Sequence: Synthetic oligonucleotide
  Target: ATXN1; (+) strand; PAM type: YTN; PAM sequence: TTT
aaacctaatgttgataccaa

SEQ ID NO: 251468 - DNA, 20 bp, Artificial Sequence
  Description of Artificial Sequence: Synthetic oligonucleotide
  Target: ATXN1; (+) strand; PAM type: YTN; PAM sequence: TTA
aacctaatgttgataccaaa

SEQ ID NO: 251469 - DNA, 20 bp, Artificial Sequence
  Description of Artificial Sequence: Synthetic oligonucleotide
  Target: ATXN1; (+) strand; PAM type: YTN; PAM sequence: CTA
atgttgataccaaattctac

SEQ ID NO: 251470 - DNA, 20 bp, Artificial Sequence
  Description of Artificial Sequence: Synthetic oligonucleotide
  Target: ATXN1; (+) strand; PAM type: YTN; PAM sequence: TTG
ataccaaattctactttttg

SEQ ID NO: 251471 - DNA, 20 bp, Artificial Sequence
  Description of Artificial Sequence: Synthetic oligonucleotide
  Target: ATXN1; (+) strand; PAM type: YTN; PAM sequence: TTC
tactttttggactcaaaaaa

SEQ ID NO: 251472 - DNA, 20 bp, Artificial Sequence
  Description of Artificial Sequence: Synthetic oligonucleotide
  Target: ATXN1; (+) strand; PAM type: YTN; PAM sequence: CTA
ctttttggactcaaaaaaac

SEQ ID NO: 251473 - DNA, 20 bp, Artificial Sequence
  Description of Artificial Sequence: Synthetic oligonucleotide
  Target: ATXN1; (+) strand; PAM type: YTN; PAM sequence: CTT
tttggactcaaaaaaacagt

SEQ ID NO: 251474 - DNA, 20 bp, Artificial Sequence
  Description of Artificial Sequence: Synthetic oligonucleotide
  Target: ATXN1; (+) strand; PAM type: YTN; PAM sequence: TTT
ttggactcaaaaaaacagtc

SEQ ID NO: 251475 - DNA, 20 bp, Artificial Sequence
  Description of Artificial Sequence: Synthetic oligonucleotide
  Target: ATXN1; (+) strand; PAM type: YTN; PAM sequence: TTT
tggactcaaaaaaacagtct

SEQ ID NO: 251476 - DNA, 20 bp, Artificial Sequence
  Description of Artificial Sequence: Synthetic oligonucleotide
  Target: ATXN1; (+) strand; PAM type: YTN; PAM sequence: TTT
ggactcaaaaaaacagtctt

SEQ ID NO: 251477 - DNA, 20 bp, Artificial Sequence
  Description of Artificial Sequence: Synthetic oligonucleotide
  Target: ATXN1; (+) strand; PAM type: YTN; PAM sequence: TTG
gactcaaaaaaacagtcttt

SEQ ID NO: 251478 - DNA, 20 bp, Artificial Sequence
  Description of Artificial Sequence: Synthetic oligonucleotide
  Target: ATXN1; (+) strand; PAM type: YTN; PAM sequence: CTC
aaaaaaacagtctttagaat

SEQ ID NO: 251479 - DNA, 20 bp, Artificial Sequence
  Description of Artificial Sequence: Synthetic oligonucleotide
  Target: ATXN1; (+) strand; PAM type: YTN; PAM sequence: CTT
tagaattgttcaatttaaaa

SEQ ID NO: 251480 - DNA, 20 bp, Artificial Sequence
  Description of Artificial Sequence: Synthetic oligonucleotide
  Target: ATXN1; (+) strand; PAM type: YTN; PAM sequence: TTT
agaattgttcaatttaaaag

SEQ ID NO: 251481 - DNA, 20 bp, Artificial Sequence
  Description of Artificial Sequence: Synthetic oligonucleotide
  Target: ATXN1; (+) strand; PAM type: YTN; PAM sequence: TTA
gaattgttcaatttaaaagc

SEQ ID NO: 251482 - DNA, 20 bp, Artificial Sequence
  Description of Artificial Sequence: Synthetic oligonucleotide
  Target: ATXN1; (+) strand; PAM type: YTN; PAM sequence: TTG
ttcaatttaaaagccttgtc

SEQ ID NO: 251483 - DNA, 20 bp, Artificial Sequence
  Description of Artificial Sequence: Synthetic oligonucleotide
  Target: ATXN1; (+) strand; PAM type: YTN; PAM sequence: TTC
aatttaaaagccttgtcata

SEQ ID NO: 251484 - DNA, 20 bp, Artificial Sequence
  Description of Artificial Sequence: Synthetic oligonucleotide
  Target: ATXN1; (+) strand; PAM type: YTN; PAM sequence: TTT
aaaagccttgtcatactgta

SEQ ID NO: 251485 - DNA, 20 bp, Artificial Sequence
  Description of Artificial Sequence: Synthetic oligonucleotide
  Target: ATXN1; (+) strand; PAM type: YTN; PAM sequence: TTA
aaagccttgtcatactgtag

SEQ ID NO: 251486 - DNA, 20 bp, Artificial Sequence
  Description of Artificial Sequence: Synthetic oligonucleotide
  Target: ATXN1; (+) strand; PAM type: YTN; PAM sequence: CTT
gtcatactgtagttatatat

SEQ ID NO: 251487 - DNA, 20 bp, Artificial Sequence
  Description of Artificial Sequence: Synthetic oligonucleotide
  Target: ATXN1; (+) strand; PAM type: YTN; PAM sequence: TTG
tcatactgtagttatatata

SEQ ID NO: 251488 - DNA, 20 bp, Artificial Sequence
  Description of Artificial Sequence: Synthetic oligonucleotide
  Target: ATXN1; (+) strand; PAM type: YTN; PAM sequence: CTG
tagttatatatactcaagga

SEQ ID NO: 251489 - DNA, 20 bp, Artificial Sequence
  Description of Artificial Sequence: Synthetic oligonucleotide
  Target: ATXN1; (+) strand; PAM type: YTN; PAM sequence: TTA
tatatactcaaggaagttat

SEQ ID NO: 251490 - DNA, 20 bp, Artificial Sequence
  Description of Artificial Sequence: Synthetic oligonucleotide
  Target: ATXN1; (+) strand; PAM type: YTN; PAM sequence: CTC
aaggaagttattgtatgcag

SEQ ID NO: 251491 - DNA, 20 bp, Artificial Sequence
  Description of Artificial Sequence: Synthetic oligonucleotide
  Target: ATXN1; (+) strand; PAM type: YTN; PAM sequence: TTA
ttgtatgcagagagctgcag

SEQ ID NO: 251492 - DNA, 20 bp, Artificial Sequence
  Description of Artificial Sequence: Synthetic oligonucleotide
  Target: ATXN1; (+) strand; PAM type: YTN; PAM sequence: TTG
tatgcagagagctgcagaca

SEQ ID NO: 251493 - DNA, 20 bp, Artificial Sequence
  Description of Artificial Sequence: Synthetic oligonucleotide
  Target: ATXN1; (+) strand; PAM type: YTN; PAM sequence: CTG
cagacattcttgaaaggtaa

SEQ ID NO: 251494 - DNA, 20 bp, Artificial Sequence
  Description of Artificial Sequence: Synthetic oligonucleotide
  Target: ATXN1; (+) strand; PAM type: YTN; PAM sequence: TTC
ttgaaaggtaaggagtatac

SEQ ID NO: 251495 - DNA, 20 bp, Artificial Sequence
  Description of Artificial Sequence: Synthetic oligonucleotide
  Target: ATXN1; (+) strand; PAM type: YTN; PAM sequence: CTT
gaaaggtaaggagtatacaa

SEQ ID NO: 251496 - DNA, 20 bp, Artificial Sequence
  Description of Artificial Sequence: Synthetic oligonucleotide
  Target: ATXN1; (+) strand; PAM type: YTN; PAM sequence: TTG
aaaggtaaggagtatacaaa

SEQ ID NO: 251497 - DNA, 20 bp, Artificial Sequence
  Description of Artificial Sequence: Synthetic oligonucleotide
  Target: ATXN1; (+) strand; PAM type: YTN; PAM sequence: CTG
caggaacctagcaatctagc

SEQ ID NO: 251498 - DNA, 20 bp, Artificial Sequence
  Description of Artificial Sequence: Synthetic oligonucleotide
  Target: ATXN1; (+) strand; PAM type: YTN; PAM sequence: CTA
gcaatctagcttcaaaatgg

SEQ ID NO: 251499 - DNA, 20 bp, Artificial Sequence
  Description of Artificial Sequence: Synthetic oligonucleotide
  Target: ATXN1; (+) strand; PAM type: YTN; PAM sequence: CTA
gcttcaaaatggtttcattc

SEQ ID NO: 251500 - DNA, 20 bp, Artificial Sequence
  Description of Artificial Sequence: Synthetic oligonucleotide
  Target: ATXN1; (+) strand; PAM type: YTN; PAM sequence: CTT
caaaatggtttcattcattc

SEQ ID NO: 251501 - DNA, 20 bp, Artificial Sequence
  Description of Artificial Sequence: Synthetic oligonucleotide
  Target: ATXN1; (+) strand; PAM type: YTN; PAM sequence: TTC
aaaatggtttcattcattca

SEQ ID NO: 251502 - DNA, 20 bp, Artificial Sequence
  Description of Artificial Sequence: Synthetic oligonucleotide
  Target: ATXN1; (+) strand; PAM type: YTN; PAM sequence: TTT
cattcattcattcattcaca

SEQ ID NO: 251503 - DNA, 20 bp, Artificial Sequence
  Description of Artificial Sequence: Synthetic oligonucleotide
  Target: ATXN1; (+) strand; PAM type: YTN; PAM sequence: TTC
attcattcattcattcacac

SEQ ID NO: 251504 - DNA, 20 bp, Artificial Sequence
  Description of Artificial Sequence: Synthetic oligonucleotide
  Target: ATXN1; (+) strand; PAM type: YTN; PAM sequence: TTC
attcattcattcacacgagc

SEQ ID NO: 251505 - DNA, 20 bp, Artificial Sequence
  Description of Artificial Sequence: Synthetic oligonucleotide
  Target: ATXN1; (+) strand; PAM type: YTN; PAM sequence: TTC
attcattcacacgagcactt

SEQ ID NO: 251506 - DNA, 20 bp, Artificial Sequence
  Description of Artificial Sequence: Synthetic oligonucleotide
  Target: ATXN1; (+) strand; PAM type: YTN; PAM sequence: TTC
attcacacgagcacttccat

SEQ ID NO: 251507 - DNA, 20 bp, Artificial Sequence
  Description of Artificial Sequence: Synthetic oligonucleotide
  Target: ATXN1; (+) strand; PAM type: YTN; PAM sequence: TTC
acacgagcacttccatcaat

SEQ ID NO: 251508 - DNA, 20 bp, Artificial Sequence
  Description of Artificial Sequence: Synthetic oligonucleotide
  Target: ATXN1; (+) strand; PAM type: YTN; PAM sequence: CTT
ccatcaatttactttcagta

SEQ ID NO: 251509 - DNA, 20 bp, Artificial Sequence
  Description of Artificial Sequence: Synthetic oligonucleotide
  Target: ATXN1; (+) strand; PAM type: YTN; PAM sequence: TTC
catcaatttactttcagtat

SEQ ID NO: 251510 - DNA, 20 bp, Artificial Sequence
  Description of Artificial Sequence: Synthetic oligonucleotide
  Target: ATXN1; (+) strand; PAM type: YTN; PAM sequence: TTT
actttcagtatccctcatat

SEQ ID NO: 251511 - DNA, 20 bp, Artificial Sequence
  Description of Artificial Sequence: Synthetic oligonucleotide
  Target: ATXN1; (+) strand; PAM type: YTN; PAM sequence: TTA
ctttcagtatccctcatata

SEQ ID NO: 251512 - DNA, 20 bp, Artificial Sequence
  Description of Artificial Sequence: Synthetic oligonucleotide
  Target: ATXN1; (+) strand; PAM type: YTN; PAM sequence: CTT
tcagtatccctcatatatgg

SEQ ID NO: 251513 - DNA, 20 bp, Artificial Sequence
  Description of Artificial Sequence: Synthetic oligonucleotide
  Target: ATXN1; (+) strand; PAM type: YTN; PAM sequence: TTT
cagtatccctcatatatggg

SEQ ID NO: 251514 - DNA, 20 bp, Artificial Sequence
  Description of Artificial Sequence: Synthetic oligonucleotide
  Target: ATXN1; (+) strand; PAM type: YTN; PAM sequence: TTC
agtatccctcatatatggga

SEQ ID NO: 251515 - DNA, 20 bp, Artificial Sequence
  Description of Artificial Sequence: Synthetic oligonucleotide
  Target: ATXN1; (+) strand; PAM type: YTN; PAM sequence: CTC
atatatgggattagtgccca

SEQ ID NO: 251516 - DNA, 20 bp, Artificial Sequence
  Description of Artificial Sequence: Synthetic oligonucleotide
  Target: ATXN1; (+) strand; PAM type: YTN; PAM sequence: TTA
gtgcccatctataagggacc

SEQ ID NO: 251517 - DNA, 20 bp, Artificial Sequence
  Description of Artificial Sequence: Synthetic oligonucleotide
  Target: ATXN1; (+) strand; PAM type: YTN; PAM sequence: CTA
taagggaccccagagagcga

SEQ ID NO: 251518 - DNA, 20 bp, Artificial Sequence
  Description of Artificial Sequence: Synthetic oligonucleotide
  Target: ATXN1; (+) strand; PAM type: YTN; PAM sequence: CTT
gctccttccaccatgtgagg

SEQ ID NO: 251519 - DNA, 20 bp, Artificial Sequence
  Description of Artificial Sequence: Synthetic oligonucleotide
  Target: ATXN1; (+) strand; PAM type: YTN; PAM sequence: TTG
ctccttccaccatgtgagga

SEQ ID NO: 251520 - DNA, 20 bp, Artificial Sequence
  Description of Artificial Sequence: Synthetic oligonucleotide
  Target: ATXN1; (+) strand; PAM type: YTN; PAM sequence: CTC
cttccaccatgtgaggacac

SEQ ID NO: 251521 - DNA, 20 bp, Artificial Sequence
  Description of Artificial Sequence: Synthetic oligonucleotide
  Target: ATXN1; (+) strand; PAM type: YTN; PAM sequence: CTT
ccaccatgtgaggacacacc

SEQ ID NO: 251522 - DNA, 20 bp, Artificial Sequence
  Description of Artificial Sequence: Synthetic oligonucleotide
  Target: ATXN1; (+) strand; PAM type: YTN; PAM sequence: TTC
caccatgtgaggacacacca

SEQ ID NO: 251523 - DNA, 20 bp, Artificial Sequence
  Description of Artificial Sequence: Synthetic oligonucleotide
  Target: ATXN1; (+) strand; PAM type: YTN; PAM sequence: CTA
tgaaccaaaaaaatcaaacc

SEQ ID NO: 251524 - DNA, 20 bp, Artificial Sequence
  Description of Artificial Sequence: Synthetic oligonucleotide
  Target: ATXN1; (+) strand; PAM type: YTN; PAM sequence: CTC
accaaatcctgaagctgctg

SEQ ID NO: 251525 - DNA, 20 bp, Artificial Sequence
  Description of Artificial Sequence: Synthetic oligonucleotide
  Target: ATXN1; (+) strand; PAM type: YTN; PAM sequence: CTG
aagctgctggcaccttgatc

SEQ ID NO: 251526 - DNA, 20 bp, Artificial Sequence
  Description of Artificial Sequence: Synthetic oligonucleotide
  Target: ATXN1; (+) strand; PAM type: YTN; PAM sequence: CTG
ctggcaccttgatcttggac

SEQ ID NO: 251527 - DNA, 20 bp, Artificial Sequence
  Description of Artificial Sequence: Synthetic oligonucleotide
  Target: ATXN1; (+) strand; PAM type: YTN; PAM sequence: CTG
gcaccttgatcttggacttc

SEQ ID NO: 251528 - DNA, 20 bp, Artificial Sequence
  Description of Artificial Sequence: Synthetic oligonucleotide
  Target: ATXN1; (+) strand; PAM type: YTN; PAM sequence: CTT
gatcttggacttcccagcca

SEQ ID NO: 251529 - DNA, 20 bp, Artificial Sequence
  Description of Artificial Sequence: Synthetic oligonucleotide
  Target: ATXN1; (+) strand; PAM type: YTN; PAM sequence: TTG
atcttggacttcccagccac

SEQ ID NO: 251530 - DNA, 20 bp, Artificial Sequence
  Description of Artificial Sequence: Synthetic oligonucleotide
  Target: ATXN1; (+) strand; PAM type: YTN; PAM sequence: CTT
ggacttcccagccaccagca

SEQ ID NO: 251531 - DNA, 20 bp, Artificial Sequence
  Description of Artificial Sequence: Synthetic oligonucleotide
  Target: ATXN1; (+) strand; PAM type: YTN; PAM sequence: TTG
gacttcccagccaccagcac

SEQ ID NO: 251532 - DNA, 20 bp, Artificial Sequence
  Description of Artificial Sequence: Synthetic oligonucleotide
  Target: ATXN1; (+) strand; PAM type: YTN; PAM sequence: CTT
cccagccaccagcactgtga

SEQ ID NO: 251533 - DNA, 20 bp, Artificial Sequence
  Description of Artificial Sequence: Synthetic oligonucleotide
  Target: ATXN1; (+) strand; PAM type: YTN; PAM sequence: TTC
ccagccaccagcactgtgag

SEQ ID NO: 251534 - DNA, 20 bp, Artificial Sequence
  Description of Artificial Sequence: Synthetic oligonucleotide
  Target: ATXN1; (+) strand; PAM type: YTN; PAM sequence: CTG
tgagaaatgtatttctgttg

SEQ ID NO: 251535 - DNA, 20 bp, Artificial Sequence
  Description of Artificial Sequence: Synthetic oligonucleotide
  Target: ATXN1; (+) strand; PAM type: YTN; PAM sequence: TTT
ctgttgtttataagtttacg

SEQ ID NO: 251536 - DNA, 20 bp, Artificial Sequence
  Description of Artificial Sequence: Synthetic oligonucleotide
  Target: ATXN1; (+) strand; PAM type: YTN; PAM sequence: TTC
tgttgtttataagtttacgg

SEQ ID NO: 251537 - DNA, 20 bp, Artificial Sequence
  Description of Artificial Sequence: Synthetic oligonucleotide
  Target: ATXN1; (+) strand; PAM type: YTN; PAM sequence: CTG
ttgtttataagtttacggta

SEQ ID NO: 251538 - DNA, 20 bp, Artificial Sequence
  Description of Artificial Sequence: Synthetic oligonucleotide
  Target: ATXN1; (+) strand; PAM type: YTN; PAM sequence: TTG
tttataagtttacggtattt

SEQ ID NO: 251539 - DNA, 20 bp, Artificial Sequence
  Description of Artificial Sequence: Synthetic oligonucleotide
  Target: ATXN1; (+) strand; PAM type: YTN; PAM sequence: TTT
ataagtttacggtattttgc

SEQ ID NO: 251540 - DNA, 20 bp, Artificial Sequence
  Description of Artificial Sequence: Synthetic oligonucleotide
  Target: ATXN1; (+) strand; PAM type: YTN; PAM sequence: TTA
taagtttacggtattttgct

SEQ ID NO: 251541 - DNA, 20 bp, Artificial Sequence
  Description of Artificial Sequence: Synthetic oligonucleotide
  Target: ATXN1; (+) strand; PAM type: YTN; PAM sequence: TTT
acggtattttgcttagcagt

SEQ ID NO: 251542 - DNA, 20 bp, Artificial Sequence
  Description of Artificial Sequence: Synthetic oligonucleotide
  Target: ATXN1; (+) strand; PAM type: YTN; PAM sequence: TTA
cggtattttgcttagcagtc

SEQ ID NO: 251543 - DNA, 20 bp, Artificial Sequence
  Description of Artificial Sequence: Synthetic oligonucleotide
  Target: ATXN1; (+) strand; PAM type: YTN; PAM sequence: TTT
tgcttagcagtccaaatgga

SEQ ID NO: 251544 - DNA, 20 bp, Artificial Sequence
  Description of Artificial Sequence: Synthetic oligonucleotide
  Target: ATXN1; (+) strand; PAM type: YTN; PAM sequence: TTT
gcttagcagtccaaatggac

SEQ ID NO: 251545 - DNA, 20 bp, Artificial Sequence
  Description of Artificial Sequence: Synthetic oligonucleotide
  Target: ATXN1; (+) strand; PAM type: YTN; PAM sequence: TTG
cttagcagtccaaatggact

SEQ ID NO: 251546 - DNA, 20 bp, Artificial Sequence
  Description of Artificial Sequence: Synthetic oligonucleotide
  Target: ATXN1; (+) strand; PAM type: YTN; PAM sequence: CTT
agcagtccaaatggactaag

SEQ ID NO: 251547 - DNA, 20 bp, Artificial Sequence
  Description of Artificial Sequence: Synthetic oligonucleotide
  Target: ATXN1; (+) strand; PAM type: YTN; PAM sequence: TTA
gcagtccaaatggactaaga

SEQ ID NO: 251548 - DNA, 20 bp, Artificial Sequence
  Description of Artificial Sequence: Synthetic oligonucleotide
  Target: ATXN1; (+) strand; PAM type: YTN; PAM sequence: CTA
agacactgccaaaagccaaa

SEQ ID NO: 251549 - DNA, 20 bp, Artificial Sequence
  Description of Artificial Sequence: Synthetic oligonucleotide
  Target: ATXN1; (+) strand; PAM type: YTN; PAM sequence: CTG
ccaaaagccaaaaatacatc

SEQ ID NO: 251550 - DNA, 20 bp, Artificial Sequence
  Description of Artificial Sequence: Synthetic oligonucleotide
  Target: ATXN1; (+) strand; PAM type: YTN; PAM sequence: CTC
aaaggaagaaaagtttgaaa

SEQ ID NO: 251551 - DNA, 20 bp, Artificial Sequence
  Description of Artificial Sequence: Synthetic oligonucleotide
  Target: ATXN1; (+) strand; PAM type: YTN; PAM sequence: TTT
gaaaccattcaactggagtg

SEQ ID NO: 251552 - DNA, 20 bp, Artificial Sequence
  Description of Artificial Sequence: Synthetic oligonucleotide
  Target: ATXN1; (+) strand; PAM type: YTN; PAM sequence: TTG
aaaccattcaactggagtga

SEQ ID NO: 251553 - DNA, 20 bp, Artificial Sequence
  Description of Artificial Sequence: Synthetic oligonucleotide
  Target: ATXN1; (+) strand; PAM type: YTN; PAM sequence: TTC
aactggagtgaatgtggcac

SEQ ID NO: 251554 - DNA, 20 bp, Artificial Sequence
  Description of Artificial Sequence: Synthetic oligonucleotide
  Target: ATXN1; (+) strand; PAM type: YTN; PAM sequence: CTG
gagtgaatgtggcacactct

SEQ ID NO: 251555 - DNA, 20 bp, Artificial Sequence
  Description of Artificial Sequence: Synthetic oligonucleotide
  Target: ATXN1; (+) strand; PAM type: YTN; PAM sequence: CTC
ttgttctctgcctgggagaa

SEQ ID NO: 251556 - DNA, 20 bp, Artificial Sequence
  Description of Artificial Sequence: Synthetic oligonucleotide
  Target: ATXN1; (+) strand; PAM type: YTN; PAM sequence: CTT
gttctctgcctgggagaaca

SEQ ID NO: 251557 - DNA, 20 bp, Artificial Sequence
  Description of Artificial Sequence: Synthetic oligonucleotide
  Target: ATXN1; (+) strand; PAM type: YTN; PAM sequence: TTG
ttctctgcctgggagaacaa

SEQ ID NO: 251558 - DNA, 20 bp, Artificial Sequence
  Description of Artificial Sequence: Synthetic oligonucleotide
  Target: ATXN1; (+) strand; PAM type: YTN; PAM sequence: TTC
tctgcctgggagaacaagtc

SEQ ID NO: 251559 - DNA, 20 bp, Artificial Sequence
  Description of Artificial Sequence: Synthetic oligonucleotide
  Target: ATXN1; (+) strand; PAM type: YTN; PAM sequence: CTC
tgcctgggagaacaagtcag

SEQ ID NO: 251560 - DNA, 20 bp, Artificial Sequence
  Description of Artificial Sequence: Synthetic oligonucleotide
  Target: ATXN1; (+) strand; PAM type: YTN; PAM sequence: CTG
cctgggagaacaagtcagct

SEQ ID NO: 251561 - DNA, 20 bp, Artificial Sequence
  Description of Artificial Sequence: Synthetic oligonucleotide
  Target: ATXN1; (+) strand; PAM type: YTN; PAM sequence: CTG
ggagaacaagtcagctgata

SEQ ID NO: 251562 - DNA, 20 bp, Artificial Sequence
  Description of Artificial Sequence: Synthetic oligonucleotide
  Target: ATXN1; (+) strand; PAM type: YTN; PAM sequence: CTG
atatgagcctgcttttctgt

SEQ ID NO: 251563 - DNA, 20 bp, Artificial Sequence
  Description of Artificial Sequence: Synthetic oligonucleotide
  Target: ATXN1; (+) strand; PAM type: YTN; PAM sequence: CTG
cttttctgtgtgaagaatgt

SEQ ID NO: 251564 - DNA, 20 bp, Artificial Sequence
  Description of Artificial Sequence: Synthetic oligonucleotide
  Target: ATXN1; (+) strand; PAM type: YTN; PAM sequence: CTT
ttctgtgtgaagaatgtaca

SEQ ID NO: 251565 - DNA, 20 bp, Artificial Sequence
  Description of Artificial Sequence: Synthetic oligonucleotide
  Target: ATXN1; (+) strand; PAM type: YTN; PAM sequence: TTT
tctgtgtgaagaatgtacag

SEQ ID NO: 251566 - DNA, 20 bp, Artificial Sequence
  Description of Artificial Sequence: Synthetic oligonucleotide
  Target: ATXN1; (+) strand; PAM type: YTN; PAM sequence: TTT
ctgtgtgaagaatgtacaga

SEQ ID NO: 251567 - DNA, 20 bp, Artificial Sequence
  Description of Artificial Sequence: Synthetic oligonucleotide
  Target: ATXN1; (+) strand; PAM type: YTN; PAM sequence: TTC
tgtgtgaagaatgtacagag

SEQ ID NO: 251568 - DNA, 20 bp, Artificial Sequence
  Description of Artificial Sequence: Synthetic oligonucleotide
  Target: ATXN1; (+) strand; PAM type: YTN; PAM sequence: CTG
tgtgaagaatgtacagagtt

SEQ ID NO: 251569 - DNA, 20 bp, Artificial Sequence
  Description of Artificial Sequence: Synthetic oligonucleotide
  Target: ATXN1; (+) strand; PAM type: YTN; PAM sequence: TTT
gaaaagatccttcttcttcc

SEQ ID NO: 251570 - DNA, 20 bp, Artificial Sequence
  Description of Artificial Sequence: Synthetic oligonucleotide
  Target: ATXN1; (+) strand; PAM type: YTN; PAM sequence: TTG
aaaagatccttcttcttccc

SEQ ID NO: 251571 - DNA, 20 bp, Artificial Sequence
  Description of Artificial Sequence: Synthetic oligonucleotide
  Target: ATXN1; (+) strand; PAM type: YTN; PAM sequence: CTT
cttcttccctcatccttccc

SEQ ID NO: 251572 - DNA, 20 bp, Artificial Sequence
  Description of Artificial Sequence: Synthetic oligonucleotide
  Target: ATXN1; (+) strand; PAM type: YTN; PAM sequence: TTC
ttcttccctcatccttccca

SEQ ID NO: 251573 - DNA, 20 bp, Artificial Sequence
  Description of Artificial Sequence: Synthetic oligonucleotide
  Target: ATXN1; (+) strand; PAM type: YTN; PAM sequence: CTT
cttccctcatccttcccatt

SEQ ID NO: 251574 - DNA, 20 bp, Artificial Sequence
  Description of Artificial Sequence: Synthetic oligonucleotide
  Target: ATXN1; (+) strand; PAM type: YTN; PAM sequence: TTC
ttccctcatccttcccattg

SEQ ID NO: 251575 - DNA, 20 bp, Artificial Sequence
  Description of Artificial Sequence: Synthetic oligonucleotide
  Target: ATXN1; (+) strand; PAM type: YTN; PAM sequence: CTT
ccctcatccttcccattgct

SEQ ID NO: 251576 - DNA, 20 bp, Artificial Sequence
  Description of Artificial Sequence: Synthetic oligonucleotide
  Target: ATXN1; (+) strand; PAM type: YTN; PAM sequence: TTC
cctcatccttcccattgctg

SEQ ID NO: 251577 - DNA, 20 bp, Artificial Sequence
  Description of Artificial Sequence: Synthetic oligonucleotide
  Target: ATXN1; (+) strand; PAM type: YTN; PAM sequence: CTC
atccttcccattgctgtgca

SEQ ID NO: 251578 - DNA, 20 bp, Artificial Sequence
  Description of Artificial Sequence: Synthetic oligonucleotide
  Target: ATXN1; (+) strand; PAM type: YTN; PAM sequence: CTT
cccattgctgtgcaccttca

SEQ ID NO: 251579 - DNA, 20 bp, Artificial Sequence
  Description of Artificial Sequence: Synthetic oligonucleotide
  Target: ATXN1; (+) strand; PAM type: YTN; PAM sequence: TTC
ccattgctgtgcaccttcat

SEQ ID NO: 251580 - DNA, 20 bp, Artificial Sequence
  Description of Artificial Sequence: Synthetic oligonucleotide
  Target: ATXN1; (+) strand; PAM type: YTN; PAM sequence: TTG
ctgtgcaccttcatgggtca

SEQ ID NO: 251581 - DNA, 20 bp, Artificial Sequence
  Description of Artificial Sequence: Synthetic oligonucleotide
  Target: ATXN1; (+) strand; PAM type: YTN; PAM sequence: CTG
tgcaccttcatgggtcatac

SEQ ID NO: 251582 - DNA, 20 bp, Artificial Sequence
  Description of Artificial Sequence: Synthetic oligonucleotide
  Target: ATXN1; (+) strand; PAM type: YTN; PAM sequence: CTT
catgggtcatacaggttata

SEQ ID NO: 251583 - DNA, 20 bp, Artificial Sequence
  Description of Artificial Sequence: Synthetic oligonucleotide
  Target: ATXN1; (+) strand; PAM type: YTN; PAM sequence: TTC
atgggtcatacaggttatat

SEQ ID NO: 251584 - DNA, 20 bp, Artificial Sequence
  Description of Artificial Sequence: Synthetic oligonucleotide
  Target: ATXN1; (+) strand; PAM type: YTN; PAM sequence: TTA
tatgagggtccggagggtca

SEQ ID NO: 251585 - DNA, 20 bp, Artificial Sequence
  Description of Artificial Sequence: Synthetic oligonucleotide
  Target: ATXN1; (+) strand; PAM type: YTN; PAM sequence: CTG
aacaggctacagccgctgtt

SEQ ID NO: 251586 - DNA, 20 bp, Artificial Sequence
  Description of Artificial Sequence: Synthetic oligonucleotide
  Target: ATXN1; (+) strand; PAM type: YTN; PAM sequence: CTA
cagccgctgttcaccaagag

SEQ ID NO: 251587 - DNA, 20 bp, Artificial Sequence
  Description of Artificial Sequence: Synthetic oligonucleotide
  Target: ATXN1; (+) strand; PAM type: YTN; PAM sequence: CTG
ttcaccaagagcccatggtc

SEQ ID NO: 251588 - DNA, 20 bp, Artificial Sequence
  Description of Artificial Sequence: Synthetic oligonucleotide
  Target: ATXN1; (+) strand; PAM type: YTN; PAM sequence: TTC
accaagagcccatggtctcg

SEQ ID NO: 251589 - DNA, 20 bp, Artificial Sequence
  Description of Artificial Sequence: Synthetic oligonucleotide
  Target: ATXN1; (+) strand; PAM type: YTN; PAM sequence: CTC
gcggggagacagacaccaag

SEQ ID NO: 251590 - DNA, 20 bp, Artificial Sequence
  Description of Artificial Sequence: Synthetic oligonucleotide
  Target: ATXN1; (+) strand; PAM type: YTN; PAM sequence: CTC
actgggattagtgctccact

SEQ ID NO: 251591 - DNA, 20 bp, Artificial Sequence
  Description of Artificial Sequence: Synthetic oligonucleotide
  Target: ATXN1; (+) strand; PAM type: YTN; PAM sequence: CTG
ggattagtgctccactgggg

SEQ ID NO: 251592 - DNA, 20 bp, Artificial Sequence
  Description of Artificial Sequence: Synthetic oligonucleotide
  Target: ATXN1; (+) strand; PAM type: YTN; PAM sequence: TTA
gtgctccactgggggtagct

SEQ ID NO: 251593 - DNA, 20 bp, Artificial Sequence
  Description of Artificial Sequence: Synthetic oligonucleotide
  Target: ATXN1; (+) strand; PAM type: YTN; PAM sequence: CTC
cactgggggtagctgaatgg

SEQ ID NO: 251594 - DNA, 20 bp, Artificial Sequence
  Description of Artificial Sequence: Synthetic oligonucleotide
  Target: ATXN1; (+) strand; PAM type: YTN; PAM sequence: CTG
ggggtagctgaatggtgctc

SEQ ID NO: 251595 - DNA, 20 bp, Artificial Sequence
  Description of Artificial Sequence: Synthetic oligonucleotide
  Target: ATXN1; (+) strand; PAM type: YTN; PAM sequence: CTG
aatggtgctctaagagcaga

SEQ ID NO: 251596 - DNA, 20 bp, Artificial Sequence
  Description of Artificial Sequence: Synthetic oligonucleotide
  Target: ATXN1; (+) strand; PAM type: YTN; PAM sequence: CTC
taagagcagagaggaacaag

SEQ ID NO: 251597 - DNA, 20 bp, Artificial Sequence
  Description of Artificial Sequence: Synthetic oligonucleotide
  Target: ATXN1; (+) strand; PAM type: YTN; PAM sequence: CTA
agagcagagaggaacaagac

SEQ ID NO: 251598 - DNA, 20 bp, Artificial Sequence
  Description of Artificial Sequence: Synthetic oligonucleotide
  Target: ATXN1; (+) strand; PAM type: YTN; PAM sequence: CTA
tctctgtacgcctgtgtgca

SEQ ID NO: 251599 - DNA, 20 bp, Artificial Sequence
  Description of Artificial Sequence: Synthetic oligonucleotide
  Target: ATXN1; (+) strand; PAM type: YTN; PAM sequence: CTC
tgtacgcctgtgtgcacagg

SEQ ID NO: 251600 - DNA, 20 bp, Artificial Sequence
  Description of Artificial Sequence: Synthetic oligonucleotide
  Target: ATXN1; (+) strand; PAM type: YTN; PAM sequence: CTG
tacgcctgtgtgcacaggag

SEQ ID NO: 251601 - DNA, 20 bp, Artificial Sequence
  Description of Artificial Sequence: Synthetic oligonucleotide
  Target: ATXN1; (+) strand; PAM type: YTN; PAM sequence: CTG
tgtgcacaggagcgggtggt

SEQ ID NO: 251602 - DNA, 20 bp, Artificial Sequence
  Description of Artificial Sequence: Synthetic oligonucleotide
  Target: ATXN1; (+) strand; PAM type: YTN; PAM sequence: CTG
ctgacaggaatgtggcacag

SEQ ID NO: 251603 - DNA, 20 bp, Artificial Sequence
  Description of Artificial Sequence: Synthetic oligonucleotide
  Target: ATXN1; (+) strand; PAM type: YTN; PAM sequence: CTG
acaggaatgtggcacagaga

SEQ ID NO: 251604 - DNA, 20 bp, Artificial Sequence
  Description of Artificial Sequence: Synthetic oligonucleotide
  Target: ATXN1; (+) strand; PAM type: YTN; PAM sequence: CTG
aatcctgaaagatgagcaaa

SEQ ID NO: 251605 - DNA, 20 bp, Artificial Sequence
  Description of Artificial Sequence: Synthetic oligonucleotide
  Target: ATXN1; (+) strand; PAM type: YTN; PAM sequence: CTG
aaagatgagcaaagcagtta

SEQ ID NO: 251606 - DNA, 20 bp, Artificial Sequence
  Description of Artificial Sequence: Synthetic oligonucleotide
  Target: ATXN1; (+) strand; PAM type: YTN; PAM sequence: TTA
ccaaagacagaagggcagca

SEQ ID NO: 251607 - DNA, 20 bp, Artificial Sequence
  Description of Artificial Sequence: Synthetic oligonucleotide
  Target: ATXN1; (+) strand; PAM type: YTN; PAM sequence: TTT
gcataaacgctgaaaaatgc

SEQ ID NO: 251608 - DNA, 20 bp, Artificial Sequence
  Description of Artificial Sequence: Synthetic oligonucleotide
  Target: ATXN1; (+) strand; PAM type: YTN; PAM sequence: TTG
cataaacgctgaaaaatgct

SEQ ID NO: 251609 - DNA, 20 bp, Artificial Sequence
  Description of Artificial Sequence: Synthetic oligonucleotide
  Target: ATXN1; (+) strand; PAM type: YTN; PAM sequence: CTG
aaaaatgcttgtaaaactat

SEQ ID NO: 251610 - DNA, 20 bp, Artificial Sequence
  Description of Artificial Sequence: Synthetic oligonucleotide
  Target: ATXN1; (+) strand; PAM type: YTN; PAM sequence: CTT
gtaaaactatggcggcatag

SEQ ID NO: 251611 - DNA, 20 bp, Artificial Sequence
  Description of Artificial Sequence: Synthetic oligonucleotide
  Target: ATXN1; (+) strand; PAM type: YTN; PAM sequence: TTG
taaaactatggcggcatagc

SEQ ID NO: 251612 - DNA, 20 bp, Artificial Sequence
  Description of Artificial Sequence: Synthetic oligonucleotide
  Target: ATXN1; (+) strand; PAM type: YTN; PAM sequence: CTA
tggcggcatagcataagcac

SEQ ID NO: 251613 - DNA, 20 bp, Artificial Sequence
  Description of Artificial Sequence: Synthetic oligonucleotide
  Target: ATXN1; (+) strand; PAM type: YTN; PAM sequence: TTT
gggagaatggccagtgattt

SEQ ID NO: 251614 - DNA, 20 bp, Artificial Sequence
  Description of Artificial Sequence: Synthetic oligonucleotide
  Target: ATXN1; (+) strand; PAM type: YTN; PAM sequence: TTG
ggagaatggccagtgatttg

SEQ ID NO: 251615 - DNA, 20 bp, Artificial Sequence
  Description of Artificial Sequence: Synthetic oligonucleotide
  Target: ATXN1; (+) strand; PAM type: YTN; PAM sequence: TTT
gctaaggctccaccaggtct

SEQ ID NO: 251616 - DNA, 20 bp, Artificial Sequence
  Description of Artificial Sequence: Synthetic oligonucleotide
  Target: ATXN1; (+) strand; PAM type: YTN; PAM sequence: TTG
ctaaggctccaccaggtctt

SEQ ID NO: 251617 - DNA, 20 bp, Artificial Sequence
  Description of Artificial Sequence: Synthetic oligonucleotide
  Target: ATXN1; (+) strand; PAM type: YTN; PAM sequence: CTA
aggctccaccaggtctttca

SEQ ID NO: 251618 - DNA, 20 bp, Artificial Sequence
  Description of Artificial Sequence: Synthetic oligonucleotide
  Target: ATXN1; (+) strand; PAM type: YTN; PAM sequence: CTC
caccaggtctttcagggtta

SEQ ID NO: 251619 - DNA, 20 bp, Artificial Sequence
  Description of Artificial Sequence: Synthetic oligonucleotide
  Target: ATXN1; (+) strand; PAM type: YTN; PAM sequence: CTT
tcagggttagaacagagcat

SEQ ID NO: 251620 - DNA, 20 bp, Artificial Sequence
  Description of Artificial Sequence: Synthetic oligonucleotide
  Target: ATXN1; (+) strand; PAM type: YTN; PAM sequence: TTT
cagggttagaacagagcatc

SEQ ID NO: 251621 - DNA, 20 bp, Artificial Sequence
  Description of Artificial Sequence: Synthetic oligonucleotide
  Target: ATXN1; (+) strand; PAM type: YTN; PAM sequence: TTC
agggttagaacagagcatca

SEQ ID NO: 251622 - DNA, 20 bp, Artificial Sequence
  Description of Artificial Sequence: Synthetic oligonucleotide
  Target: ATXN1; (+) strand; PAM type: YTN; PAM sequence: TTA
gaacagagcatcatcacaca

SEQ ID NO: 251623 - DNA, 20 bp, Artificial Sequence
  Description of Artificial Sequence: Synthetic oligonucleotide
  Target: ATXN1; (+) strand; PAM type: YTN; PAM sequence: TTG
agctccatttgggaaactag

SEQ ID NO: 251624 - DNA, 20 bp, Artificial Sequence
  Description of Artificial Sequence: Synthetic oligonucleotide
  Target: ATXN1; (+) strand; PAM type: YTN; PAM sequence: CTC
catttgggaaactagagctc

SEQ ID NO: 251625 - DNA, 20 bp, Artificial Sequence
  Description of Artificial Sequence: Synthetic oligonucleotide
  Target: ATXN1; (+) strand; PAM type: YTN; PAM sequence: TTT
gggaaactagagctctaagc

SEQ ID NO: 251626 - DNA, 20 bp, Artificial Sequence
  Description of Artificial Sequence: Synthetic oligonucleotide
  Target: ATXN1; (+) strand; PAM type: YTN; PAM sequence: TTG
ggaaactagagctctaagcg

SEQ ID NO: 251627 - DNA, 20 bp, Artificial Sequence
  Description of Artificial Sequence: Synthetic oligonucleotide
  Target: ATXN1; (+) strand; PAM type: YTN; PAM sequence: CTA
gagctctaagcgccttctgc

SEQ ID NO: 251628 - DNA, 20 bp, Artificial Sequence
  Description of Artificial Sequence: Synthetic oligonucleotide
  Target: ATXN1; (+) strand; PAM type: YTN; PAM sequence: CTC
taagcgccttctgcctactt

SEQ ID NO: 251629 - DNA, 20 bp, Artificial Sequence
  Description of Artificial Sequence: Synthetic oligonucleotide
  Target: ATXN1; (+) strand; PAM type: YTN; PAM sequence: CTA
agcgccttctgcctacttca

SEQ ID NO: 251630 - DNA, 20 bp, Artificial Sequence
  Description of Artificial Sequence: Synthetic oligonucleotide
  Target: ATXN1; (+) strand; PAM type: YTN; PAM sequence: CTT
ctgcctacttcatggcaagg

SEQ ID NO: 251631 - DNA, 20 bp, Artificial Sequence
  Description of Artificial Sequence: Synthetic oligonucleotide
  Target: ATXN1; (+) strand; PAM type: YTN; PAM sequence: TTC
tgcctacttcatggcaagga

SEQ ID NO: 251632 - DNA, 20 bp, Artificial Sequence
  Description of Artificial Sequence: Synthetic oligonucleotide
  Target: ATXN1; (+) strand; PAM type: YTN; PAM sequence: CTG
cctacttcatggcaaggagg

SEQ ID NO: 251633 - DNA, 20 bp, Artificial Sequence
  Description of Artificial Sequence: Synthetic oligonucleotide
  Target: ATXN1; (+) strand; PAM type: YTN; PAM sequence: CTA
cttcatggcaaggagggcca

SEQ ID NO: 251634 - DNA, 20 bp, Artificial Sequence
  Description of Artificial Sequence: Synthetic oligonucleotide
  Target: ATXN1; (+) strand; PAM type: YTN; PAM sequence: CTT
catggcaaggagggccatct

SEQ ID NO: 251635 - DNA, 20 bp, Artificial Sequence
  Description of Artificial Sequence: Synthetic oligonucleotide
  Target: ATXN1; (+) strand; PAM type: YTN; PAM sequence: TTC
atggcaaggagggccatctc

SEQ ID NO: 251636 - DNA, 20 bp, Artificial Sequence
  Description of Artificial Sequence: Synthetic oligonucleotide
  Target: ATXN1; (+) strand; PAM type: YTN; PAM sequence: CTC
gggcaccaccagccctctat

SEQ ID NO: 251637 - DNA, 20 bp, Artificial Sequence
  Description of Artificial Sequence: Synthetic oligonucleotide
  Target: ATXN1; (+) strand; PAM type: YTN; PAM sequence: CTC
tatggcagccatggggctcg

SEQ ID NO: 251638 - DNA, 20 bp, Artificial Sequence
  Description of Artificial Sequence: Synthetic oligonucleotide
  Target: ATXN1; (+) strand; PAM type: YTN; PAM sequence: CTA
tggcagccatggggctcgtt

SEQ ID NO: 251639 - DNA, 20 bp, Artificial Sequence
  Description of Artificial Sequence: Synthetic oligonucleotide
  Target: ATXN1; (+) strand; PAM type: YTN; PAM sequence: CTC
gttcatatcctcctggccca

SEQ ID NO: 251640 - DNA, 20 bp, Artificial Sequence
  Description of Artificial Sequence: Synthetic oligonucleotide
  Target: ATXN1; (+) strand; PAM type: YTN; PAM sequence: TTC
atatcctcctggcccaccac

SEQ ID NO: 251641 - DNA, 20 bp, Artificial Sequence
  Description of Artificial Sequence: Synthetic oligonucleotide
  Target: ATXN1; (+) strand; PAM type: YTN; PAM sequence: CTC
ctggcccaccacaacctgtg

SEQ ID NO: 251642 - DNA, 20 bp, Artificial Sequence
  Description of Artificial Sequence: Synthetic oligonucleotide
  Target: ATXN1; (+) strand; PAM type: YTN; PAM sequence: CTG
gcccaccacaacctgtgtgc

SEQ ID NO: 251643 - DNA, 20 bp, Artificial Sequence
  Description of Artificial Sequence: Synthetic oligonucleotide
  Target: ATXN1; (+) strand; PAM type: YTN; PAM sequence: CTG
tgtgcaggtactcaggccac

SEQ ID NO: 251644 - DNA, 20 bp, Artificial Sequence
  Description of Artificial Sequence: Synthetic oligonucleotide
  Target: ATXN1; (+) strand; PAM type: YTN; PAM sequence: CTC
aggccacactgcttcccttt

SEQ ID NO: 251645 - DNA, 20 bp, Artificial Sequence
  Description of Artificial Sequence: Synthetic oligonucleotide
  Target: ATXN1; (+) strand; PAM type: YTN; PAM sequence: CTG
cttccctttgtctatgccag

SEQ ID NO: 251646 - DNA, 20 bp, Artificial Sequence
  Description of Artificial Sequence: Synthetic oligonucleotide
  Target: ATXN1; (+) strand; PAM type: YTN; PAM sequence: CTT
ccctttgtctatgccaggtg

SEQ ID NO: 251647 - DNA, 20 bp, Artificial Sequence
  Description of Artificial Sequence: Synthetic oligonucleotide
  Target: ATXN1; (+) strand; PAM type: YTN; PAM sequence: TTC
cctttgtctatgccaggtgg

SEQ ID NO: 251648 - DNA, 20 bp, Artificial Sequence
  Description of Artificial Sequence: Synthetic oligonucleotide
  Target: ATXN1; (+) strand; PAM type: YTN; PAM sequence: CTT
tgtctatgccaggtggcctt

SEQ ID NO: 251649 - DNA, 20 bp, Artificial Sequence
  Description of Artificial Sequence: Synthetic oligonucleotide
  Target: ATXN1; (+) strand; PAM type: YTN; PAM sequence: TTT
gtctatgccaggtggcctta

SEQ ID NO: 251650 - DNA, 20 bp, Artificial Sequence
  Description of Artificial Sequence: Synthetic oligonucleotide
  Target: ATXN1; (+) strand; PAM type: YTN; PAM sequence: TTG
tctatgccaggtggccttat

SEQ ID NO: 251651 - DNA, 20 bp, Artificial Sequence
  Description of Artificial Sequence: Synthetic oligonucleotide
  Target: ATXN1; (+) strand; PAM type: YTN; PAM sequence: CTA
tgccaggtggccttattctt

SEQ ID NO: 251652 - DNA, 20 bp, Artificial Sequence
  Description of Artificial Sequence: Synthetic oligonucleotide
  Target: ATXN1; (+) strand; PAM type: YTN; PAM sequence: CTT
attcttcaaagctctggcca

SEQ ID NO: 251653 - DNA, 20 bp, Artificial Sequence
  Description of Artificial Sequence: Synthetic oligonucleotide
  Target: ATXN1; (+) strand; PAM type: YTN; PAM sequence: TTA
ttcttcaaagctctggccaa

SEQ ID NO: 251654 - DNA, 20 bp, Artificial Sequence
  Description of Artificial Sequence: Synthetic oligonucleotide
  Target: ATXN1; (+) strand; PAM type: YTN; PAM sequence: TTC
ttcaaagctctggccaagtt

SEQ ID NO: 251655 - DNA, 20 bp, Artificial Sequence
  Description of Artificial Sequence: Synthetic oligonucleotide
  Target: ATXN1; (+) strand; PAM type: YTN; PAM sequence: CTT
caaagctctggccaagttct

SEQ ID NO: 251656 - DNA, 20 bp, Artificial Sequence
  Description of Artificial Sequence: Synthetic oligonucleotide
  Target: ATXN1; (+) strand; PAM type: YTN; PAM sequence: TTC
aaagctctggccaagttcta

SEQ ID NO: 251657 - DNA, 20 bp, Artificial Sequence
  Description of Artificial Sequence: Synthetic oligonucleotide
  Target: ATXN1; (+) strand; PAM type: YTN; PAM sequence: CTC
tggccaagttctaattcttg

SEQ ID NO: 251658 - DNA, 20 bp, Artificial Sequence
  Description of Artificial Sequence: Synthetic oligonucleotide
  Target: ATXN1; (+) strand; PAM type: YTN; PAM sequence: CTG
gccaagttctaattcttgca

SEQ ID NO: 251659 - DNA, 20 bp, Artificial Sequence
  Description of Artificial Sequence: Synthetic oligonucleotide
  Target: ATXN1; (+) strand; PAM type: YTN; PAM sequence: TTC
taattcttgcacgtgcctta

SEQ ID NO: 251660 - DNA, 20 bp, Artificial Sequence
  Description of Artificial Sequence: Synthetic oligonucleotide
  Target: ATXN1; (+) strand; PAM type: YTN; PAM sequence: CTA
attcttgcacgtgccttact

SEQ ID NO: 251661 - DNA, 20 bp, Artificial Sequence
  Description of Artificial Sequence: Synthetic oligonucleotide
  Target: ATXN1; (+) strand; PAM type: YTN; PAM sequence: TTC
ttgcacgtgccttacttgct

SEQ ID NO: 251662 - DNA, 20 bp, Artificial Sequence
  Description of Artificial Sequence: Synthetic oligonucleotide
  Target: ATXN1; (+) strand; PAM type: YTN; PAM sequence: CTT
gcacgtgccttacttgctaa

SEQ ID NO: 251663 - DNA, 20 bp, Artificial Sequence
  Description of Artificial Sequence: Synthetic oligonucleotide
  Target: ATXN1; (+) strand; PAM type: YTN; PAM sequence: TTG
cacgtgccttacttgctaac

SEQ ID NO: 251664 - DNA, 20 bp, Artificial Sequence
  Description of Artificial Sequence: Synthetic oligonucleotide
  Target: ATXN1; (+) strand; PAM type: YTN; PAM sequence: CTT
acttgctaactcctacccag

SEQ ID NO: 251665 - DNA, 20 bp, Artificial Sequence
  Description of Artificial Sequence: Synthetic oligonucleotide
  Target: ATXN1; (+) strand; PAM type: YTN; PAM sequence: TTA
cttgctaactcctacccagc

SEQ ID NO: 251666 - DNA, 20 bp, Artificial Sequence
  Description of Artificial Sequence: Synthetic oligonucleotide
  Target: ATXN1; (+) strand; PAM type: YTN; PAM sequence: CTT
gctaactcctacccagcaac

SEQ ID NO: 251667 - DNA, 20 bp, Artificial Sequence
  Description of Artificial Sequence: Synthetic oligonucleotide
  Target: ATXN1; (+) strand; PAM type: YTN; PAM sequence: TTG
ctaactcctacccagcaact

SEQ ID NO: 251668 - DNA, 20 bp, Artificial Sequence
  Description of Artificial Sequence: Synthetic oligonucleotide
  Target: ATXN1; (+) strand; PAM type: YTN; PAM sequence: CTA
actcctacccagcaactcag

SEQ ID NO: 251669 - DNA, 20 bp, Artificial Sequence
  Description of Artificial Sequence: Synthetic oligonucleotide
  Target: ATXN1; (+) strand; PAM type: YTN; PAM sequence: CTC
ctacccagcaactcagaaca

SEQ ID NO: 251670 - DNA, 20 bp, Artificial Sequence
  Description of Artificial Sequence: Synthetic oligonucleotide
  Target: ATXN1; (+) strand; PAM type: YTN; PAM sequence: CTA
cccagcaactcagaacatta

SEQ ID NO: 251671 - DNA, 20 bp, Artificial Sequence
  Description of Artificial Sequence: Synthetic oligonucleotide
  Target: ATXN1; (+) strand; PAM type: YTN; PAM sequence: CTC
agaacattaactgattgtac

SEQ ID NO: 251672 - DNA, 20 bp, Artificial Sequence
  Description of Artificial Sequence: Synthetic oligonucleotide
  Target: ATXN1; (+) strand; PAM type: YTN; PAM sequence: TTA
actgattgtaccactcccct

SEQ ID NO: 251673 - DNA, 20 bp, Artificial Sequence
  Description of Artificial Sequence: Synthetic oligonucleotide
  Target: ATXN1; (+) strand; PAM type: YTN; PAM sequence: CTG
attgtaccactcccctggtc

SEQ ID NO: 251674 - DNA, 20 bp, Artificial Sequence
  Description of Artificial Sequence: Synthetic oligonucleotide
  Target: ATXN1; (+) strand; PAM type: YTN; PAM sequence: TTG
taccactcccctggtctgtc

SEQ ID NO: 251675 - DNA, 20 bp, Artificial Sequence
  Description of Artificial Sequence: Synthetic oligonucleotide
  Target: ATXN1; (+) strand; PAM type: YTN; PAM sequence: CTC
ccctggtctgtcctaactca

SEQ ID NO: 251676 - DNA, 20 bp, Artificial Sequence
  Description of Artificial Sequence: Synthetic oligonucleotide
  Target: ATXN1; (+) strand; PAM type: YTN; PAM sequence: CTG
gtctgtcctaactcagatac

SEQ ID NO: 251677 - DNA, 20 bp, Artificial Sequence
  Description of Artificial Sequence: Synthetic oligonucleotide
  Target: ATXN1; (+) strand; PAM type: YTN; PAM sequence: CTG
tcctaactcagatactgcct

SEQ ID NO: 251678 - DNA, 20 bp, Artificial Sequence
  Description of Artificial Sequence: Synthetic oligonucleotide
  Target: ATXN1; (+) strand; PAM type: YTN; PAM sequence: CTA
actcagatactgccttgtgt

SEQ ID NO: 251679 - DNA, 20 bp, Artificial Sequence
  Description of Artificial Sequence: Synthetic oligonucleotide
  Target: ATXN1; (+) strand; PAM type: YTN; PAM sequence: CTC
agatactgccttgtgtcata

SEQ ID NO: 251680 - DNA, 20 bp, Artificial Sequence
  Description of Artificial Sequence: Synthetic oligonucleotide
  Target: ATXN1; (+) strand; PAM type: YTN; PAM sequence: CTG
ccttgtgtcataaaagcaac

SEQ ID NO: 251681 - DNA, 20 bp, Artificial Sequence
  Description of Artificial Sequence: Synthetic oligonucleotide
  Target: ATXN1; (+) strand; PAM type: YTN; PAM sequence: CTT
gtgtcataaaagcaacatac

SEQ ID NO: 251682 - DNA, 20 bp, Artificial Sequence
  Description of Artificial Sequence: Synthetic oligonucleotide
  Target: ATXN1; (+) strand; PAM type: YTN; PAM sequence: TTG
tgtcataaaagcaacatacc

SEQ ID NO: 251683 - DNA, 20 bp, Artificial Sequence
  Description of Artificial Sequence: Synthetic oligonucleotide
  Target: ATXN1; (+) strand; PAM type: YTN; PAM sequence: CTT
agatttagataccatgctat

SEQ ID NO: 251684 - DNA, 20 bp, Artificial Sequence
  Description of Artificial Sequence: Synthetic oligonucleotide
  Target: ATXN1; (+) strand; PAM type: YTN; PAM sequence: TTA
gatttagataccatgctatg

SEQ ID NO: 251685 - DNA, 20 bp, Artificial Sequence
  Description of Artificial Sequence: Synthetic oligonucleotide
  Target: ATXN1; (+) strand; PAM type: YTN; PAM sequence: TTT
agataccatgctatgactta

SEQ ID NO: 251686 - DNA, 20 bp, Artificial Sequence
  Description of Artificial Sequence: Synthetic oligonucleotide
  Target: ATXN1; (+) strand; PAM type: YTN; PAM sequence: TTA
gataccatgctatgacttac

SEQ ID NO: 251687 - DNA, 20 bp, Artificial Sequence
  Description of Artificial Sequence: Synthetic oligonucleotide
  Target: ATXN1; (+) strand; PAM type: YTN; PAM sequence: CTA
tgacttaccaagcactttat

SEQ ID NO: 251688 - DNA, 20 bp, Artificial Sequence
  Description of Artificial Sequence: Synthetic oligonucleotide
  Target: ATXN1; (+) strand; PAM type: YTN; PAM sequence: CTT
accaagcactttataatata

SEQ ID NO: 251689 - DNA, 20 bp, Artificial Sequence
  Description of Artificial Sequence: Synthetic oligonucleotide
  Target: ATXN1; (+) strand; PAM type: YTN; PAM sequence: TTA
ccaagcactttataatatac

SEQ ID NO: 251690 - DNA, 20 bp, Artificial Sequence
  Description of Artificial Sequence: Synthetic oligonucleotide
  Target: ATXN1; (+) strand; PAM type: YTN; PAM sequence: CTT
tataatatacattataccct

SEQ ID NO: 251691 - DNA, 20 bp, Artificial Sequence
  Description of Artificial Sequence: Synthetic oligonucleotide
  Target: ATXN1; (+) strand; PAM type: YTN; PAM sequence: TTT
ataatatacattataccctt

SEQ ID NO: 251692 - DNA, 20 bp, Artificial Sequence
  Description of Artificial Sequence: Synthetic oligonucleotide
  Target: ATXN1; (+) strand; PAM type: YTN; PAM sequence: TTA
taatatacattataccctta

SEQ ID NO: 251693 - DNA, 20 bp, Artificial Sequence
  Description of Artificial Sequence: Synthetic oligonucleotide
  Target: ATXN1; (+) strand; PAM type: YTN; PAM sequence: TTA
tacccttaatatccccagta

SEQ ID NO: 251694 - DNA, 20 bp, Artificial Sequence
  Description of Artificial Sequence: Synthetic oligonucleotide
  Target: ATXN1; (+) strand; PAM type: YTN; PAM sequence: CTT
aatatccccagtaattcttt

SEQ ID NO: 251695 - DNA, 20 bp, Artificial Sequence
  Description of Artificial Sequence: Synthetic oligonucleotide
  Target: ATXN1; (+) strand; PAM type: YTN; PAM sequence: TTA
atatccccagtaattctttc

SEQ ID NO: 251696 - DNA, 20 bp, Artificial Sequence
  Description of Artificial Sequence: Synthetic oligonucleotide
  Target: ATXN1; (+) strand; PAM type: YTN; PAM sequence: TTC
tttcagataggcgttaggcc

SEQ ID NO: 251697 - DNA, 20 bp, Artificial Sequence
  Description of Artificial Sequence: Synthetic oligonucleotide
  Target: ATXN1; (+) strand; PAM type: YTN; PAM sequence: CTT
tcagataggcgttaggccca

SEQ ID NO: 251698 - DNA, 20 bp, Artificial Sequence
  Description of Artificial Sequence: Synthetic oligonucleotide
  Target: ATXN1; (+) strand; PAM type: YTN; PAM sequence: TTT
cagataggcgttaggcccac

SEQ ID NO: 251699 - DNA, 20 bp, Artificial Sequence
  Description of Artificial Sequence: Synthetic oligonucleotide
  Target: ATXN1; (+) strand; PAM type: YTN; PAM sequence: TTC
agataggcgttaggcccact

SEQ ID NO: 251700 - DNA, 20 bp, Artificial Sequence
  Description of Artificial Sequence: Synthetic oligonucleotide
  Target: ATXN1; (+) strand; PAM type: YTN; PAM sequence: TTA
ggcccactttttagatcagt

SEQ ID NO: 251701 - DNA, 20 bp, Artificial Sequence
  Description of Artificial Sequence: Synthetic oligonucleotide
  Target: ATXN1; (+) strand; PAM type: YTN; PAM sequence: CTT
tttagatcagtaaactcagg

SEQ ID NO: 251702 - DNA, 20 bp, Artificial Sequence
  Description of Artificial Sequence: Synthetic oligonucleotide
  Target: ATXN1; (+) strand; PAM type: YTN; PAM sequence: TTT
ttagatcagtaaactcaggc

SEQ ID NO: 251703 - DNA, 20 bp, Artificial Sequence
  Description of Artificial Sequence: Synthetic oligonucleotide
  Target: ATXN1; (+) strand; PAM type: YTN; PAM sequence: TTT
tagatcagtaaactcaggct

SEQ ID NO: 251704 - DNA, 20 bp, Artificial Sequence
  Description of Artificial Sequence: Synthetic oligonucleotide
  Target: ATXN1; (+) strand; PAM type: YTN; PAM sequence: TTT
agatcagtaaactcaggctc

SEQ ID NO: 251705 - DNA, 20 bp, Artificial Sequence
  Description of Artificial Sequence: Synthetic oligonucleotide
  Target: ATXN1; (+) strand; PAM type: YTN; PAM sequence: TTA
gatcagtaaactcaggctca

SEQ ID NO: 251706 - DNA, 20 bp, Artificial Sequence
  Description of Artificial Sequence: Synthetic oligonucleotide
  Target: ATXN1; (+) strand; PAM type: YTN; PAM sequence: CTC
aggctcatgtaggttaaggg

SEQ ID NO: 251707 - DNA, 20 bp, Artificial Sequence
  Description of Artificial Sequence: Synthetic oligonucleotide
  Target: ATXN1; (+) strand; PAM type: YTN; PAM sequence: CTC
atgtaggttaagggaagttc

SEQ ID NO: 251708 - DNA, 20 bp, Artificial Sequence
  Description of Artificial Sequence: Synthetic oligonucleotide
  Target: ATXN1; (+) strand; PAM type: YTN; PAM sequence: TTA
agggaagttcccaggagcac

SEQ ID NO: 251709 - DNA, 20 bp, Artificial Sequence
  Description of Artificial Sequence: Synthetic oligonucleotide
  Target: ATXN1; (+) strand; PAM type: YTN; PAM sequence: TTC
ccaggagcacagaatatgta

SEQ ID NO: 251710 - DNA, 20 bp, Artificial Sequence
  Description of Artificial Sequence: Synthetic oligonucleotide
  Target: ATXN1; (+) strand; PAM type: YTN; PAM sequence: CTT
gtggagccaggactagaaaa

SEQ ID NO: 251711 - DNA, 20 bp, Artificial Sequence
  Description of Artificial Sequence: Synthetic oligonucleotide
  Target: ATXN1; (+) strand; PAM type: YTN; PAM sequence: TTG
tggagccaggactagaaaac

SEQ ID NO: 251712 - DNA, 20 bp, Artificial Sequence
  Description of Artificial Sequence: Synthetic oligonucleotide
  Target: ATXN1; (+) strand; PAM type: YTN; PAM sequence: CTA
gaaaacaaatctacagattc

SEQ ID NO: 251713 - DNA, 20 bp, Artificial Sequence
  Description of Artificial Sequence: Synthetic oligonucleotide
  Target: ATXN1; (+) strand; PAM type: YTN; PAM sequence: CTA
cagattctatgaacagtgct

SEQ ID NO: 251714 - DNA, 20 bp, Artificial Sequence
  Description of Artificial Sequence: Synthetic oligonucleotide
  Target: ATXN1; (+) strand; PAM type: YTN; PAM sequence: TTC
tatgaacagtgctcttccat

SEQ ID NO: 251715 - DNA, 20 bp, Artificial Sequence
  Description of Artificial Sequence: Synthetic oligonucleotide
  Target: ATXN1; (+) strand; PAM type: YTN; PAM sequence: CTA
tgaacagtgctcttccatta

SEQ ID NO: 251716 - DNA, 20 bp, Artificial Sequence
  Description of Artificial Sequence: Synthetic oligonucleotide
  Target: ATXN1; (+) strand; PAM type: YTN; PAM sequence: CTC
ttccattacaccactgggcc

SEQ ID NO: 251717 - DNA, 20 bp, Artificial Sequence
  Description of Artificial Sequence: Synthetic oligonucleotide
  Target: ATXN1; (+) strand; PAM type: YTN; PAM sequence: CTT
ccattacaccactgggcccc

SEQ ID NO: 251718 - DNA, 20 bp, Artificial Sequence
  Description of Artificial Sequence: Synthetic oligonucleotide
  Target: ATXN1; (+) strand; PAM type: YTN; PAM sequence: TTC
cattacaccactgggcccct

SEQ ID NO: 251719 - DNA, 20 bp, Artificial Sequence
  Description of Artificial Sequence: Synthetic oligonucleotide
  Target: ATXN1; (+) strand; PAM type: YTN; PAM sequence: TTA
caccactgggcccctctctt

SEQ ID NO: 251720 - DNA, 20 bp, Artificial Sequence
  Description of Artificial Sequence: Synthetic oligonucleotide
  Target: ATXN1; (+) strand; PAM type: YTN; PAM sequence: CTG
ggcccctctcttgactttat

SEQ ID NO: 251721 - DNA, 20 bp, Artificial Sequence
  Description of Artificial Sequence: Synthetic oligonucleotide
  Target: ATXN1; (+) strand; PAM type: YTN; PAM sequence: CTC
tcttgactttatttatttat

SEQ ID NO: 251722 - DNA, 20 bp, Artificial Sequence
  Description of Artificial Sequence: Synthetic oligonucleotide
  Target: ATXN1; (+) strand; PAM type: YTN; PAM sequence: CTC
ttgactttatttatttattt

SEQ ID NO: 251723 - DNA, 20 bp, Artificial Sequence
  Description of Artificial Sequence: Synthetic oligonucleotide
  Target: ATXN1; (+) strand; PAM type: YTN; PAM sequence: CTT
gactttatttatttatttat

SEQ ID NO: 251724 - DNA, 20 bp, Artificial Sequence
  Description of Artificial Sequence: Synthetic oligonucleotide
  Target: ATXN1; (+) strand; PAM type: YTN; PAM sequence: TTG
actttatttatttatttatt

SEQ ID NO: 251725 - DNA, 20 bp, Artificial Sequence
  Description of Artificial Sequence: Synthetic oligonucleotide
  Target: ATXN1; (+) strand; PAM type: YTN; PAM sequence: CTT
tatttatttatttatttatt

SEQ ID NO: 251726 - DNA, 20 bp, Artificial Sequence
  Description of Artificial Sequence: Synthetic oligonucleotide
  Target: ATXN1; (+) strand; PAM type: YTN; PAM sequence: TTT
atttatttatttatttattt

SEQ ID NO: 251727 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttattta

SEQ ID NO: 251728 - DNA, 20 bp, Artificial Sequence
  Description of Artificial Sequence: Synthetic oligonucleotide
  Target: ATXN1; (+) strand; PAM type: YTN; PAM sequence: TTT
atttatttatttatttattt

SEQ ID NO: 251729 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttattta

SEQ ID NO: 251730 - DNA, 20 bp, Artificial Sequence
  Description of Artificial Sequence: Synthetic oligonucleotide
  Target: ATXN1; (+) strand; PAM type: YTN; PAM sequence: TTT
atttatttatttatttattt

SEQ ID NO: 251731 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttattta

SEQ ID NO: 251732 - DNA, 20 bp, Artificial Sequence
  Description of Artificial Sequence: Synthetic oligonucleotide
  Target: ATXN1; (+) strand; PAM type: YTN; PAM sequence: TTT
atttatttatttatttattt

SEQ ID NO: 251733 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttattta

SEQ ID NO: 251734 - DNA, 20 bp, Artificial Sequence
  Description of Artificial Sequence: Synthetic oligonucleotide
  Target: ATXN1; (+) strand; PAM type: YTN; PAM sequence: TTT
atttatttatttatttattt

SEQ ID NO: 251735 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttattta

SEQ ID NO: 251736 - DNA, 20 bp, Artificial Sequence
  Description of Artificial Sequence: Synthetic oligonucleotide
  Target: ATXN1; (+) strand; PAM type: YTN; PAM sequence: TTT
atttatttatttatttagag

SEQ ID NO: 251737 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttagaga

SEQ ID NO: 251738 - DNA, 20 bp, Artificial Sequence
  Description of Artificial Sequence: Synthetic oligonucleotide
  Target: ATXN1; (+) strand; PAM type: YTN; PAM sequence: TTT
atttatttatttagagacag

SEQ ID NO: 251739 - DNA, 20 bp, Artificial Sequence
  Description of Artificial Sequence: Synthetic oligonucleotide
  Target: ATXN1; (+) strand; PAM type: YTN; PAM sequence: TTA
tttatttatttagagacagg

SEQ ID NO: 251740 - DNA, 20 bp, Artificial Sequence
  Description of Artificial Sequence: Synthetic oligonucleotide
  Target: ATXN1; (+) strand; PAM type: YTN; PAM sequence: TTT
atttatttagagacagggtc

SEQ ID NO: 251741 - DNA, 20 bp, Artificial Sequence
  Description of Artificial Sequence: Synthetic oligonucleotide
  Target: ATXN1; (+) strand; PAM type: YTN; PAM sequence: TTA
tttatttagagacagggtct

SEQ ID NO: 251742 - DNA, 20 bp, Artificial Sequence
  Description of Artificial Sequence: Synthetic oligonucleotide
  Target: ATXN1; (+) strand; PAM type: YTN; PAM sequence: TTT
atttagagacagggtctcac

SEQ ID NO: 251743 - DNA, 20 bp, Artificial Sequence
  Description of Artificial Sequence: Synthetic oligonucleotide
  Target: ATXN1; (+) strand; PAM type: YTN; PAM sequence: TTA
tttagagacagggtctcact

SEQ ID NO: 251744 - DNA, 20 bp, Artificial Sequence
  Description of Artificial Sequence: Synthetic oligonucleotide
  Target: ATXN1; (+) strand; PAM type: YTN; PAM sequence: TTT
agagacagggtctcactctg

SEQ ID NO: 251745 - DNA, 20 bp, Artificial Sequence
  Description of Artificial Sequence: Synthetic oligonucleotide
  Target: ATXN1; (+) strand; PAM type: YTN; PAM sequence: TTA
gagacagggtctcactctgt

SEQ ID NO: 251746 - DNA, 20 bp, Artificial Sequence
  Description of Artificial Sequence: Synthetic oligonucleotide
  Target: ATXN1; (+) strand; PAM type: YTN; PAM sequence: CTC
actctgtcaccgaggctgga

SEQ ID NO: 251747 - DNA, 20 bp, Artificial Sequence
  Description of Artificial Sequence: Synthetic oligonucleotide
  Target: ATXN1; (+) strand; PAM type: YTN; PAM sequence: CTC
tgtcaccgaggctggagtgc

SEQ ID NO: 251748 - DNA, 20 bp, Artificial Sequence
  Description of Artificial Sequence: Synthetic oligonucleotide
  Target: ATXN1; (+) strand; PAM type: YTN; PAM sequence: CTG
tcaccgaggctggagtgcag

SEQ ID NO: 251749 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggtgcaatcac

SEQ ID NO: 251750 - DNA, 20 bp, Artificial Sequence
  Description of Artificial Sequence: Synthetic oligonucleotide
  Target: ATXN1; (+) strand; PAM type: YTN; PAM sequence: CTC
accgcagccttgactgccct

SEQ ID NO: 251751 - DNA, 20 bp, Artificial Sequence
  Description of Artificial Sequence: Synthetic oligonucleotide
  Target: ATXN1; (+) strand; PAM type: YTN; PAM sequence: CTT
gactgccctggctgaaatat

SEQ ID NO: 251752 - DNA, 20 bp, Artificial Sequence
  Description of Artificial Sequence: Synthetic oligonucleotide
  Target: ATXN1; (+) strand; PAM type: YTN; PAM sequence: TTG
actgccctggctgaaatatc

SEQ ID NO: 251753 - DNA, 20 bp, Artificial Sequence
  Description of Artificial Sequence: Synthetic oligonucleotide
  Target: ATXN1; (+) strand; PAM type: YTN; PAM sequence: CTG
ccctggctgaaatatcctcc

SEQ ID NO: 251754 - DNA, 20 bp, Artificial Sequence
  Description of Artificial Sequence: Synthetic oligonucleotide
  Target: ATXN1; (+) strand; PAM type: YTN; PAM sequence: CTG
gctgaaatatcctcccacct

SEQ ID NO: 251755 - DNA, 20 bp, Artificial Sequence
  Description of Artificial Sequence: Synthetic oligonucleotide
  Target: ATXN1; (+) strand; PAM type: YTN; PAM sequence: CTG
aaatatcctcccacctcagc

SEQ ID NO: 251756 - DNA, 20 bp, Artificial Sequence
  Description of Artificial Sequence: Synthetic oligonucleotide
  Target: ATXN1; (+) strand; PAM type: YTN; PAM sequence: CTC
ccacctcagcctcctgagta

SEQ ID NO: 251757 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagtagctggga

SEQ ID NO: 251758 - DNA, 20 bp, Artificial Sequence
  Description of Artificial Sequence: Synthetic oligonucleotide
  Target: ATXN1; (+) strand; PAM type: YTN; PAM sequence: CTC
ctgagtagctgggactacag

SEQ ID NO: 251759 - DNA, 20 bp, Artificial Sequence
  Description of Artificial Sequence: Synthetic oligonucleotide
  Target: ATXN1; (+) strand; PAM type: YTN; PAM sequence: CTG
agtagctgggactacaggtg

SEQ ID NO: 251760 - DNA, 20 bp, Artificial Sequence
  Description of Artificial Sequence: Synthetic oligonucleotide
  Target: ATXN1; (+) strand; PAM type: YTN; PAM sequence: CTG
ggactacaggtgcacaccac

SEQ ID NO: 251761 - DNA, 20 bp, Artificial Sequence
  Description of Artificial Sequence: Synthetic oligonucleotide
  Target: ATXN1; (+) strand; PAM type: YTN; PAM sequence: CTA
caggtgcacaccaccacccc

SEQ ID NO: 251762 - DNA, 20 bp, Artificial Sequence
  Description of Artificial Sequence: Synthetic oligonucleotide
  Target: ATXN1; (+) strand; PAM type: YTN; PAM sequence: CTG
gctaattttttaactttttt

SEQ ID NO: 251763 - DNA, 20 bp, Artificial Sequence
  Description of Artificial Sequence: Synthetic oligonucleotide
  Target: ATXN1; (+) strand; PAM type: YTN; PAM sequence: CTA
attttttaacttttttgtaa

SEQ ID NO: 251764 - DNA, 20 bp, Artificial Sequence
  Description of Artificial Sequence: Synthetic oligonucleotide
  Target: ATXN1; (+) strand; PAM type: YTN; PAM sequence: TTT
tttaacttttttgtaaagac

SEQ ID NO: 251765 - DNA, 20 bp, Artificial Sequence
  Description of Artificial Sequence: Synthetic oligonucleotide
  Target: ATXN1; (+) strand; PAM type: YTN; PAM sequence: TTT
ttaacttttttgtaaagaca

SEQ ID NO: 251766 - DNA, 20 bp, Artificial Sequence
  Description of Artificial Sequence: Synthetic oligonucleotide
  Target: ATXN1; (+) strand; PAM type: YTN; PAM sequence: TTT
taacttttttgtaaagacaa

SEQ ID NO: 251767 - DNA, 20 bp, Artificial Sequence
  Description of Artificial Sequence: Synthetic oligonucleotide
  Target: ATXN1; (+) strand; PAM type: YTN; PAM sequence: TTT
aacttttttgtaaagacaaa

SEQ ID NO: 251768 - DNA, 20 bp, Artificial Sequence
  Description of Artificial Sequence: Synthetic oligonucleotide
  Target: ATXN1; (+) strand; PAM type: YTN; PAM sequence: TTA
acttttttgtaaagacaaag

SEQ ID NO: 251769 - DNA, 20 bp, Artificial Sequence
  Description of Artificial Sequence: Synthetic oligonucleotide
  Target: ATXN1; (+) strand; PAM type: YTN; PAM sequence: CTT
ttttgtaaagacaaagtctc

SEQ ID NO: 251770 - DNA, 20 bp, Artificial Sequence
  Description of Artificial Sequence: Synthetic oligonucleotide
  Target: ATXN1; (+) strand; PAM type: YTN; PAM sequence: TTT
tttgtaaagacaaagtctca

SEQ ID NO: 251771 - DNA, 20 bp, Artificial Sequence
  Description of Artificial Sequence: Synthetic oligonucleotide
  Target: ATXN1; (+) strand; PAM type: YTN; PAM sequence: TTT
ttgtaaagacaaagtctcac

SEQ ID NO: 251772 - DNA, 20 bp, Artificial Sequence
  Description of Artificial Sequence: Synthetic oligonucleotide
  Target: ATXN1; (+) strand; PAM type: YTN; PAM sequence: TTT
tgtaaagacaaagtctcact

SEQ ID NO: 251773 - DNA, 20 bp, Artificial Sequence
  Description of Artificial Sequence: Synthetic oligonucleotide
  Target: ATXN1; (+) strand; PAM type: YTN; PAM sequence: TTT
gtaaagacaaagtctcacta

SEQ ID NO: 251774 - DNA, 20 bp, Artificial Sequence
  Description of Artificial Sequence: Synthetic oligonucleotide
  Target: ATXN1; (+) strand; PAM type: YTN; PAM sequence: TTG
taaagacaaagtctcactat

SEQ ID NO: 251775 - DNA, 20 bp, Artificial Sequence
  Description of Artificial Sequence: Synthetic oligonucleotide
  Target: ATXN1; (+) strand; PAM type: YTN; PAM sequence: CTC
actatatttcccaggctggt

SEQ ID NO: 251776 - DNA, 20 bp, Artificial Sequence
  Description of Artificial Sequence: Synthetic oligonucleotide
  Target: ATXN1; (+) strand; PAM type: YTN; PAM sequence: CTA
tatttcccaggctggtctca

SEQ ID NO: 251777 - DNA, 20 bp, Artificial Sequence
  Description of Artificial Sequence: Synthetic oligonucleotide
  Target: ATXN1; (+) strand; PAM type: YTN; PAM sequence: TTT
cccaggctggtctcaaactc

SEQ ID NO: 251778 - DNA, 20 bp, Artificial Sequence
  Description of Artificial Sequence: Synthetic oligonucleotide
  Target: ATXN1; (+) strand; PAM type: YTN; PAM sequence: TTC
ccaggctggtctcaaactcc

SEQ ID NO: 251779 - DNA, 20 bp, Artificial Sequence
  Description of Artificial Sequence: Synthetic oligonucleotide
  Target: ATXN1; (+) strand; PAM type: YTN; PAM sequence: CTG
gtctcaaactcctgggttca

SEQ ID NO: 251780 - DNA, 20 bp, Artificial Sequence
  Description of Artificial Sequence: Synthetic oligonucleotide
  Target: ATXN1; (+) strand; PAM type: YTN; PAM sequence: CTC
aaactcctgggttcaagcag

SEQ ID NO: 251781 - DNA, 20 bp, Artificial Sequence
  Description of Artificial Sequence: Synthetic oligonucleotide
  Target: ATXN1; (+) strand; PAM type: YTN; PAM sequence: CTC
ctgggttcaagcagtcctcc

SEQ ID NO: 251782 - DNA, 20 bp, Artificial Sequence
  Description of Artificial Sequence: Synthetic oligonucleotide
  Target: ATXN1; (+) strand; PAM type: YTN; PAM sequence: CTG
ggttcaagcagtcctcccac

SEQ ID NO: 251783 - DNA, 20 bp, Artificial Sequence
  Description of Artificial Sequence: Synthetic oligonucleotide
  Target: ATXN1; (+) strand; PAM type: YTN; PAM sequence: TTC
aagcagtcctcccacctcag

SEQ ID NO: 251784 - DNA, 20 bp, Artificial Sequence
  Description of Artificial Sequence: Synthetic oligonucleotide
  Target: ATXN1; (+) strand; PAM type: YTN; PAM sequence: CTC
ccacctcagcttcccaaaat

SEQ ID NO: 251785 - DNA, 20 bp, Artificial Sequence
  Description of Artificial Sequence: Synthetic oligonucleotide
  Target: ATXN1; (+) strand; PAM type: YTN; PAM sequence: CTC
agcttcccaaaatgctggga

SEQ ID NO: 251786 - DNA, 20 bp, Artificial Sequence
  Description of Artificial Sequence: Synthetic oligonucleotide
  Target: ATXN1; (+) strand; PAM type: YTN; PAM sequence: CTT
cccaaaatgctgggagtata

SEQ ID NO: 251787 - DNA, 20 bp, Artificial Sequence
  Description of Artificial Sequence: Synthetic oligonucleotide
  Target: ATXN1; (+) strand; PAM type: YTN; PAM sequence: TTC
ccaaaatgctgggagtatag

SEQ ID NO: 251788 - DNA, 20 bp, Artificial Sequence
  Description of Artificial Sequence: Synthetic oligonucleotide
  Target: ATXN1; (+) strand; PAM type: YTN; PAM sequence: CTG
ggagtataggcatgagcaca

SEQ ID NO: 251789 - DNA, 20 bp, Artificial Sequence
  Description of Artificial Sequence: Synthetic oligonucleotide
  Target: ATXN1; (+) strand; PAM type: YTN; PAM sequence: CTC
ctcttgacttattaagttat

SEQ ID NO: 251790 - DNA, 20 bp, Artificial Sequence
  Description of Artificial Sequence: Synthetic oligonucleotide
  Target: ATXN1; (+) strand; PAM type: YTN; PAM sequence: CTC
ttgacttattaagttattat

SEQ ID NO: 251791 - DNA, 20 bp, Artificial Sequence
  Description of Artificial Sequence: Synthetic oligonucleotide
  Target: ATXN1; (+) strand; PAM type: YTN; PAM sequence: CTT
gacttattaagttattatga

SEQ ID NO: 251792 - DNA, 20 bp, Artificial Sequence
  Description of Artificial Sequence: Synthetic oligonucleotide
  Target: ATXN1; (+) strand; PAM type: YTN; PAM sequence: TTG
acttattaagttattatgat

SEQ ID NO: 251793 - DNA, 20 bp, Artificial Sequence
  Description of Artificial Sequence: Synthetic oligonucleotide
  Target: ATXN1; (+) strand; PAM type: YTN; PAM sequence: CTT
attaagttattatgatgccg

SEQ ID NO: 251794 - DNA, 20 bp, Artificial Sequence
  Description of Artificial Sequence: Synthetic oligonucleotide
  Target: ATXN1; (+) strand; PAM type: YTN; PAM sequence: TTA
ttaagttattatgatgccga

SEQ ID NO: 251795 - DNA, 20 bp, Artificial Sequence
  Description of Artificial Sequence: Synthetic oligonucleotide
  Target: ATXN1; (+) strand; PAM type: YTN; PAM sequence: TTA
agttattatgatgccgattc

SEQ ID NO: 251796 - DNA, 20 bp, Artificial Sequence
  Description of Artificial Sequence: Synthetic oligonucleotide
  Target: ATXN1; (+) strand; PAM type: YTN; PAM sequence: TTA
ttatgatgccgattcagcaa

SEQ ID NO: 251797 - DNA, 20 bp, Artificial Sequence
  Description of Artificial Sequence: Synthetic oligonucleotide
  Target: ATXN1; (+) strand; PAM type: YTN; PAM sequence: TTA
tgatgccgattcagcaagcc

SEQ ID NO: 251798 - DNA, 20 bp, Artificial Sequence
  Description of Artificial Sequence: Synthetic oligonucleotide
  Target: ATXN1; (+) strand; PAM type: YTN; PAM sequence: TTC
agcaagcccactactgggta

SEQ ID NO: 251799 - DNA, 20 bp, Artificial Sequence
  Description of Artificial Sequence: Synthetic oligonucleotide
  Target: ATXN1; (+) strand; PAM type: YTN; PAM sequence: CTA
ctgggtatctacccagagga

SEQ ID NO: 251800 - DNA, 20 bp, Artificial Sequence
  Description of Artificial Sequence: Synthetic oligonucleotide
  Target: ATXN1; (+) strand; PAM type: YTN; PAM sequence: CTG
ggtatctacccagaggaaaa

SEQ ID NO: 251801 - DNA, 20 bp, Artificial Sequence
  Description of Artificial Sequence: Synthetic oligonucleotide
  Target: ATXN1; (+) strand; PAM type: YTN; PAM sequence: CTA
cccagaggaaaataagtcat

SEQ ID NO: 251802 - DNA, 20 bp, Artificial Sequence
  Description of Artificial Sequence: Synthetic oligonucleotide
  Target: ATXN1; (+) strand; PAM type: YTN; PAM sequence: TTA
ttcgaaaaagatacttgcac

SEQ ID NO: 251803 - DNA, 20 bp, Artificial Sequence
  Description of Artificial Sequence: Synthetic oligonucleotide
  Target: ATXN1; (+) strand; PAM type: YTN; PAM sequence: TTC
gaaaaagatacttgcacacg

SEQ ID NO: 251804 - DNA, 20 bp, Artificial Sequence
  Description of Artificial Sequence: Synthetic oligonucleotide
  Target: ATXN1; (+) strand; PAM type: YTN; PAM sequence: CTT
gcacacgcatgtttatagca

SEQ ID NO: 251805 - DNA, 20 bp, Artificial Sequence
  Description of Artificial Sequence: Synthetic oligonucleotide
  Target: ATXN1; (+) strand; PAM type: YTN; PAM sequence: TTG
cacacgcatgtttatagcag

SEQ ID NO: 251806 - DNA, 20 bp, Artificial Sequence
  Description of Artificial Sequence: Synthetic oligonucleotide
  Target: ATXN1; (+) strand; PAM type: YTN; PAM sequence: TTT
atagcagcacaattcacaat

SEQ ID NO: 251807 - DNA, 20 bp, Artificial Sequence
  Description of Artificial Sequence: Synthetic oligonucleotide
  Target: ATXN1; (+) strand; PAM type: YTN; PAM sequence: TTA
tagcagcacaattcacaatt

SEQ ID NO: 251808 - DNA, 20 bp, Artificial Sequence
  Description of Artificial Sequence: Synthetic oligonucleotide
  Target: ATXN1; (+) strand; PAM type: YTN; PAM sequence: TTC
acaattgcaaaatcatggaa

SEQ ID NO: 251809 - DNA, 20 bp, Artificial Sequence
  Description of Artificial Sequence: Synthetic oligonucleotide
  Target: ATXN1; (+) strand; PAM type: YTN; PAM sequence: TTG
caaaatcatggaaccaaccc

SEQ ID NO: 251810 - DNA, 20 bp, Artificial Sequence
  Description of Artificial Sequence: Synthetic oligonucleotide
  Target: ATXN1; (+) strand; PAM type: YTN; PAM sequence: TTG
agtggataaaggaactgtgg

SEQ ID NO: 251811 - DNA, 20 bp, Artificial Sequence
  Description of Artificial Sequence: Synthetic oligonucleotide
  Target: ATXN1; (+) strand; PAM type: YTN; PAM sequence: CTG
tggtacatatatatgatgga

SEQ ID NO: 251812 - DNA, 20 bp, Artificial Sequence
  Description of Artificial Sequence: Synthetic oligonucleotide
  Target: ATXN1; (+) strand; PAM type: YTN; PAM sequence: CTA
ctcagccataaaaaggaatg

SEQ ID NO: 251813 - DNA, 20 bp, Artificial Sequence
  Description of Artificial Sequence: Synthetic oligonucleotide
  Target: ATXN1; (+) strand; PAM type: YTN; PAM sequence: CTC
agccataaaaaggaatgaat

SEQ ID NO: 251814 - DNA, 20 bp, Artificial Sequence
  Description of Artificial Sequence: Synthetic oligonucleotide
  Target: ATXN1; (+) strand; PAM type: YTN; PAM sequence: TTA
acagcatttgcagtgacctg

SEQ ID NO: 251815 - DNA, 20 bp, Artificial Sequence
  Description of Artificial Sequence: Synthetic oligonucleotide
  Target: ATXN1; (+) strand; PAM type: YTN; PAM sequence: TTT
gcagtgacctggatgagatt

SEQ ID NO: 251816 - DNA, 20 bp, Artificial Sequence
  Description of Artificial Sequence: Synthetic oligonucleotide
  Target: ATXN1; (+) strand; PAM type: YTN; PAM sequence: TTG
cagtgacctggatgagattg

SEQ ID NO: 251817 - DNA, 20 bp, Artificial Sequence
  Description of Artificial Sequence: Synthetic oligonucleotide
  Target: ATXN1; (+) strand; PAM type: YTN; PAM sequence: CTG
gatgagattggagactatta

SEQ ID NO: 251818 - DNA, 20 bp, Artificial Sequence
  Description of Artificial Sequence: Synthetic oligonucleotide
  Target: ATXN1; (+) strand; PAM type: YTN; PAM sequence: TTG
gagactattattctaagtga

SEQ ID NO: 251819 - DNA, 20 bp, Artificial Sequence
  Description of Artificial Sequence: Synthetic oligonucleotide
  Target: ATXN1; (+) strand; PAM type: YTN; PAM sequence: CTA
ttattctaagtgaagtaact

SEQ ID NO: 251820 - DNA, 20 bp, Artificial Sequence
  Description of Artificial Sequence: Synthetic oligonucleotide
  Target: ATXN1; (+) strand; PAM type: YTN; PAM sequence: TTA
ttctaagtgaagtaactcaa

SEQ ID NO: 251821 - DNA, 20 bp, Artificial Sequence
  Description of Artificial Sequence: Synthetic oligonucleotide
  Target: ATXN1; (+) strand; PAM type: YTN; PAM sequence: TTC
taagtgaagtaactcaagaa

SEQ ID NO: 251822 - DNA, 20 bp, Artificial Sequence
  Description of Artificial Sequence: Synthetic oligonucleotide
  Target: ATXN1; (+) strand; PAM type: YTN; PAM sequence: CTA
agtgaagtaactcaagaatg

SEQ ID NO: 251823 - DNA, 20 bp, Artificial Sequence
  Description of Artificial Sequence: Synthetic oligonucleotide
  Target: ATXN1; (+) strand; PAM type: YTN; PAM sequence: CTC
aagaatggaaaaccaaacat

SEQ ID NO: 251824 - DNA, 20 bp, Artificial Sequence
  Description of Artificial Sequence: Synthetic oligonucleotide
  Target: ATXN1; (+) strand; PAM type: YTN; PAM sequence: TTC
tcactgatatgtgagagcta

SEQ ID NO: 251825 - DNA, 20 bp, Artificial Sequence
  Description of Artificial Sequence: Synthetic oligonucleotide
  Target: ATXN1; (+) strand; PAM type: YTN; PAM sequence: CTC
actgatatgtgagagctaag

SEQ ID NO: 251826 - DNA, 20 bp, Artificial Sequence
  Description of Artificial Sequence: Synthetic oligonucleotide
  Target: ATXN1; (+) strand; PAM type: YTN; PAM sequence: CTG
atatgtgagagctaagctat

SEQ ID NO: 251827 - DNA, 20 bp, Artificial Sequence
  Description of Artificial Sequence: Synthetic oligonucleotide
  Target: ATXN1; (+) strand; PAM type: YTN; PAM sequence: CTA
agctatgaggatgcaaaggc

SEQ ID NO: 251828 - DNA, 20 bp, Artificial Sequence
  Description of Artificial Sequence: Synthetic oligonucleotide
  Target: ATXN1; (+) strand; PAM type: YTN; PAM sequence: CTA
tgaggatgcaaaggcataag

SEQ ID NO: 251829 - DNA, 20 bp, Artificial Sequence
  Description of Artificial Sequence: Synthetic oligonucleotide
  Target: ATXN1; (+) strand; PAM type: YTN; PAM sequence: CTT
tgggcacttagggggaagag

SEQ ID NO: 251830 - DNA, 20 bp, Artificial Sequence
  Description of Artificial Sequence: Synthetic oligonucleotide
  Target: ATXN1; (+) strand; PAM type: YTN; PAM sequence: TTT
gggcacttagggggaagagt

SEQ ID NO: 251831 - DNA, 20 bp, Artificial Sequence
  Description of Artificial Sequence: Synthetic oligonucleotide
  Target: ATXN1; (+) strand; PAM type: YTN; PAM sequence: TTG
ggcacttagggggaagagtg

SEQ ID NO: 251832 - DNA, 20 bp, Artificial Sequence
  Description of Artificial Sequence: Synthetic oligonucleotide
  Target: ATXN1; (+) strand; PAM type: YTN; PAM sequence: CTT
agggggaagagtgggagtgg

SEQ ID NO: 251833 - DNA, 20 bp, Artificial Sequence
  Description of Artificial Sequence: Synthetic oligonucleotide
  Target: ATXN1; (+) strand; PAM type: YTN; PAM sequence: TTA
gggggaagagtgggagtggg

SEQ ID NO: 251834 - DNA, 20 bp, Artificial Sequence
  Description of Artificial Sequence: Synthetic oligonucleotide
  Target: ATXN1; (+) strand; PAM type: YTN; PAM sequence: CTG
caaatatggtgcagtgtata

SEQ ID NO: 251835 - DNA, 20 bp, Artificial Sequence
  Description of Artificial Sequence: Synthetic oligonucleotide
  Target: ATXN1; (+) strand; PAM type: YTN; PAM sequence: CTG
ctcaggtgatgggtgcacca

SEQ ID NO: 251836 - DNA, 20 bp, Artificial Sequence
  Description of Artificial Sequence: Synthetic oligonucleotide
  Target: ATXN1; (+) strand; PAM type: YTN; PAM sequence: CTC
aggtgatgggtgcaccaaaa

SEQ ID NO: 251837 - DNA, 20 bp, Artificial Sequence
  Description of Artificial Sequence: Synthetic oligonucleotide
  Target: ATXN1; (+) strand; PAM type: YTN; PAM sequence: CTC
acaaatcgccactaaagaac

SEQ ID NO: 251838 - DNA, 20 bp, Artificial Sequence
  Description of Artificial Sequence: Synthetic oligonucleotide
  Target: ATXN1; (+) strand; PAM type: YTN; PAM sequence: CTA
aagaacttatgtaaccaaat

SEQ ID NO: 251839 - DNA, 20 bp, Artificial Sequence
  Description of Artificial Sequence: Synthetic oligonucleotide
  Target: ATXN1; (+) strand; PAM type: YTN; PAM sequence: CTT
atgtaaccaaataccacctg

SEQ ID NO: 251840 - DNA, 20 bp, Artificial Sequence
  Description of Artificial Sequence: Synthetic oligonucleotide
  Target: ATXN1; (+) strand; PAM type: YTN; PAM sequence: TTA
tgtaaccaaataccacctgt

SEQ ID NO: 251841 - DNA, 20 bp, Artificial Sequence
  Description of Artificial Sequence: Synthetic oligonucleotide
  Target: ATXN1; (+) strand; PAM type: YTN; PAM sequence: CTG
tatcccaataacttacggaa

SEQ ID NO: 251842 - DNA, 20 bp, Artificial Sequence
  Description of Artificial Sequence: Synthetic oligonucleotide
  Target: ATXN1; (+) strand; PAM type: YTN; PAM sequence: CTT
acggaaaaataaaataaaaa

SEQ ID NO: 251843 - DNA, 20 bp, Artificial Sequence
  Description of Artificial Sequence: Synthetic oligonucleotide
  Target: ATXN1; (+) strand; PAM type: YTN; PAM sequence: TTA
cggaaaaataaaataaaaat

SEQ ID NO: 251844 - DNA, 20 bp, Artificial Sequence
  Description of Artificial Sequence: Synthetic oligonucleotide
  Target: ATXN1; (+) strand; PAM type: YTN; PAM sequence: TTT
taagaagttattattatgcc

SEQ ID NO: 251845 - DNA, 20 bp, Artificial Sequence
  Description of Artificial Sequence: Synthetic oligonucleotide
  Target: ATXN1; (+) strand; PAM type: YTN; PAM sequence: TTT
aagaagttattattatgcca

SEQ ID NO: 251846 - DNA, 20 bp, Artificial Sequence
  Description of Artificial Sequence: Synthetic oligonucleotide
  Target: ATXN1; (+) strand; PAM type: YTN; PAM sequence: TTA
agaagttattattatgccac

SEQ ID NO: 251847 - DNA, 20 bp, Artificial Sequence
  Description of Artificial Sequence: Synthetic oligonucleotide
  Target: ATXN1; (+) strand; PAM type: YTN; PAM sequence: TTA
ttattatgccacttattttg

SEQ ID NO: 251848 - DNA, 20 bp, Artificial Sequence
  Description of Artificial Sequence: Synthetic oligonucleotide
  Target: ATXN1; (+) strand; PAM type: YTN; PAM sequence: TTA
ttatgccacttattttgaat

SEQ ID NO: 251849 - DNA, 20 bp, Artificial Sequence
  Description of Artificial Sequence: Synthetic oligonucleotide
  Target: ATXN1; (+) strand; PAM type: YTN; PAM sequence: TTA
tgccacttattttgaataag

SEQ ID NO: 251850 - DNA, 20 bp, Artificial Sequence
  Description of Artificial Sequence: Synthetic oligonucleotide
  Target: ATXN1; (+) strand; PAM type: YTN; PAM sequence: CTT
attttgaataagtacacgtt

SEQ ID NO: 251851 - DNA, 20 bp, Artificial Sequence
  Description of Artificial Sequence: Synthetic oligonucleotide
  Target: ATXN1; (+) strand; PAM type: YTN; PAM sequence: TTA
ttttgaataagtacacgttt

SEQ ID NO: 251852 - DNA, 20 bp, Artificial Sequence
  Description of Artificial Sequence: Synthetic oligonucleotide
  Target: ATXN1; (+) strand; PAM type: YTN; PAM sequence: TTT
tgaataagtacacgttttac

SEQ ID NO: 251853 - DNA, 20 bp, Artificial Sequence
  Description of Artificial Sequence: Synthetic oligonucleotide
  Target: ATXN1; (+) strand; PAM type: YTN; PAM sequence: TTT
gaataagtacacgttttacc

SEQ ID NO: 251854 - DNA, 20 bp, Artificial Sequence
  Description of Artificial Sequence: Synthetic oligonucleotide
  Target: ATXN1; (+) strand; PAM type: YTN; PAM sequence: TTG
aataagtacacgttttaccc

SEQ ID NO: 251855 - DNA, 20 bp, Artificial Sequence
  Description of Artificial Sequence: Synthetic oligonucleotide
  Target: ATXN1; (+) strand; PAM type: YTN; PAM sequence: TTT
tacccttgtgatgcaacgca

SEQ ID NO: 251856 - DNA, 20 bp, Artificial Sequence
  Description of Artificial Sequence: Synthetic oligonucleotide
  Target: ATXN1; (+) strand; PAM type: YTN; PAM sequence: TTT
acccttgtgatgcaacgcaa

SEQ ID NO: 251857 - DNA, 20 bp, Artificial Sequence
  Description of Artificial Sequence: Synthetic oligonucleotide
  Target: ATXN1; (+) strand; PAM type: YTN; PAM sequence: TTA
cccttgtgatgcaacgcaac

SEQ ID NO: 251858 - DNA, 20 bp, Artificial Sequence
  Description of Artificial Sequence: Synthetic oligonucleotide
  Target: ATXN1; (+) strand; PAM type: YTN; PAM sequence: CTT
gtgatgcaacgcaactgaag

SEQ ID NO: 251859 - DNA, 20 bp, Artificial Sequence
  Description of Artificial Sequence: Synthetic oligonucleotide
  Target: ATXN1; (+) strand; PAM type: YTN; PAM sequence: TTG
tgatgcaacgcaactgaaga

SEQ ID NO: 251860 - DNA, 20 bp, Artificial Sequence
  Description of Artificial Sequence: Synthetic oligonucleotide
  Target: ATXN1; (+) strand; PAM type: YTN; PAM sequence: CTG
aagaatgacctactatcaat

SEQ ID NO: 251861 - DNA, 20 bp, Artificial Sequence
  Description of Artificial Sequence: Synthetic oligonucleotide
  Target: ATXN1; (+) strand; PAM type: YTN; PAM sequence: CTA
ctatcaattctattcctttg

SEQ ID NO: 251862 - DNA, 20 bp, Artificial Sequence
  Description of Artificial Sequence: Synthetic oligonucleotide
  Target: ATXN1; (+) strand; PAM type: YTN; PAM sequence: CTA
tcaattctattcctttgtgt

SEQ ID NO: 251863 - DNA, 20 bp, Artificial Sequence
  Description of Artificial Sequence: Synthetic oligonucleotide
  Target: ATXN1; (+) strand; PAM type: YTN; PAM sequence: TTC
tattcctttgtgtcctccat

SEQ ID NO: 251864 - DNA, 20 bp, Artificial Sequence
  Description of Artificial Sequence: Synthetic oligonucleotide
  Target: ATXN1; (+) strand; PAM type: YTN; PAM sequence: CTA
ttcctttgtgtcctccatga

SEQ ID NO: 251865 - DNA, 20 bp, Artificial Sequence
  Description of Artificial Sequence: Synthetic oligonucleotide
  Target: ATXN1; (+) strand; PAM type: YTN; PAM sequence: TTC
ctttgtgtcctccatgacac

SEQ ID NO: 251866 - DNA, 20 bp, Artificial Sequence
  Description of Artificial Sequence: Synthetic oligonucleotide
  Target: ATXN1; (+) strand; PAM type: YTN; PAM sequence: CTT
tgtgtcctccatgacactct

SEQ ID NO: 251867 - DNA, 20 bp, Artificial Sequence
  Description of Artificial Sequence: Synthetic oligonucleotide
  Target: ATXN1; (+) strand; PAM type: YTN; PAM sequence: TTT
gtgtcctccatgacactcta

SEQ ID NO: 251868 - DNA, 20 bp, Artificial Sequence
  Description of Artificial Sequence: Synthetic oligonucleotide
  Target: ATXN1; (+) strand; PAM type: YTN; PAM sequence: TTG
tgtcctccatgacactctag

SEQ ID NO: 251869 - DNA, 20 bp, Artificial Sequence
  Description of Artificial Sequence: Synthetic oligonucleotide
  Target: ATXN1; (+) strand; PAM type: YTN; PAM sequence: CTC
catgacactctagaacagtg

SEQ ID NO: 251870 - DNA, 20 bp, Artificial Sequence
  Description of Artificial Sequence: Synthetic oligonucleotide
  Target: ATXN1; (+) strand; PAM type: YTN; PAM sequence: CTC
tagaacagtgctatgcaagc

SEQ ID NO: 251871 - DNA, 20 bp, Artificial Sequence
  Description of Artificial Sequence: Synthetic oligonucleotide
  Target: ATXN1; (+) strand; PAM type: YTN; PAM sequence: CTA
gaacagtgctatgcaagcag

SEQ ID NO: 251872 - DNA, 20 bp, Artificial Sequence
  Description of Artificial Sequence: Synthetic oligonucleotide
  Target: ATXN1; (+) strand; PAM type: YTN; PAM sequence: CTA
tgcaagcagaaagtaacagc

SEQ ID NO: 251873 - DNA, 20 bp, Artificial Sequence
  Description of Artificial Sequence: Synthetic oligonucleotide
  Target: ATXN1; (+) strand; PAM type: YTN; PAM sequence: CTT
attcattcattcattcaata

SEQ ID NO: 251874 - DNA, 20 bp, Artificial Sequence
  Description of Artificial Sequence: Synthetic oligonucleotide
  Target: ATXN1; (+) strand; PAM type: YTN; PAM sequence: TTA
ttcattcattcattcaataa

SEQ ID NO: 251875 - DNA, 20 bp, Artificial Sequence
  Description of Artificial Sequence: Synthetic oligonucleotide
  Target: ATXN1; (+) strand; PAM type: YTN; PAM sequence: TTC
attcattcattcaataacca

SEQ ID NO: 251876 - DNA, 20 bp, Artificial Sequence
  Description of Artificial Sequence: Synthetic oligonucleotide
  Target: ATXN1; (+) strand; PAM type: YTN; PAM sequence: TTC
attcattcaataaccataca

SEQ ID NO: 251877 - DNA, 20 bp, Artificial Sequence
  Description of Artificial Sequence: Synthetic oligonucleotide
  Target: ATXN1; (+) strand; PAM type: YTN; PAM sequence: TTC
attcaataaccatacactga

SEQ ID NO: 251878 - DNA, 20 bp, Artificial Sequence
  Description of Artificial Sequence: Synthetic oligonucleotide
  Target: ATXN1; (+) strand; PAM type: YTN; PAM sequence: TTC
aataaccatacactgaacat

SEQ ID NO: 251879 - DNA, 20 bp, Artificial Sequence
  Description of Artificial Sequence: Synthetic oligonucleotide
  Target: ATXN1; (+) strand; PAM type: YTN; PAM sequence: CTG
aacatccaggaagtgctaac

SEQ ID NO: 251880 - DNA, 20 bp, Artificial Sequence
  Description of Artificial Sequence: Synthetic oligonucleotide
  Target: ATXN1; (+) strand; PAM type: YTN; PAM sequence: CTA
accaggtactgcactaggta

SEQ ID NO: 251881 - DNA, 20 bp, Artificial Sequence
  Description of Artificial Sequence: Synthetic oligonucleotide
  Target: ATXN1; (+) strand; PAM type: YTN; PAM sequence: CTG
cactaggtattagggaaaca

SEQ ID NO: 251882 - DNA, 20 bp, Artificial Sequence
  Description of Artificial Sequence: Synthetic oligonucleotide
  Target: ATXN1; (+) strand; PAM type: YTN; PAM sequence: CTA
ggtattagggaaacagagat

SEQ ID NO: 251883 - DNA, 20 bp, Artificial Sequence
  Description of Artificial Sequence: Synthetic oligonucleotide
  Target: ATXN1; (+) strand; PAM type: YTN; PAM sequence: TTA
gggaaacagagatgagtaaa

SEQ ID NO: 251884 - DNA, 20 bp, Artificial Sequence
  Description of Artificial Sequence: Synthetic oligonucleotide
  Target: ATXN1; (+) strand; PAM type: YTN; PAM sequence: TTC
agttgagactccatgtcttg

SEQ ID NO: 251885 - DNA, 20 bp, Artificial Sequence
  Description of Artificial Sequence: Synthetic oligonucleotide
  Target: ATXN1; (+) strand; PAM type: YTN; PAM sequence: TTG
agactccatgtcttgttggg

SEQ ID NO: 251886 - DNA, 20 bp, Artificial Sequence
  Description of Artificial Sequence: Synthetic oligonucleotide
  Target: ATXN1; (+) strand; PAM type: YTN; PAM sequence: CTC
catgtcttgttgggaaccag

SEQ ID NO: 251887 - DNA, 20 bp, Artificial Sequence
  Description of Artificial Sequence: Synthetic oligonucleotide
  Target: ATXN1; (+) strand; PAM type: YTN; PAM sequence: CTT
gttgggaaccaggcacgtgt

SEQ ID NO: 251888 - DNA, 20 bp, Artificial Sequence
  Description of Artificial Sequence: Synthetic oligonucleotide
  Target: ATXN1; (+) strand; PAM type: YTN; PAM sequence: TTG
ttgggaaccaggcacgtgta

SEQ ID NO: 251889 - DNA, 20 bp, Artificial Sequence
  Description of Artificial Sequence: Synthetic oligonucleotide
  Target: ATXN1; (+) strand; PAM type: YTN; PAM sequence: TTG
ggaaccaggcacgtgtagag

SEQ ID NO: 251890 - DNA, 20 bp, Artificial Sequence
  Description of Artificial Sequence: Synthetic oligonucleotide
  Target: ATXN1; (+) strand; PAM type: YTN; PAM sequence: CTC
ttacgcaggtaataaatgac

SEQ ID NO: 251891 - DNA, 20 bp, Artificial Sequence
  Description of Artificial Sequence: Synthetic oligonucleotide
  Target: ATXN1; (+) strand; PAM type: YTN; PAM sequence: CTT
acgcaggtaataaatgactc

SEQ ID NO: 251892 - DNA, 20 bp, Artificial Sequence
  Description of Artificial Sequence: Synthetic oligonucleotide
  Target: ATXN1; (+) strand; PAM type: YTN; PAM sequence: TTA
cgcaggtaataaatgactct

SEQ ID NO: 251893 - DNA, 20 bp, Artificial Sequence
  Description of Artificial Sequence: Synthetic oligonucleotide
  Target: ATXN1; (+) strand; PAM type: YTN; PAM sequence: CTC
tacagaggcatcagcaagac

SEQ ID NO: 251894 - DNA, 20 bp, Artificial Sequence
  Description of Artificial Sequence: Synthetic oligonucleotide
  Target: ATXN1; (+) strand; PAM type: YTN; PAM sequence: CTA
cagaggcatcagcaagacgc

SEQ ID NO: 251895 - DNA, 20 bp, Artificial Sequence
  Description of Artificial Sequence: Synthetic oligonucleotide
  Target: ATXN1; (+) strand; PAM type: YTN; PAM sequence: CTG
gaaggagaaataagtcagca

SEQ ID NO: 251896 - DNA, 20 bp, Artificial Sequence
  Description of Artificial Sequence: Synthetic oligonucleotide
  Target: ATXN1; (+) strand; PAM type: YTN; PAM sequence: CTC
actctgcaaagaagtgtaca

SEQ ID NO: 251897 - DNA, 20 bp, Artificial Sequence
  Description of Artificial Sequence: Synthetic oligonucleotide
  Target: ATXN1; (+) strand; PAM type: YTN; PAM sequence: CTC
tgcaaagaagtgtacaggaa

SEQ ID NO: 251898 - DNA, 20 bp, Artificial Sequence
  Description of Artificial Sequence: Synthetic oligonucleotide
  Target: ATXN1; (+) strand; PAM type: YTN; PAM sequence: CTG
caaagaagtgtacaggaagc

SEQ ID NO: 251899 - DNA, 20 bp, Artificial Sequence
  Description of Artificial Sequence: Synthetic oligonucleotide
  Target: ATXN1; (+) strand; PAM type: YTN; PAM sequence: CTC
tagatgggtcatttttgaac

SEQ ID NO: 251900 - DNA, 20 bp, Artificial Sequence
  Description of Artificial Sequence: Synthetic oligonucleotide
  Target: ATXN1; (+) strand; PAM type: YTN; PAM sequence: CTA
gatgggtcatttttgaacat

SEQ ID NO: 251901 - DNA, 20 bp, Artificial Sequence
  Description of Artificial Sequence: Synthetic oligonucleotide
  Target: ATXN1; (+) strand; PAM type: YTN; PAM sequence: TTT
ttgaacatatcctcaagatg

SEQ ID NO: 251902 - DNA, 20 bp, Artificial Sequence
  Description of Artificial Sequence: Synthetic oligonucleotide
  Target: ATXN1; (+) strand; PAM type: YTN; PAM sequence: TTT
tgaacatatcctcaagatga

SEQ ID NO: 251903 - DNA, 20 bp, Artificial Sequence
  Description of Artificial Sequence: Synthetic oligonucleotide
  Target: ATXN1; (+) strand; PAM type: YTN; PAM sequence: TTT
gaacatatcctcaagatgag

SEQ ID NO: 251904 - DNA, 20 bp, Artificial Sequence
  Description of Artificial Sequence: Synthetic oligonucleotide
  Target: ATXN1; (+) strand; PAM type: YTN; PAM sequence: TTG
aacatatcctcaagatgagt

SEQ ID NO: 251905 - DNA, 20 bp, Artificial Sequence
  Description of Artificial Sequence: Synthetic oligonucleotide
  Target: ATXN1; (+) strand; PAM type: YTN; PAM sequence: CTC
aagatgagttttgaaaggat

SEQ ID NO: 251906 - DNA, 20 bp, Artificial Sequence
  Description of Artificial Sequence: Synthetic oligonucleotide
  Target: ATXN1; (+) strand; PAM type: YTN; PAM sequence: TTT
tgaaaggataaactcaataa

SEQ ID NO: 251907 - DNA, 20 bp, Artificial Sequence
  Description of Artificial Sequence: Synthetic oligonucleotide
  Target: ATXN1; (+) strand; PAM type: YTN; PAM sequence: TTT
gaaaggataaactcaataag

SEQ ID NO: 251908 - DNA, 20 bp, Artificial Sequence
  Description of Artificial Sequence: Synthetic oligonucleotide
  Target: ATXN1; (+) strand; PAM type: YTN; PAM sequence: TTG
aaaggataaactcaataagt

SEQ ID NO: 251909 - DNA, 20 bp, Artificial Sequence
  Description of Artificial Sequence: Synthetic oligonucleotide
  Target: ATXN1; (+) strand; PAM type: YTN; PAM sequence: CTC
aataagtggcttaaaaagta

SEQ ID NO: 251910 - DNA, 20 bp, Artificial Sequence
  Description of Artificial Sequence: Synthetic oligonucleotide
  Target: ATXN1; (+) strand; PAM type: YTN; PAM sequence: CTT
aaaaagtaagaaaagaggaa

SEQ ID NO: 251911 - DNA, 20 bp, Artificial Sequence
  Description of Artificial Sequence: Synthetic oligonucleotide
  Target: ATXN1; (+) strand; PAM type: YTN; PAM sequence: TTA
aaaagtaagaaaagaggaag

SEQ ID NO: 251912 - DNA, 20 bp, Artificial Sequence
  Description of Artificial Sequence: Synthetic oligonucleotide
  Target: ATXN1; (+) strand; PAM type: YTN; PAM sequence: CTT
aggtgggtccacatggactg

SEQ ID NO: 251913 - DNA, 20 bp, Artificial Sequence
  Description of Artificial Sequence: Synthetic oligonucleotide
  Target: ATXN1; (+) strand; PAM type: YTN; PAM sequence: TTA
ggtgggtccacatggactgt

SEQ ID NO: 251914 - DNA, 20 bp, Artificial Sequence
  Description of Artificial Sequence: Synthetic oligonucleotide
  Target: ATXN1; (+) strand; PAM type: YTN; PAM sequence: CTG
tacacatccacccagcaggc

SEQ ID NO: 251915 - DNA, 20 bp, Artificial Sequence
  Description of Artificial Sequence: Synthetic oligonucleotide
  Target: ATXN1; (+) strand; PAM type: YTN; PAM sequence: CTA
tagaatgtttctctcccaag

SEQ ID NO: 251916 - DNA, 20 bp, Artificial Sequence
  Description of Artificial Sequence: Synthetic oligonucleotide
  Target: ATXN1; (+) strand; PAM type: YTN; PAM sequence: TTT
ctctcccaagggcaatgaat

SEQ ID NO: 251917 - DNA, 20 bp, Artificial Sequence
  Description of Artificial Sequence: Synthetic oligonucleotide
  Target: ATXN1; (+) strand; PAM type: YTN; PAM sequence: TTC
tctcccaagggcaatgaatt

SEQ ID NO: 251918 - DNA, 20 bp, Artificial Sequence
  Description of Artificial Sequence: Synthetic oligonucleotide
  Target: ATXN1; (+) strand; PAM type: YTN; PAM sequence: CTC
tcccaagggcaatgaattgg

SEQ ID NO: 251919 - DNA, 20 bp, Artificial Sequence
  Description of Artificial Sequence: Synthetic oligonucleotide
  Target: ATXN1; (+) strand; PAM type: YTN; PAM sequence: CTC
ccaagggcaatgaattggtt

SEQ ID NO: 251920 - DNA, 20 bp, Artificial Sequence
  Description of Artificial Sequence: Synthetic oligonucleotide
  Target: ATXN1; (+) strand; PAM type: YTN; PAM sequence: TTG
gtttagccacaggattttct

SEQ ID NO: 251921 - DNA, 20 bp, Artificial Sequence
  Description of Artificial Sequence: Synthetic oligonucleotide
  Target: ATXN1; (+) strand; PAM type: YTN; PAM sequence: TTT
agccacaggattttcttcaa

SEQ ID NO: 251922 - DNA, 20 bp, Artificial Sequence
  Description of Artificial Sequence: Synthetic oligonucleotide
  Target: ATXN1; (+) strand; PAM type: YTN; PAM sequence: TTA
gccacaggattttcttcaaa

SEQ ID NO: 251923 - DNA, 20 bp, Artificial Sequence
  Description of Artificial Sequence: Synthetic oligonucleotide
  Target: ATXN1; (+) strand; PAM type: YTN; PAM sequence: TTT
tcttcaaaggaggtcctcaa

SEQ ID NO: 251924 - DNA, 20 bp, Artificial Sequence
  Description of Artificial Sequence: Synthetic oligonucleotide
  Target: ATXN1; (+) strand; PAM type: YTN; PAM sequence: TTT
cttcaaaggaggtcctcaac

SEQ ID NO: 251925 - DNA, 20 bp, Artificial Sequence
  Description of Artificial Sequence: Synthetic oligonucleotide
  Target: ATXN1; (+) strand; PAM type: YTN; PAM sequence: TTC
ttcaaaggaggtcctcaaca

SEQ ID NO: 251926 - DNA, 20 bp, Artificial Sequence
  Description of Artificial Sequence: Synthetic oligonucleotide
  Target: ATXN1; (+) strand; PAM type: YTN; PAM sequence: CTT
caaaggaggtcctcaacatg

SEQ ID NO: 251927 - DNA, 20 bp, Artificial Sequence
  Description of Artificial Sequence: Synthetic oligonucleotide
  Target: ATXN1; (+) strand; PAM type: YTN; PAM sequence: TTC
aaaggaggtcctcaacatgc

SEQ ID NO: 251928 - DNA, 20 bp, Artificial Sequence
  Description of Artificial Sequence: Synthetic oligonucleotide
  Target: ATXN1; (+) strand; PAM type: YTN; PAM sequence: CTC
aacatgccagcgggtacttc

SEQ ID NO: 251929 - DNA, 20 bp, Artificial Sequence
  Description of Artificial Sequence: Synthetic oligonucleotide
  Target: ATXN1; (+) strand; PAM type: YTN; PAM sequence: CTT
ccctgattttggtcaggatg

SEQ ID NO: 251930 - DNA, 20 bp, Artificial Sequence
  Description of Artificial Sequence: Synthetic oligonucleotide
  Target: ATXN1; (+) strand; PAM type: YTN; PAM sequence: TTC
cctgattttggtcaggatgc

SEQ ID NO: 251931 - DNA, 20 bp, Artificial Sequence
  Description of Artificial Sequence: Synthetic oligonucleotide
  Target: ATXN1; (+) strand; PAM type: YTN; PAM sequence: CTG
attttggtcaggatgcaatc

SEQ ID NO: 251932 - DNA, 20 bp, Artificial Sequence
  Description of Artificial Sequence: Synthetic oligonucleotide
  Target: ATXN1; (+) strand; PAM type: YTN; PAM sequence: TTT
tggtcaggatgcaatccagg

SEQ ID NO: 251933 - DNA, 20 bp, Artificial Sequence
  Description of Artificial Sequence: Synthetic oligonucleotide
  Target: ATXN1; (+) strand; PAM type: YTN; PAM sequence: TTT
ggtcaggatgcaatccaggt

SEQ ID NO: 251934 - DNA, 20 bp, Artificial Sequence
  Description of Artificial Sequence: Synthetic oligonucleotide
  Target: ATXN1; (+) strand; PAM type: YTN; PAM sequence: TTG
gtcaggatgcaatccaggtg

SEQ ID NO: 251935 - DNA, 20 bp, Artificial Sequence
  Description of Artificial Sequence: Synthetic oligonucleotide
  Target: ATXN1; (+) strand; PAM type: YTN; PAM sequence: CTG
gcttgtgacatctgtaatct

SEQ ID NO: 251936 - DNA, 20 bp, Artificial Sequence
  Description of Artificial Sequence: Synthetic oligonucleotide
  Target: ATXN1; (+) strand; PAM type: YTN; PAM sequence: CTT
gtgacatctgtaatctgccc

SEQ ID NO: 251937 - DNA, 20 bp, Artificial Sequence
  Description of Artificial Sequence: Synthetic oligonucleotide
  Target: ATXN1; (+) strand; PAM type: YTN; PAM sequence: TTG
tgacatctgtaatctgccca

SEQ ID NO: 251938 - DNA, 20 bp, Artificial Sequence
  Description of Artificial Sequence: Synthetic oligonucleotide
  Target: ATXN1; (+) strand; PAM type: YTN; PAM sequence: CTG
taatctgcccagatcacaga

SEQ ID NO: 251939 - DNA, 20 bp, Artificial Sequence
  Description of Artificial Sequence: Synthetic oligonucleotide
  Target: ATXN1; (+) strand; PAM type: YTN; PAM sequence: CTG
cccagatcacagatgcgcag

SEQ ID NO: 251940 - DNA, 20 bp, Artificial Sequence
  Description of Artificial Sequence: Synthetic oligonucleotide
  Target: ATXN1; (+) strand; PAM type: YTN; PAM sequence: TTC
cctctgcttagaacagaagc

SEQ ID NO: 251941 - DNA, 20 bp, Artificial Sequence
  Description of Artificial Sequence: Synthetic oligonucleotide
  Target: ATXN1; (+) strand; PAM type: YTN; PAM sequence: CTC
tgcttagaacagaagccagg

SEQ ID NO: 251942 - DNA, 20 bp, Artificial Sequence
  Description of Artificial Sequence: Synthetic oligonucleotide
  Target: ATXN1; (+) strand; PAM type: YTN; PAM sequence: CTG
cttagaacagaagccaggag

SEQ ID NO: 251943 - DNA, 20 bp, Artificial Sequence
  Description of Artificial Sequence: Synthetic oligonucleotide
  Target: ATXN1; (+) strand; PAM type: YTN; PAM sequence: CTT
agaacagaagccaggagaag

SEQ ID NO: 251944 - DNA, 20 bp, Artificial Sequence
  Description of Artificial Sequence: Synthetic oligonucleotide
  Target: ATXN1; (+) strand; PAM type: YTN; PAM sequence: TTA
gaacagaagccaggagaagg

SEQ ID NO: 251945 - DNA, 20 bp, Artificial Sequence
  Description of Artificial Sequence: Synthetic oligonucleotide
  Target: ATXN1; (+) strand; PAM type: YTN; PAM sequence: CTG
aatacatgcatctttaagat

SEQ ID NO: 251946 - DNA, 20 bp, Artificial Sequence
  Description of Artificial Sequence: Synthetic oligonucleotide
  Target: ATXN1; (+) strand; PAM type: YTN; PAM sequence: CTT
taagattcatacccacggaa

SEQ ID NO: 251947 - DNA, 20 bp, Artificial Sequence
  Description of Artificial Sequence: Synthetic oligonucleotide
  Target: ATXN1; (+) strand; PAM type: YTN; PAM sequence: TTT
aagattcatacccacggaac

SEQ ID NO: 251948 - DNA, 20 bp, Artificial Sequence
  Description of Artificial Sequence: Synthetic oligonucleotide
  Target: ATXN1; (+) strand; PAM type: YTN; PAM sequence: TTA
agattcatacccacggaaca

SEQ ID NO: 251949 - DNA, 20 bp, Artificial Sequence
  Description of Artificial Sequence: Synthetic oligonucleotide
  Target: ATXN1; (+) strand; PAM type: YTN; PAM sequence: TTC
atacccacggaacagagact

SEQ ID NO: 251950 - DNA, 20 bp, Artificial Sequence
  Description of Artificial Sequence: Synthetic oligonucleotide
  Target: ATXN1; (+) strand; PAM type: YTN; PAM sequence: CTC
tcctagtcatctgttcacaa

SEQ ID NO: 251951 - DNA, 20 bp, Artificial Sequence
  Description of Artificial Sequence: Synthetic oligonucleotide
  Target: ATXN1; (+) strand; PAM type: YTN; PAM sequence: CTC
ctagtcatctgttcacaaac

SEQ ID NO: 251952 - DNA, 20 bp, Artificial Sequence
  Description of Artificial Sequence: Synthetic oligonucleotide
  Target: ATXN1; (+) strand; PAM type: YTN; PAM sequence: CTA
gtcatctgttcacaaacttt

SEQ ID NO: 251953 - DNA, 20 bp, Artificial Sequence
  Description of Artificial Sequence: Synthetic oligonucleotide
  Target: ATXN1; (+) strand; PAM type: YTN; PAM sequence: CTG
ttcacaaactttcagtgagt

SEQ ID NO: 251954 - DNA, 20 bp, Artificial Sequence
  Description of Artificial Sequence: Synthetic oligonucleotide
  Target: ATXN1; (+) strand; PAM type: YTN; PAM sequence: TTC
acaaactttcagtgagtgtc

SEQ ID NO: 251955 - DNA, 20 bp, Artificial Sequence
  Description of Artificial Sequence: Synthetic oligonucleotide
  Target: ATXN1; (+) strand; PAM type: YTN; PAM sequence: CTT
tcagtgagtgtctactatat

SEQ ID NO: 251956 - DNA, 20 bp, Artificial Sequence
  Description of Artificial Sequence: Synthetic oligonucleotide
  Target: ATXN1; (+) strand; PAM type: YTN; PAM sequence: TTT
cagtgagtgtctactatatg

SEQ ID NO: 251957 - DNA, 20 bp, Artificial Sequence
  Description of Artificial Sequence: Synthetic oligonucleotide
  Target: ATXN1; (+) strand; PAM type: YTN; PAM sequence: TTC
agtgagtgtctactatatgc

SEQ ID NO: 251958 - DNA, 20 bp, Artificial Sequence
  Description of Artificial Sequence: Synthetic oligonucleotide
  Target: ATXN1; (+) strand; PAM type: YTN; PAM sequence: CTA
ctatatgccaggcagaccac

SEQ ID NO: 251959 - DNA, 20 bp, Artificial Sequence
  Description of Artificial Sequence: Synthetic oligonucleotide
  Target: ATXN1; (+) strand; PAM type: YTN; PAM sequence: CTA
tatgccaggcagaccacagt

SEQ ID NO: 251960 - DNA, 20 bp, Artificial Sequence
  Description of Artificial Sequence: Synthetic oligonucleotide
  Target: ATXN1; (+) strand; PAM type: YTN; PAM sequence: TTA
agcttaataacccttaaata

SEQ ID NO: 251961 - DNA, 20 bp, Artificial Sequence
  Description of Artificial Sequence: Synthetic oligonucleotide
  Target: ATXN1; (+) strand; PAM type: YTN; PAM sequence: CTT
aataacccttaaatatcatt

SEQ ID NO: 251962 - DNA, 20 bp, Artificial Sequence
  Description of Artificial Sequence: Synthetic oligonucleotide
  Target: ATXN1; (+) strand; PAM type: YTN; PAM sequence: TTA
ataacccttaaatatcattc

SEQ ID NO: 251963 - DNA, 20 bp, Artificial Sequence
  Description of Artificial Sequence: Synthetic oligonucleotide
  Target: ATXN1; (+) strand; PAM type: YTN; PAM sequence: CTT
aaatatcattctctggttcc

SEQ ID NO: 251964 - DNA, 20 bp, Artificial Sequence
  Description of Artificial Sequence: Synthetic oligonucleotide
  Target: ATXN1; (+) strand; PAM type: YTN; PAM sequence: TTA
aatatcattctctggttcca

SEQ ID NO: 251965 - DNA, 20 bp, Artificial Sequence
  Description of Artificial Sequence: Synthetic oligonucleotide
  Target: ATXN1; (+) strand; PAM type: YTN; PAM sequence: TTC
tctggttccaggcctcttca

SEQ ID NO: 251966 - DNA, 20 bp, Artificial Sequence
  Description of Artificial Sequence: Synthetic oligonucleotide
  Target: ATXN1; (+) strand; PAM type: YTN; PAM sequence: CTC
tggttccaggcctcttcaga

SEQ ID NO: 251967 - DNA, 20 bp, Artificial Sequence
  Description of Artificial Sequence: Synthetic oligonucleotide
  Target: ATXN1; (+) strand; PAM type: YTN; PAM sequence: CTG
gttccaggcctcttcagaag

SEQ ID NO: 251968 - DNA, 20 bp, Artificial Sequence
  Description of Artificial Sequence: Synthetic oligonucleotide
  Target: ATXN1; (+) strand; PAM type: YTN; PAM sequence: TTC
caggcctcttcagaagcttg

SEQ ID NO: 251969 - DNA, 20 bp, Artificial Sequence
  Description of Artificial Sequence: Synthetic oligonucleotide
  Target: ATXN1; (+) strand; PAM type: YTN; PAM sequence: CTC
ttcagaagcttggctattta

SEQ ID NO: 251970 - DNA, 20 bp, Artificial Sequence
  Description of Artificial Sequence: Synthetic oligonucleotide
  Target: ATXN1; (+) strand; PAM type: YTN; PAM sequence: CTT
cagaagcttggctatttatt

SEQ ID NO: 251971 - DNA, 20 bp, Artificial Sequence
  Description of Artificial Sequence: Synthetic oligonucleotide
  Target: ATXN1; (+) strand; PAM type: YTN; PAM sequence: TTC
agaagcttggctatttatta

SEQ ID NO: 251972 - DNA, 20 bp, Artificial Sequence
  Description of Artificial Sequence: Synthetic oligonucleotide
  Target: ATXN1; (+) strand; PAM type: YTN; PAM sequence: CTT
ggctatttattatctaatat

SEQ ID NO: 251973 - DNA, 20 bp, Artificial Sequence
  Description of Artificial Sequence: Synthetic oligonucleotide
  Target: ATXN1; (+) strand; PAM type: YTN; PAM sequence: TTG
gctatttattatctaatatt

SEQ ID NO: 251974 - DNA, 20 bp, Artificial Sequence
  Description of Artificial Sequence: Synthetic oligonucleotide
  Target: ATXN1; (+) strand; PAM type: YTN; PAM sequence: CTA
tttattatctaatattcttg

SEQ ID NO: 251975 - DNA, 20 bp, Artificial Sequence
  Description of Artificial Sequence: Synthetic oligonucleotide
  Target: ATXN1; (+) strand; PAM type: YTN; PAM sequence: TTT
attatctaatattcttgtga

SEQ ID NO: 251976 - DNA, 20 bp, Artificial Sequence
  Description of Artificial Sequence: Synthetic oligonucleotide
  Target: ATXN1; (+) strand; PAM type: YTN; PAM sequence: TTA
ttatctaatattcttgtgag

SEQ ID NO: 251977 - DNA, 20 bp, Artificial Sequence
  Description of Artificial Sequence: Synthetic oligonucleotide
  Target: ATXN1; (+) strand; PAM type: YTN; PAM sequence: TTA
tctaatattcttgtgagttc

SEQ ID NO: 251978 - DNA, 20 bp, Artificial Sequence
  Description of Artificial Sequence: Synthetic oligonucleotide
  Target: ATXN1; (+) strand; PAM type: YTN; PAM sequence: CTA
atattcttgtgagttcctgt

SEQ ID NO: 251979 - DNA, 20 bp, Artificial Sequence
  Description of Artificial Sequence: Synthetic oligonucleotide
  Target: ATXN1; (+) strand; PAM type: YTN; PAM sequence: TTC
ttgtgagttcctgtgtctgg

SEQ ID NO: 251980 - DNA, 20 bp, Artificial Sequence
  Description of Artificial Sequence: Synthetic oligonucleotide
  Target: ATXN1; (+) strand; PAM type: YTN; PAM sequence: CTT
gtgagttcctgtgtctggat

SEQ ID NO: 251981 - DNA, 20 bp, Artificial Sequence
  Description of Artificial Sequence: Synthetic oligonucleotide
  Target: ATXN1; (+) strand; PAM type: YTN; PAM sequence: TTG
tgagttcctgtgtctggatt

SEQ ID NO: 251982 - DNA, 20 bp, Artificial Sequence
  Description of Artificial Sequence: Synthetic oligonucleotide
  Target: ATXN1; (+) strand; PAM type: YTN; PAM sequence: TTC
ctgtgtctggatttctgtgt

SEQ ID NO: 251983 - DNA, 20 bp, Artificial Sequence
  Description of Artificial Sequence: Synthetic oligonucleotide
  Target: ATXN1; (+) strand; PAM type: YTN; PAM sequence: CTG
tgtctggatttctgtgttta

SEQ ID NO: 251984 - DNA, 20 bp, Artificial Sequence
  Description of Artificial Sequence: Synthetic oligonucleotide
  Target: ATXN1; (+) strand; PAM type: YTN; PAM sequence: CTG
gatttctgtgtttaggctct

SEQ ID NO: 251985 - DNA, 20 bp, Artificial Sequence
  Description of Artificial Sequence: Synthetic oligonucleotide
  Target: ATXN1; (+) strand; PAM type: YTN; PAM sequence: TTT
ctgtgtttaggctcttttag

SEQ ID NO: 251986 - DNA, 20 bp, Artificial Sequence
  Description of Artificial Sequence: Synthetic oligonucleotide
  Target: ATXN1; (+) strand; PAM type: YTN; PAM sequence: TTC
tgtgtttaggctcttttagg

SEQ ID NO: 251987 - DNA, 20 bp, Artificial Sequence
  Description of Artificial Sequence: Synthetic oligonucleotide
  Target: ATXN1; (+) strand; PAM type: YTN; PAM sequence: CTG
tgtttaggctcttttaggga

SEQ ID NO: 251988 - DNA, 20 bp, Artificial Sequence
  Description of Artificial Sequence: Synthetic oligonucleotide
  Target: ATXN1; (+) strand; PAM type: YTN; PAM sequence: TTT
aggctcttttagggagatag

SEQ ID NO: 251989 - DNA, 20 bp, Artificial Sequence
  Description of Artificial Sequence: Synthetic oligonucleotide
  Target: ATXN1; (+) strand; PAM type: YTN; PAM sequence: TTA
ggctcttttagggagatagt

SEQ ID NO: 251990 - DNA, 20 bp, Artificial Sequence
  Description of Artificial Sequence: Synthetic oligonucleotide
  Target: ATXN1; (+) strand; PAM type: YTN; PAM sequence: CTC
ttttagggagatagtaagga

SEQ ID NO: 251991 - DNA, 20 bp, Artificial Sequence
  Description of Artificial Sequence: Synthetic oligonucleotide
  Target: ATXN1; (+) strand; PAM type: YTN; PAM sequence: CTT
ttagggagatagtaaggaac

SEQ ID NO: 251992 - DNA, 20 bp, Artificial Sequence
  Description of Artificial Sequence: Synthetic oligonucleotide
  Target: ATXN1; (+) strand; PAM type: YTN; PAM sequence: TTT
tagggagatagtaaggaact

SEQ ID NO: 251993 - DNA, 20 bp, Artificial Sequence
  Description of Artificial Sequence: Synthetic oligonucleotide
  Target: ATXN1; (+) strand; PAM type: YTN; PAM sequence: TTT
agggagatagtaaggaactg

SEQ ID NO: 251994 - DNA, 20 bp, Artificial Sequence
  Description of Artificial Sequence: Synthetic oligonucleotide
  Target: ATXN1; (+) strand; PAM type: YTN; PAM sequence: TTA
gggagatagtaaggaactgg

SEQ ID NO: 251995 - DNA, 20 bp, Artificial Sequence
  Description of Artificial Sequence: Synthetic oligonucleotide
  Target: ATXN1; (+) strand; PAM type: YTN; PAM sequence: CTG
gcatccatgtgacttttttt

SEQ ID NO: 251996 - DNA, 20 bp, Artificial Sequence
  Description of Artificial Sequence: Synthetic oligonucleotide
  Target: ATXN1; (+) strand; PAM type: YTN; PAM sequence: CTT
ttttttttttttaaaagcct

SEQ ID NO: 251997 - DNA, 20 bp, Artificial Sequence
  Description of Artificial Sequence: Synthetic oligonucleotide
  Target: ATXN1; (+) strand; PAM type: YTN; PAM sequence: TTT
tttttttttttaaaagcctt

SEQ ID NO: 251998 - DNA, 20 bp, Artificial Sequence
  Description of Artificial Sequence: Synthetic oligonucleotide
  Target: ATXN1; (+) strand; PAM type: YTN; PAM sequence: TTT
ttttttttttaaaagccttc

SEQ ID NO: 251999 - DNA, 20 bp, Artificial Sequence
  Description of Artificial Sequence: Synthetic oligonucleotide
  Target: ATXN1; (+) strand; PAM type: YTN; PAM sequence: TTT
tttttttttaaaagccttct

SEQ ID NO: 252000 - DNA, 20 bp, Artificial Sequence
  Description of Artificial Sequence: Synthetic oligonucleotide
  Target: ATXN1; (+) strand; PAM type: YTN; PAM sequence: TTT
ttttttttaaaagccttctc

SEQ ID NO: 252001 - DNA, 20 bp, Artificial Sequence
  Description of Artificial Sequence: Synthetic oligonucleotide
  Target: ATXN1; (+) strand; PAM type: YTN; PAM sequence: TTT
tttttttaaaagccttctct

SEQ ID NO: 252002 - DNA, 20 bp, Artificial Sequence
  Description of Artificial Sequence: Synthetic oligonucleotide
  Target: ATXN1; (+) strand; PAM type: YTN; PAM sequence: TTT
ttttttaaaagccttctctg

SEQ ID NO: 252003 - DNA, 20 bp, Artificial Sequence
  Description of Artificial Sequence: Synthetic oligonucleotide
  Target: ATXN1; (+) strand; PAM type: YTN; PAM sequence: TTT
tttttaaaagccttctctgc

SEQ ID NO: 252004 - DNA, 20 bp, Artificial Sequence
  Description of Artificial Sequence: Synthetic oligonucleotide
  Target: ATXN1; (+) strand; PAM type: YTN; PAM sequence: TTT
ttttaaaagccttctctgcc

SEQ ID NO: 252005 - DNA, 20 bp, Artificial Sequence
  Description of Artificial Sequence: Synthetic oligonucleotide
  Target: ATXN1; (+) strand; PAM type: YTN; PAM sequence: TTT
tttaaaagccttctctgcct

SEQ ID NO: 252006 - DNA, 20 bp, Artificial Sequence
  Description of Artificial Sequence: Synthetic oligonucleotide
  Target: ATXN1; (+) strand; PAM type: YTN; PAM sequence: TTT
ttaaaagccttctctgcctg

SEQ ID NO: 252007 - DNA, 20 bp, Artificial Sequence
  Description of Artificial Sequence: Synthetic oligonucleotide
  Target: ATXN1; (+) strand; PAM type: YTN; PAM sequence: TTT
taaaagccttctctgcctga

SEQ ID NO: 252008 - DNA, 20 bp, Artificial Sequence
  Description of Artificial Sequence: Synthetic oligonucleotide
  Target: ATXN1; (+) strand; PAM type: YTN; PAM sequence: TTT
aaaagccttctctgcctgaa

SEQ ID NO: 252009 - DNA, 20 bp, Artificial Sequence
  Description of Artificial Sequence: Synthetic oligonucleotide
  Target: ATXN1; (+) strand; PAM type: YTN; PAM sequence: TTA
aaagccttctctgcctgaaa

SEQ ID NO: 252010 - DNA, 20 bp, Artificial Sequence
  Description of Artificial Sequence: Synthetic oligonucleotide
  Target: ATXN1; (+) strand; PAM type: YTN; PAM sequence: CTT
ctctgcctgaaaatgccaga

SEQ ID NO: 252011 - DNA, 20 bp, Artificial Sequence
  Description of Artificial Sequence: Synthetic oligonucleotide
  Target: ATXN1; (+) strand; PAM type: YTN; PAM sequence: TTC
tctgcctgaaaatgccagac

SEQ ID NO: 252012 - DNA, 20 bp, Artificial Sequence
  Description of Artificial Sequence: Synthetic oligonucleotide
  Target: ATXN1; (+) strand; PAM type: YTN; PAM sequence: CTC
tgcctgaaaatgccagacac

SEQ ID NO: 252013 - DNA, 20 bp, Artificial Sequence
  Description of Artificial Sequence: Synthetic oligonucleotide
  Target: ATXN1; (+) strand; PAM type: YTN; PAM sequence: CTG
cctgaaaatgccagacacat

SEQ ID NO: 252014 - DNA, 20 bp, Artificial Sequence
  Description of Artificial Sequence: Synthetic oligonucleotide
  Target: ATXN1; (+) strand; PAM type: YTN; PAM sequence: CTG
aaaatgccagacacatttca

SEQ ID NO: 252015 - DNA, 20 bp, Artificial Sequence
  Description of Artificial Sequence: Synthetic oligonucleotide
  Target: ATXN1; (+) strand; PAM type: YTN; PAM sequence: TTT
cagatgtcaaaactaacgtg

SEQ ID NO: 252016 - DNA, 20 bp, Artificial Sequence
  Description of Artificial Sequence: Synthetic oligonucleotide
  Target: ATXN1; (+) strand; PAM type: YTN; PAM sequence: TTC
agatgtcaaaactaacgtgg

SEQ ID NO: 252017 - DNA, 20 bp, Artificial Sequence
  Description of Artificial Sequence: Synthetic oligonucleotide
  Target: ATXN1; (+) strand; PAM type: YTN; PAM sequence: CTA
acgtggcattcagggtgggt

SEQ ID NO: 252018 - DNA, 20 bp, Artificial Sequence
  Description of Artificial Sequence: Synthetic oligonucleotide
  Target: ATXN1; (+) strand; PAM type: YTN; PAM sequence: TTC
agggtgggtgactgatccat

SEQ ID NO: 252019 - DNA, 20 bp, Artificial Sequence
  Description of Artificial Sequence: Synthetic oligonucleotide
  Target: ATXN1; (+) strand; PAM type: YTN; PAM sequence: CTG
atccatgtgagtgctcttaa

SEQ ID NO: 252020 - DNA, 20 bp, Artificial Sequence
  Description of Artificial Sequence: Synthetic oligonucleotide
  Target: ATXN1; (+) strand; PAM type: YTN; PAM sequence: CTC
ttaagtgggtgtagaagcct

SEQ ID NO: 252021 - DNA, 20 bp, Artificial Sequence
  Description of Artificial Sequence: Synthetic oligonucleotide
  Target: ATXN1; (+) strand; PAM type: YTN; PAM sequence: CTT
aagtgggtgtagaagcctgt

SEQ ID NO: 252022 - DNA, 20 bp, Artificial Sequence
  Description of Artificial Sequence: Synthetic oligonucleotide
  Target: ATXN1; (+) strand; PAM type: YTN; PAM sequence: TTA
agtgggtgtagaagcctgtc

SEQ ID NO: 252023 - DNA, 20 bp, Artificial Sequence
  Description of Artificial Sequence: Synthetic oligonucleotide
  Target: ATXN1; (+) strand; PAM type: YTN; PAM sequence: CTG
tctggctcattgtcttttct

SEQ ID NO: 252024 - DNA, 20 bp, Artificial Sequence
  Description of Artificial Sequence: Synthetic oligonucleotide
  Target: ATXN1; (+) strand; PAM type: YTN; PAM sequence: CTG
gctcattgtcttttctgcac

SEQ ID NO: 252025 - DNA, 20 bp, Artificial Sequence
  Description of Artificial Sequence: Synthetic oligonucleotide
  Target: ATXN1; (+) strand; PAM type: YTN; PAM sequence: CTC
attgtcttttctgcacacgc

SEQ ID NO: 252026 - DNA, 20 bp, Artificial Sequence
  Description of Artificial Sequence: Synthetic oligonucleotide
  Target: ATXN1; (+) strand; PAM type: YTN; PAM sequence: TTG
tcttttctgcacacgcgcat

SEQ ID NO: 252027 - DNA, 20 bp, Artificial Sequence
  Description of Artificial Sequence: Synthetic oligonucleotide
  Target: ATXN1; (+) strand; PAM type: YTN; PAM sequence: CTT
ttctgcacacgcgcattcaa

SEQ ID NO: 252028 - DNA, 20 bp, Artificial Sequence
  Description of Artificial Sequence: Synthetic oligonucleotide
  Target: ATXN1; (+) strand; PAM type: YTN; PAM sequence: TTT
tctgcacacgcgcattcaaa

SEQ ID NO: 252029 - DNA, 20 bp, Artificial Sequence
  Description of Artificial Sequence: Synthetic oligonucleotide
  Target: ATXN1; (+) strand; PAM type: YTN; PAM sequence: TTT
ctgcacacgcgcattcaaat

SEQ ID NO: 252030 - DNA, 20 bp, Artificial Sequence
  Description of Artificial Sequence: Synthetic oligonucleotide
  Target: ATXN1; (+) strand; PAM type: YTN; PAM sequence: TTC
tgcacacgcgcattcaaatg

SEQ ID NO: 252031 - DNA, 20 bp, Artificial Sequence
  Description of Artificial Sequence: Synthetic oligonucleotide
  Target: ATXN1; (+) strand; PAM type: YTN; PAM sequence: CTG
cacacgcgcattcaaatgtg

SEQ ID NO: 252032 - DNA, 20 bp, Artificial Sequence
  Description of Artificial Sequence: Synthetic oligonucleotide
  Target: ATXN1; (+) strand; PAM type: YTN; PAM sequence: TTC
aaatgtgcacaggcttgtag

SEQ ID NO: 252033 - DNA, 20 bp, Artificial Sequence
  Description of Artificial Sequence: Synthetic oligonucleotide
  Target: ATXN1; (+) strand; PAM type: YTN; PAM sequence: CTT
gtaggccataaatagctctt

SEQ ID NO: 252034 - DNA, 20 bp, Artificial Sequence
  Description of Artificial Sequence: Synthetic oligonucleotide
  Target: ATXN1; (+) strand; PAM type: YTN; PAM sequence: TTG
taggccataaatagctctta

SEQ ID NO: 252035 - DNA, 20 bp, Artificial Sequence
  Description of Artificial Sequence: Synthetic oligonucleotide
  Target: ATXN1; (+) strand; PAM type: YTN; PAM sequence: CTC
ttaggggagtgtgagattac

SEQ ID NO: 252036 - DNA, 20 bp, Artificial Sequence
  Description of Artificial Sequence: Synthetic oligonucleotide
  Target: ATXN1; (+) strand; PAM type: YTN; PAM sequence: CTT
aggggagtgtgagattacat

SEQ ID NO: 252037 - DNA, 20 bp, Artificial Sequence
  Description of Artificial Sequence: Synthetic oligonucleotide
  Target: ATXN1; (+) strand; PAM type: YTN; PAM sequence: TTA
ggggagtgtgagattacatc

SEQ ID NO: 252038 - DNA, 20 bp, Artificial Sequence
  Description of Artificial Sequence: Synthetic oligonucleotide
  Target: ATXN1; (+) strand; PAM type: YTN; PAM sequence: TTA
catcacagactcaagagggc

SEQ ID NO: 252039 - DNA, 20 bp, Artificial Sequence
  Description of Artificial Sequence: Synthetic oligonucleotide
  Target: ATXN1; (+) strand; PAM type: YTN; PAM sequence: CTC
aagagggccccgttacctca

SEQ ID NO: 252040 - DNA, 20 bp, Artificial Sequence
  Description of Artificial Sequence: Synthetic oligonucleotide
  Target: ATXN1; (+) strand; PAM type: YTN; PAM sequence: TTA
cctcaaatcagtgaatgctt

SEQ ID NO: 252041 - DNA, 20 bp, Artificial Sequence
  Description of Artificial Sequence: Synthetic oligonucleotide
  Target: ATXN1; (+) strand; PAM type: YTN; PAM sequence: CTC
aaatcagtgaatgcttgaca

SEQ ID NO: 252042 - DNA, 20 bp, Artificial Sequence
  Description of Artificial Sequence: Synthetic oligonucleotide
  Target: ATXN1; (+) strand; PAM type: YTN; PAM sequence: CTT
gacactcatctccccaaaaa

SEQ ID NO: 252043 - DNA, 20 bp, Artificial Sequence
  Description of Artificial Sequence: Synthetic oligonucleotide
  Target: ATXN1; (+) strand; PAM type: YTN; PAM sequence: TTG
acactcatctccccaaaaag

SEQ ID NO: 252044 - DNA, 20 bp, Artificial Sequence
  Description of Artificial Sequence: Synthetic oligonucleotide
  Target: ATXN1; (+) strand; PAM type: YTN; PAM sequence: CTC
atctccccaaaaaggcatgc

SEQ ID NO: 252045 - DNA, 20 bp, Artificial Sequence
  Description of Artificial Sequence: Synthetic oligonucleotide
  Target: ATXN1; (+) strand; PAM type: YTN; PAM sequence: CTC
cccaaaaaggcatgctgttg

SEQ ID NO: 252046 - DNA, 20 bp, Artificial Sequence
  Description of Artificial Sequence: Synthetic oligonucleotide
  Target: ATXN1; (+) strand; PAM type: YTN; PAM sequence: CTG
ttgaaaatgcagatactaga

SEQ ID NO: 252047 - DNA, 20 bp, Artificial Sequence
  Description of Artificial Sequence: Synthetic oligonucleotide
  Target: ATXN1; (+) strand; PAM type: YTN; PAM sequence: TTG
aaaatgcagatactagactc

SEQ ID NO: 252048 - DNA, 20 bp, Artificial Sequence
  Description of Artificial Sequence: Synthetic oligonucleotide
  Target: ATXN1; (+) strand; PAM type: YTN; PAM sequence: CTA
gactcaccctgacccccaaa

SEQ ID NO: 252049 - DNA, 20 bp, Artificial Sequence
  Description of Artificial Sequence: Synthetic oligonucleotide
  Target: ATXN1; (+) strand; PAM type: YTN; PAM sequence: CTC
accctgacccccaaaaaact

SEQ ID NO: 252050 - DNA, 20 bp, Artificial Sequence
  Description of Artificial Sequence: Synthetic oligonucleotide
  Target: ATXN1; (+) strand; PAM type: YTN; PAM sequence: CTG
acccccaaaaaactaccact

SEQ ID NO: 252051 - DNA, 20 bp, Artificial Sequence
  Description of Artificial Sequence: Synthetic oligonucleotide
  Target: ATXN1; (+) strand; PAM type: YTN; PAM sequence: CTA
ccactggcaggcattgttat

SEQ ID NO: 252052 - DNA, 20 bp, Artificial Sequence
  Description of Artificial Sequence: Synthetic oligonucleotide
  Target: ATXN1; (+) strand; PAM type: YTN; PAM sequence: CTG
gcaggcattgttatgggctg

SEQ ID NO: 252053 - DNA, 20 bp, Artificial Sequence
  Description of Artificial Sequence: Synthetic oligonucleotide
  Target: ATXN1; (+) strand; PAM type: YTN; PAM sequence: TTG
ttatgggctgaattctgtcc

SEQ ID NO: 252054 - DNA, 20 bp, Artificial Sequence
  Description of Artificial Sequence: Synthetic oligonucleotide
  Target: ATXN1; (+) strand; PAM type: YTN; PAM sequence: TTA
tgggctgaattctgtccctc

SEQ ID NO: 252055 - DNA, 20 bp, Artificial Sequence
  Description of Artificial Sequence: Synthetic oligonucleotide
  Target: ATXN1; (+) strand; PAM type: YTN; PAM sequence: CTG
aattctgtccctccaaattt

SEQ ID NO: 252056 - DNA, 20 bp, Artificial Sequence
  Description of Artificial Sequence: Synthetic oligonucleotide
  Target: ATXN1; (+) strand; PAM type: YTN; PAM sequence: TTC
tgtccctccaaatttatata

SEQ ID NO: 252057 - DNA, 20 bp, Artificial Sequence
  Description of Artificial Sequence: Synthetic oligonucleotide
  Target: ATXN1; (+) strand; PAM type: YTN; PAM sequence: CTG
tccctccaaatttatatatt

SEQ ID NO: 252058 - DNA, 20 bp, Artificial Sequence
  Description of Artificial Sequence: Synthetic oligonucleotide
  Target: ATXN1; (+) strand; PAM type: YTN; PAM sequence: CTC
caaatttatatattgacatc

SEQ ID NO: 252059 - DNA, 20 bp, Artificial Sequence
  Description of Artificial Sequence: Synthetic oligonucleotide
  Target: ATXN1; (+) strand; PAM type: YTN; PAM sequence: TTT
atatattgacatcctgaccc

SEQ ID NO: 252060 - DNA, 20 bp, Artificial Sequence
  Description of Artificial Sequence: Synthetic oligonucleotide
  Target: ATXN1; (+) strand; PAM type: YTN; PAM sequence: TTA
tatattgacatcctgacccc

SEQ ID NO: 252061 - DNA, 20 bp, Artificial Sequence
  Description of Artificial Sequence: Synthetic oligonucleotide
  Target: ATXN1; (+) strand; PAM type: YTN; PAM sequence: TTG
acatcctgacccctaatacc

SEQ ID NO: 252062 - DNA, 20 bp, Artificial Sequence
  Description of Artificial Sequence: Synthetic oligonucleotide
  Target: ATXN1; (+) strand; PAM type: YTN; PAM sequence: CTG
acccctaatacctctgaatg

SEQ ID NO: 252063 - DNA, 20 bp, Artificial Sequence
  Description of Artificial Sequence: Synthetic oligonucleotide
  Target: ATXN1; (+) strand; PAM type: YTN; PAM sequence: CTA
atacctctgaatgtgaactt

SEQ ID NO: 252064 - DNA, 20 bp, Artificial Sequence
  Description of Artificial Sequence: Synthetic oligonucleotide
  Target: ATXN1; (+) strand; PAM type: YTN; PAM sequence: CTC
tgaatgtgaacttacttgga

SEQ ID NO: 252065 - DNA, 20 bp, Artificial Sequence
  Description of Artificial Sequence: Synthetic oligonucleotide
  Target: ATXN1; (+) strand; PAM type: YTN; PAM sequence: CTG
aatgtgaacttacttggaaa

SEQ ID NO: 252066 - DNA, 20 bp, Artificial Sequence
  Description of Artificial Sequence: Synthetic oligonucleotide
  Target: ATXN1; (+) strand; PAM type: YTN; PAM sequence: CTT
acttggaaatagggttgttg

SEQ ID NO: 252067 - DNA, 20 bp, Artificial Sequence
  Description of Artificial Sequence: Synthetic oligonucleotide
  Target: ATXN1; (+) strand; PAM type: YTN; PAM sequence: TTA
cttggaaatagggttgttgc

SEQ ID NO: 252068 - DNA, 20 bp, Artificial Sequence
  Description of Artificial Sequence: Synthetic oligonucleotide
  Target: ATXN1; (+) strand; PAM type: YTN; PAM sequence: CTT
ggaaatagggttgttgcaga

SEQ ID NO: 252069 - DNA, 20 bp, Artificial Sequence
  Description of Artificial Sequence: Synthetic oligonucleotide
  Target: ATXN1; (+) strand; PAM type: YTN; PAM sequence: TTG
gaaatagggttgttgcagat

SEQ ID NO: 252070 - DNA, 20 bp, Artificial Sequence
  Description of Artificial Sequence: Synthetic oligonucleotide
  Target: ATXN1; (+) strand; PAM type: YTN; PAM sequence: TTG
ttgcagatataattagttaa

SEQ ID NO: 252071 - DNA, 20 bp, Artificial Sequence
  Description of Artificial Sequence: Synthetic oligonucleotide
  Target: ATXN1; (+) strand; PAM type: YTN; PAM sequence: TTG
cagatataattagttaagat

SEQ ID NO: 252072 - DNA, 20 bp, Artificial Sequence
  Description of Artificial Sequence: Synthetic oligonucleotide
  Target: ATXN1; (+) strand; PAM type: YTN; PAM sequence: TTA
gttaagatgaggtcatcctg

SEQ ID NO: 252073 - DNA, 20 bp, Artificial Sequence
  Description of Artificial Sequence: Synthetic oligonucleotide
  Target: ATXN1; (+) strand; PAM type: YTN; PAM sequence: TTA
agatgaggtcatcctggagg

SEQ ID NO: 252074 - DNA, 20 bp, Artificial Sequence
  Description of Artificial Sequence: Synthetic oligonucleotide
  Target: ATXN1; (+) strand; PAM type: YTN; PAM sequence: CTG
gaggagaggggttcctaatc

SEQ ID NO: 252075 - DNA, 20 bp, Artificial Sequence
  Description of Artificial Sequence: Synthetic oligonucleotide
  Target: ATXN1; (+) strand; PAM type: YTN; PAM sequence: TTC
ctaatctgacagaactggtg

SEQ ID NO: 252076 - DNA, 20 bp, Artificial Sequence
  Description of Artificial Sequence: Synthetic oligonucleotide
  Target: ATXN1; (+) strand; PAM type: YTN; PAM sequence: CTA
atctgacagaactggtgtcc

SEQ ID NO: 252077 - DNA, 20 bp, Artificial Sequence
  Description of Artificial Sequence: Synthetic oligonucleotide
  Target: ATXN1; (+) strand; PAM type: YTN; PAM sequence: CTG
acagaactggtgtccttgtg

SEQ ID NO: 252078 - DNA, 20 bp, Artificial Sequence
  Description of Artificial Sequence: Synthetic oligonucleotide
  Target: ATXN1; (+) strand; PAM type: YTN; PAM sequence: CTG
gtgtccttgtgaaaagggga

SEQ ID NO: 252079 - DNA, 20 bp, Artificial Sequence
  Description of Artificial Sequence: Synthetic oligonucleotide
  Target: ATXN1; (+) strand; PAM type: YTN; PAM sequence: CTT
gtgaaaaggggaaatgtggg

SEQ ID NO: 252080 - DNA, 20 bp, Artificial Sequence
  Description of Artificial Sequence: Synthetic oligonucleotide
  Target: ATXN1; (+) strand; PAM type: YTN; PAM sequence: TTG
tgaaaaggggaaatgtgggc

SEQ ID NO: 252081 - DNA, 20 bp, Artificial Sequence
  Description of Artificial Sequence: Synthetic oligonucleotide
  Target: ATXN1; (+) strand; PAM type: YTN; PAM sequence: CTG
ggcgcggtggctcacgcctg

SEQ ID NO: 252082 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 252083 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 252084 - DNA, 20 bp, Artificial Sequence
  Description of Artificial Sequence: Synthetic oligonucleotide
  Target: ATXN1; (+) strand; PAM type: YTN; PAM sequence: CTT
tgggaggtcgaggcaggcgg

SEQ ID NO: 252085 - DNA, 20 bp, Artificial Sequence
  Description of Artificial Sequence: Synthetic oligonucleotide
  Target: ATXN1; (+) strand; PAM type: YTN; PAM sequence: TTT
gggaggtcgaggcaggcgga

SEQ ID NO: 252086 - DNA, 20 bp, Artificial Sequence
  Description of Artificial Sequence: Synthetic oligonucleotide
  Target: ATXN1; (+) strand; PAM type: YTN; PAM sequence: TTG
ggaggtcgaggcaggcggat

SEQ ID NO: 252087 - DNA, 20 bp, Artificial Sequence
  Description of Artificial Sequence: Synthetic oligonucleotide
  Target: ATXN1; (+) strand; PAM type: YTN; PAM sequence: TTC
gagaccagtctagccaacat

SEQ ID NO: 252088 - DNA, 20 bp, Artificial Sequence
  Description of Artificial Sequence: Synthetic oligonucleotide
  Target: ATXN1; (+) strand; PAM type: YTN; PAM sequence: CTA
gccaacatggtgaaaccctg

SEQ ID NO: 252089 - DNA, 20 bp, Artificial Sequence
  Description of Artificial Sequence: Synthetic oligonucleotide
  Target: ATXN1; (+) strand; PAM type: YTN; PAM sequence: CTG
tctctactattacaaaaatt

SEQ ID NO: 252090 - DNA, 20 bp, Artificial Sequence
  Description of Artificial Sequence: Synthetic oligonucleotide
  Target: ATXN1; (+) strand; PAM type: YTN; PAM sequence: CTC
tactattacaaaaattagcc

SEQ ID NO: 252091 - DNA, 20 bp, Artificial Sequence
  Description of Artificial Sequence: Synthetic oligonucleotide
  Target: ATXN1; (+) strand; PAM type: YTN; PAM sequence: CTA
ctattacaaaaattagcctg

SEQ ID NO: 252092 - DNA, 20 bp, Artificial Sequence
  Description of Artificial Sequence: Synthetic oligonucleotide
  Target: ATXN1; (+) strand; PAM type: YTN; PAM sequence: CTA
ttacaaaaattagcctggcg

SEQ ID NO: 252093 - DNA, 20 bp, Artificial Sequence
  Description of Artificial Sequence: Synthetic oligonucleotide
  Target: ATXN1; (+) strand; PAM type: YTN; PAM sequence: TTA
caaaaattagcctggcgtgg

SEQ ID NO: 252094 - DNA, 20 bp, Artificial Sequence
  Description of Artificial Sequence: Synthetic oligonucleotide
  Target: ATXN1; (+) strand; PAM type: YTN; PAM sequence: TTA
gcctggcgtggtggcgggcg

SEQ ID NO: 252095 - DNA, 20 bp, Artificial Sequence
  Description of Artificial Sequence: Synthetic oligonucleotide
  Target: ATXN1; (+) strand; PAM type: YTN; PAM sequence: CTG
gcgtggtggcgggcgcctat

SEQ ID NO: 252096 - DNA, 20 bp, Artificial Sequence
  Description of Artificial Sequence: Synthetic oligonucleotide
  Target: ATXN1; (+) strand; PAM type: YTN; PAM sequence: CTA
taattccagctactcgggag

SEQ ID NO: 252097 - DNA, 20 bp, Artificial Sequence
  Description of Artificial Sequence: Synthetic oligonucleotide
  Target: ATXN1; (+) strand; PAM type: YTN; PAM sequence: TTC
cagctactcgggagaatgag

SEQ ID NO: 252098 - DNA, 20 bp, Artificial Sequence
  Description of Artificial Sequence: Synthetic oligonucleotide
  Target: ATXN1; (+) strand; PAM type: YTN; PAM sequence: CTA
ctcgggagaatgagggagga

SEQ ID NO: 252099 - DNA, 20 bp, Artificial Sequence
  Description of Artificial Sequence: Synthetic oligonucleotide
  Target: ATXN1; (+) strand; PAM type: YTN; PAM sequence: CTC
gggagaatgagggaggagaa

SEQ ID NO: 252100 - DNA, 20 bp, Artificial Sequence
  Description of Artificial Sequence: Synthetic oligonucleotide
  Target: ATXN1; (+) strand; PAM type: YTN; PAM sequence: CTC
ttgaacctgggaggcagagg

SEQ ID NO: 252101 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggcagaggtt

SEQ ID NO: 252102 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggcagaggttg

SEQ ID NO: 252103 - DNA, 20 bp, Artificial Sequence
  Description of Artificial Sequence: Synthetic oligonucleotide
  Target: ATXN1; (+) strand; PAM type: YTN; PAM sequence: CTG
ggaggcagaggttgcagtaa

SEQ ID NO: 252104 - DNA, 20 bp, Artificial Sequence
  Description of Artificial Sequence: Synthetic oligonucleotide
  Target: ATXN1; (+) strand; PAM type: YTN; PAM sequence: TTG
cagtaagtgagatcgcacca

SEQ ID NO: 252105 - DNA, 20 bp, Artificial Sequence
  Description of Artificial Sequence: Synthetic oligonucleotide
  Target: ATXN1; (+) strand; PAM type: YTN; PAM sequence: CTG
caccccagcctgggtgacag

SEQ ID NO: 252106 - DNA, 20 bp, Artificial Sequence
  Description of Artificial Sequence: Synthetic oligonucleotide
  Target: ATXN1; (+) strand; PAM type: YTN; PAM sequence: CTG
ggtgacagagcaagactcca

SEQ ID NO: 252107 - DNA, 20 bp, Artificial Sequence
  Description of Artificial Sequence: Synthetic oligonucleotide
  Target: ATXN1; (+) strand; PAM type: YTN; PAM sequence: CTC
catcatgaaaaaaaaagggg

SEQ ID NO: 252108 - DNA, 20 bp, Artificial Sequence
  Description of Artificial Sequence: Synthetic oligonucleotide
  Target: ATXN1; (+) strand; PAM type: YTN; PAM sequence: CTC
aggcacacaggcagagtgct

SEQ ID NO: 252109 - DNA, 20 bp, Artificial Sequence
  Description of Artificial Sequence: Synthetic oligonucleotide
  Target: ATXN1; (+) strand; PAM type: YTN; PAM sequence: CTC
tgtgaggactggagtgacag

SEQ ID NO: 252110 - DNA, 20 bp, Artificial Sequence
  Description of Artificial Sequence: Synthetic oligonucleotide
  Target: ATXN1; (+) strand; PAM type: YTN; PAM sequence: CTG
tgaggactggagtgacagag

SEQ ID NO: 252111 - DNA, 20 bp, Artificial Sequence
  Description of Artificial Sequence: Synthetic oligonucleotide
  Target: ATXN1; (+) strand; PAM type: YTN; PAM sequence: CTG
gagtgacagagccacatgct

SEQ ID NO: 252112 - DNA, 20 bp, Artificial Sequence
  Description of Artificial Sequence: Synthetic oligonucleotide
  Target: ATXN1; (+) strand; PAM type: YTN; PAM sequence: CTA
aggagccaccagaagctagg

SEQ ID NO: 252113 - DNA, 20 bp, Artificial Sequence
  Description of Artificial Sequence: Synthetic oligonucleotide
  Target: ATXN1; (+) strand; PAM type: YTN; PAM sequence: CTA
gggagtgacctggaacagat

SEQ ID NO: 252114 - DNA, 20 bp, Artificial Sequence
  Description of Artificial Sequence: Synthetic oligonucleotide
  Target: ATXN1; (+) strand; PAM type: YTN; PAM sequence: CTG
gaacagatccttcccgagca

SEQ ID NO: 252115 - DNA, 20 bp, Artificial Sequence
  Description of Artificial Sequence: Synthetic oligonucleotide
  Target: ATXN1; (+) strand; PAM type: YTN; PAM sequence: CTT
cccgagcatcttcacaggga

SEQ ID NO: 252116 - DNA, 20 bp, Artificial Sequence
  Description of Artificial Sequence: Synthetic oligonucleotide
  Target: ATXN1; (+) strand; PAM type: YTN; PAM sequence: TTC
ccgagcatcttcacagggag

SEQ ID NO: 252117 - DNA, 20 bp, Artificial Sequence
  Description of Artificial Sequence: Synthetic oligonucleotide
  Target: ATXN1; (+) strand; PAM type: YTN; PAM sequence: CTT
cacagggagcatggccctgc

SEQ ID NO: 252118 - DNA, 20 bp, Artificial Sequence
  Description of Artificial Sequence: Synthetic oligonucleotide
  Target: ATXN1; (+) strand; PAM type: YTN; PAM sequence: TTC
acagggagcatggccctgcc

SEQ ID NO: 252119 - DNA, 20 bp, Artificial Sequence
  Description of Artificial Sequence: Synthetic oligonucleotide
  Target: ATXN1; (+) strand; PAM type: YTN; PAM sequence: CTG
cccacaccttgatctctgac

SEQ ID NO: 252120 - DNA, 20 bp, Artificial Sequence
  Description of Artificial Sequence: Synthetic oligonucleotide
  Target: ATXN1; (+) strand; PAM type: YTN; PAM sequence: CTT
gatctctgacttccaggccc

SEQ ID NO: 252121 - DNA, 20 bp, Artificial Sequence
  Description of Artificial Sequence: Synthetic oligonucleotide
  Target: ATXN1; (+) strand; PAM type: YTN; PAM sequence: TTG
atctctgacttccaggcccc

SEQ ID NO: 252122 - DNA, 20 bp, Artificial Sequence
  Description of Artificial Sequence: Synthetic oligonucleotide
  Target: ATXN1; (+) strand; PAM type: YTN; PAM sequence: CTC
tgacttccaggccccccagc

SEQ ID NO: 252123 - DNA, 20 bp, Artificial Sequence
  Description of Artificial Sequence: Synthetic oligonucleotide
  Target: ATXN1; (+) strand; PAM type: YTN; PAM sequence: CTG
acttccaggccccccagctg

SEQ ID NO: 252124 - DNA, 20 bp, Artificial Sequence
  Description of Artificial Sequence: Synthetic oligonucleotide
  Target: ATXN1; (+) strand; PAM type: YTN; PAM sequence: CTT
ccaggccccccagctgtgag

SEQ ID NO: 252125 - DNA, 20 bp, Artificial Sequence
  Description of Artificial Sequence: Synthetic oligonucleotide
  Target: ATXN1; (+) strand; PAM type: YTN; PAM sequence: TTC
caggccccccagctgtgaga

SEQ ID NO: 252126 - DNA, 20 bp, Artificial Sequence
  Description of Artificial Sequence: Synthetic oligonucleotide
  Target: ATXN1; (+) strand; PAM type: YTN; PAM sequence: CTG
tgagacactcaatgtctgtt

SEQ ID NO: 252127 - DNA, 20 bp, Artificial Sequence
  Description of Artificial Sequence: Synthetic oligonucleotide
  Target: ATXN1; (+) strand; PAM type: YTN; PAM sequence: CTC
aatgtctgttaagtcaccca

SEQ ID NO: 252128 - DNA, 20 bp, Artificial Sequence
  Description of Artificial Sequence: Synthetic oligonucleotide
  Target: ATXN1; (+) strand; PAM type: YTN; PAM sequence: CTG
ttaagtcacccagtttctgg

SEQ ID NO: 252129 - DNA, 20 bp, Artificial Sequence
  Description of Artificial Sequence: Synthetic oligonucleotide
  Target: ATXN1; (+) strand; PAM type: YTN; PAM sequence: TTA
agtcacccagtttctggcac

SEQ ID NO: 252130 - DNA, 20 bp, Artificial Sequence
  Description of Artificial Sequence: Synthetic oligonucleotide
  Target: ATXN1; (+) strand; PAM type: YTN; PAM sequence: TTT
ctggcactttgtaatggcag

SEQ ID NO: 252131 - DNA, 20 bp, Artificial Sequence
  Description of Artificial Sequence: Synthetic oligonucleotide
  Target: ATXN1; (+) strand; PAM type: YTN; PAM sequence: TTC
tggcactttgtaatggcagc

SEQ ID NO: 252132 - DNA, 20 bp, Artificial Sequence
  Description of Artificial Sequence: Synthetic oligonucleotide
  Target: ATXN1; (+) strand; PAM type: YTN; PAM sequence: CTG
gcactttgtaatggcagccc

SEQ ID NO: 252133 - DNA, 20 bp, Artificial Sequence
  Description of Artificial Sequence: Synthetic oligonucleotide
  Target: ATXN1; (+) strand; PAM type: YTN; PAM sequence: CTT
tgtaatggcagccctggaaa

SEQ ID NO: 252134 - DNA, 20 bp, Artificial Sequence
  Description of Artificial Sequence: Synthetic oligonucleotide
  Target: ATXN1; (+) strand; PAM type: YTN; PAM sequence: TTT
gtaatggcagccctggaaaa

SEQ ID NO: 252135 - DNA, 20 bp, Artificial Sequence
  Description of Artificial Sequence: Synthetic oligonucleotide
  Target: ATXN1; (+) strand; PAM type: YTN; PAM sequence: TTG
taatggcagccctggaaaaa

SEQ ID NO: 252136 - DNA, 20 bp, Artificial Sequence
  Description of Artificial Sequence: Synthetic oligonucleotide
  Target: ATXN1; (+) strand; PAM type: YTN; PAM sequence: CTG
gaaaaatattacaggcatat

SEQ ID NO: 252137 - DNA, 20 bp, Artificial Sequence
  Description of Artificial Sequence: Synthetic oligonucleotide
  Target: ATXN1; (+) strand; PAM type: YTN; PAM sequence: TTA
caggcatataatgccgtttg

SEQ ID NO: 252138 - DNA, 20 bp, Artificial Sequence
  Description of Artificial Sequence: Synthetic oligonucleotide
  Target: ATXN1; (+) strand; PAM type: YTN; PAM sequence: TTT
gtgtgtgaaggaatgacttc

SEQ ID NO: 252139 - DNA, 20 bp, Artificial Sequence
  Description of Artificial Sequence: Synthetic oligonucleotide
  Target: ATXN1; (+) strand; PAM type: YTN; PAM sequence: TTG
tgtgtgaaggaatgacttca

SEQ ID NO: 252140 - DNA, 20 bp, Artificial Sequence
  Description of Artificial Sequence: Synthetic oligonucleotide
  Target: ATXN1; (+) strand; PAM type: YTN; PAM sequence: CTT
catcatccagtggctggaat

SEQ ID NO: 252141 - DNA, 20 bp, Artificial Sequence
  Description of Artificial Sequence: Synthetic oligonucleotide
  Target: ATXN1; (+) strand; PAM type: YTN; PAM sequence: TTC
atcatccagtggctggaatt

SEQ ID NO: 252142 - DNA, 20 bp, Artificial Sequence
  Description of Artificial Sequence: Synthetic oligonucleotide
  Target: ATXN1; (+) strand; PAM type: YTN; PAM sequence: CTG
gaatttaattatgatgtgat

SEQ ID NO: 252143 - DNA, 20 bp, Artificial Sequence
  Description of Artificial Sequence: Synthetic oligonucleotide
  Target: ATXN1; (+) strand; PAM type: YTN; PAM sequence: TTT
aattatgatgtgatgctatc

SEQ ID NO: 252144 - DNA, 20 bp, Artificial Sequence
  Description of Artificial Sequence: Synthetic oligonucleotide
  Target: ATXN1; (+) strand; PAM type: YTN; PAM sequence: TTA
attatgatgtgatgctatca

SEQ ID NO: 252145 - DNA, 20 bp, Artificial Sequence
  Description of Artificial Sequence: Synthetic oligonucleotide
  Target: ATXN1; (+) strand; PAM type: YTN; PAM sequence: TTA
tgatgtgatgctatcaacaa

SEQ ID NO: 252146 - DNA, 20 bp, Artificial Sequence
  Description of Artificial Sequence: Synthetic oligonucleotide
  Target: ATXN1; (+) strand; PAM type: YTN; PAM sequence: CTA
tcaacaacattcacttcctc

SEQ ID NO: 252147 - DNA, 20 bp, Artificial Sequence
  Description of Artificial Sequence: Synthetic oligonucleotide
  Target: ATXN1; (+) strand; PAM type: YTN; PAM sequence: TTC
acttcctcttcacatatatt

SEQ ID NO: 252148 - DNA, 20 bp, Artificial Sequence
  Description of Artificial Sequence: Synthetic oligonucleotide
  Target: ATXN1; (+) strand; PAM type: YTN; PAM sequence: CTT
cctcttcacatatattgtgc

SEQ ID NO: 252149 - DNA, 20 bp, Artificial Sequence
  Description of Artificial Sequence: Synthetic oligonucleotide
  Target: ATXN1; (+) strand; PAM type: YTN; PAM sequence: TTC
ctcttcacatatattgtgcc

SEQ ID NO: 252150 - DNA, 20 bp, Artificial Sequence
  Description of Artificial Sequence: Synthetic oligonucleotide
  Target: ATXN1; (+) strand; PAM type: YTN; PAM sequence: CTC
ttcacatatattgtgcccct

SEQ ID NO: 252151 - DNA, 20 bp, Artificial Sequence
  Description of Artificial Sequence: Synthetic oligonucleotide
  Target: ATXN1; (+) strand; PAM type: YTN; PAM sequence: CTT
cacatatattgtgcccctca

SEQ ID NO: 252152 - DNA, 20 bp, Artificial Sequence
  Description of Artificial Sequence: Synthetic oligonucleotide
  Target: ATXN1; (+) strand; PAM type: YTN; PAM sequence: TTC
acatatattgtgcccctcac

SEQ ID NO: 252153 - DNA, 20 bp, Artificial Sequence
  Description of Artificial Sequence: Synthetic oligonucleotide
  Target: ATXN1; (+) strand; PAM type: YTN; PAM sequence: TTG
tgcccctcacctgactgcaa

SEQ ID NO: 252154 - DNA, 20 bp, Artificial Sequence
  Description of Artificial Sequence: Synthetic oligonucleotide
  Target: ATXN1; (+) strand; PAM type: YTN; PAM sequence: CTC
acctgactgcaaaattccca

SEQ ID NO: 252155 - DNA, 20 bp, Artificial Sequence
  Description of Artificial Sequence: Synthetic oligonucleotide
  Target: ATXN1; (+) strand; PAM type: YTN; PAM sequence: CTG
actgcaaaattcccattgca

SEQ ID NO: 252156 - DNA, 20 bp, Artificial Sequence
  Description of Artificial Sequence: Synthetic oligonucleotide
  Target: ATXN1; (+) strand; PAM type: YTN; PAM sequence: CTG
caaaattcccattgcaagtt

SEQ ID NO: 252157 - DNA, 20 bp, Artificial Sequence
  Description of Artificial Sequence: Synthetic oligonucleotide
  Target: ATXN1; (+) strand; PAM type: YTN; PAM sequence: TTC
ccattgcaagttaagacagg

SEQ ID NO: 252158 - DNA, 20 bp, Artificial Sequence
  Description of Artificial Sequence: Synthetic oligonucleotide
  Target: ATXN1; (+) strand; PAM type: YTN; PAM sequence: TTG
caagttaagacaggtgcctt

SEQ ID NO: 252159 - DNA, 20 bp, Artificial Sequence
  Description of Artificial Sequence: Synthetic oligonucleotide
  Target: ATXN1; (+) strand; PAM type: YTN; PAM sequence: TTA
agacaggtgccttacacagt

SEQ ID NO: 252160 - DNA, 20 bp, Artificial Sequence
  Description of Artificial Sequence: Synthetic oligonucleotide
  Target: ATXN1; (+) strand; PAM type: YTN; PAM sequence: CTT
acacagtgacctgagctgcc

SEQ ID NO: 252161 - DNA, 20 bp, Artificial Sequence
  Description of Artificial Sequence: Synthetic oligonucleotide
  Target: ATXN1; (+) strand; PAM type: YTN; PAM sequence: TTA
cacagtgacctgagctgcct

SEQ ID NO: 252162 - DNA, 20 bp, Artificial Sequence
  Description of Artificial Sequence: Synthetic oligonucleotide
  Target: ATXN1; (+) strand; PAM type: YTN; PAM sequence: CTG
agctgcctctcttccagaag

SEQ ID NO: 252163 - DNA, 20 bp, Artificial Sequence
  Description of Artificial Sequence: Synthetic oligonucleotide
  Target: ATXN1; (+) strand; PAM type: YTN; PAM sequence: CTG
cctctcttccagaagggaca

SEQ ID NO: 252164 - DNA, 20 bp, Artificial Sequence
  Description of Artificial Sequence: Synthetic oligonucleotide
  Target: ATXN1; (+) strand; PAM type: YTN; PAM sequence: CTC
tcttccagaagggacaactc

SEQ ID NO: 252165 - DNA, 20 bp, Artificial Sequence
  Description of Artificial Sequence: Synthetic oligonucleotide
  Target: ATXN1; (+) strand; PAM type: YTN; PAM sequence: CTC
ttccagaagggacaactctg

SEQ ID NO: 252166 - DNA, 20 bp, Artificial Sequence
  Description of Artificial Sequence: Synthetic oligonucleotide
  Target: ATXN1; (+) strand; PAM type: YTN; PAM sequence: CTT
ccagaagggacaactctgcc

SEQ ID NO: 252167 - DNA, 20 bp, Artificial Sequence
  Description of Artificial Sequence: Synthetic oligonucleotide
  Target: ATXN1; (+) strand; PAM type: YTN; PAM sequence: TTC
cagaagggacaactctgcca

SEQ ID NO: 252168 - DNA, 20 bp, Artificial Sequence
  Description of Artificial Sequence: Synthetic oligonucleotide
  Target: ATXN1; (+) strand; PAM type: YTN; PAM sequence: CTC
tgccagtcaggttatccaca

SEQ ID NO: 252169 - DNA, 20 bp, Artificial Sequence
  Description of Artificial Sequence: Synthetic oligonucleotide
  Target: ATXN1; (+) strand; PAM type: YTN; PAM sequence: CTG
ccagtcaggttatccacagt

SEQ ID NO: 252170 - DNA, 20 bp, Artificial Sequence
  Description of Artificial Sequence: Synthetic oligonucleotide
  Target: ATXN1; (+) strand; PAM type: YTN; PAM sequence: TTA
tccacagtgaacattacagc

SEQ ID NO: 252171 - DNA, 20 bp, Artificial Sequence
  Description of Artificial Sequence: Synthetic oligonucleotide
  Target: ATXN1; (+) strand; PAM type: YTN; PAM sequence: TTA
cagcagactccactatttct

SEQ ID NO: 252172 - DNA, 20 bp, Artificial Sequence
  Description of Artificial Sequence: Synthetic oligonucleotide
  Target: ATXN1; (+) strand; PAM type: YTN; PAM sequence: CTC
cactatttctcaggtatcta

SEQ ID NO: 252173 - DNA, 20 bp, Artificial Sequence
  Description of Artificial Sequence: Synthetic oligonucleotide
  Target: ATXN1; (+) strand; PAM type: YTN; PAM sequence: CTA
tttctcaggtatctacgttt

SEQ ID NO: 252174 - DNA, 20 bp, Artificial Sequence
  Description of Artificial Sequence: Synthetic oligonucleotide
  Target: ATXN1; (+) strand; PAM type: YTN; PAM sequence: TTT
ctcaggtatctacgtttggt

SEQ ID NO: 252175 - DNA, 20 bp, Artificial Sequence
  Description of Artificial Sequence: Synthetic oligonucleotide
  Target: ATXN1; (+) strand; PAM type: YTN; PAM sequence: TTC
tcaggtatctacgtttggta

SEQ ID NO: 252176 - DNA, 20 bp, Artificial Sequence
  Description of Artificial Sequence: Synthetic oligonucleotide
  Target: ATXN1; (+) strand; PAM type: YTN; PAM sequence: CTC
aggtatctacgtttggtaga

SEQ ID NO: 252177 - DNA, 20 bp, Artificial Sequence
  Description of Artificial Sequence: Synthetic oligonucleotide
  Target: ATXN1; (+) strand; PAM type: YTN; PAM sequence: CTA
cgtttggtagatacttctcc

SEQ ID NO: 252178 - DNA, 20 bp, Artificial Sequence
  Description of Artificial Sequence: Synthetic oligonucleotide
  Target: ATXN1; (+) strand; PAM type: YTN; PAM sequence: TTT
ggtagatacttctcctgctc

SEQ ID NO: 252179 - DNA, 20 bp, Artificial Sequence
  Description of Artificial Sequence: Synthetic oligonucleotide
  Target: ATXN1; (+) strand; PAM type: YTN; PAM sequence: TTG
gtagatacttctcctgctcc

SEQ ID NO: 252180 - DNA, 20 bp, Artificial Sequence
  Description of Artificial Sequence: Synthetic oligonucleotide
  Target: ATXN1; (+) strand; PAM type: YTN; PAM sequence: CTT
ctcctgctccttgagaagtc

SEQ ID NO: 252181 - DNA, 20 bp, Artificial Sequence
  Description of Artificial Sequence: Synthetic oligonucleotide
  Target: ATXN1; (+) strand; PAM type: YTN; PAM sequence: TTC
tcctgctccttgagaagtcc

SEQ ID NO: 252182 - DNA, 20 bp, Artificial Sequence
  Description of Artificial Sequence: Synthetic oligonucleotide
  Target: ATXN1; (+) strand; PAM type: YTN; PAM sequence: CTC
ctgctccttgagaagtcccc

SEQ ID NO: 252183 - DNA, 20 bp, Artificial Sequence
  Description of Artificial Sequence: Synthetic oligonucleotide
  Target: ATXN1; (+) strand; PAM type: YTN; PAM sequence: CTG
ctccttgagaagtccccagt

SEQ ID NO: 252184 - DNA, 20 bp, Artificial Sequence
  Description of Artificial Sequence: Synthetic oligonucleotide
  Target: ATXN1; (+) strand; PAM type: YTN; PAM sequence: CTC
cttgagaagtccccagtggt

SEQ ID NO: 252185 - DNA, 20 bp, Artificial Sequence
  Description of Artificial Sequence: Synthetic oligonucleotide
  Target: ATXN1; (+) strand; PAM type: YTN; PAM sequence: CTT
gagaagtccccagtggtcag

SEQ ID NO: 252186 - DNA, 20 bp, Artificial Sequence
  Description of Artificial Sequence: Synthetic oligonucleotide
  Target: ATXN1; (+) strand; PAM type: YTN; PAM sequence: TTG
agaagtccccagtggtcagt

SEQ ID NO: 252187 - DNA, 20 bp, Artificial Sequence
  Description of Artificial Sequence: Synthetic oligonucleotide
  Target: ATXN1; (+) strand; PAM type: YTN; PAM sequence: TTA
ttattaaagtacccaatcta

SEQ ID NO: 252188 - DNA, 20 bp, Artificial Sequence
  Description of Artificial Sequence: Synthetic oligonucleotide
  Target: ATXN1; (+) strand; PAM type: YTN; PAM sequence: TTA
ttaaagtacccaatctaaga

SEQ ID NO: 252189 - DNA, 20 bp, Artificial Sequence
  Description of Artificial Sequence: Synthetic oligonucleotide
  Target: ATXN1; (+) strand; PAM type: YTN; PAM sequence: TTA
aagtacccaatctaagagcc

SEQ ID NO: 252190 - DNA, 20 bp, Artificial Sequence
  Description of Artificial Sequence: Synthetic oligonucleotide
  Target: ATXN1; (+) strand; PAM type: YTN; PAM sequence: CTA
agagccactgacgtttctat

SEQ ID NO: 252191 - DNA, 20 bp, Artificial Sequence
  Description of Artificial Sequence: Synthetic oligonucleotide
  Target: ATXN1; (+) strand; PAM type: YTN; PAM sequence: CTG
acgtttctatactgatgtat

SEQ ID NO: 252192 - DNA, 20 bp, Artificial Sequence
  Description of Artificial Sequence: Synthetic oligonucleotide
  Target: ATXN1; (+) strand; PAM type: YTN; PAM sequence: TTT
ctatactgatgtatgtctac

SEQ ID NO: 252193 - DNA, 20 bp, Artificial Sequence
  Description of Artificial Sequence: Synthetic oligonucleotide
  Target: ATXN1; (+) strand; PAM type: YTN; PAM sequence: TTC
tatactgatgtatgtctaca

SEQ ID NO: 252194 - DNA, 20 bp, Artificial Sequence
  Description of Artificial Sequence: Synthetic oligonucleotide
  Target: ATXN1; (+) strand; PAM type: YTN; PAM sequence: CTA
tactgatgtatgtctacatt

SEQ ID NO: 252195 - DNA, 20 bp, Artificial Sequence
  Description of Artificial Sequence: Synthetic oligonucleotide
  Target: ATXN1; (+) strand; PAM type: YTN; PAM sequence: CTG
atgtatgtctacatttatag

SEQ ID NO: 252196 - DNA, 20 bp, Artificial Sequence
  Description of Artificial Sequence: Synthetic oligonucleotide
  Target: ATXN1; (+) strand; PAM type: YTN; PAM sequence: CTA
catttatagatttagacatg

SEQ ID NO: 252197 - DNA, 20 bp, Artificial Sequence
  Description of Artificial Sequence: Synthetic oligonucleotide
  Target: ATXN1; (+) strand; PAM type: YTN; PAM sequence: TTT
atagatttagacatggagtt

SEQ ID NO: 252198 - DNA, 20 bp, Artificial Sequence
  Description of Artificial Sequence: Synthetic oligonucleotide
  Target: ATXN1; (+) strand; PAM type: YTN; PAM sequence: TTA
tagatttagacatggagtta

SEQ ID NO: 252199 - DNA, 20 bp, Artificial Sequence
  Description of Artificial Sequence: Synthetic oligonucleotide
  Target: ATXN1; (+) strand; PAM type: YTN; PAM sequence: TTT
agacatggagttatacagaa

SEQ ID NO: 252200 - DNA, 20 bp, Artificial Sequence
  Description of Artificial Sequence: Synthetic oligonucleotide
  Target: ATXN1; (+) strand; PAM type: YTN; PAM sequence: TTA
gacatggagttatacagaat

SEQ ID NO: 252201 - DNA, 20 bp, Artificial Sequence
  Description of Artificial Sequence: Synthetic oligonucleotide
  Target: ATXN1; (+) strand; PAM type: YTN; PAM sequence: TTA
tacagaatgaaagtttattc

SEQ ID NO: 252202 - DNA, 20 bp, Artificial Sequence
  Description of Artificial Sequence: Synthetic oligonucleotide
  Target: ATXN1; (+) strand; PAM type: YTN; PAM sequence: TTT
attcaaatagataaaaacat

SEQ ID NO: 252203 - DNA, 20 bp, Artificial Sequence
  Description of Artificial Sequence: Synthetic oligonucleotide
  Target: ATXN1; (+) strand; PAM type: YTN; PAM sequence: TTA
ttcaaatagataaaaacatc

SEQ ID NO: 252204 - DNA, 20 bp, Artificial Sequence
  Description of Artificial Sequence: Synthetic oligonucleotide
  Target: ATXN1; (+) strand; PAM type: YTN; PAM sequence: TTC
aaatagataaaaacatccca

SEQ ID NO: 252205 - DNA, 20 bp, Artificial Sequence
  Description of Artificial Sequence: Synthetic oligonucleotide
  Target: ATXN1; (+) strand; PAM type: YTN; PAM sequence: TTG
aagttccactaactagtaat

SEQ ID NO: 252206 - DNA, 20 bp, Artificial Sequence
  Description of Artificial Sequence: Synthetic oligonucleotide
  Target: ATXN1; (+) strand; PAM type: YTN; PAM sequence: TTC
cactaactagtaattggcta

SEQ ID NO: 252207 - DNA, 20 bp, Artificial Sequence
  Description of Artificial Sequence: Synthetic oligonucleotide
  Target: ATXN1; (+) strand; PAM type: YTN; PAM sequence: CTA
actagtaattggctattagt

SEQ ID NO: 252208 - DNA, 20 bp, Artificial Sequence
  Description of Artificial Sequence: Synthetic oligonucleotide
  Target: ATXN1; (+) strand; PAM type: YTN; PAM sequence: CTA
gtaattggctattagtaatt

SEQ ID NO: 252209 - DNA, 20 bp, Artificial Sequence
  Description of Artificial Sequence: Synthetic oligonucleotide
  Target: ATXN1; (+) strand; PAM type: YTN; PAM sequence: TTG
gctattagtaattctaccca

SEQ ID NO: 252210 - DNA, 20 bp, Artificial Sequence
  Description of Artificial Sequence: Synthetic oligonucleotide
  Target: ATXN1; (+) strand; PAM type: YTN; PAM sequence: CTA
ttagtaattctacccaaaac

SEQ ID NO: 252211 - DNA, 20 bp, Artificial Sequence
  Description of Artificial Sequence: Synthetic oligonucleotide
  Target: ATXN1; (+) strand; PAM type: YTN; PAM sequence: TTA
gtaattctacccaaaacaaa

SEQ ID NO: 252212 - DNA, 20 bp, Artificial Sequence
  Description of Artificial Sequence: Synthetic oligonucleotide
  Target: ATXN1; (+) strand; PAM type: YTN; PAM sequence: TTC
tacccaaaacaaattaataa

SEQ ID NO: 252213 - DNA, 20 bp, Artificial Sequence
  Description of Artificial Sequence: Synthetic oligonucleotide
  Target: ATXN1; (+) strand; PAM type: YTN; PAM sequence: CTA
cccaaaacaaattaataatt

SEQ ID NO: 252214 - DNA, 20 bp, Artificial Sequence
  Description of Artificial Sequence: Synthetic oligonucleotide
  Target: ATXN1; (+) strand; PAM type: YTN; PAM sequence: TTA
ataattcatttgggccaggc

SEQ ID NO: 252215 - DNA, 20 bp, Artificial Sequence
  Description of Artificial Sequence: Synthetic oligonucleotide
  Target: ATXN1; (+) strand; PAM type: YTN; PAM sequence: TTC
atttgggccaggcctggtgg

SEQ ID NO: 252216 - DNA, 20 bp, Artificial Sequence
  Description of Artificial Sequence: Synthetic oligonucleotide
  Target: ATXN1; (+) strand; PAM type: YTN; PAM sequence: TTT
gggccaggcctggtggctta

SEQ ID NO: 252217 - DNA, 20 bp, Artificial Sequence
  Description of Artificial Sequence: Synthetic oligonucleotide
  Target: ATXN1; (+) strand; PAM type: YTN; PAM sequence: TTG
ggccaggcctggtggcttat

SEQ ID NO: 252218 - DNA, 20 bp, Artificial Sequence
  Description of Artificial Sequence: Synthetic oligonucleotide
  Target: ATXN1; (+) strand; PAM type: YTN; PAM sequence: CTG
gtggcttatggctctaatct

SEQ ID NO: 252219 - DNA, 20 bp, Artificial Sequence
  Description of Artificial Sequence: Synthetic oligonucleotide
  Target: ATXN1; (+) strand; PAM type: YTN; PAM sequence: CTT
atggctctaatctcagcact

SEQ ID NO: 252220 - DNA, 20 bp, Artificial Sequence
  Description of Artificial Sequence: Synthetic oligonucleotide
  Target: ATXN1; (+) strand; PAM type: YTN; PAM sequence: TTA
tggctctaatctcagcactt

SEQ ID NO: 252221 - DNA, 20 bp, Artificial Sequence
  Description of Artificial Sequence: Synthetic oligonucleotide
  Target: ATXN1; (+) strand; PAM type: YTN; PAM sequence: CTC
taatctcagcactttgggag

SEQ ID NO: 252222 - DNA, 20 bp, Artificial Sequence
  Description of Artificial Sequence: Synthetic oligonucleotide
  Target: ATXN1; (+) strand; PAM type: YTN; PAM sequence: CTA
atctcagcactttgggaggc

SEQ ID NO: 252223 - DNA, 20 bp, Artificial Sequence
  Description of Artificial Sequence: Synthetic oligonucleotide
  Target: ATXN1; (+) strand; PAM type: YTN; PAM sequence: CTC
agcactttgggaggccaagg

SEQ ID NO: 252224 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggcaggagg

SEQ ID NO: 252225 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggcaggagga

SEQ ID NO: 252226 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggcaggaggat

SEQ ID NO: 252227 - DNA, 20 bp, Artificial Sequence
  Description of Artificial Sequence: Synthetic oligonucleotide
  Target: ATXN1; (+) strand; PAM type: YTN; PAM sequence: CTT
gaggccaggagtttaagacc

SEQ ID NO: 252228 - DNA, 20 bp, Artificial Sequence
  Description of Artificial Sequence: Synthetic oligonucleotide
  Target: ATXN1; (+) strand; PAM type: YTN; PAM sequence: TTG
aggccaggagtttaagacca

SEQ ID NO: 252229 - DNA, 20 bp, Artificial Sequence
  Description of Artificial Sequence: Synthetic oligonucleotide
  Target: ATXN1; (+) strand; PAM type: YTN; PAM sequence: TTT
aagaccagcctgggcaacat

SEQ ID NO: 252230 - DNA, 20 bp, Artificial Sequence
  Description of Artificial Sequence: Synthetic oligonucleotide
  Target: ATXN1; (+) strand; PAM type: YTN; PAM sequence: TTA
agaccagcctgggcaacata

SEQ ID NO: 252231 - DNA, 20 bp, Artificial Sequence
  Description of Artificial Sequence: Synthetic oligonucleotide
  Target: ATXN1; (+) strand; PAM type: YTN; PAM sequence: CTG
ggcaacatagcaagacccca

SEQ ID NO: 252232 - DNA, 20 bp, Artificial Sequence
  Description of Artificial Sequence: Synthetic oligonucleotide
  Target: ATXN1; (+) strand; PAM type: YTN; PAM sequence: CTA
tacaagaagcttaaaaaaat

SEQ ID NO: 252233 - DNA, 20 bp, Artificial Sequence
  Description of Artificial Sequence: Synthetic oligonucleotide
  Target: ATXN1; (+) strand; PAM type: YTN; PAM sequence: CTT
aaaaaaatagccaggcagga

SEQ ID NO: 252234 - DNA, 20 bp, Artificial Sequence
  Description of Artificial Sequence: Synthetic oligonucleotide
  Target: ATXN1; (+) strand; PAM type: YTN; PAM sequence: TTA
aaaaaatagccaggcaggag

SEQ ID NO: 252235 - DNA, 20 bp, Artificial Sequence
  Description of Artificial Sequence: Synthetic oligonucleotide
  Target: ATXN1; (+) strand; PAM type: YTN; PAM sequence: CTG
ggaggcggagcttgcagtga

SEQ ID NO: 252236 - DNA, 20 bp, Artificial Sequence
  Description of Artificial Sequence: Synthetic oligonucleotide
  Target: ATXN1; (+) strand; PAM type: YTN; PAM sequence: CTT
gcagtgagctgggatcacac

SEQ ID NO: 252237 - DNA, 20 bp, Artificial Sequence
  Description of Artificial Sequence: Synthetic oligonucleotide
  Target: ATXN1; (+) strand; PAM type: YTN; PAM sequence: TTG
cagtgagctgggatcacact

SEQ ID NO: 252238 - DNA, 20 bp, Artificial Sequence
  Description of Artificial Sequence: Synthetic oligonucleotide
  Target: ATXN1; (+) strand; PAM type: YTN; PAM sequence: CTG
ggatcacactactgcactcc

SEQ ID NO: 252239 - DNA, 20 bp, Artificial Sequence
  Description of Artificial Sequence: Synthetic oligonucleotide
  Target: ATXN1; (+) strand; PAM type: YTN; PAM sequence: CTA
ctgcactccagcctgggcaa

SEQ ID NO: 252240 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcaacag

SEQ ID NO: 252241 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacagagcga

SEQ ID NO: 252242 - DNA, 20 bp, Artificial Sequence
  Description of Artificial Sequence: Synthetic oligonucleotide
  Target: ATXN1; (+) strand; PAM type: YTN; PAM sequence: CTG
ggcaacagagcgagattcca

SEQ ID NO: 252243 - DNA, 20 bp, Artificial Sequence
  Description of Artificial Sequence: Synthetic oligonucleotide
  Target: ATXN1; (+) strand; PAM type: YTN; PAM sequence: TTC
catctcaaaaaaaaaaaaaa

SEQ ID NO: 252244 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaataccc

SEQ ID NO: 252245 - DNA, 20 bp, Artificial Sequence
  Description of Artificial Sequence: Synthetic oligonucleotide
  Target: ATXN1; (+) strand; PAM type: YTN; PAM sequence: CTT
atagtcccagcaacttggga

SEQ ID NO: 252246 - DNA, 20 bp, Artificial Sequence
  Description of Artificial Sequence: Synthetic oligonucleotide
  Target: ATXN1; (+) strand; PAM type: YTN; PAM sequence: TTA
tagtcccagcaacttgggag

SEQ ID NO: 252247 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggtggaagca

SEQ ID NO: 252248 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggtggaagcat

SEQ ID NO: 252249 - DNA, 20 bp, Artificial Sequence
  Description of Artificial Sequence: Synthetic oligonucleotide
  Target: ATXN1; (+) strand; PAM type: YTN; PAM sequence: CTG
aggtggaagcatcacttggg

SEQ ID NO: 252250 - DNA, 20 bp, Artificial Sequence
  Description of Artificial Sequence: Synthetic oligonucleotide
  Target: ATXN1; (+) strand; PAM type: YTN; PAM sequence: CTT
gggcccagaagtttgaggat

SEQ ID NO: 252251 - DNA, 20 bp, Artificial Sequence
  Description of Artificial Sequence: Synthetic oligonucleotide
  Target: ATXN1; (+) strand; PAM type: YTN; PAM sequence: TTG
ggcccagaagtttgaggatg

SEQ ID NO: 252252 - DNA, 20 bp, Artificial Sequence
  Description of Artificial Sequence: Synthetic oligonucleotide
  Target: ATXN1; (+) strand; PAM type: YTN; PAM sequence: TTT
gaggatgcagtgagctatga

SEQ ID NO: 252253 - DNA, 20 bp, Artificial Sequence
  Description of Artificial Sequence: Synthetic oligonucleotide
  Target: ATXN1; (+) strand; PAM type: YTN; PAM sequence: TTG
aggatgcagtgagctatgat

SEQ ID NO: 252254 - DNA, 20 bp, Artificial Sequence
  Description of Artificial Sequence: Synthetic oligonucleotide
  Target: ATXN1; (+) strand; PAM type: YTN; PAM sequence: CTA
tgatcgtgccagtgctctcc

SEQ ID NO: 252255 - DNA, 20 bp, Artificial Sequence
  Description of Artificial Sequence: Synthetic oligonucleotide
  Target: ATXN1; (+) strand; PAM type: YTN; PAM sequence: CTC
tccagcctgggtgacaagag

SEQ ID NO: 252256 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacaagagtg

SEQ ID NO: 252257 - DNA, 20 bp, Artificial Sequence
  Description of Artificial Sequence: Synthetic oligonucleotide
  Target: ATXN1; (+) strand; PAM type: YTN; PAM sequence: CTG
ggtgacaagagtgagactct

SEQ ID NO: 252258 - DNA, 20 bp, Artificial Sequence
  Description of Artificial Sequence: Synthetic oligonucleotide
  Target: ATXN1; (+) strand; PAM type: YTN; PAM sequence: CTC
tctccctaaagaaaagaaaa

SEQ ID NO: 252259 - DNA, 20 bp, Artificial Sequence
  Description of Artificial Sequence: Synthetic oligonucleotide
  Target: ATXN1; (+) strand; PAM type: YTN; PAM sequence: CTC
tccctaaagaaaagaaaaag

SEQ ID NO: 252260 - DNA, 20 bp, Artificial Sequence
  Description of Artificial Sequence: Synthetic oligonucleotide
  Target: ATXN1; (+) strand; PAM type: YTN; PAM sequence: CTC
cctaaagaaaagaaaaagaa

SEQ ID NO: 252261 - DNA, 20 bp, Artificial Sequence
  Description of Artificial Sequence: Synthetic oligonucleotide
  Target: ATXN1; (+) strand; PAM type: YTN; PAM sequence: CTA
aagaaaagaaaaagaattcc

SEQ ID NO: 252262 - DNA, 20 bp, Artificial Sequence
  Description of Artificial Sequence: Synthetic oligonucleotide
  Target: ATXN1; (+) strand; PAM type: YTN; PAM sequence: TTC
ccttggaaggttttgctttt

SEQ ID NO: 252263 - DNA, 20 bp, Artificial Sequence
  Description of Artificial Sequence: Synthetic oligonucleotide
  Target: ATXN1; (+) strand; PAM type: YTN; PAM sequence: CTT
ggaaggttttgcttttttag

SEQ ID NO: 252264 - DNA, 20 bp, Artificial Sequence
  Description of Artificial Sequence: Synthetic oligonucleotide
  Target: ATXN1; (+) strand; PAM type: YTN; PAM sequence: TTG
gaaggttttgcttttttaga

SEQ ID NO: 252265 - DNA, 20 bp, Artificial Sequence
  Description of Artificial Sequence: Synthetic oligonucleotide
  Target: ATXN1; (+) strand; PAM type: YTN; PAM sequence: TTT
tgcttttttagaaataagat

SEQ ID NO: 252266 - DNA, 20 bp, Artificial Sequence
  Description of Artificial Sequence: Synthetic oligonucleotide
  Target: ATXN1; (+) strand; PAM type: YTN; PAM sequence: TTT
gcttttttagaaataagatt

SEQ ID NO: 252267 - DNA, 20 bp, Artificial Sequence
  Description of Artificial Sequence: Synthetic oligonucleotide
  Target: ATXN1; (+) strand; PAM type: YTN; PAM sequence: TTG
cttttttagaaataagatta

SEQ ID NO: 252268 - DNA, 20 bp, Artificial Sequence
  Description of Artificial Sequence: Synthetic oligonucleotide
  Target: ATXN1; (+) strand; PAM type: YTN; PAM sequence: CTT
ttttagaaataagattagct

SEQ ID NO: 252269 - DNA, 20 bp, Artificial Sequence
  Description of Artificial Sequence: Synthetic oligonucleotide
  Target: ATXN1; (+) strand; PAM type: YTN; PAM sequence: TTT
tttagaaataagattagcta

SEQ ID NO: 252270 - DNA, 20 bp, Artificial Sequence
  Description of Artificial Sequence: Synthetic oligonucleotide
  Target: ATXN1; (+) strand; PAM type: YTN; PAM sequence: TTT
ttagaaataagattagctaa

SEQ ID NO: 252271 - DNA, 20 bp, Artificial Sequence
  Description of Artificial Sequence: Synthetic oligonucleotide
  Target: ATXN1; (+) strand; PAM type: YTN; PAM sequence: TTT
tagaaataagattagctaag

SEQ ID NO: 252272 - DNA, 20 bp, Artificial Sequence
  Description of Artificial Sequence: Synthetic oligonucleotide
  Target: ATXN1; (+) strand; PAM type: YTN; PAM sequence: TTT
agaaataagattagctaaga

SEQ ID NO: 252273 - DNA, 20 bp, Artificial Sequence
  Description of Artificial Sequence: Synthetic oligonucleotide
  Target: ATXN1; (+) strand; PAM type: YTN; PAM sequence: TTA
gaaataagattagctaagaa

SEQ ID NO: 252274 - DNA, 20 bp, Artificial Sequence
  Description of Artificial Sequence: Synthetic oligonucleotide
  Target: ATXN1; (+) strand; PAM type: YTN; PAM sequence: TTA
gctaagaaaattaataatgc

SEQ ID NO: 252275 - DNA, 20 bp, Artificial Sequence
  Description of Artificial Sequence: Synthetic oligonucleotide
  Target: ATXN1; (+) strand; PAM type: YTN; PAM sequence: CTA
agaaaattaataatgcaaag

SEQ ID NO: 252276 - DNA, 20 bp, Artificial Sequence
  Description of Artificial Sequence: Synthetic oligonucleotide
  Target: ATXN1; (+) strand; PAM type: YTN; PAM sequence: TTA
ataatgcaaagaagttaggg

SEQ ID NO: 252277 - DNA, 20 bp, Artificial Sequence
  Description of Artificial Sequence: Synthetic oligonucleotide
  Target: ATXN1; (+) strand; PAM type: YTN; PAM sequence: TTA
ggggtgggtggggtgagaga

SEQ ID NO: 252278 - DNA, 20 bp, Artificial Sequence
  Description of Artificial Sequence: Synthetic oligonucleotide
  Target: ATXN1; (+) strand; PAM type: YTN; PAM sequence: TTT
aaactatttttttaaatcca

SEQ ID NO: 252279 - DNA, 20 bp, Artificial Sequence
  Description of Artificial Sequence: Synthetic oligonucleotide
  Target: ATXN1; (+) strand; PAM type: YTN; PAM sequence: TTA
aactatttttttaaatccaa

SEQ ID NO: 252280 - DNA, 20 bp, Artificial Sequence
  Description of Artificial Sequence: Synthetic oligonucleotide
  Target: ATXN1; (+) strand; PAM type: YTN; PAM sequence: CTA
tttttttaaatccaaaattg

SEQ ID NO: 252281 - DNA, 20 bp, Artificial Sequence
  Description of Artificial Sequence: Synthetic oligonucleotide
  Target: ATXN1; (+) strand; PAM type: YTN; PAM sequence: TTT
ttttaaatccaaaattgttt

SEQ ID NO: 252282 - DNA, 20 bp, Artificial Sequence
  Description of Artificial Sequence: Synthetic oligonucleotide
  Target: ATXN1; (+) strand; PAM type: YTN; PAM sequence: TTT
tttaaatccaaaattgtttt

SEQ ID NO: 252283 - DNA, 20 bp, Artificial Sequence
  Description of Artificial Sequence: Synthetic oligonucleotide
  Target: ATXN1; (+) strand; PAM type: YTN; PAM sequence: TTT
ttaaatccaaaattgtttta

SEQ ID NO: 252284 - DNA, 20 bp, Artificial Sequence
  Description of Artificial Sequence: Synthetic oligonucleotide
  Target: ATXN1; (+) strand; PAM type: YTN; PAM sequence: TTT
taaatccaaaattgttttaa

SEQ ID NO: 252285 - DNA, 20 bp, Artificial Sequence
  Description of Artificial Sequence: Synthetic oligonucleotide
  Target: ATXN1; (+) strand; PAM type: YTN; PAM sequence: TTT
aaatccaaaattgttttaaa

SEQ ID NO: 252286 - DNA, 20 bp, Artificial Sequence
  Description of Artificial Sequence: Synthetic oligonucleotide
  Target: ATXN1; (+) strand; PAM type: YTN; PAM sequence: TTA
aatccaaaattgttttaaaa

SEQ ID NO: 252287 - DNA, 20 bp, Artificial Sequence
  Description of Artificial Sequence: Synthetic oligonucleotide
  Target: ATXN1; (+) strand; PAM type: YTN; PAM sequence: TTG
ttttaaaatagtttatccca

SEQ ID NO: 252288 - DNA, 20 bp, Artificial Sequence
  Description of Artificial Sequence: Synthetic oligonucleotide
  Target: ATXN1; (+) strand; PAM type: YTN; PAM sequence: TTT
taaaatagtttatcccattt

SEQ ID NO: 252289 - DNA, 20 bp, Artificial Sequence
  Description of Artificial Sequence: Synthetic oligonucleotide
  Target: ATXN1; (+) strand; PAM type: YTN; PAM sequence: TTT
aaaatagtttatcccatttc

SEQ ID NO: 252290 - DNA, 20 bp, Artificial Sequence
  Description of Artificial Sequence: Synthetic oligonucleotide
  Target: ATXN1; (+) strand; PAM type: YTN; PAM sequence: TTA
aaatagtttatcccatttcc

SEQ ID NO: 252291 - DNA, 20 bp, Artificial Sequence
  Description of Artificial Sequence: Synthetic oligonucleotide
  Target: ATXN1; (+) strand; PAM type: YTN; PAM sequence: TTT
atcccatttccattcctcca

SEQ ID NO: 252292 - DNA, 20 bp, Artificial Sequence
  Description of Artificial Sequence: Synthetic oligonucleotide
  Target: ATXN1; (+) strand; PAM type: YTN; PAM sequence: TTA
tcccatttccattcctccat

SEQ ID NO: 252293 - DNA, 20 bp, Artificial Sequence
  Description of Artificial Sequence: Synthetic oligonucleotide
  Target: ATXN1; (+) strand; PAM type: YTN; PAM sequence: TTT
ccattcctccataacaatga

SEQ ID NO: 252294 - DNA, 20 bp, Artificial Sequence
  Description of Artificial Sequence: Synthetic oligonucleotide
  Target: ATXN1; (+) strand; PAM type: YTN; PAM sequence: TTC
cattcctccataacaatgaa

SEQ ID NO: 252295 - DNA, 20 bp, Artificial Sequence
  Description of Artificial Sequence: Synthetic oligonucleotide
  Target: ATXN1; (+) strand; PAM type: YTN; PAM sequence: TTC
ctccataacaatgaagatgc

SEQ ID NO: 252296 - DNA, 20 bp, Artificial Sequence
  Description of Artificial Sequence: Synthetic oligonucleotide
  Target: ATXN1; (+) strand; PAM type: YTN; PAM sequence: CTC
cataacaatgaagatgctga

SEQ ID NO: 252297 - DNA, 20 bp, Artificial Sequence
  Description of Artificial Sequence: Synthetic oligonucleotide
  Target: ATXN1; (+) strand; PAM type: YTN; PAM sequence: CTG
actttcaacgtctgttactg

SEQ ID NO: 252298 - DNA, 20 bp, Artificial Sequence
  Description of Artificial Sequence: Synthetic oligonucleotide
  Target: ATXN1; (+) strand; PAM type: YTN; PAM sequence: CTT
tcaacgtctgttactgtagc

SEQ ID NO: 252299 - DNA, 20 bp, Artificial Sequence
  Description of Artificial Sequence: Synthetic oligonucleotide
  Target: ATXN1; (+) strand; PAM type: YTN; PAM sequence: TTT
caacgtctgttactgtagcc

SEQ ID NO: 252300 - DNA, 20 bp, Artificial Sequence
  Description of Artificial Sequence: Synthetic oligonucleotide
  Target: ATXN1; (+) strand; PAM type: YTN; PAM sequence: TTC
aacgtctgttactgtagcct

SEQ ID NO: 252301 - DNA, 20 bp, Artificial Sequence
  Description of Artificial Sequence: Synthetic oligonucleotide
  Target: ATXN1; (+) strand; PAM type: YTN; PAM sequence: CTG
ttactgtagcctaggtagag

SEQ ID NO: 252302 - DNA, 20 bp, Artificial Sequence
  Description of Artificial Sequence: Synthetic oligonucleotide
  Target: ATXN1; (+) strand; PAM type: YTN; PAM sequence: TTA
ctgtagcctaggtagagtga

SEQ ID NO: 252303 - DNA, 20 bp, Artificial Sequence
  Description of Artificial Sequence: Synthetic oligonucleotide
  Target: ATXN1; (+) strand; PAM type: YTN; PAM sequence: CTG
tagcctaggtagagtgaagg

SEQ ID NO: 252304 - DNA, 20 bp, Artificial Sequence
  Description of Artificial Sequence: Synthetic oligonucleotide
  Target: ATXN1; (+) strand; PAM type: YTN; PAM sequence: CTA
ggtagagtgaagggtggtca

SEQ ID NO: 252305 - DNA, 20 bp, Artificial Sequence
  Description of Artificial Sequence: Synthetic oligonucleotide
  Target: ATXN1; (+) strand; PAM type: YTN; PAM sequence: CTC
acatctagagcaggggtgtc

SEQ ID NO: 252306 - DNA, 20 bp, Artificial Sequence
  Description of Artificial Sequence: Synthetic oligonucleotide
  Target: ATXN1; (+) strand; PAM type: YTN; PAM sequence: CTA
gagcaggggtgtccaatctt

SEQ ID NO: 252307 - DNA, 20 bp, Artificial Sequence
  Description of Artificial Sequence: Synthetic oligonucleotide
  Target: ATXN1; (+) strand; PAM type: YTN; PAM sequence: CTT
ttggcttccctgggccacac

SEQ ID NO: 252308 - DNA, 20 bp, Artificial Sequence
  Description of Artificial Sequence: Synthetic oligonucleotide
  Target: ATXN1; (+) strand; PAM type: YTN; PAM sequence: TTT
tggcttccctgggccacact

SEQ ID NO: 252309 - DNA, 20 bp, Artificial Sequence
  Description of Artificial Sequence: Synthetic oligonucleotide
  Target: ATXN1; (+) strand; PAM type: YTN; PAM sequence: TTT
ggcttccctgggccacactg

SEQ ID NO: 252310 - DNA, 20 bp, Artificial Sequence
  Description of Artificial Sequence: Synthetic oligonucleotide
  Target: ATXN1; (+) strand; PAM type: YTN; PAM sequence: TTG
gcttccctgggccacactgg

SEQ ID NO: 252311 - DNA, 20 bp, Artificial Sequence
  Description of Artificial Sequence: Synthetic oligonucleotide
  Target: ATXN1; (+) strand; PAM type: YTN; PAM sequence: CTT
ccctgggccacactggaagg

SEQ ID NO: 252312 - DNA, 20 bp, Artificial Sequence
  Description of Artificial Sequence: Synthetic oligonucleotide
  Target: ATXN1; (+) strand; PAM type: YTN; PAM sequence: TTC
cctgggccacactggaagga

SEQ ID NO: 252313 - DNA, 20 bp, Artificial Sequence
  Description of Artificial Sequence: Synthetic oligonucleotide
  Target: ATXN1; (+) strand; PAM type: YTN; PAM sequence: CTG
ggccacactggaaggagaaa

SEQ ID NO: 252314 - DNA, 20 bp, Artificial Sequence
  Description of Artificial Sequence: Synthetic oligonucleotide
  Target: ATXN1; (+) strand; PAM type: YTN; PAM sequence: CTG
gaaggagaaaaattgtcttg

SEQ ID NO: 252315 - DNA, 20 bp, Artificial Sequence
  Description of Artificial Sequence: Synthetic oligonucleotide
  Target: ATXN1; (+) strand; PAM type: YTN; PAM sequence: TTG
tcttgggctgcacataaaag

SEQ ID NO: 252316 - DNA, 20 bp, Artificial Sequence
  Description of Artificial Sequence: Synthetic oligonucleotide
  Target: ATXN1; (+) strand; PAM type: YTN; PAM sequence: CTT
gggctgcacataaaagacac

SEQ ID NO: 252317 - DNA, 20 bp, Artificial Sequence
  Description of Artificial Sequence: Synthetic oligonucleotide
  Target: ATXN1; (+) strand; PAM type: YTN; PAM sequence: TTG
ggctgcacataaaagacact

SEQ ID NO: 252318 - DNA, 20 bp, Artificial Sequence
  Description of Artificial Sequence: Synthetic oligonucleotide
  Target: ATXN1; (+) strand; PAM type: YTN; PAM sequence: CTG
cacataaaagacactatcac

SEQ ID NO: 252319 - DNA, 20 bp, Artificial Sequence
  Description of Artificial Sequence: Synthetic oligonucleotide
  Target: ATXN1; (+) strand; PAM type: YTN; PAM sequence: CTA
tcactaatgacagctgatga

SEQ ID NO: 252320 - DNA, 20 bp, Artificial Sequence
  Description of Artificial Sequence: Synthetic oligonucleotide
  Target: ATXN1; (+) strand; PAM type: YTN; PAM sequence: CTA
atgacagctgatgagctaaa

SEQ ID NO: 252321 - DNA, 20 bp, Artificial Sequence
  Description of Artificial Sequence: Synthetic oligonucleotide
  Target: ATXN1; (+) strand; PAM type: YTN; PAM sequence: CTG
atgagctaaaaaaaaaataa

SEQ ID NO: 252322 - DNA, 20 bp, Artificial Sequence
  Description of Artificial Sequence: Synthetic oligonucleotide
  Target: ATXN1; (+) strand; PAM type: YTN; PAM sequence: CTA
aaaaaaaaataaataaactt

SEQ ID NO: 252323 - DNA, 20 bp, Artificial Sequence
  Description of Artificial Sequence: Synthetic oligonucleotide
  Target: ATXN1; (+) strand; PAM type: YTN; PAM sequence: CTT
gcaagtcttggccaagtgtt

SEQ ID NO: 252324 - DNA, 20 bp, Artificial Sequence
  Description of Artificial Sequence: Synthetic oligonucleotide
  Target: ATXN1; (+) strand; PAM type: YTN; PAM sequence: TTG
caagtcttggccaagtgttc

SEQ ID NO: 252325 - DNA, 20 bp, Artificial Sequence
  Description of Artificial Sequence: Synthetic oligonucleotide
  Target: ATXN1; (+) strand; PAM type: YTN; PAM sequence: CTT
ggccaagtgttcctgggaag

SEQ ID NO: 252326 - DNA, 20 bp, Artificial Sequence
  Description of Artificial Sequence: Synthetic oligonucleotide
  Target: ATXN1; (+) strand; PAM type: YTN; PAM sequence: TTG
gccaagtgttcctgggaagg

SEQ ID NO: 252327 - DNA, 20 bp, Artificial Sequence
  Description of Artificial Sequence: Synthetic oligonucleotide
  Target: ATXN1; (+) strand; PAM type: YTN; PAM sequence: TTC
ctgggaaggcctggatggca

SEQ ID NO: 252328 - DNA, 20 bp, Artificial Sequence
  Description of Artificial Sequence: Synthetic oligonucleotide
  Target: ATXN1; (+) strand; PAM type: YTN; PAM sequence: CTG
ggaaggcctggatggcagag

SEQ ID NO: 252329 - DNA, 20 bp, Artificial Sequence
  Description of Artificial Sequence: Synthetic oligonucleotide
  Target: ATXN1; (+) strand; PAM type: YTN; PAM sequence: CTG
gatggcagaggtgaatggga

SEQ ID NO: 252330 - DNA, 20 bp, Artificial Sequence
  Description of Artificial Sequence: Synthetic oligonucleotide
  Target: ATXN1; (+) strand; PAM type: YTN; PAM sequence: CTC
agaaagactccctgaaagcc

SEQ ID NO: 252331 - DNA, 20 bp, Artificial Sequence
  Description of Artificial Sequence: Synthetic oligonucleotide
  Target: ATXN1; (+) strand; PAM type: YTN; PAM sequence: CTC
cctgaaagccttgttactcc

SEQ ID NO: 252332 - DNA, 20 bp, Artificial Sequence
  Description of Artificial Sequence: Synthetic oligonucleotide
  Target: ATXN1; (+) strand; PAM type: YTN; PAM sequence: CTG
aaagccttgttactcctctc

SEQ ID NO: 252333 - DNA, 20 bp, Artificial Sequence
  Description of Artificial Sequence: Synthetic oligonucleotide
  Target: ATXN1; (+) strand; PAM type: YTN; PAM sequence: CTT
gttactcctctctgtcccaa

SEQ ID NO: 252334 - DNA, 20 bp, Artificial Sequence
  Description of Artificial Sequence: Synthetic oligonucleotide
  Target: ATXN1; (+) strand; PAM type: YTN; PAM sequence: TTG
ttactcctctctgtcccaag

SEQ ID NO: 252335 - DNA, 20 bp, Artificial Sequence
  Description of Artificial Sequence: Synthetic oligonucleotide
  Target: ATXN1; (+) strand; PAM type: YTN; PAM sequence: TTA
ctcctctctgtcccaagttc

SEQ ID NO: 252336 - DNA, 20 bp, Artificial Sequence
  Description of Artificial Sequence: Synthetic oligonucleotide
  Target: ATXN1; (+) strand; PAM type: YTN; PAM sequence: CTC
ctctctgtcccaagttccct

SEQ ID NO: 252337 - DNA, 20 bp, Artificial Sequence
  Description of Artificial Sequence: Synthetic oligonucleotide
  Target: ATXN1; (+) strand; PAM type: YTN; PAM sequence: CTC
tctgtcccaagttccctttt

SEQ ID NO: 252338 - DNA, 20 bp, Artificial Sequence
  Description of Artificial Sequence: Synthetic oligonucleotide
  Target: ATXN1; (+) strand; PAM type: YTN; PAM sequence: CTC
tgtcccaagttcccttttcc

SEQ ID NO: 252339 - DNA, 20 bp, Artificial Sequence
  Description of Artificial Sequence: Synthetic oligonucleotide
  Target: ATXN1; (+) strand; PAM type: YTN; PAM sequence: CTG
tcccaagttcccttttccca

SEQ ID NO: 252340 - DNA, 20 bp, Artificial Sequence
  Description of Artificial Sequence: Synthetic oligonucleotide
  Target: ATXN1; (+) strand; PAM type: YTN; PAM sequence: TTC
ccttttcccaggacgattgc

SEQ ID NO: 252341 - DNA, 20 bp, Artificial Sequence
  Description of Artificial Sequence: Synthetic oligonucleotide
  Target: ATXN1; (+) strand; PAM type: YTN; PAM sequence: CTT
ttcccaggacgattgctctt

SEQ ID NO: 252342 - DNA, 20 bp, Artificial Sequence
  Description of Artificial Sequence: Synthetic oligonucleotide
  Target: ATXN1; (+) strand; PAM type: YTN; PAM sequence: TTT
tcccaggacgattgctcttc

SEQ ID NO: 252343 - DNA, 20 bp, Artificial Sequence
  Description of Artificial Sequence: Synthetic oligonucleotide
  Target: ATXN1; (+) strand; PAM type: YTN; PAM sequence: TTT
cccaggacgattgctcttcc

SEQ ID NO: 252344 - DNA, 20 bp, Artificial Sequence
  Description of Artificial Sequence: Synthetic oligonucleotide
  Target: ATXN1; (+) strand; PAM type: YTN; PAM sequence: TTC
ccaggacgattgctcttcct

SEQ ID NO: 252345 - DNA, 20 bp, Artificial Sequence
  Description of Artificial Sequence: Synthetic oligonucleotide
  Target: ATXN1; (+) strand; PAM type: YTN; PAM sequence: TTG
ctcttcctcccatctcgccc

SEQ ID NO: 252346 - DNA, 20 bp, Artificial Sequence
  Description of Artificial Sequence: Synthetic oligonucleotide
  Target: ATXN1; (+) strand; PAM type: YTN; PAM sequence: CTC
ttcctcccatctcgccctcc

SEQ ID NO: 252347 - DNA, 20 bp, Artificial Sequence
  Description of Artificial Sequence: Synthetic oligonucleotide
  Target: ATXN1; (+) strand; PAM type: YTN; PAM sequence: CTT
cctcccatctcgccctcctc

SEQ ID NO: 252348 - DNA, 20 bp, Artificial Sequence
  Description of Artificial Sequence: Synthetic oligonucleotide
  Target: ATXN1; (+) strand; PAM type: YTN; PAM sequence: TTC
ctcccatctcgccctcctct

SEQ ID NO: 252349 - DNA, 20 bp, Artificial Sequence
  Description of Artificial Sequence: Synthetic oligonucleotide
  Target: ATXN1; (+) strand; PAM type: YTN; PAM sequence: CTC
ccatctcgccctcctctctt

SEQ ID NO: 252350 - DNA, 20 bp, Artificial Sequence
  Description of Artificial Sequence: Synthetic oligonucleotide
  Target: ATXN1; (+) strand; PAM type: YTN; PAM sequence: CTC
gccctcctctcttacaggtc

SEQ ID NO: 252351 - DNA, 20 bp, Artificial Sequence
  Description of Artificial Sequence: Synthetic oligonucleotide
  Target: ATXN1; (+) strand; PAM type: YTN; PAM sequence: CTC
ctctcttacaggtccctata

SEQ ID NO: 252352 - DNA, 20 bp, Artificial Sequence
  Description of Artificial Sequence: Synthetic oligonucleotide
  Target: ATXN1; (+) strand; PAM type: YTN; PAM sequence: CTC
tcttacaggtccctataatg

SEQ ID NO: 252353 - DNA, 20 bp, Artificial Sequence
  Description of Artificial Sequence: Synthetic oligonucleotide
  Target: ATXN1; (+) strand; PAM type: YTN; PAM sequence: CTC
ttacaggtccctataatggc

SEQ ID NO: 252354 - DNA, 20 bp, Artificial Sequence
  Description of Artificial Sequence: Synthetic oligonucleotide
  Target: ATXN1; (+) strand; PAM type: YTN; PAM sequence: CTT
acaggtccctataatggctg

SEQ ID NO: 252355 - DNA, 20 bp, Artificial Sequence
  Description of Artificial Sequence: Synthetic oligonucleotide
  Target: ATXN1; (+) strand; PAM type: YTN; PAM sequence: TTA
caggtccctataatggctgt

SEQ ID NO: 252356 - DNA, 20 bp, Artificial Sequence
  Description of Artificial Sequence: Synthetic oligonucleotide
  Target: ATXN1; (+) strand; PAM type: YTN; PAM sequence: CTA
taatggctgttcttatgttc

SEQ ID NO: 252357 - DNA, 20 bp, Artificial Sequence
  Description of Artificial Sequence: Synthetic oligonucleotide
  Target: ATXN1; (+) strand; PAM type: YTN; PAM sequence: CTG
ttcttatgttccccactccc

SEQ ID NO: 252358 - DNA, 20 bp, Artificial Sequence
  Description of Artificial Sequence: Synthetic oligonucleotide
  Target: ATXN1; (+) strand; PAM type: YTN; PAM sequence: TTC
ttatgttccccactccctac

SEQ ID NO: 252359 - DNA, 20 bp, Artificial Sequence
  Description of Artificial Sequence: Synthetic oligonucleotide
  Target: ATXN1; (+) strand; PAM type: YTN; PAM sequence: CTT
atgttccccactccctaccc

SEQ ID NO: 252360 - DNA, 20 bp, Artificial Sequence
  Description of Artificial Sequence: Synthetic oligonucleotide
  Target: ATXN1; (+) strand; PAM type: YTN; PAM sequence: TTA
tgttccccactccctacccc

SEQ ID NO: 252361 - DNA, 20 bp, Artificial Sequence
  Description of Artificial Sequence: Synthetic oligonucleotide
  Target: ATXN1; (+) strand; PAM type: YTN; PAM sequence: TTC
cccactccctaccccgcacc

SEQ ID NO: 252362 - DNA, 20 bp, Artificial Sequence
  Description of Artificial Sequence: Synthetic oligonucleotide
  Target: ATXN1; (+) strand; PAM type: YTN; PAM sequence: CTC
cctaccccgcaccatatctt

SEQ ID NO: 252363 - DNA, 20 bp, Artificial Sequence
  Description of Artificial Sequence: Synthetic oligonucleotide
  Target: ATXN1; (+) strand; PAM type: YTN; PAM sequence: CTA
ccccgcaccatatcttctct

SEQ ID NO: 252364 - DNA, 20 bp, Artificial Sequence
  Description of Artificial Sequence: Synthetic oligonucleotide
  Target: ATXN1; (+) strand; PAM type: YTN; PAM sequence: CTT
ctcttaaggaggaatttggc

SEQ ID NO: 252365 - DNA, 20 bp, Artificial Sequence
  Description of Artificial Sequence: Synthetic oligonucleotide
  Target: ATXN1; (+) strand; PAM type: YTN; PAM sequence: TTC
tcttaaggaggaatttggcc

SEQ ID NO: 252366 - DNA, 20 bp, Artificial Sequence
  Description of Artificial Sequence: Synthetic oligonucleotide
  Target: ATXN1; (+) strand; PAM type: YTN; PAM sequence: CTC
ttaaggaggaatttggccta

SEQ ID NO: 252367 - DNA, 20 bp, Artificial Sequence
  Description of Artificial Sequence: Synthetic oligonucleotide
  Target: ATXN1; (+) strand; PAM type: YTN; PAM sequence: CTT
aaggaggaatttggcctaat

SEQ ID NO: 252368 - DNA, 20 bp, Artificial Sequence
  Description of Artificial Sequence: Synthetic oligonucleotide
  Target: ATXN1; (+) strand; PAM type: YTN; PAM sequence: TTA
aggaggaatttggcctaatc

SEQ ID NO: 252369 - DNA, 20 bp, Artificial Sequence
  Description of Artificial Sequence: Synthetic oligonucleotide
  Target: ATXN1; (+) strand; PAM type: YTN; PAM sequence: TTT
ggcctaatctaagtttaatc

SEQ ID NO: 252370 - DNA, 20 bp, Artificial Sequence
  Description of Artificial Sequence: Synthetic oligonucleotide
  Target: ATXN1; (+) strand; PAM type: YTN; PAM sequence: TTG
gcctaatctaagtttaatca

SEQ ID NO: 252371 - DNA, 20 bp, Artificial Sequence
  Description of Artificial Sequence: Synthetic oligonucleotide
  Target: ATXN1; (+) strand; PAM type: YTN; PAM sequence: CTA
atctaagtttaatcattgac

SEQ ID NO: 252372 - DNA, 20 bp, Artificial Sequence
  Description of Artificial Sequence: Synthetic oligonucleotide
  Target: ATXN1; (+) strand; PAM type: YTN; PAM sequence: CTA
agtttaatcattgacctttc

SEQ ID NO: 252373 - DNA, 20 bp, Artificial Sequence
  Description of Artificial Sequence: Synthetic oligonucleotide
  Target: ATXN1; (+) strand; PAM type: YTN; PAM sequence: TTT
aatcattgacctttctgacc

SEQ ID NO: 252374 - DNA, 20 bp, Artificial Sequence
  Description of Artificial Sequence: Synthetic oligonucleotide
  Target: ATXN1; (+) strand; PAM type: YTN; PAM sequence: TTA
atcattgacctttctgacct

SEQ ID NO: 252375 - DNA, 20 bp, Artificial Sequence
  Description of Artificial Sequence: Synthetic oligonucleotide
  Target: ATXN1; (+) strand; PAM type: YTN; PAM sequence: TTG
acctttctgacctcacaagg

SEQ ID NO: 252376 - DNA, 20 bp, Artificial Sequence
  Description of Artificial Sequence: Synthetic oligonucleotide
  Target: ATXN1; (+) strand; PAM type: YTN; PAM sequence: CTT
tctgacctcacaaggaatag

SEQ ID NO: 252377 - DNA, 20 bp, Artificial Sequence
  Description of Artificial Sequence: Synthetic oligonucleotide
  Target: ATXN1; (+) strand; PAM type: YTN; PAM sequence: TTT
ctgacctcacaaggaatagc

SEQ ID NO: 252378 - DNA, 20 bp, Artificial Sequence
  Description of Artificial Sequence: Synthetic oligonucleotide
  Target: ATXN1; (+) strand; PAM type: YTN; PAM sequence: TTC
tgacctcacaaggaatagca

SEQ ID NO: 252379 - DNA, 20 bp, Artificial Sequence
  Description of Artificial Sequence: Synthetic oligonucleotide
  Target: ATXN1; (+) strand; PAM type: YTN; PAM sequence: CTG
acctcacaaggaatagcaag

SEQ ID NO: 252380 - DNA, 20 bp, Artificial Sequence
  Description of Artificial Sequence: Synthetic oligonucleotide
  Target: ATXN1; (+) strand; PAM type: YTN; PAM sequence: CTC
acaaggaatagcaagctaaa

SEQ ID NO: 252381 - DNA, 20 bp, Artificial Sequence
  Description of Artificial Sequence: Synthetic oligonucleotide
  Target: ATXN1; (+) strand; PAM type: YTN; PAM sequence: CTA
aataagcacagaacttgtcc

SEQ ID NO: 252382 - DNA, 20 bp, Artificial Sequence
  Description of Artificial Sequence: Synthetic oligonucleotide
  Target: ATXN1; (+) strand; PAM type: YTN; PAM sequence: CTT
gtcctccttagatggtgagg

SEQ ID NO: 252383 - DNA, 20 bp, Artificial Sequence
  Description of Artificial Sequence: Synthetic oligonucleotide
  Target: ATXN1; (+) strand; PAM type: YTN; PAM sequence: TTG
tcctccttagatggtgagga

SEQ ID NO: 252384 - DNA, 20 bp, Artificial Sequence
  Description of Artificial Sequence: Synthetic oligonucleotide
  Target: ATXN1; (+) strand; PAM type: YTN; PAM sequence: CTC
cttagatggtgaggaaagag

SEQ ID NO: 252385 - DNA, 20 bp, Artificial Sequence
  Description of Artificial Sequence: Synthetic oligonucleotide
  Target: ATXN1; (+) strand; PAM type: YTN; PAM sequence: CTT
agatggtgaggaaagagaat

SEQ ID NO: 252386 - DNA, 20 bp, Artificial Sequence
  Description of Artificial Sequence: Synthetic oligonucleotide
  Target: ATXN1; (+) strand; PAM type: YTN; PAM sequence: TTA
gatggtgaggaaagagaatt

SEQ ID NO: 252387 - DNA, 20 bp, Artificial Sequence
  Description of Artificial Sequence: Synthetic oligonucleotide
  Target: ATXN1; (+) strand; PAM type: YTN; PAM sequence: TTG
taaatgtttatgacttgcta

SEQ ID NO: 252388 - DNA, 20 bp, Artificial Sequence
  Description of Artificial Sequence: Synthetic oligonucleotide
  Target: ATXN1; (+) strand; PAM type: YTN; PAM sequence: TTT
atgacttgctatatttttct

SEQ ID NO: 252389 - DNA, 20 bp, Artificial Sequence
  Description of Artificial Sequence: Synthetic oligonucleotide
  Target: ATXN1; (+) strand; PAM type: YTN; PAM sequence: TTA
tgacttgctatatttttctt

SEQ ID NO: 252390 - DNA, 20 bp, Artificial Sequence
  Description of Artificial Sequence: Synthetic oligonucleotide
  Target: ATXN1; (+) strand; PAM type: YTN; PAM sequence: CTT
gctatatttttctttaattc

SEQ ID NO: 252391 - DNA, 20 bp, Artificial Sequence
  Description of Artificial Sequence: Synthetic oligonucleotide
  Target: ATXN1; (+) strand; PAM type: YTN; PAM sequence: TTG
ctatatttttctttaattca

SEQ ID NO: 252392 - DNA, 20 bp, Artificial Sequence
  Description of Artificial Sequence: Synthetic oligonucleotide
  Target: ATXN1; (+) strand; PAM type: YTN; PAM sequence: CTA
tatttttctttaattcatgg

SEQ ID NO: 252393 - DNA, 20 bp, Artificial Sequence
  Description of Artificial Sequence: Synthetic oligonucleotide
  Target: ATXN1; (+) strand; PAM type: YTN; PAM sequence: TTT
ttctttaattcatggaacat

SEQ ID NO: 252394 - DNA, 20 bp, Artificial Sequence
  Description of Artificial Sequence: Synthetic oligonucleotide
  Target: ATXN1; (+) strand; PAM type: YTN; PAM sequence: TTT
tctttaattcatggaacatt

SEQ ID NO: 252395 - DNA, 20 bp, Artificial Sequence
  Description of Artificial Sequence: Synthetic oligonucleotide
  Target: ATXN1; (+) strand; PAM type: YTN; PAM sequence: TTT
ctttaattcatggaacattt

SEQ ID NO: 252396 - DNA, 20 bp, Artificial Sequence
  Description of Artificial Sequence: Synthetic oligonucleotide
  Target: ATXN1; (+) strand; PAM type: YTN; PAM sequence: TTC
tttaattcatggaacatttt

SEQ ID NO: 252397 - DNA, 20 bp, Artificial Sequence
  Description of Artificial Sequence: Synthetic oligonucleotide
  Target: ATXN1; (+) strand; PAM type: YTN; PAM sequence: CTT
taattcatggaacattttat

SEQ ID NO: 252398 - DNA, 20 bp, Artificial Sequence
  Description of Artificial Sequence: Synthetic oligonucleotide
  Target: ATXN1; (+) strand; PAM type: YTN; PAM sequence: TTT
aattcatggaacattttata

SEQ ID NO: 252399 - DNA, 20 bp, Artificial Sequence
  Description of Artificial Sequence: Synthetic oligonucleotide
  Target: ATXN1; (+) strand; PAM type: YTN; PAM sequence: TTA
attcatggaacattttatat

SEQ ID NO: 252400 - DNA, 20 bp, Artificial Sequence
  Description of Artificial Sequence: Synthetic oligonucleotide
  Target: ATXN1; (+) strand; PAM type: YTN; PAM sequence: TTC
atggaacattttatattaat

SEQ ID NO: 252401 - DNA, 20 bp, Artificial Sequence
  Description of Artificial Sequence: Synthetic oligonucleotide
  Target: ATXN1; (+) strand; PAM type: YTN; PAM sequence: TTT
tatattaatgtaaaaagaac

SEQ ID NO: 252402 - DNA, 20 bp, Artificial Sequence
  Description of Artificial Sequence: Synthetic oligonucleotide
  Target: ATXN1; (+) strand; PAM type: YTN; PAM sequence: TTT
atattaatgtaaaaagaact

SEQ ID NO: 252403 - DNA, 20 bp, Artificial Sequence
  Description of Artificial Sequence: Synthetic oligonucleotide
  Target: ATXN1; (+) strand; PAM type: YTN; PAM sequence: TTA
tattaatgtaaaaagaactg

SEQ ID NO: 252404 - DNA, 20 bp, Artificial Sequence
  Description of Artificial Sequence: Synthetic oligonucleotide
  Target: ATXN1; (+) strand; PAM type: YTN; PAM sequence: TTA
atgtaaaaagaactgggagg

SEQ ID NO: 252405 - DNA, 20 bp, Artificial Sequence
  Description of Artificial Sequence: Synthetic oligonucleotide
  Target: ATXN1; (+) strand; PAM type: YTN; PAM sequence: CTG
ggaggactgttgggaatact

SEQ ID NO: 252406 - DNA, 20 bp, Artificial Sequence
  Description of Artificial Sequence: Synthetic oligonucleotide
  Target: ATXN1; (+) strand; PAM type: YTN; PAM sequence: CTG
ttgggaatactctgtcatac

SEQ ID NO: 252407 - DNA, 20 bp, Artificial Sequence
  Description of Artificial Sequence: Synthetic oligonucleotide
  Target: ATXN1; (+) strand; PAM type: YTN; PAM sequence: TTG
ggaatactctgtcataccag

SEQ ID NO: 252408 - DNA, 20 bp, Artificial Sequence
  Description of Artificial Sequence: Synthetic oligonucleotide
  Target: ATXN1; (+) strand; PAM type: YTN; PAM sequence: CTC
tgtcataccagcatcattcc

SEQ ID NO: 252409 - DNA, 20 bp, Artificial Sequence
  Description of Artificial Sequence: Synthetic oligonucleotide
  Target: ATXN1; (+) strand; PAM type: YTN; PAM sequence: CTG
tcataccagcatcattccac

SEQ ID NO: 252410 - DNA, 20 bp, Artificial Sequence
  Description of Artificial Sequence: Synthetic oligonucleotide
  Target: ATXN1; (+) strand; PAM type: YTN; PAM sequence: TTC
cacttgagccctttatgcta

SEQ ID NO: 252411 - DNA, 20 bp, Artificial Sequence
  Description of Artificial Sequence: Synthetic oligonucleotide
  Target: ATXN1; (+) strand; PAM type: YTN; PAM sequence: CTT
gagccctttatgctataata

SEQ ID NO: 252412 - DNA, 20 bp, Artificial Sequence
  Description of Artificial Sequence: Synthetic oligonucleotide
  Target: ATXN1; (+) strand; PAM type: YTN; PAM sequence: TTG
agccctttatgctataatat

SEQ ID NO: 252413 - DNA, 20 bp, Artificial Sequence
  Description of Artificial Sequence: Synthetic oligonucleotide
  Target: ATXN1; (+) strand; PAM type: YTN; PAM sequence: CTT
tatgctataatattaaatgt

SEQ ID NO: 252414 - DNA, 20 bp, Artificial Sequence
  Description of Artificial Sequence: Synthetic oligonucleotide
  Target: ATXN1; (+) strand; PAM type: YTN; PAM sequence: TTT
atgctataatattaaatgta

SEQ ID NO: 252415 - DNA, 20 bp, Artificial Sequence
  Description of Artificial Sequence: Synthetic oligonucleotide
  Target: ATXN1; (+) strand; PAM type: YTN; PAM sequence: TTA
tgctataatattaaatgtag

SEQ ID NO: 252416 - DNA, 20 bp, Artificial Sequence
  Description of Artificial Sequence: Synthetic oligonucleotide
  Target: ATXN1; (+) strand; PAM type: YTN; PAM sequence: CTA
taatattaaatgtagttata

SEQ ID NO: 252417 - DNA, 20 bp, Artificial Sequence
  Description of Artificial Sequence: Synthetic oligonucleotide
  Target: ATXN1; (+) strand; PAM type: YTN; PAM sequence: TTA
aatgtagttatatatttcct

SEQ ID NO: 252418 - DNA, 20 bp, Artificial Sequence
  Description of Artificial Sequence: Synthetic oligonucleotide
  Target: ATXN1; (+) strand; PAM type: YTN; PAM sequence: TTA
tatatttcctattttccttc

SEQ ID NO: 252419 - DNA, 20 bp, Artificial Sequence
  Description of Artificial Sequence: Synthetic oligonucleotide
  Target: ATXN1; (+) strand; PAM type: YTN; PAM sequence: TTT
cctattttccttcttttcaa

SEQ ID NO: 252420 - DNA, 20 bp, Artificial Sequence
  Description of Artificial Sequence: Synthetic oligonucleotide
  Target: ATXN1; (+) strand; PAM type: YTN; PAM sequence: TTC
ctattttccttcttttcaaa

SEQ ID NO: 252421 - DNA, 20 bp, Artificial Sequence
  Description of Artificial Sequence: Synthetic oligonucleotide
  Target: ATXN1; (+) strand; PAM type: YTN; PAM sequence: CTA
ttttccttcttttcaaacta

SEQ ID NO: 252422 - DNA, 20 bp, Artificial Sequence
  Description of Artificial Sequence: Synthetic oligonucleotide
  Target: ATXN1; (+) strand; PAM type: YTN; PAM sequence: TTT
tccttcttttcaaactataa

SEQ ID NO: 252423 - DNA, 20 bp, Artificial Sequence
  Description of Artificial Sequence: Synthetic oligonucleotide
  Target: ATXN1; (+) strand; PAM type: YTN; PAM sequence: TTT
ccttcttttcaaactataaa

SEQ ID NO: 252424 - DNA, 20 bp, Artificial Sequence
  Description of Artificial Sequence: Synthetic oligonucleotide
  Target: ATXN1; (+) strand; PAM type: YTN; PAM sequence: TTC
cttcttttcaaactataaaa

SEQ ID NO: 252425 - DNA, 20 bp, Artificial Sequence
  Description of Artificial Sequence: Synthetic oligonucleotide
  Target: ATXN1; (+) strand; PAM type: YTN; PAM sequence: CTT
cttttcaaactataaaactt

SEQ ID NO: 252426 - DNA, 20 bp, Artificial Sequence
  Description of Artificial Sequence: Synthetic oligonucleotide
  Target: ATXN1; (+) strand; PAM type: YTN; PAM sequence: TTC
ttttcaaactataaaactta

SEQ ID NO: 252427 - DNA, 20 bp, Artificial Sequence
  Description of Artificial Sequence: Synthetic oligonucleotide
  Target: ATXN1; (+) strand; PAM type: YTN; PAM sequence: CTT
ttcaaactataaaacttagt

SEQ ID NO: 252428 - DNA, 20 bp, Artificial Sequence
  Description of Artificial Sequence: Synthetic oligonucleotide
  Target: ATXN1; (+) strand; PAM type: YTN; PAM sequence: TTT
tcaaactataaaacttagtc

SEQ ID NO: 252429 - DNA, 20 bp, Artificial Sequence
  Description of Artificial Sequence: Synthetic oligonucleotide
  Target: ATXN1; (+) strand; PAM type: YTN; PAM sequence: TTT
caaactataaaacttagtct

SEQ ID NO: 252430 - DNA, 20 bp, Artificial Sequence
  Description of Artificial Sequence: Synthetic oligonucleotide
  Target: ATXN1; (+) strand; PAM type: YTN; PAM sequence: TTC
aaactataaaacttagtctt

SEQ ID NO: 252431 - DNA, 20 bp, Artificial Sequence
  Description of Artificial Sequence: Synthetic oligonucleotide
  Target: ATXN1; (+) strand; PAM type: YTN; PAM sequence: CTA
taaaacttagtctttcacgt

SEQ ID NO: 252432 - DNA, 20 bp, Artificial Sequence
  Description of Artificial Sequence: Synthetic oligonucleotide
  Target: ATXN1; (+) strand; PAM type: YTN; PAM sequence: CTT
agtctttcacgtaatgggag

SEQ ID NO: 252433 - DNA, 20 bp, Artificial Sequence
  Description of Artificial Sequence: Synthetic oligonucleotide
  Target: ATXN1; (+) strand; PAM type: YTN; PAM sequence: TTA
gtctttcacgtaatgggaga

SEQ ID NO: 252434 - DNA, 20 bp, Artificial Sequence
  Description of Artificial Sequence: Synthetic oligonucleotide
  Target: ATXN1; (+) strand; PAM type: YTN; PAM sequence: CTT
tcacgtaatgggagaggcga

SEQ ID NO: 252435 - DNA, 20 bp, Artificial Sequence
  Description of Artificial Sequence: Synthetic oligonucleotide
  Target: ATXN1; (+) strand; PAM type: YTN; PAM sequence: TTT
cacgtaatgggagaggcgat

SEQ ID NO: 252436 - DNA, 20 bp, Artificial Sequence
  Description of Artificial Sequence: Synthetic oligonucleotide
  Target: ATXN1; (+) strand; PAM type: YTN; PAM sequence: TTC
acgtaatgggagaggcgata

SEQ ID NO: 252437 - DNA, 20 bp, Artificial Sequence
  Description of Artificial Sequence: Synthetic oligonucleotide
  Target: ATXN1; (+) strand; PAM type: YTN; PAM sequence: CTT
atggtaaatgctcaatatat

SEQ ID NO: 252438 - DNA, 20 bp, Artificial Sequence
  Description of Artificial Sequence: Synthetic oligonucleotide
  Target: ATXN1; (+) strand; PAM type: YTN; PAM sequence: TTA
tggtaaatgctcaatatatt

SEQ ID NO: 252439 - DNA, 20 bp, Artificial Sequence
  Description of Artificial Sequence: Synthetic oligonucleotide
  Target: ATXN1; (+) strand; PAM type: YTN; PAM sequence: CTC
aatatatttatctattatta

SEQ ID NO: 252440 - DNA, 20 bp, Artificial Sequence
  Description of Artificial Sequence: Synthetic oligonucleotide
  Target: ATXN1; (+) strand; PAM type: YTN; PAM sequence: TTT
atctattattaatgataata

SEQ ID NO: 252441 - DNA, 20 bp, Artificial Sequence
  Description of Artificial Sequence: Synthetic oligonucleotide
  Target: ATXN1; (+) strand; PAM type: YTN; PAM sequence: TTA
tctattattaatgataatac

SEQ ID NO: 252442 - DNA, 20 bp, Artificial Sequence
  Description of Artificial Sequence: Synthetic oligonucleotide
  Target: ATXN1; (+) strand; PAM type: YTN; PAM sequence: CTA
ttattaatgataatactgga

SEQ ID NO: 252443 - DNA, 20 bp, Artificial Sequence
  Description of Artificial Sequence: Synthetic oligonucleotide
  Target: ATXN1; (+) strand; PAM type: YTN; PAM sequence: TTA
ttaatgataatactggattt

SEQ ID NO: 252444 - DNA, 20 bp, Artificial Sequence
  Description of Artificial Sequence: Synthetic oligonucleotide
  Target: ATXN1; (+) strand; PAM type: YTN; PAM sequence: TTA
atgataatactggatttata

SEQ ID NO: 252445 - DNA, 20 bp, Artificial Sequence
  Description of Artificial Sequence: Synthetic oligonucleotide
  Target: ATXN1; (+) strand; PAM type: YTN; PAM sequence: CTG
gatttatactgaaataattc

SEQ ID NO: 252446 - DNA, 20 bp, Artificial Sequence
  Description of Artificial Sequence: Synthetic oligonucleotide
  Target: ATXN1; (+) strand; PAM type: YTN; PAM sequence: TTT
atactgaaataattcaccac

SEQ ID NO: 252447 - DNA, 20 bp, Artificial Sequence
  Description of Artificial Sequence: Synthetic oligonucleotide
  Target: ATXN1; (+) strand; PAM type: YTN; PAM sequence: TTA
tactgaaataattcaccact

SEQ ID NO: 252448 - DNA, 20 bp, Artificial Sequence
  Description of Artificial Sequence: Synthetic oligonucleotide
  Target: ATXN1; (+) strand; PAM type: YTN; PAM sequence: CTG
aaataattcaccacttatta

SEQ ID NO: 252449 - DNA, 20 bp, Artificial Sequence
  Description of Artificial Sequence: Synthetic oligonucleotide
  Target: ATXN1; (+) strand; PAM type: YTN; PAM sequence: TTC
accacttattaaaacacaat

SEQ ID NO: 252450 - DNA, 20 bp, Artificial Sequence
  Description of Artificial Sequence: Synthetic oligonucleotide
  Target: ATXN1; (+) strand; PAM type: YTN; PAM sequence: CTT
attaaaacacaattcttaaa

SEQ ID NO: 252451 - DNA, 20 bp, Artificial Sequence
  Description of Artificial Sequence: Synthetic oligonucleotide
  Target: ATXN1; (+) strand; PAM type: YTN; PAM sequence: TTA
ttaaaacacaattcttaaaa

SEQ ID NO: 252452 - DNA, 20 bp, Artificial Sequence
  Description of Artificial Sequence: Synthetic oligonucleotide
  Target: ATXN1; (+) strand; PAM type: YTN; PAM sequence: TTA
aaacacaattcttaaaatat

SEQ ID NO: 252453 - DNA, 20 bp, Artificial Sequence
  Description of Artificial Sequence: Synthetic oligonucleotide
  Target: ATXN1; (+) strand; PAM type: YTN; PAM sequence: TTC
ttaaaatataagttgccctt

SEQ ID NO: 252454 - DNA, 20 bp, Artificial Sequence
  Description of Artificial Sequence: Synthetic oligonucleotide
  Target: ATXN1; (+) strand; PAM type: YTN; PAM sequence: CTT
aaaatataagttgcccttcc

SEQ ID NO: 252455 - DNA, 20 bp, Artificial Sequence
  Description of Artificial Sequence: Synthetic oligonucleotide
  Target: ATXN1; (+) strand; PAM type: YTN; PAM sequence: TTA
aaatataagttgcccttccc

SEQ ID NO: 252456 - DNA, 20 bp, Artificial Sequence
  Description of Artificial Sequence: Synthetic oligonucleotide
  Target: ATXN1; (+) strand; PAM type: YTN; PAM sequence: TTG
cccttccccaccacacacac

SEQ ID NO: 252457 - DNA, 20 bp, Artificial Sequence
  Description of Artificial Sequence: Synthetic oligonucleotide
  Target: ATXN1; (+) strand; PAM type: YTN; PAM sequence: CTT
ccccaccacacacacttttc

SEQ ID NO: 252458 - DNA, 20 bp, Artificial Sequence
  Description of Artificial Sequence: Synthetic oligonucleotide
  Target: ATXN1; (+) strand; PAM type: YTN; PAM sequence: TTC
cccaccacacacacttttct

SEQ ID NO: 252459 - DNA, 20 bp, Artificial Sequence
  Description of Artificial Sequence: Synthetic oligonucleotide
  Target: ATXN1; (+) strand; PAM type: YTN; PAM sequence: CTT
ttctgtttgtggtcattaga

SEQ ID NO: 252460 - DNA, 20 bp, Artificial Sequence
  Description of Artificial Sequence: Synthetic oligonucleotide
  Target: ATXN1; (+) strand; PAM type: YTN; PAM sequence: TTT
tctgtttgtggtcattagat

SEQ ID NO: 252461 - DNA, 20 bp, Artificial Sequence
  Description of Artificial Sequence: Synthetic oligonucleotide
  Target: ATXN1; (+) strand; PAM type: YTN; PAM sequence: TTT
ctgtttgtggtcattagatc

SEQ ID NO: 252462 - DNA, 20 bp, Artificial Sequence
  Description of Artificial Sequence: Synthetic oligonucleotide
  Target: ATXN1; (+) strand; PAM type: YTN; PAM sequence: TTC
tgtttgtggtcattagatca

SEQ ID NO: 252463 - DNA, 20 bp, Artificial Sequence
  Description of Artificial Sequence: Synthetic oligonucleotide
  Target: ATXN1; (+) strand; PAM type: YTN; PAM sequence: CTG
tttgtggtcattagatcatg

SEQ ID NO: 252464 - DNA, 20 bp, Artificial Sequence
  Description of Artificial Sequence: Synthetic oligonucleotide
  Target: ATXN1; (+) strand; PAM type: YTN; PAM sequence: TTT
gtggtcattagatcatgcta

SEQ ID NO: 252465 - DNA, 20 bp, Artificial Sequence
  Description of Artificial Sequence: Synthetic oligonucleotide
  Target: ATXN1; (+) strand; PAM type: YTN; PAM sequence: TTG
tggtcattagatcatgctac

SEQ ID NO: 252466 - DNA, 20 bp, Artificial Sequence
  Description of Artificial Sequence: Synthetic oligonucleotide
  Target: ATXN1; (+) strand; PAM type: YTN; PAM sequence: TTA
gatcatgctactaacggctt

SEQ ID NO: 252467 - DNA, 20 bp, Artificial Sequence
  Description of Artificial Sequence: Synthetic oligonucleotide
  Target: ATXN1; (+) strand; PAM type: YTN; PAM sequence: CTA
ctaacggctttgcctaaaca

SEQ ID NO: 252468 - DNA, 20 bp, Artificial Sequence
  Description of Artificial Sequence: Synthetic oligonucleotide
  Target: ATXN1; (+) strand; PAM type: YTN; PAM sequence: CTA
acggctttgcctaaacaatt

SEQ ID NO: 252469 - DNA, 20 bp, Artificial Sequence
  Description of Artificial Sequence: Synthetic oligonucleotide
  Target: ATXN1; (+) strand; PAM type: YTN; PAM sequence: CTT
tgcctaaacaatttattcat

SEQ ID NO: 252470 - DNA, 20 bp, Artificial Sequence
  Description of Artificial Sequence: Synthetic oligonucleotide
  Target: ATXN1; (+) strand; PAM type: YTN; PAM sequence: TTT
gcctaaacaatttattcatt

SEQ ID NO: 252471 - DNA, 20 bp, Artificial Sequence
  Description of Artificial Sequence: Synthetic oligonucleotide
  Target: ATXN1; (+) strand; PAM type: YTN; PAM sequence: TTG
cctaaacaatttattcattt

SEQ ID NO: 252472 - DNA, 20 bp, Artificial Sequence
  Description of Artificial Sequence: Synthetic oligonucleotide
  Target: ATXN1; (+) strand; PAM type: YTN; PAM sequence: CTA
aacaatttattcatttaaca

SEQ ID NO: 252473 - DNA, 20 bp, Artificial Sequence
  Description of Artificial Sequence: Synthetic oligonucleotide
  Target: ATXN1; (+) strand; PAM type: YTN; PAM sequence: TTT
attcatttaacatctacaca

SEQ ID NO: 252474 - DNA, 20 bp, Artificial Sequence
  Description of Artificial Sequence: Synthetic oligonucleotide
  Target: ATXN1; (+) strand; PAM type: YTN; PAM sequence: TTA
ttcatttaacatctacacac

SEQ ID NO: 252475 - DNA, 20 bp, Artificial Sequence
  Description of Artificial Sequence: Synthetic oligonucleotide
  Target: ATXN1; (+) strand; PAM type: YTN; PAM sequence: TTC
atttaacatctacacaccag

SEQ ID NO: 252476 - DNA, 20 bp, Artificial Sequence
  Description of Artificial Sequence: Synthetic oligonucleotide
  Target: ATXN1; (+) strand; PAM type: YTN; PAM sequence: TTT
aacatctacacaccaggcac

SEQ ID NO: 252477 - DNA, 20 bp, Artificial Sequence
  Description of Artificial Sequence: Synthetic oligonucleotide
  Target: ATXN1; (+) strand; PAM type: YTN; PAM sequence: TTA
acatctacacaccaggcacc

SEQ ID NO: 252478 - DNA, 20 bp, Artificial Sequence
  Description of Artificial Sequence: Synthetic oligonucleotide
  Target: ATXN1; (+) strand; PAM type: YTN; PAM sequence: CTA
cacaccaggcacccagctag

SEQ ID NO: 252479 - DNA, 20 bp, Artificial Sequence
  Description of Artificial Sequence: Synthetic oligonucleotide
  Target: ATXN1; (+) strand; PAM type: YTN; PAM sequence: CTA
gtctggggacaaaaacgggt

SEQ ID NO: 252480 - DNA, 20 bp, Artificial Sequence
  Description of Artificial Sequence: Synthetic oligonucleotide
  Target: ATXN1; (+) strand; PAM type: YTN; PAM sequence: CTG
gggacaaaaacgggtaagac

SEQ ID NO: 252481 - DNA, 20 bp, Artificial Sequence
  Description of Artificial Sequence: Synthetic oligonucleotide
  Target: ATXN1; (+) strand; PAM type: YTN; PAM sequence: CTT
ttctgccccaaagggatgat

SEQ ID NO: 252482 - DNA, 20 bp, Artificial Sequence
  Description of Artificial Sequence: Synthetic oligonucleotide
  Target: ATXN1; (+) strand; PAM type: YTN; PAM sequence: TTT
tctgccccaaagggatgatg

SEQ ID NO: 252483 - DNA, 20 bp, Artificial Sequence
  Description of Artificial Sequence: Synthetic oligonucleotide
  Target: ATXN1; (+) strand; PAM type: YTN; PAM sequence: TTT
ctgccccaaagggatgatgg

SEQ ID NO: 252484 - DNA, 20 bp, Artificial Sequence
  Description of Artificial Sequence: Synthetic oligonucleotide
  Target: ATXN1; (+) strand; PAM type: YTN; PAM sequence: TTC
tgccccaaagggatgatgga

SEQ ID NO: 252485 - DNA, 20 bp, Artificial Sequence
  Description of Artificial Sequence: Synthetic oligonucleotide
  Target: ATXN1; (+) strand; PAM type: YTN; PAM sequence: CTG
ccccaaagggatgatggaat

SEQ ID NO: 252486 - DNA, 20 bp, Artificial Sequence
  Description of Artificial Sequence: Synthetic oligonucleotide
  Target: ATXN1; (+) strand; PAM type: YTN; PAM sequence: TTA
ctttgacatggggcactcct

SEQ ID NO: 252487 - DNA, 20 bp, Artificial Sequence
  Description of Artificial Sequence: Synthetic oligonucleotide
  Target: ATXN1; (+) strand; PAM type: YTN; PAM sequence: CTT
tgacatggggcactcctttg

SEQ ID NO: 252488 - DNA, 20 bp, Artificial Sequence
  Description of Artificial Sequence: Synthetic oligonucleotide
  Target: ATXN1; (+) strand; PAM type: YTN; PAM sequence: TTT
gacatggggcactcctttgg

SEQ ID NO: 252489 - DNA, 20 bp, Artificial Sequence
  Description of Artificial Sequence: Synthetic oligonucleotide
  Target: ATXN1; (+) strand; PAM type: YTN; PAM sequence: TTG
acatggggcactcctttggc

SEQ ID NO: 252490 - DNA, 20 bp, Artificial Sequence
  Description of Artificial Sequence: Synthetic oligonucleotide
  Target: ATXN1; (+) strand; PAM type: YTN; PAM sequence: CTC
ctttggccaatgaagtaaag

SEQ ID NO: 252491 - DNA, 20 bp, Artificial Sequence
  Description of Artificial Sequence: Synthetic oligonucleotide
  Target: ATXN1; (+) strand; PAM type: YTN; PAM sequence: CTT
tggccaatgaagtaaaggtc

SEQ ID NO: 252492 - DNA, 20 bp, Artificial Sequence
  Description of Artificial Sequence: Synthetic oligonucleotide
  Target: ATXN1; (+) strand; PAM type: YTN; PAM sequence: TTT
ggccaatgaagtaaaggtca

SEQ ID NO: 252493 - DNA, 20 bp, Artificial Sequence
  Description of Artificial Sequence: Synthetic oligonucleotide
  Target: ATXN1; (+) strand; PAM type: YTN; PAM sequence: TTG
gccaatgaagtaaaggtcag

SEQ ID NO: 252494 - DNA, 20 bp, Artificial Sequence
  Description of Artificial Sequence: Synthetic oligonucleotide
  Target: ATXN1; (+) strand; PAM type: YTN; PAM sequence: TTA
acctgtcatagaaaaggtca

SEQ ID NO: 252495 - DNA, 20 bp, Artificial Sequence
  Description of Artificial Sequence: Synthetic oligonucleotide
  Target: ATXN1; (+) strand; PAM type: YTN; PAM sequence: CTG
tcatagaaaaggtcatgaat

SEQ ID NO: 252496 - DNA, 20 bp, Artificial Sequence
  Description of Artificial Sequence: Synthetic oligonucleotide
  Target: ATXN1; (+) strand; PAM type: YTN; PAM sequence: CTA
caggatacttcactttgctc

SEQ ID NO: 252497 - DNA, 20 bp, Artificial Sequence
  Description of Artificial Sequence: Synthetic oligonucleotide
  Target: ATXN1; (+) strand; PAM type: YTN; PAM sequence: CTT
cactttgctctcatgagatt

SEQ ID NO: 252498 - DNA, 20 bp, Artificial Sequence
  Description of Artificial Sequence: Synthetic oligonucleotide
  Target: ATXN1; (+) strand; PAM type: YTN; PAM sequence: TTC
actttgctctcatgagattt

SEQ ID NO: 252499 - DNA, 20 bp, Artificial Sequence
  Description of Artificial Sequence: Synthetic oligonucleotide
  Target: ATXN1; (+) strand; PAM type: YTN; PAM sequence: CTT
tgctctcatgagatttggtc

SEQ ID NO: 252500 - DNA, 20 bp, Artificial Sequence
  Description of Artificial Sequence: Synthetic oligonucleotide
  Target: ATXN1; (+) strand; PAM type: YTN; PAM sequence: TTT
gctctcatgagatttggtca

SEQ ID NO: 252501 - DNA, 20 bp, Artificial Sequence
  Description of Artificial Sequence: Synthetic oligonucleotide
  Target: ATXN1; (+) strand; PAM type: YTN; PAM sequence: TTG
ctctcatgagatttggtcag

SEQ ID NO: 252502 - DNA, 20 bp, Artificial Sequence
  Description of Artificial Sequence: Synthetic oligonucleotide
  Target: ATXN1; (+) strand; PAM type: YTN; PAM sequence: CTC
tcatgagatttggtcagtaa

SEQ ID NO: 252503 - DNA, 20 bp, Artificial Sequence
  Description of Artificial Sequence: Synthetic oligonucleotide
  Target: ATXN1; (+) strand; PAM type: YTN; PAM sequence: CTC
atgagatttggtcagtaaag

SEQ ID NO: 252504 - DNA, 20 bp, Artificial Sequence
  Description of Artificial Sequence: Synthetic oligonucleotide
  Target: ATXN1; (+) strand; PAM type: YTN; PAM sequence: TTT
ggtcagtaaaggaattatcc

SEQ ID NO: 252505 - DNA, 20 bp, Artificial Sequence
  Description of Artificial Sequence: Synthetic oligonucleotide
  Target: ATXN1; (+) strand; PAM type: YTN; PAM sequence: TTG
gtcagtaaaggaattatccg

SEQ ID NO: 252506 - DNA, 20 bp, Artificial Sequence
  Description of Artificial Sequence: Synthetic oligonucleotide
  Target: ATXN1; (+) strand; PAM type: YTN; PAM sequence: TTA
tccgtgtaaagagaaaatca

SEQ ID NO: 252507 - DNA, 20 bp, Artificial Sequence
  Description of Artificial Sequence: Synthetic oligonucleotide
  Target: ATXN1; (+) strand; PAM type: YTN; PAM sequence: CTT
gccagcctgtgaacaaaaga

SEQ ID NO: 252508 - DNA, 20 bp, Artificial Sequence
  Description of Artificial Sequence: Synthetic oligonucleotide
  Target: ATXN1; (+) strand; PAM type: YTN; PAM sequence: TTG
ccagcctgtgaacaaaagac

SEQ ID NO: 252509 - DNA, 20 bp, Artificial Sequence
  Description of Artificial Sequence: Synthetic oligonucleotide
  Target: ATXN1; (+) strand; PAM type: YTN; PAM sequence: CTG
tgaacaaaagactagccaat

SEQ ID NO: 252510 - DNA, 20 bp, Artificial Sequence
  Description of Artificial Sequence: Synthetic oligonucleotide
  Target: ATXN1; (+) strand; PAM type: YTN; PAM sequence: CTA
gccaatgccacttcttacca

SEQ ID NO: 252511 - DNA, 20 bp, Artificial Sequence
  Description of Artificial Sequence: Synthetic oligonucleotide
  Target: ATXN1; (+) strand; PAM type: YTN; PAM sequence: CTT
cttaccagcaaggtccaaac

SEQ ID NO: 252512 - DNA, 20 bp, Artificial Sequence
  Description of Artificial Sequence: Synthetic oligonucleotide
  Target: ATXN1; (+) strand; PAM type: YTN; PAM sequence: TTC
ttaccagcaaggtccaaaca

SEQ ID NO: 252513 - DNA, 20 bp, Artificial Sequence
  Description of Artificial Sequence: Synthetic oligonucleotide
  Target: ATXN1; (+) strand; PAM type: YTN; PAM sequence: CTT
accagcaaggtccaaacagt

SEQ ID NO: 252514 - DNA, 20 bp, Artificial Sequence
  Description of Artificial Sequence: Synthetic oligonucleotide
  Target: ATXN1; (+) strand; PAM type: YTN; PAM sequence: TTA
ccagcaaggtccaaacagtc

SEQ ID NO: 252515 - DNA, 20 bp, Artificial Sequence
  Description of Artificial Sequence: Synthetic oligonucleotide
  Target: ATXN1; (+) strand; PAM type: YTN; PAM sequence: TTA
tgtggggtatgtagaatgtg

SEQ ID NO: 252516 - DNA, 20 bp, Artificial Sequence
  Description of Artificial Sequence: Synthetic oligonucleotide
  Target: ATXN1; (+) strand; PAM type: YTN; PAM sequence: TTC
tctctgtaccctgtcttgaa

SEQ ID NO: 252517 - DNA, 20 bp, Artificial Sequence
  Description of Artificial Sequence: Synthetic oligonucleotide
  Target: ATXN1; (+) strand; PAM type: YTN; PAM sequence: CTC
tctgtaccctgtcttgaatt

SEQ ID NO: 252518 - DNA, 20 bp, Artificial Sequence
  Description of Artificial Sequence: Synthetic oligonucleotide
  Target: ATXN1; (+) strand; PAM type: YTN; PAM sequence: CTC
tgtaccctgtcttgaattct

SEQ ID NO: 252519 - DNA, 20 bp, Artificial Sequence
  Description of Artificial Sequence: Synthetic oligonucleotide
  Target: ATXN1; (+) strand; PAM type: YTN; PAM sequence: CTG
taccctgtcttgaattctat

SEQ ID NO: 252520 - DNA, 20 bp, Artificial Sequence
  Description of Artificial Sequence: Synthetic oligonucleotide
  Target: ATXN1; (+) strand; PAM type: YTN; PAM sequence: CTG
tcttgaattctattttgcac

SEQ ID NO: 252521 - DNA, 20 bp, Artificial Sequence
  Description of Artificial Sequence: Synthetic oligonucleotide
  Target: ATXN1; (+) strand; PAM type: YTN; PAM sequence: CTT
gaattctattttgcacatcc

SEQ ID NO: 252522 - DNA, 20 bp, Artificial Sequence
  Description of Artificial Sequence: Synthetic oligonucleotide
  Target: ATXN1; (+) strand; PAM type: YTN; PAM sequence: TTG
aattctattttgcacatcca

SEQ ID NO: 252523 - DNA, 20 bp, Artificial Sequence
  Description of Artificial Sequence: Synthetic oligonucleotide
  Target: ATXN1; (+) strand; PAM type: YTN; PAM sequence: TTC
tattttgcacatccaggaaa

SEQ ID NO: 252524 - DNA, 20 bp, Artificial Sequence
  Description of Artificial Sequence: Synthetic oligonucleotide
  Target: ATXN1; (+) strand; PAM type: YTN; PAM sequence: CTA
ttttgcacatccaggaaagc

SEQ ID NO: 252525 - DNA, 20 bp, Artificial Sequence
  Description of Artificial Sequence: Synthetic oligonucleotide
  Target: ATXN1; (+) strand; PAM type: YTN; PAM sequence: TTT
tgcacatccaggaaagccaa

SEQ ID NO: 252526 - DNA, 20 bp, Artificial Sequence
  Description of Artificial Sequence: Synthetic oligonucleotide
  Target: ATXN1; (+) strand; PAM type: YTN; PAM sequence: TTT
gcacatccaggaaagccaag

SEQ ID NO: 252527 - DNA, 20 bp, Artificial Sequence
  Description of Artificial Sequence: Synthetic oligonucleotide
  Target: ATXN1; (+) strand; PAM type: YTN; PAM sequence: TTG
cacatccaggaaagccaaga

SEQ ID NO: 252528 - DNA, 20 bp, Artificial Sequence
  Description of Artificial Sequence: Synthetic oligonucleotide
  Target: ATXN1; (+) strand; PAM type: YTN; PAM sequence: CTG
attgcaacatatatagtcat

SEQ ID NO: 252529 - DNA, 20 bp, Artificial Sequence
  Description of Artificial Sequence: Synthetic oligonucleotide
  Target: ATXN1; (+) strand; PAM type: YTN; PAM sequence: TTG
caacatatatagtcatattt

SEQ ID NO: 252530 - DNA, 20 bp, Artificial Sequence
  Description of Artificial Sequence: Synthetic oligonucleotide
  Target: ATXN1; (+) strand; PAM type: YTN; PAM sequence: TTT
tgataccacagtttggatgg

SEQ ID NO: 252531 - DNA, 20 bp, Artificial Sequence
  Description of Artificial Sequence: Synthetic oligonucleotide
  Target: ATXN1; (+) strand; PAM type: YTN; PAM sequence: TTT
gataccacagtttggatggc

SEQ ID NO: 252532 - DNA, 20 bp, Artificial Sequence
  Description of Artificial Sequence: Synthetic oligonucleotide
  Target: ATXN1; (+) strand; PAM type: YTN; PAM sequence: TTG
ataccacagtttggatggca

SEQ ID NO: 252533 - DNA, 20 bp, Artificial Sequence
  Description of Artificial Sequence: Synthetic oligonucleotide
  Target: ATXN1; (+) strand; PAM type: YTN; PAM sequence: TTT
ggatggcaagattattcaat

SEQ ID NO: 252534 - DNA, 20 bp, Artificial Sequence
  Description of Artificial Sequence: Synthetic oligonucleotide
  Target: ATXN1; (+) strand; PAM type: YTN; PAM sequence: TTG
gatggcaagattattcaatc

SEQ ID NO: 252535 - DNA, 20 bp, Artificial Sequence
  Description of Artificial Sequence: Synthetic oligonucleotide
  Target: ATXN1; (+) strand; PAM type: YTN; PAM sequence: TTA
ttcaatcctttttcctatca

SEQ ID NO: 252536 - DNA, 20 bp, Artificial Sequence
  Description of Artificial Sequence: Synthetic oligonucleotide
  Target: ATXN1; (+) strand; PAM type: YTN; PAM sequence: TTC
aatcctttttcctatcagag

SEQ ID NO: 252537 - DNA, 20 bp, Artificial Sequence
  Description of Artificial Sequence: Synthetic oligonucleotide
  Target: ATXN1; (+) strand; PAM type: YTN; PAM sequence: CTT
tttcctatcagagagcttca

SEQ ID NO: 252538 - DNA, 20 bp, Artificial Sequence
  Description of Artificial Sequence: Synthetic oligonucleotide
  Target: ATXN1; (+) strand; PAM type: YTN; PAM sequence: TTT
ttcctatcagagagcttcat

SEQ ID NO: 252539 - DNA, 20 bp, Artificial Sequence
  Description of Artificial Sequence: Synthetic oligonucleotide
  Target: ATXN1; (+) strand; PAM type: YTN; PAM sequence: TTT
tcctatcagagagcttcatc

SEQ ID NO: 252540 - DNA, 20 bp, Artificial Sequence
  Description of Artificial Sequence: Synthetic oligonucleotide
  Target: ATXN1; (+) strand; PAM type: YTN; PAM sequence: TTT
cctatcagagagcttcatct

SEQ ID NO: 252541 - DNA, 20 bp, Artificial Sequence
  Description of Artificial Sequence: Synthetic oligonucleotide
  Target: ATXN1; (+) strand; PAM type: YTN; PAM sequence: TTC
ctatcagagagcttcatctg

SEQ ID NO: 252542 - DNA, 20 bp, Artificial Sequence
  Description of Artificial Sequence: Synthetic oligonucleotide
  Target: ATXN1; (+) strand; PAM type: YTN; PAM sequence: CTA
tcagagagcttcatctgttt

SEQ ID NO: 252543 - DNA, 20 bp, Artificial Sequence
  Description of Artificial Sequence: Synthetic oligonucleotide
  Target: ATXN1; (+) strand; PAM type: YTN; PAM sequence: CTT
catctgttttctctgacttc

SEQ ID NO: 252544 - DNA, 20 bp, Artificial Sequence
  Description of Artificial Sequence: Synthetic oligonucleotide
  Target: ATXN1; (+) strand; PAM type: YTN; PAM sequence: TTC
atctgttttctctgacttct

SEQ ID NO: 252545 - DNA, 20 bp, Artificial Sequence
  Description of Artificial Sequence: Synthetic oligonucleotide
  Target: ATXN1; (+) strand; PAM type: YTN; PAM sequence: CTG
ttttctctgacttctccatg

SEQ ID NO: 252546 - DNA, 20 bp, Artificial Sequence
  Description of Artificial Sequence: Synthetic oligonucleotide
  Target: ATXN1; (+) strand; PAM type: YTN; PAM sequence: TTT
tctctgacttctccatggat

SEQ ID NO: 252547 - DNA, 20 bp, Artificial Sequence
  Description of Artificial Sequence: Synthetic oligonucleotide
  Target: ATXN1; (+) strand; PAM type: YTN; PAM sequence: TTT
ctctgacttctccatggatc

SEQ ID NO: 252548 - DNA, 20 bp, Artificial Sequence
  Description of Artificial Sequence: Synthetic oligonucleotide
  Target: ATXN1; (+) strand; PAM type: YTN; PAM sequence: TTC
tctgacttctccatggatcc

SEQ ID NO: 252549 - DNA, 20 bp, Artificial Sequence
  Description of Artificial Sequence: Synthetic oligonucleotide
  Target: ATXN1; (+) strand; PAM type: YTN; PAM sequence: CTC
tgacttctccatggatccac

SEQ ID NO: 252550 - DNA, 20 bp, Artificial Sequence
  Description of Artificial Sequence: Synthetic oligonucleotide
  Target: ATXN1; (+) strand; PAM type: YTN; PAM sequence: CTG
acttctccatggatccacaa

SEQ ID NO: 252551 - DNA, 20 bp, Artificial Sequence
  Description of Artificial Sequence: Synthetic oligonucleotide
  Target: ATXN1; (+) strand; PAM type: YTN; PAM sequence: CTT
ctccatggatccacaacagt

SEQ ID NO: 252552 - DNA, 20 bp, Artificial Sequence
  Description of Artificial Sequence: Synthetic oligonucleotide
  Target: ATXN1; (+) strand; PAM type: YTN; PAM sequence: TTC
tccatggatccacaacagtc

SEQ ID NO: 252553 - DNA, 20 bp, Artificial Sequence
  Description of Artificial Sequence: Synthetic oligonucleotide
  Target: ATXN1; (+) strand; PAM type: YTN; PAM sequence: CTC
catggatccacaacagtcaa

SEQ ID NO: 252554 - DNA, 20 bp, Artificial Sequence
  Description of Artificial Sequence: Synthetic oligonucleotide
  Target: ATXN1; (+) strand; PAM type: YTN; PAM sequence: CTT
taaaaaatactcaggacatg

SEQ ID NO: 252555 - DNA, 20 bp, Artificial Sequence
  Description of Artificial Sequence: Synthetic oligonucleotide
  Target: ATXN1; (+) strand; PAM type: YTN; PAM sequence: TTT
aaaaaatactcaggacatgg

SEQ ID NO: 252556 - DNA, 20 bp, Artificial Sequence
  Description of Artificial Sequence: Synthetic oligonucleotide
  Target: ATXN1; (+) strand; PAM type: YTN; PAM sequence: TTA
aaaaatactcaggacatgga

SEQ ID NO: 252557 - DNA, 20 bp, Artificial Sequence
  Description of Artificial Sequence: Synthetic oligonucleotide
  Target: ATXN1; (+) strand; PAM type: YTN; PAM sequence: CTC
aggacatggaccaatacaaa

SEQ ID NO: 252558 - DNA, 20 bp, Artificial Sequence
  Description of Artificial Sequence: Synthetic oligonucleotide
  Target: ATXN1; (+) strand; PAM type: YTN; PAM sequence: TTA
aacaactgaacatggaataa

SEQ ID NO: 252559 - DNA, 20 bp, Artificial Sequence
  Description of Artificial Sequence: Synthetic oligonucleotide
  Target: ATXN1; (+) strand; PAM type: YTN; PAM sequence: CTG
aacatggaataaggccacag

SEQ ID NO: 252560 - DNA, 20 bp, Artificial Sequence
  Description of Artificial Sequence: Synthetic oligonucleotide
  Target: ATXN1; (+) strand; PAM type: YTN; PAM sequence: TTC
tctaaaaagagtatctgacc

SEQ ID NO: 252561 - DNA, 20 bp, Artificial Sequence
  Description of Artificial Sequence: Synthetic oligonucleotide
  Target: ATXN1; (+) strand; PAM type: YTN; PAM sequence: CTC
taaaaagagtatctgacctt

SEQ ID NO: 252562 - DNA, 20 bp, Artificial Sequence
  Description of Artificial Sequence: Synthetic oligonucleotide
  Target: ATXN1; (+) strand; PAM type: YTN; PAM sequence: CTA
aaaagagtatctgaccttgc

SEQ ID NO: 252563 - DNA, 20 bp, Artificial Sequence
  Description of Artificial Sequence: Synthetic oligonucleotide
  Target: ATXN1; (+) strand; PAM type: YTN; PAM sequence: CTG
accttgctcagactggtgtg

SEQ ID NO: 252564 - DNA, 20 bp, Artificial Sequence
  Description of Artificial Sequence: Synthetic oligonucleotide
  Target: ATXN1; (+) strand; PAM type: YTN; PAM sequence: CTT
gctcagactggtgtgaccat

SEQ ID NO: 252565 - DNA, 20 bp, Artificial Sequence
  Description of Artificial Sequence: Synthetic oligonucleotide
  Target: ATXN1; (+) strand; PAM type: YTN; PAM sequence: TTG
ctcagactggtgtgaccatg

SEQ ID NO: 252566 - DNA, 20 bp, Artificial Sequence
  Description of Artificial Sequence: Synthetic oligonucleotide
  Target: ATXN1; (+) strand; PAM type: YTN; PAM sequence: CTC
agactggtgtgaccatgaga

SEQ ID NO: 252567 - DNA, 20 bp, Artificial Sequence
  Description of Artificial Sequence: Synthetic oligonucleotide
  Target: ATXN1; (+) strand; PAM type: YTN; PAM sequence: CTG
gtgtgaccatgagatatgag

SEQ ID NO: 252568 - DNA, 20 bp, Artificial Sequence
  Description of Artificial Sequence: Synthetic oligonucleotide
  Target: ATXN1; (+) strand; PAM type: YTN; PAM sequence: CTC
ttcatattcattcccacttc

SEQ ID NO: 252569 - DNA, 20 bp, Artificial Sequence
  Description of Artificial Sequence: Synthetic oligonucleotide
  Target: ATXN1; (+) strand; PAM type: YTN; PAM sequence: CTT
catattcattcccacttcag

SEQ ID NO: 252570 - DNA, 20 bp, Artificial Sequence
  Description of Artificial Sequence: Synthetic oligonucleotide
  Target: ATXN1; (+) strand; PAM type: YTN; PAM sequence: TTC
atattcattcccacttcagt

SEQ ID NO: 252571 - DNA, 20 bp, Artificial Sequence
  Description of Artificial Sequence: Synthetic oligonucleotide
  Target: ATXN1; (+) strand; PAM type: YTN; PAM sequence: TTC
attcccacttcagttcagcc

SEQ ID NO: 252572 - DNA, 20 bp, Artificial Sequence
  Description of Artificial Sequence: Synthetic oligonucleotide
  Target: ATXN1; (+) strand; PAM type: YTN; PAM sequence: TTC
ccacttcagttcagcctaac

SEQ ID NO: 252573 - DNA, 20 bp, Artificial Sequence
  Description of Artificial Sequence: Synthetic oligonucleotide
  Target: ATXN1; (+) strand; PAM type: YTN; PAM sequence: CTT
cagttcagcctaacacttca

SEQ ID NO: 252574 - DNA, 20 bp, Artificial Sequence
  Description of Artificial Sequence: Synthetic oligonucleotide
  Target: ATXN1; (+) strand; PAM type: YTN; PAM sequence: TTC
agttcagcctaacacttcat

SEQ ID NO: 252575 - DNA, 20 bp, Artificial Sequence
  Description of Artificial Sequence: Synthetic oligonucleotide
  Target: ATXN1; (+) strand; PAM type: YTN; PAM sequence: TTC
agcctaacacttcattcacc

SEQ ID NO: 252576 - DNA, 20 bp, Artificial Sequence
  Description of Artificial Sequence: Synthetic oligonucleotide
  Target: ATXN1; (+) strand; PAM type: YTN; PAM sequence: CTA
acacttcattcaccaaatga

SEQ ID NO: 252577 - DNA, 20 bp, Artificial Sequence
  Description of Artificial Sequence: Synthetic oligonucleotide
  Target: ATXN1; (+) strand; PAM type: YTN; PAM sequence: CTT
cattcaccaaatgagtgatc

SEQ ID NO: 252578 - DNA, 20 bp, Artificial Sequence
  Description of Artificial Sequence: Synthetic oligonucleotide
  Target: ATXN1; (+) strand; PAM type: YTN; PAM sequence: TTC
attcaccaaatgagtgatca

SEQ ID NO: 252579 - DNA, 20 bp, Artificial Sequence
  Description of Artificial Sequence: Synthetic oligonucleotide
  Target: ATXN1; (+) strand; PAM type: YTN; PAM sequence: TTC
accaaatgagtgatcaccaa

SEQ ID NO: 252580 - DNA, 20 bp, Artificial Sequence
  Description of Artificial Sequence: Synthetic oligonucleotide
  Target: ATXN1; (+) strand; PAM type: YTN; PAM sequence: CTG
cctactatgcatcagacata

SEQ ID NO: 252581 - DNA, 20 bp, Artificial Sequence
  Description of Artificial Sequence: Synthetic oligonucleotide
  Target: ATXN1; (+) strand; PAM type: YTN; PAM sequence: CTA
ctatgcatcagacatataaa

SEQ ID NO: 252582 - DNA, 20 bp, Artificial Sequence
  Description of Artificial Sequence: Synthetic oligonucleotide
  Target: ATXN1; (+) strand; PAM type: YTN; PAM sequence: CTA
tgcatcagacatataaaaca

SEQ ID NO: 252583 - DNA, 20 bp, Artificial Sequence
  Description of Artificial Sequence: Synthetic oligonucleotide
  Target: ATXN1; (+) strand; PAM type: YTN; PAM sequence: CTA
aaagacacagttcctgttct

SEQ ID NO: 252584 - DNA, 20 bp, Artificial Sequence
  Description of Artificial Sequence: Synthetic oligonucleotide
  Target: ATXN1; (+) strand; PAM type: YTN; PAM sequence: TTC
ctgttctcaaggagctccat

SEQ ID NO: 252585 - DNA, 20 bp, Artificial Sequence
  Description of Artificial Sequence: Synthetic oligonucleotide
  Target: ATXN1; (+) strand; PAM type: YTN; PAM sequence: CTG
ttctcaaggagctccattga

SEQ ID NO: 252586 - DNA, 20 bp, Artificial Sequence
  Description of Artificial Sequence: Synthetic oligonucleotide
  Target: ATXN1; (+) strand; PAM type: YTN; PAM sequence: TTC
tcaaggagctccattgatat

SEQ ID NO: 252587 - DNA, 20 bp, Artificial Sequence
  Description of Artificial Sequence: Synthetic oligonucleotide
  Target: ATXN1; (+) strand; PAM type: YTN; PAM sequence: CTC
aaggagctccattgatatgg

SEQ ID NO: 252588 - DNA, 20 bp, Artificial Sequence
  Description of Artificial Sequence: Synthetic oligonucleotide
  Target: ATXN1; (+) strand; PAM type: YTN; PAM sequence: CTC
cattgatatggttggcattt

SEQ ID NO: 252589 - DNA, 20 bp, Artificial Sequence
  Description of Artificial Sequence: Synthetic oligonucleotide
  Target: ATXN1; (+) strand; PAM type: YTN; PAM sequence: TTG
atatggttggcatttgtgtc

SEQ ID NO: 252590 - DNA, 20 bp, Artificial Sequence
  Description of Artificial Sequence: Synthetic oligonucleotide
  Target: ATXN1; (+) strand; PAM type: YTN; PAM sequence: TTG
gcatttgtgtccccacccaa

SEQ ID NO: 252591 - DNA, 20 bp, Artificial Sequence
  Description of Artificial Sequence: Synthetic oligonucleotide
  Target: ATXN1; (+) strand; PAM type: YTN; PAM sequence: TTT
gtgtccccacccaaatctca

SEQ ID NO: 252592 - DNA, 20 bp, Artificial Sequence
  Description of Artificial Sequence: Synthetic oligonucleotide
  Target: ATXN1; (+) strand; PAM type: YTN; PAM sequence: TTG
tgtccccacccaaatctcat

SEQ ID NO: 252593 - DNA, 20 bp, Artificial Sequence
  Description of Artificial Sequence: Synthetic oligonucleotide
  Target: ATXN1; (+) strand; PAM type: YTN; PAM sequence: CTC
atgtcaaattgtaatcccca

SEQ ID NO: 252594 - DNA, 20 bp, Artificial Sequence
  Description of Artificial Sequence: Synthetic oligonucleotide
  Target: ATXN1; (+) strand; PAM type: YTN; PAM sequence: TTG
taatccccagtgtttggagg

SEQ ID NO: 252595 - DNA, 20 bp, Artificial Sequence
  Description of Artificial Sequence: Synthetic oligonucleotide
  Target: ATXN1; (+) strand; PAM type: YTN; PAM sequence: TTT
ggaggaagggcctggtggga

SEQ ID NO: 252596 - DNA, 20 bp, Artificial Sequence
  Description of Artificial Sequence: Synthetic oligonucleotide
  Target: ATXN1; (+) strand; PAM type: YTN; PAM sequence: TTG
gaggaagggcctggtgggag

SEQ ID NO: 252597 - DNA, 20 bp, Artificial Sequence
  Description of Artificial Sequence: Synthetic oligonucleotide
  Target: ATXN1; (+) strand; PAM type: YTN; PAM sequence: CTG
gtgggagatgactggatcac

SEQ ID NO: 252598 - DNA, 20 bp, Artificial Sequence
  Description of Artificial Sequence: Synthetic oligonucleotide
  Target: ATXN1; (+) strand; PAM type: YTN; PAM sequence: CTG
gatcacgggcttagatttct

SEQ ID NO: 252599 - DNA, 20 bp, Artificial Sequence
  Description of Artificial Sequence: Synthetic oligonucleotide
  Target: ATXN1; (+) strand; PAM type: YTN; PAM sequence: CTT
agatttctccctctctgttc

SEQ ID NO: 252600 - DNA, 20 bp, Artificial Sequence
  Description of Artificial Sequence: Synthetic oligonucleotide
  Target: ATXN1; (+) strand; PAM type: YTN; PAM sequence: TTA
gatttctccctctctgttct

SEQ ID NO: 252601 - DNA, 20 bp, Artificial Sequence
  Description of Artificial Sequence: Synthetic oligonucleotide
  Target: ATXN1; (+) strand; PAM type: YTN; PAM sequence: TTT
ctccctctctgttctcatga

SEQ ID NO: 252602 - DNA, 20 bp, Artificial Sequence
  Description of Artificial Sequence: Synthetic oligonucleotide
  Target: ATXN1; (+) strand; PAM type: YTN; PAM sequence: TTC
tccctctctgttctcatgat

SEQ ID NO: 252603 - DNA, 20 bp, Artificial Sequence
  Description of Artificial Sequence: Synthetic oligonucleotide
  Target: ATXN1; (+) strand; PAM type: YTN; PAM sequence: CTC
cctctctgttctcatgatag

SEQ ID NO: 252604 - DNA, 20 bp, Artificial Sequence
  Description of Artificial Sequence: Synthetic oligonucleotide
  Target: ATXN1; (+) strand; PAM type: YTN; PAM sequence: CTC
tctgttctcatgatagtgag

SEQ ID NO: 252605 - DNA, 20 bp, Artificial Sequence
  Description of Artificial Sequence: Synthetic oligonucleotide
  Target: ATXN1; (+) strand; PAM type: YTN; PAM sequence: CTC
tgttctcatgatagtgagtt

SEQ ID NO: 252606 - DNA, 20 bp, Artificial Sequence
  Description of Artificial Sequence: Synthetic oligonucleotide
  Target: ATXN1; (+) strand; PAM type: YTN; PAM sequence: CTG
ttctcatgatagtgagttct

SEQ ID NO: 252607 - DNA, 20 bp, Artificial Sequence
  Description of Artificial Sequence: Synthetic oligonucleotide
  Target: ATXN1; (+) strand; PAM type: YTN; PAM sequence: TTC
tcatgatagtgagttctcat

SEQ ID NO: 252608 - DNA, 20 bp, Artificial Sequence
  Description of Artificial Sequence: Synthetic oligonucleotide
  Target: ATXN1; (+) strand; PAM type: YTN; PAM sequence: CTC
atgatagtgagttctcatga

SEQ ID NO: 252609 - DNA, 20 bp, Artificial Sequence
  Description of Artificial Sequence: Synthetic oligonucleotide
  Target: ATXN1; (+) strand; PAM type: YTN; PAM sequence: TTC
tcatgagatctggttgttta

SEQ ID NO: 252610 - DNA, 20 bp, Artificial Sequence
  Description of Artificial Sequence: Synthetic oligonucleotide
  Target: ATXN1; (+) strand; PAM type: YTN; PAM sequence: CTC
atgagatctggttgtttaaa

SEQ ID NO: 252611 - DNA, 20 bp, Artificial Sequence
  Description of Artificial Sequence: Synthetic oligonucleotide
  Target: ATXN1; (+) strand; PAM type: YTN; PAM sequence: CTG
gttgtttaaaagtgtgtagc

SEQ ID NO: 252612 - DNA, 20 bp, Artificial Sequence
  Description of Artificial Sequence: Synthetic oligonucleotide
  Target: ATXN1; (+) strand; PAM type: YTN; PAM sequence: TTG
tttaaaagtgtgtagcacct

SEQ ID NO: 252613 - DNA, 20 bp, Artificial Sequence
  Description of Artificial Sequence: Synthetic oligonucleotide
  Target: ATXN1; (+) strand; PAM type: YTN; PAM sequence: TTT
aaaagtgtgtagcacctccc

SEQ ID NO: 252614 - DNA, 20 bp, Artificial Sequence
  Description of Artificial Sequence: Synthetic oligonucleotide
  Target: ATXN1; (+) strand; PAM type: YTN; PAM sequence: TTA
aaagtgtgtagcacctcccc

SEQ ID NO: 252615 - DNA, 20 bp, Artificial Sequence
  Description of Artificial Sequence: Synthetic oligonucleotide
  Target: ATXN1; (+) strand; PAM type: YTN; PAM sequence: CTC
ccctttcccttcctcctgct

SEQ ID NO: 252616 - DNA, 20 bp, Artificial Sequence
  Description of Artificial Sequence: Synthetic oligonucleotide
  Target: ATXN1; (+) strand; PAM type: YTN; PAM sequence: CTT
tcccttcctcctgctccagc

SEQ ID NO: 252617 - DNA, 20 bp, Artificial Sequence
  Description of Artificial Sequence: Synthetic oligonucleotide
  Target: ATXN1; (+) strand; PAM type: YTN; PAM sequence: TTT
cccttcctcctgctccagcc

SEQ ID NO: 252618 - DNA, 20 bp, Artificial Sequence
  Description of Artificial Sequence: Synthetic oligonucleotide
  Target: ATXN1; (+) strand; PAM type: YTN; PAM sequence: TTC
ccttcctcctgctccagcca

SEQ ID NO: 252619 - DNA, 20 bp, Artificial Sequence
  Description of Artificial Sequence: Synthetic oligonucleotide
  Target: ATXN1; (+) strand; PAM type: YTN; PAM sequence: CTT
cctcctgctccagccacgta

SEQ ID NO: 252620 - DNA, 20 bp, Artificial Sequence
  Description of Artificial Sequence: Synthetic oligonucleotide
  Target: ATXN1; (+) strand; PAM type: YTN; PAM sequence: TTC
ctcctgctccagccacgtag

SEQ ID NO: 252621 - DNA, 20 bp, Artificial Sequence
  Description of Artificial Sequence: Synthetic oligonucleotide
  Target: ATXN1; (+) strand; PAM type: YTN; PAM sequence: CTC
ctgctccagccacgtaggac

SEQ ID NO: 252622 - DNA, 20 bp, Artificial Sequence
  Description of Artificial Sequence: Synthetic oligonucleotide
  Target: ATXN1; (+) strand; PAM type: YTN; PAM sequence: CTG
ctccagccacgtaggacgtg

SEQ ID NO: 252623 - DNA, 20 bp, Artificial Sequence
  Description of Artificial Sequence: Synthetic oligonucleotide
  Target: ATXN1; (+) strand; PAM type: YTN; PAM sequence: CTC
cagccacgtaggacgtgctg

SEQ ID NO: 252624 - DNA, 20 bp, Artificial Sequence
  Description of Artificial Sequence: Synthetic oligonucleotide
  Target: ATXN1; (+) strand; PAM type: YTN; PAM sequence: CTG
gcttccccttctccttctgc

SEQ ID NO: 252625 - DNA, 20 bp, Artificial Sequence
  Description of Artificial Sequence: Synthetic oligonucleotide
  Target: ATXN1; (+) strand; PAM type: YTN; PAM sequence: CTT
ccccttctccttctgccatg

SEQ ID NO: 252626 - DNA, 20 bp, Artificial Sequence
  Description of Artificial Sequence: Synthetic oligonucleotide
  Target: ATXN1; (+) strand; PAM type: YTN; PAM sequence: TTC
cccttctccttctgccatga

SEQ ID NO: 252627 - DNA, 20 bp, Artificial Sequence
  Description of Artificial Sequence: Synthetic oligonucleotide
  Target: ATXN1; (+) strand; PAM type: YTN; PAM sequence: CTT
ctccttctgccatgattgta

SEQ ID NO: 252628 - DNA, 20 bp, Artificial Sequence
  Description of Artificial Sequence: Synthetic oligonucleotide
  Target: ATXN1; (+) strand; PAM type: YTN; PAM sequence: TTC
tccttctgccatgattgtaa

SEQ ID NO: 252629 - DNA, 20 bp, Artificial Sequence
  Description of Artificial Sequence: Synthetic oligonucleotide
  Target: ATXN1; (+) strand; PAM type: YTN; PAM sequence: CTC
cttctgccatgattgtaagt

SEQ ID NO: 252630 - DNA, 20 bp, Artificial Sequence
  Description of Artificial Sequence: Synthetic oligonucleotide
  Target: ATXN1; (+) strand; PAM type: YTN; PAM sequence: CTT
ctgccatgattgtaagtttc

SEQ ID NO: 252631 - DNA, 20 bp, Artificial Sequence
  Description of Artificial Sequence: Synthetic oligonucleotide
  Target: ATXN1; (+) strand; PAM type: YTN; PAM sequence: TTC
tgccatgattgtaagtttcc

SEQ ID NO: 252632 - DNA, 20 bp, Artificial Sequence
  Description of Artificial Sequence: Synthetic oligonucleotide
  Target: ATXN1; (+) strand; PAM type: YTN; PAM sequence: CTG
ccatgattgtaagtttcctg

SEQ ID NO: 252633 - DNA, 20 bp, Artificial Sequence
  Description of Artificial Sequence: Synthetic oligonucleotide
  Target: ATXN1; (+) strand; PAM type: YTN; PAM sequence: TTG
taagtttcctgaggcctccc

SEQ ID NO: 252634 - DNA, 20 bp, Artificial Sequence
  Description of Artificial Sequence: Synthetic oligonucleotide
  Target: ATXN1; (+) strand; PAM type: YTN; PAM sequence: TTT
cctgaggcctccccagccat

SEQ ID NO: 252635 - DNA, 20 bp, Artificial Sequence
  Description of Artificial Sequence: Synthetic oligonucleotide
  Target: ATXN1; (+) strand; PAM type: YTN; PAM sequence: TTC
ctgaggcctccccagccatg

SEQ ID NO: 252636 - DNA, 20 bp, Artificial Sequence
  Description of Artificial Sequence: Synthetic oligonucleotide
  Target: ATXN1; (+) strand; PAM type: YTN; PAM sequence: CTG
aggcctccccagccatgttt

SEQ ID NO: 252637 - DNA, 20 bp, Artificial Sequence
  Description of Artificial Sequence: Synthetic oligonucleotide
  Target: ATXN1; (+) strand; PAM type: YTN; PAM sequence: CTC
cccagccatgtttcctgtac

SEQ ID NO: 252638 - DNA, 20 bp, Artificial Sequence
  Description of Artificial Sequence: Synthetic oligonucleotide
  Target: ATXN1; (+) strand; PAM type: YTN; PAM sequence: TTT
cctgtacagcctgtggaaac

SEQ ID NO: 252639 - DNA, 20 bp, Artificial Sequence
  Description of Artificial Sequence: Synthetic oligonucleotide
  Target: ATXN1; (+) strand; PAM type: YTN; PAM sequence: TTC
ctgtacagcctgtggaaaca

SEQ ID NO: 252640 - DNA, 20 bp, Artificial Sequence
  Description of Artificial Sequence: Synthetic oligonucleotide
  Target: ATXN1; (+) strand; PAM type: YTN; PAM sequence: CTG
tacagcctgtggaaacatga

SEQ ID NO: 252641 - DNA, 20 bp, Artificial Sequence
  Description of Artificial Sequence: Synthetic oligonucleotide
  Target: ATXN1; (+) strand; PAM type: YTN; PAM sequence: CTG
tggaaacatgagccaattaa

SEQ ID NO: 252642 - DNA, 20 bp, Artificial Sequence
  Description of Artificial Sequence: Synthetic oligonucleotide
  Target: ATXN1; (+) strand; PAM type: YTN; PAM sequence: TTA
aacctcttttctttacacat

SEQ ID NO: 252643 - DNA, 20 bp, Artificial Sequence
  Description of Artificial Sequence: Synthetic oligonucleotide
  Target: ATXN1; (+) strand; PAM type: YTN; PAM sequence: CTC
ttttctttacacattatcca

SEQ ID NO: 252644 - DNA, 20 bp, Artificial Sequence
  Description of Artificial Sequence: Synthetic oligonucleotide
  Target: ATXN1; (+) strand; PAM type: YTN; PAM sequence: CTT
ttctttacacattatccagt

SEQ ID NO: 252645 - DNA, 20 bp, Artificial Sequence
  Description of Artificial Sequence: Synthetic oligonucleotide
  Target: ATXN1; (+) strand; PAM type: YTN; PAM sequence: TTT
tctttacacattatccagtc

SEQ ID NO: 252646 - DNA, 20 bp, Artificial Sequence
  Description of Artificial Sequence: Synthetic oligonucleotide
  Target: ATXN1; (+) strand; PAM type: YTN; PAM sequence: TTT
ctttacacattatccagtct

SEQ ID NO: 252647 - DNA, 20 bp, Artificial Sequence
  Description of Artificial Sequence: Synthetic oligonucleotide
  Target: ATXN1; (+) strand; PAM type: YTN; PAM sequence: TTC
tttacacattatccagtctc

SEQ ID NO: 252648 - DNA, 20 bp, Artificial Sequence
  Description of Artificial Sequence: Synthetic oligonucleotide
  Target: ATXN1; (+) strand; PAM type: YTN; PAM sequence: CTT
tacacattatccagtctcag

SEQ ID NO: 252649 - DNA, 20 bp, Artificial Sequence
  Description of Artificial Sequence: Synthetic oligonucleotide
  Target: ATXN1; (+) strand; PAM type: YTN; PAM sequence: TTT
acacattatccagtctcagg

SEQ ID NO: 252650 - DNA, 20 bp, Artificial Sequence
  Description of Artificial Sequence: Synthetic oligonucleotide
  Target: ATXN1; (+) strand; PAM type: YTN; PAM sequence: TTA
cacattatccagtctcaggt

SEQ ID NO: 252651 - DNA, 20 bp, Artificial Sequence
  Description of Artificial Sequence: Synthetic oligonucleotide
  Target: ATXN1; (+) strand; PAM type: YTN; PAM sequence: TTA
tccagtctcaggtagttctc

SEQ ID NO: 252652 - DNA, 20 bp, Artificial Sequence
  Description of Artificial Sequence: Synthetic oligonucleotide
  Target: ATXN1; (+) strand; PAM type: YTN; PAM sequence: CTC
aggtagttctcatagcaatg

SEQ ID NO: 252653 - DNA, 20 bp, Artificial Sequence
  Description of Artificial Sequence: Synthetic oligonucleotide
  Target: ATXN1; (+) strand; PAM type: YTN; PAM sequence: TTC
tcatagcaatgtgagaagag

SEQ ID NO: 252654 - DNA, 20 bp, Artificial Sequence
  Description of Artificial Sequence: Synthetic oligonucleotide
  Target: ATXN1; (+) strand; PAM type: YTN; PAM sequence: CTC
atagcaatgtgagaagagac

SEQ ID NO: 252655 - DNA, 20 bp, Artificial Sequence
  Description of Artificial Sequence: Synthetic oligonucleotide
  Target: ATXN1; (+) strand; PAM type: YTN; PAM sequence: CTA
atacatctgtatccagtgtg

SEQ ID NO: 252656 - DNA, 20 bp, Artificial Sequence
  Description of Artificial Sequence: Synthetic oligonucleotide
  Target: ATXN1; (+) strand; PAM type: YTN; PAM sequence: CTG
tatccagtgtgcagagatgg

SEQ ID NO: 252657 - DNA, 20 bp, Artificial Sequence
  Description of Artificial Sequence: Synthetic oligonucleotide
  Target: ATXN1; (+) strand; PAM type: YTN; PAM sequence: CTA
aaaatcttacatatgagttt

SEQ ID NO: 252658 - DNA, 20 bp, Artificial Sequence
  Description of Artificial Sequence: Synthetic oligonucleotide
  Target: ATXN1; (+) strand; PAM type: YTN; PAM sequence: CTT
acatatgagtttcatgggtg

SEQ ID NO: 252659 - DNA, 20 bp, Artificial Sequence
  Description of Artificial Sequence: Synthetic oligonucleotide
  Target: ATXN1; (+) strand; PAM type: YTN; PAM sequence: TTA
catatgagtttcatgggtgg

SEQ ID NO: 252660 - DNA, 20 bp, Artificial Sequence
  Description of Artificial Sequence: Synthetic oligonucleotide
  Target: ATXN1; (+) strand; PAM type: YTN; PAM sequence: TTT
catgggtgggaagcacagag

SEQ ID NO: 252661 - DNA, 20 bp, Artificial Sequence
  Description of Artificial Sequence: Synthetic oligonucleotide
  Target: ATXN1; (+) strand; PAM type: YTN; PAM sequence: TTC
atgggtgggaagcacagagt

SEQ ID NO: 252662 - DNA, 20 bp, Artificial Sequence
  Description of Artificial Sequence: Synthetic oligonucleotide
  Target: ATXN1; (+) strand; PAM type: YTN; PAM sequence: CTC
agtgagaccaggagggaaaa

SEQ ID NO: 252663 - DNA, 20 bp, Artificial Sequence
  Description of Artificial Sequence: Synthetic oligonucleotide
  Target: ATXN1; (+) strand; PAM type: YTN; PAM sequence: TTA
gggtgggctccttggagctg

SEQ ID NO: 252664 - DNA, 20 bp, Artificial Sequence
  Description of Artificial Sequence: Synthetic oligonucleotide
  Target: ATXN1; (+) strand; PAM type: YTN; PAM sequence: CTC
cttggagctgatggcagggt

SEQ ID NO: 252665 - DNA, 20 bp, Artificial Sequence
  Description of Artificial Sequence: Synthetic oligonucleotide
  Target: ATXN1; (+) strand; PAM type: YTN; PAM sequence: CTT
ggagctgatggcagggttga

SEQ ID NO: 252666 - DNA, 20 bp, Artificial Sequence
  Description of Artificial Sequence: Synthetic oligonucleotide
  Target: ATXN1; (+) strand; PAM type: YTN; PAM sequence: TTG
gagctgatggcagggttgag

SEQ ID NO: 252667 - DNA, 20 bp, Artificial Sequence
  Description of Artificial Sequence: Synthetic oligonucleotide
  Target: ATXN1; (+) strand; PAM type: YTN; PAM sequence: CTG
atggcagggttgagttttga

SEQ ID NO: 252668 - DNA, 20 bp, Artificial Sequence
  Description of Artificial Sequence: Synthetic oligonucleotide
  Target: ATXN1; (+) strand; PAM type: YTN; PAM sequence: TTG
agttttgaagagtacacagg

SEQ ID NO: 252669 - DNA, 20 bp, Artificial Sequence
  Description of Artificial Sequence: Synthetic oligonucleotide
  Target: ATXN1; (+) strand; PAM type: YTN; PAM sequence: TTT
tgaagagtacacaggaatgt

SEQ ID NO: 252670 - DNA, 20 bp, Artificial Sequence
  Description of Artificial Sequence: Synthetic oligonucleotide
  Target: ATXN1; (+) strand; PAM type: YTN; PAM sequence: TTT
gaagagtacacaggaatgtg

SEQ ID NO: 252671 - DNA, 20 bp, Artificial Sequence
  Description of Artificial Sequence: Synthetic oligonucleotide
  Target: ATXN1; (+) strand; PAM type: YTN; PAM sequence: TTG
aagagtacacaggaatgtgt

SEQ ID NO: 252672 - DNA, 20 bp, Artificial Sequence
  Description of Artificial Sequence: Synthetic oligonucleotide
  Target: ATXN1; (+) strand; PAM type: YTN; PAM sequence: CTG
catgtgatgtgagagggaac

SEQ ID NO: 252673 - DNA, 20 bp, Artificial Sequence
  Description of Artificial Sequence: Synthetic oligonucleotide
  Target: ATXN1; (+) strand; PAM type: YTN; PAM sequence: TTG
tctagacagaggagggagct

SEQ ID NO: 252674 - DNA, 20 bp, Artificial Sequence
  Description of Artificial Sequence: Synthetic oligonucleotide
  Target: ATXN1; (+) strand; PAM type: YTN; PAM sequence: CTA
gacagaggagggagctcatg

SEQ ID NO: 252675 - DNA, 20 bp, Artificial Sequence
  Description of Artificial Sequence: Synthetic oligonucleotide
  Target: ATXN1; (+) strand; PAM type: YTN; PAM sequence: CTC
atgcagagtcacataagggg

SEQ ID NO: 252676 - DNA, 20 bp, Artificial Sequence
  Description of Artificial Sequence: Synthetic oligonucleotide
  Target: ATXN1; (+) strand; PAM type: YTN; PAM sequence: TTC
agggaagcacaagtatggca

SEQ ID NO: 252677 - DNA, 20 bp, Artificial Sequence
  Description of Artificial Sequence: Synthetic oligonucleotide
  Target: ATXN1; (+) strand; PAM type: YTN; PAM sequence: CTT
ctctccccaagatatctctt

SEQ ID NO: 252678 - DNA, 20 bp, Artificial Sequence
  Description of Artificial Sequence: Synthetic oligonucleotide
  Target: ATXN1; (+) strand; PAM type: YTN; PAM sequence: TTC
tctccccaagatatctcttg

SEQ ID NO: 252679 - DNA, 20 bp, Artificial Sequence
  Description of Artificial Sequence: Synthetic oligonucleotide
  Target: ATXN1; (+) strand; PAM type: YTN; PAM sequence: CTC
tccccaagatatctcttgaa

SEQ ID NO: 252680 - DNA, 20 bp, Artificial Sequence
  Description of Artificial Sequence: Synthetic oligonucleotide
  Target: ATXN1; (+) strand; PAM type: YTN; PAM sequence: CTC
cccaagatatctcttgaagg

SEQ ID NO: 252681 - DNA, 20 bp, Artificial Sequence
  Description of Artificial Sequence: Synthetic oligonucleotide
  Target: ATXN1; (+) strand; PAM type: YTN; PAM sequence: CTC
ttgaaggtatggagaatctc

SEQ ID NO: 252682 - DNA, 20 bp, Artificial Sequence
  Description of Artificial Sequence: Synthetic oligonucleotide
  Target: ATXN1; (+) strand; PAM type: YTN; PAM sequence: CTT
gaaggtatggagaatctcag

SEQ ID NO: 252683 - DNA, 20 bp, Artificial Sequence
  Description of Artificial Sequence: Synthetic oligonucleotide
  Target: ATXN1; (+) strand; PAM type: YTN; PAM sequence: TTG
aaggtatggagaatctcaga

SEQ ID NO: 252684 - DNA, 20 bp, Artificial Sequence
  Description of Artificial Sequence: Synthetic oligonucleotide
  Target: ATXN1; (+) strand; PAM type: YTN; PAM sequence: CTC
agaagggttaggcaggaaca

SEQ ID NO: 252685 - DNA, 20 bp, Artificial Sequence
  Description of Artificial Sequence: Synthetic oligonucleotide
  Target: ATXN1; (+) strand; PAM type: YTN; PAM sequence: TTA
ggcaggaacattttttgatt

SEQ ID NO: 252686 - DNA, 20 bp, Artificial Sequence
  Description of Artificial Sequence: Synthetic oligonucleotide
  Target: ATXN1; (+) strand; PAM type: YTN; PAM sequence: TTT
tttgattaaaaatgtcactc

SEQ ID NO: 252687 - DNA, 20 bp, Artificial Sequence
  Description of Artificial Sequence: Synthetic oligonucleotide
  Target: ATXN1; (+) strand; PAM type: YTN; PAM sequence: TTT
ttgattaaaaatgtcactct

SEQ ID NO: 252688 - DNA, 20 bp, Artificial Sequence
  Description of Artificial Sequence: Synthetic oligonucleotide
  Target: ATXN1; (+) strand; PAM type: YTN; PAM sequence: TTT
tgattaaaaatgtcactctg

SEQ ID NO: 252689 - DNA, 20 bp, Artificial Sequence
  Description of Artificial Sequence: Synthetic oligonucleotide
  Target: ATXN1; (+) strand; PAM type: YTN; PAM sequence: TTT
gattaaaaatgtcactctgg

SEQ ID NO: 252690 - DNA, 20 bp, Artificial Sequence
  Description of Artificial Sequence: Synthetic oligonucleotide
  Target: ATXN1; (+) strand; PAM type: YTN; PAM sequence: TTG
attaaaaatgtcactctggt

SEQ ID NO: 252691 - DNA, 20 bp, Artificial Sequence
  Description of Artificial Sequence: Synthetic oligonucleotide
  Target: ATXN1; (+) strand; PAM type: YTN; PAM sequence: TTA
aaaatgtcactctggtcata

SEQ ID NO: 252692 - DNA, 20 bp, Artificial Sequence
  Description of Artificial Sequence: Synthetic oligonucleotide
  Target: ATXN1; (+) strand; PAM type: YTN; PAM sequence: CTC
tggtcatagagtagaagatg

SEQ ID NO: 252693 - DNA, 20 bp, Artificial Sequence
  Description of Artificial Sequence: Synthetic oligonucleotide
  Target: ATXN1; (+) strand; PAM type: YTN; PAM sequence: CTG
gtcatagagtagaagatgga

SEQ ID NO: 252694 - DNA, 20 bp, Artificial Sequence
  Description of Artificial Sequence: Synthetic oligonucleotide
  Target: ATXN1; (+) strand; PAM type: YTN; PAM sequence: TTC
tacaggcaaggcaaacagtc

SEQ ID NO: 252695 - DNA, 20 bp, Artificial Sequence
  Description of Artificial Sequence: Synthetic oligonucleotide
  Target: ATXN1; (+) strand; PAM type: YTN; PAM sequence: CTA
caggcaaggcaaacagtcgg

SEQ ID NO: 252696 - DNA, 20 bp, Artificial Sequence
  Description of Artificial Sequence: Synthetic oligonucleotide
  Target: ATXN1; (+) strand; PAM type: YTN; PAM sequence: CTT
gctgcaatgccactgagctg

SEQ ID NO: 252697 - DNA, 20 bp, Artificial Sequence
  Description of Artificial Sequence: Synthetic oligonucleotide
  Target: ATXN1; (+) strand; PAM type: YTN; PAM sequence: TTG
ctgcaatgccactgagctgt

SEQ ID NO: 252698 - DNA, 20 bp, Artificial Sequence
  Description of Artificial Sequence: Synthetic oligonucleotide
  Target: ATXN1; (+) strand; PAM type: YTN; PAM sequence: CTG
caatgccactgagctgtcat

SEQ ID NO: 252699 - DNA, 20 bp, Artificial Sequence
  Description of Artificial Sequence: Synthetic oligonucleotide
  Target: ATXN1; (+) strand; PAM type: YTN; PAM sequence: CTG
agctgtcatcaggtttggcc

SEQ ID NO: 252700 - DNA, 20 bp, Artificial Sequence
  Description of Artificial Sequence: Synthetic oligonucleotide
  Target: ATXN1; (+) strand; PAM type: YTN; PAM sequence: CTG
tcatcaggtttggcctgctg

SEQ ID NO: 252701 - DNA, 20 bp, Artificial Sequence
  Description of Artificial Sequence: Synthetic oligonucleotide
  Target: ATXN1; (+) strand; PAM type: YTN; PAM sequence: TTT
ggcctgctgcaggggcagta

SEQ ID NO: 252702 - DNA, 20 bp, Artificial Sequence
  Description of Artificial Sequence: Synthetic oligonucleotide
  Target: ATXN1; (+) strand; PAM type: YTN; PAM sequence: TTG
gcctgctgcaggggcagtaa

SEQ ID NO: 252703 - DNA, 20 bp, Artificial Sequence
  Description of Artificial Sequence: Synthetic oligonucleotide
  Target: ATXN1; (+) strand; PAM type: YTN; PAM sequence: CTG
ctgcaggggcagtaagcatg

SEQ ID NO: 252704 - DNA, 20 bp, Artificial Sequence
  Description of Artificial Sequence: Synthetic oligonucleotide
  Target: ATXN1; (+) strand; PAM type: YTN; PAM sequence: CTG
caggggcagtaagcatggag

SEQ ID NO: 252705 - DNA, 20 bp, Artificial Sequence
  Description of Artificial Sequence: Synthetic oligonucleotide
  Target: ATXN1; (+) strand; PAM type: YTN; PAM sequence: CTC
agcaccaaggctgctgaatg

SEQ ID NO: 252706 - DNA, 20 bp, Artificial Sequence
  Description of Artificial Sequence: Synthetic oligonucleotide
  Target: ATXN1; (+) strand; PAM type: YTN; PAM sequence: CTG
ctgaatggctgggcaggggc

SEQ ID NO: 252707 - DNA, 20 bp, Artificial Sequence
  Description of Artificial Sequence: Synthetic oligonucleotide
  Target: ATXN1; (+) strand; PAM type: YTN; PAM sequence: CTG
aatggctgggcaggggcaca

SEQ ID NO: 252708 - DNA, 20 bp, Artificial Sequence
  Description of Artificial Sequence: Synthetic oligonucleotide
  Target: ATXN1; (+) strand; PAM type: YTN; PAM sequence: CTG
ggcaggggcacatggaggaa

SEQ ID NO: 252709 - DNA, 20 bp, Artificial Sequence
  Description of Artificial Sequence: Synthetic oligonucleotide
  Target: ATXN1; (+) strand; PAM type: YTN; PAM sequence: CTT
ctggcttggctagtgccatt

SEQ ID NO: 252710 - DNA, 20 bp, Artificial Sequence
  Description of Artificial Sequence: Synthetic oligonucleotide
  Target: ATXN1; (+) strand; PAM type: YTN; PAM sequence: TTC
tggcttggctagtgccattt

SEQ ID NO: 252711 - DNA, 20 bp, Artificial Sequence
  Description of Artificial Sequence: Synthetic oligonucleotide
  Target: ATXN1; (+) strand; PAM type: YTN; PAM sequence: CTG
gcttggctagtgccatttgc

SEQ ID NO: 252712 - DNA, 20 bp, Artificial Sequence
  Description of Artificial Sequence: Synthetic oligonucleotide
  Target: ATXN1; (+) strand; PAM type: YTN; PAM sequence: CTT
ggctagtgccatttgcacaa

SEQ ID NO: 252713 - DNA, 20 bp, Artificial Sequence
  Description of Artificial Sequence: Synthetic oligonucleotide
  Target: ATXN1; (+) strand; PAM type: YTN; PAM sequence: TTG
gctagtgccatttgcacaag

SEQ ID NO: 252714 - DNA, 20 bp, Artificial Sequence
  Description of Artificial Sequence: Synthetic oligonucleotide
  Target: ATXN1; (+) strand; PAM type: YTN; PAM sequence: CTA
gtgccatttgcacaagagat

SEQ ID NO: 252715 - DNA, 20 bp, Artificial Sequence
  Description of Artificial Sequence: Synthetic oligonucleotide
  Target: ATXN1; (+) strand; PAM type: YTN; PAM sequence: TTT
gcacaagagatatgggagaa

SEQ ID NO: 252716 - DNA, 20 bp, Artificial Sequence
  Description of Artificial Sequence: Synthetic oligonucleotide
  Target: ATXN1; (+) strand; PAM type: YTN; PAM sequence: TTG
cacaagagatatgggagaaa

SEQ ID NO: 252717 - DNA, 20 bp, Artificial Sequence
  Description of Artificial Sequence: Synthetic oligonucleotide
  Target: ATXN1; (+) strand; PAM type: YTN; PAM sequence: CTA
gctcctttctaactcagtgc

SEQ ID NO: 252718 - DNA, 20 bp, Artificial Sequence
  Description of Artificial Sequence: Synthetic oligonucleotide
  Target: ATXN1; (+) strand; PAM type: YTN; PAM sequence: CTC
ctttctaactcagtgcctta

SEQ ID NO: 252719 - DNA, 20 bp, Artificial Sequence
  Description of Artificial Sequence: Synthetic oligonucleotide
  Target: ATXN1; (+) strand; PAM type: YTN; PAM sequence: CTT
tctaactcagtgccttaatt

SEQ ID NO: 252720 - DNA, 20 bp, Artificial Sequence
  Description of Artificial Sequence: Synthetic oligonucleotide
  Target: ATXN1; (+) strand; PAM type: YTN; PAM sequence: TTT
ctaactcagtgccttaattt

SEQ ID NO: 252721 - DNA, 20 bp, Artificial Sequence
  Description of Artificial Sequence: Synthetic oligonucleotide
  Target: ATXN1; (+) strand; PAM type: YTN; PAM sequence: TTC
taactcagtgccttaatttc

SEQ ID NO: 252722 - DNA, 20 bp, Artificial Sequence
  Description of Artificial Sequence: Synthetic oligonucleotide
  Target: ATXN1; (+) strand; PAM type: YTN; PAM sequence: CTA
actcagtgccttaatttctc

SEQ ID NO: 252723 - DNA, 20 bp, Artificial Sequence
  Description of Artificial Sequence: Synthetic oligonucleotide
  Target: ATXN1; (+) strand; PAM type: YTN; PAM sequence: CTC
agtgccttaatttctcgttt

SEQ ID NO: 252724 - DNA, 20 bp, Artificial Sequence
  Description of Artificial Sequence: Synthetic oligonucleotide
  Target: ATXN1; (+) strand; PAM type: YTN; PAM sequence: CTT
aatttctcgttttacttcta

SEQ ID NO: 252725 - DNA, 20 bp, Artificial Sequence
  Description of Artificial Sequence: Synthetic oligonucleotide
  Target: ATXN1; (+) strand; PAM type: YTN; PAM sequence: TTA
atttctcgttttacttctag

SEQ ID NO: 252726 - DNA, 20 bp, Artificial Sequence
  Description of Artificial Sequence: Synthetic oligonucleotide
  Target: ATXN1; (+) strand; PAM type: YTN; PAM sequence: TTT
ctcgttttacttctaggata

SEQ ID NO: 252727 - DNA, 20 bp, Artificial Sequence
  Description of Artificial Sequence: Synthetic oligonucleotide
  Target: ATXN1; (+) strand; PAM type: YTN; PAM sequence: TTC
tcgttttacttctaggataa

SEQ ID NO: 252728 - DNA, 20 bp, Artificial Sequence
  Description of Artificial Sequence: Synthetic oligonucleotide
  Target: ATXN1; (+) strand; PAM type: YTN; PAM sequence: CTC
gttttacttctaggataaag

SEQ ID NO: 252729 - DNA, 20 bp, Artificial Sequence
  Description of Artificial Sequence: Synthetic oligonucleotide
  Target: ATXN1; (+) strand; PAM type: YTN; PAM sequence: TTT
tacttctaggataaagttta

SEQ ID NO: 252730 - DNA, 20 bp, Artificial Sequence
  Description of Artificial Sequence: Synthetic oligonucleotide
  Target: ATXN1; (+) strand; PAM type: YTN; PAM sequence: TTT
acttctaggataaagtttaa

SEQ ID NO: 252731 - DNA, 20 bp, Artificial Sequence
  Description of Artificial Sequence: Synthetic oligonucleotide
  Target: ATXN1; (+) strand; PAM type: YTN; PAM sequence: TTA
cttctaggataaagtttaaa

SEQ ID NO: 252732 - DNA, 20 bp, Artificial Sequence
  Description of Artificial Sequence: Synthetic oligonucleotide
  Target: ATXN1; (+) strand; PAM type: YTN; PAM sequence: CTT
ctaggataaagtttaaaatc

SEQ ID NO: 252733 - DNA, 20 bp, Artificial Sequence
  Description of Artificial Sequence: Synthetic oligonucleotide
  Target: ATXN1; (+) strand; PAM type: YTN; PAM sequence: TTC
taggataaagtttaaaatct

SEQ ID NO: 252734 - DNA, 20 bp, Artificial Sequence
  Description of Artificial Sequence: Synthetic oligonucleotide
  Target: ATXN1; (+) strand; PAM type: YTN; PAM sequence: CTA
ggataaagtttaaaatctct

SEQ ID NO: 252735 - DNA, 20 bp, Artificial Sequence
  Description of Artificial Sequence: Synthetic oligonucleotide
  Target: ATXN1; (+) strand; PAM type: YTN; PAM sequence: TTT
aaaatctctaacttgacgct

SEQ ID NO: 252736 - DNA, 20 bp, Artificial Sequence
  Description of Artificial Sequence: Synthetic oligonucleotide
  Target: ATXN1; (+) strand; PAM type: YTN; PAM sequence: TTA
aaatctctaacttgacgctg

SEQ ID NO: 252737 - DNA, 20 bp, Artificial Sequence
  Description of Artificial Sequence: Synthetic oligonucleotide
  Target: ATXN1; (+) strand; PAM type: YTN; PAM sequence: CTC
taacttgacgctgaaagttc

SEQ ID NO: 252738 - DNA, 20 bp, Artificial Sequence
  Description of Artificial Sequence: Synthetic oligonucleotide
  Target: ATXN1; (+) strand; PAM type: YTN; PAM sequence: CTA
acttgacgctgaaagttctc

SEQ ID NO: 252739 - DNA, 20 bp, Artificial Sequence
  Description of Artificial Sequence: Synthetic oligonucleotide
  Target: ATXN1; (+) strand; PAM type: YTN; PAM sequence: CTT
gacgctgaaagttctctaca

SEQ ID NO: 252740 - DNA, 20 bp, Artificial Sequence
  Description of Artificial Sequence: Synthetic oligonucleotide
  Target: ATXN1; (+) strand; PAM type: YTN; PAM sequence: TTG
acgctgaaagttctctacaa

SEQ ID NO: 252741 - DNA, 20 bp, Artificial Sequence
  Description of Artificial Sequence: Synthetic oligonucleotide
  Target: ATXN1; (+) strand; PAM type: YTN; PAM sequence: CTG
aaagttctctacaatccccc

SEQ ID NO: 252742 - DNA, 20 bp, Artificial Sequence
  Description of Artificial Sequence: Synthetic oligonucleotide
  Target: ATXN1; (+) strand; PAM type: YTN; PAM sequence: TTC
tctacaatccccctacatgc

SEQ ID NO: 252743 - DNA, 20 bp, Artificial Sequence
  Description of Artificial Sequence: Synthetic oligonucleotide
  Target: ATXN1; (+) strand; PAM type: YTN; PAM sequence: CTC
tacaatccccctacatgcag

SEQ ID NO: 252744 - DNA, 20 bp, Artificial Sequence
  Description of Artificial Sequence: Synthetic oligonucleotide
  Target: ATXN1; (+) strand; PAM type: YTN; PAM sequence: CTA
caatccccctacatgcagta

SEQ ID NO: 252745 - DNA, 20 bp, Artificial Sequence
  Description of Artificial Sequence: Synthetic oligonucleotide
  Target: ATXN1; (+) strand; PAM type: YTN; PAM sequence: CTA
catgcagtaggtactcgata

SEQ ID NO: 252746 - DNA, 20 bp, Artificial Sequence
  Description of Artificial Sequence: Synthetic oligonucleotide
  Target: ATXN1; (+) strand; PAM type: YTN; PAM sequence: CTC
gatacataccagttgattca

SEQ ID NO: 252747 - DNA, 20 bp, Artificial Sequence
  Description of Artificial Sequence: Synthetic oligonucleotide
  Target: ATXN1; (+) strand; PAM type: YTN; PAM sequence: TTG
attcaacaactgaaacaaac

SEQ ID NO: 252748 - DNA, 20 bp, Artificial Sequence
  Description of Artificial Sequence: Synthetic oligonucleotide
  Target: ATXN1; (+) strand; PAM type: YTN; PAM sequence: TTC
aacaactgaaacaaacacac

SEQ ID NO: 252749 - DNA, 20 bp, Artificial Sequence
  Description of Artificial Sequence: Synthetic oligonucleotide
  Target: ATXN1; (+) strand; PAM type: YTN; PAM sequence: CTG
aaacaaacacacaaaaataa

SEQ ID NO: 252750 - DNA, 20 bp, Artificial Sequence
  Description of Artificial Sequence: Synthetic oligonucleotide
  Target: ATXN1; (+) strand; PAM type: YTN; PAM sequence: CTT
tctctatctaacatatcaat

SEQ ID NO: 252751 - DNA, 20 bp, Artificial Sequence
  Description of Artificial Sequence: Synthetic oligonucleotide
  Target: ATXN1; (+) strand; PAM type: YTN; PAM sequence: TTT
ctctatctaacatatcaata

SEQ ID NO: 252752 - DNA, 20 bp, Artificial Sequence
  Description of Artificial Sequence: Synthetic oligonucleotide
  Target: ATXN1; (+) strand; PAM type: YTN; PAM sequence: TTC
tctatctaacatatcaatat

SEQ ID NO: 252753 - DNA, 20 bp, Artificial Sequence
  Description of Artificial Sequence: Synthetic oligonucleotide
  Target: ATXN1; (+) strand; PAM type: YTN; PAM sequence: CTC
tatctaacatatcaatattt

SEQ ID NO: 252754 - DNA, 20 bp, Artificial Sequence
  Description of Artificial Sequence: Synthetic oligonucleotide
  Target: ATXN1; (+) strand; PAM type: YTN; PAM sequence: CTA
tctaacatatcaatattttt

SEQ ID NO: 252755 - DNA, 20 bp, Artificial Sequence
  Description of Artificial Sequence: Synthetic oligonucleotide
  Target: ATXN1; (+) strand; PAM type: YTN; PAM sequence: CTA
acatatcaatatttttctga

SEQ ID NO: 252756 - DNA, 20 bp, Artificial Sequence
  Description of Artificial Sequence: Synthetic oligonucleotide
  Target: ATXN1; (+) strand; PAM type: YTN; PAM sequence: TTT
ttctgattacaggtttggct

SEQ ID NO: 252757 - DNA, 20 bp, Artificial Sequence
  Description of Artificial Sequence: Synthetic oligonucleotide
  Target: ATXN1; (+) strand; PAM type: YTN; PAM sequence: TTT
tctgattacaggtttggctt

SEQ ID NO: 252758 - DNA, 20 bp, Artificial Sequence
  Description of Artificial Sequence: Synthetic oligonucleotide
  Target: ATXN1; (+) strand; PAM type: YTN; PAM sequence: TTT
ctgattacaggtttggctta

SEQ ID NO: 252759 - DNA, 20 bp, Artificial Sequence
  Description of Artificial Sequence: Synthetic oligonucleotide
  Target: ATXN1; (+) strand; PAM type: YTN; PAM sequence: TTC
tgattacaggtttggcttac

SEQ ID NO: 252760 - DNA, 20 bp, Artificial Sequence
  Description of Artificial Sequence: Synthetic oligonucleotide
  Target: ATXN1; (+) strand; PAM type: YTN; PAM sequence: CTG
attacaggtttggcttacta

SEQ ID NO: 252761 - DNA, 20 bp, Artificial Sequence
  Description of Artificial Sequence: Synthetic oligonucleotide
  Target: ATXN1; (+) strand; PAM type: YTN; PAM sequence: TTA
caggtttggcttactacttt

SEQ ID NO: 252762 - DNA, 20 bp, Artificial Sequence
  Description of Artificial Sequence: Synthetic oligonucleotide
  Target: ATXN1; (+) strand; PAM type: YTN; PAM sequence: TTT
ggcttactactttgcctttg

SEQ ID NO: 252763 - DNA, 20 bp, Artificial Sequence
  Description of Artificial Sequence: Synthetic oligonucleotide
  Target: ATXN1; (+) strand; PAM type: YTN; PAM sequence: TTG
gcttactactttgcctttgt

SEQ ID NO: 252764 - DNA, 20 bp, Artificial Sequence
  Description of Artificial Sequence: Synthetic oligonucleotide
  Target: ATXN1; (+) strand; PAM type: YTN; PAM sequence: CTT
actactttgcctttgtgaaa

SEQ ID NO: 252765 - DNA, 20 bp, Artificial Sequence
  Description of Artificial Sequence: Synthetic oligonucleotide
  Target: ATXN1; (+) strand; PAM type: YTN; PAM sequence: TTA
ctactttgcctttgtgaaag

SEQ ID NO: 252766 - DNA, 20 bp, Artificial Sequence
  Description of Artificial Sequence: Synthetic oligonucleotide
  Target: ATXN1; (+) strand; PAM type: YTN; PAM sequence: CTA
ctttgcctttgtgaaagaag

SEQ ID NO: 252767 - DNA, 20 bp, Artificial Sequence
  Description of Artificial Sequence: Synthetic oligonucleotide
  Target: ATXN1; (+) strand; PAM type: YTN; PAM sequence: CTT
tgcctttgtgaaagaagaga

SEQ ID NO: 252768 - DNA, 20 bp, Artificial Sequence
  Description of Artificial Sequence: Synthetic oligonucleotide
  Target: ATXN1; (+) strand; PAM type: YTN; PAM sequence: TTT
gcctttgtgaaagaagagaa

SEQ ID NO: 252769 - DNA, 20 bp, Artificial Sequence
  Description of Artificial Sequence: Synthetic oligonucleotide
  Target: ATXN1; (+) strand; PAM type: YTN; PAM sequence: TTG
cctttgtgaaagaagagaaa

SEQ ID NO: 252770 - DNA, 20 bp, Artificial Sequence
  Description of Artificial Sequence: Synthetic oligonucleotide
  Target: ATXN1; (+) strand; PAM type: YTN; PAM sequence: CTT
tgtgaaagaagagaaatagc

SEQ ID NO: 252771 - DNA, 20 bp, Artificial Sequence
  Description of Artificial Sequence: Synthetic oligonucleotide
  Target: ATXN1; (+) strand; PAM type: YTN; PAM sequence: TTT
gtgaaagaagagaaatagct

SEQ ID NO: 252772 - DNA, 20 bp, Artificial Sequence
  Description of Artificial Sequence: Synthetic oligonucleotide
  Target: ATXN1; (+) strand; PAM type: YTN; PAM sequence: TTG
tgaaagaagagaaatagctt

SEQ ID NO: 252773 - DNA, 20 bp, Artificial Sequence
  Description of Artificial Sequence: Synthetic oligonucleotide
  Target: ATXN1; (+) strand; PAM type: YTN; PAM sequence: CTT
gcaacttattcaaagaataa

SEQ ID NO: 252774 - DNA, 20 bp, Artificial Sequence
  Description of Artificial Sequence: Synthetic oligonucleotide
  Target: ATXN1; (+) strand; PAM type: YTN; PAM sequence: TTG
caacttattcaaagaataag

SEQ ID NO: 252775 - DNA, 20 bp, Artificial Sequence
  Description of Artificial Sequence: Synthetic oligonucleotide
  Target: ATXN1; (+) strand; PAM type: YTN; PAM sequence: CTT
attcaaagaataagataagt

SEQ ID NO: 252776 - DNA, 20 bp, Artificial Sequence
  Description of Artificial Sequence: Synthetic oligonucleotide
  Target: ATXN1; (+) strand; PAM type: YTN; PAM sequence: TTA
ttcaaagaataagataagtg

SEQ ID NO: 252777 - DNA, 20 bp, Artificial Sequence
  Description of Artificial Sequence: Synthetic oligonucleotide
  Target: ATXN1; (+) strand; PAM type: YTN; PAM sequence: TTC
aaagaataagataagtgcaa

SEQ ID NO: 252778 - DNA, 20 bp, Artificial Sequence
  Description of Artificial Sequence: Synthetic oligonucleotide
  Target: ATXN1; (+) strand; PAM type: YTN; PAM sequence: TTT
ttctgataacgtgctaatct

SEQ ID NO: 252779 - DNA, 20 bp, Artificial Sequence
  Description of Artificial Sequence: Synthetic oligonucleotide
  Target: ATXN1; (+) strand; PAM type: YTN; PAM sequence: TTT
tctgataacgtgctaatctc

SEQ ID NO: 252780 - DNA, 20 bp, Artificial Sequence
  Description of Artificial Sequence: Synthetic oligonucleotide
  Target: ATXN1; (+) strand; PAM type: YTN; PAM sequence: TTT
ctgataacgtgctaatctca

SEQ ID NO: 252781 - DNA, 20 bp, Artificial Sequence
  Description of Artificial Sequence: Synthetic oligonucleotide
  Target: ATXN1; (+) strand; PAM type: YTN; PAM sequence: TTC
tgataacgtgctaatctcaa

SEQ ID NO: 252782 - DNA, 20 bp, Artificial Sequence
  Description of Artificial Sequence: Synthetic oligonucleotide
  Target: ATXN1; (+) strand; PAM type: YTN; PAM sequence: CTG
ataacgtgctaatctcaaac

SEQ ID NO: 252783 - DNA, 20 bp, Artificial Sequence
  Description of Artificial Sequence: Synthetic oligonucleotide
  Target: ATXN1; (+) strand; PAM type: YTN; PAM sequence: CTA
atctcaaacacattttctct

SEQ ID NO: 252784 - DNA, 20 bp, Artificial Sequence
  Description of Artificial Sequence: Synthetic oligonucleotide
  Target: ATXN1; (+) strand; PAM type: YTN; PAM sequence: CTC
aaacacattttctctcctga

SEQ ID NO: 252785 - DNA, 20 bp, Artificial Sequence
  Description of Artificial Sequence: Synthetic oligonucleotide
  Target: ATXN1; (+) strand; PAM type: YTN; PAM sequence: TTT
tctctcctgatacagggcta

SEQ ID NO: 252786 - DNA, 20 bp, Artificial Sequence
  Description of Artificial Sequence: Synthetic oligonucleotide
  Target: ATXN1; (+) strand; PAM type: YTN; PAM sequence: TTT
ctctcctgatacagggctac

SEQ ID NO: 252787 - DNA, 20 bp, Artificial Sequence
  Description of Artificial Sequence: Synthetic oligonucleotide
  Target: ATXN1; (+) strand; PAM type: YTN; PAM sequence: TTC
tctcctgatacagggctaca

SEQ ID NO: 252788 - DNA, 20 bp, Artificial Sequence
  Description of Artificial Sequence: Synthetic oligonucleotide
  Target: ATXN1; (+) strand; PAM type: YTN; PAM sequence: CTC
tcctgatacagggctacagt

SEQ ID NO: 252789 - DNA, 20 bp, Artificial Sequence
  Description of Artificial Sequence: Synthetic oligonucleotide
  Target: ATXN1; (+) strand; PAM type: YTN; PAM sequence: CTC
ctgatacagggctacagtgt

SEQ ID NO: 252790 - DNA, 20 bp, Artificial Sequence
  Description of Artificial Sequence: Synthetic oligonucleotide
  Target: ATXN1; (+) strand; PAM type: YTN; PAM sequence: CTG
atacagggctacagtgtgtt

SEQ ID NO: 252791 - DNA, 20 bp, Artificial Sequence
  Description of Artificial Sequence: Synthetic oligonucleotide
  Target: ATXN1; (+) strand; PAM type: YTN; PAM sequence: CTA
cagtgtgttcatctgattat

SEQ ID NO: 252792 - DNA, 20 bp, Artificial Sequence
  Description of Artificial Sequence: Synthetic oligonucleotide
  Target: ATXN1; (+) strand; PAM type: YTN; PAM sequence: TTC
atctgattatcaccaacaat

SEQ ID NO: 252793 - DNA, 20 bp, Artificial Sequence
  Description of Artificial Sequence: Synthetic oligonucleotide
  Target: ATXN1; (+) strand; PAM type: YTN; PAM sequence: CTG
attatcaccaacaatcattc

SEQ ID NO: 252794 - DNA, 20 bp, Artificial Sequence
  Description of Artificial Sequence: Synthetic oligonucleotide
  Target: ATXN1; (+) strand; PAM type: YTN; PAM sequence: TTA
tcaccaacaatcattcctaa

SEQ ID NO: 252795 - DNA, 20 bp, Artificial Sequence
  Description of Artificial Sequence: Synthetic oligonucleotide
  Target: ATXN1; (+) strand; PAM type: YTN; PAM sequence: TTC
ctaatcattcctatcttact

SEQ ID NO: 252796 - DNA, 20 bp, Artificial Sequence
  Description of Artificial Sequence: Synthetic oligonucleotide
  Target: ATXN1; (+) strand; PAM type: YTN; PAM sequence: CTA
atcattcctatcttactctg

SEQ ID NO: 252797 - DNA, 20 bp, Artificial Sequence
  Description of Artificial Sequence: Synthetic oligonucleotide
  Target: ATXN1; (+) strand; PAM type: YTN; PAM sequence: TTC
ctatcttactctgggttagg

SEQ ID NO: 252798 - DNA, 20 bp, Artificial Sequence
  Description of Artificial Sequence: Synthetic oligonucleotide
  Target: ATXN1; (+) strand; PAM type: YTN; PAM sequence: CTA
tcttactctgggttagggtc

SEQ ID NO: 252799 - DNA, 20 bp, Artificial Sequence
  Description of Artificial Sequence: Synthetic oligonucleotide
  Target: ATXN1; (+) strand; PAM type: YTN; PAM sequence: CTT
actctgggttagggtctctg

SEQ ID NO: 252800 - DNA, 20 bp, Artificial Sequence
  Description of Artificial Sequence: Synthetic oligonucleotide
  Target: ATXN1; (+) strand; PAM type: YTN; PAM sequence: TTA
ctctgggttagggtctctgt

SEQ ID NO: 252801 - DNA, 20 bp, Artificial Sequence
  Description of Artificial Sequence: Synthetic oligonucleotide
  Target: ATXN1; (+) strand; PAM type: YTN; PAM sequence: CTC
tgggttagggtctctgtcct

SEQ ID NO: 252802 - DNA, 20 bp, Artificial Sequence
  Description of Artificial Sequence: Synthetic oligonucleotide
  Target: ATXN1; (+) strand; PAM type: YTN; PAM sequence: CTG
ggttagggtctctgtcctct

SEQ ID NO: 252803 - DNA, 20 bp, Artificial Sequence
  Description of Artificial Sequence: Synthetic oligonucleotide
  Target: ATXN1; (+) strand; PAM type: YTN; PAM sequence: TTA
gggtctctgtcctctccttc

SEQ ID NO: 252804 - DNA, 20 bp, Artificial Sequence
  Description of Artificial Sequence: Synthetic oligonucleotide
  Target: ATXN1; (+) strand; PAM type: YTN; PAM sequence: CTC
tgtcctctccttcaccctta

SEQ ID NO: 252805 - DNA, 20 bp, Artificial Sequence
  Description of Artificial Sequence: Synthetic oligonucleotide
  Target: ATXN1; (+) strand; PAM type: YTN; PAM sequence: CTG
tcctctccttcacccttaag

SEQ ID NO: 252806 - DNA, 20 bp, Artificial Sequence
  Description of Artificial Sequence: Synthetic oligonucleotide
  Target: ATXN1; (+) strand; PAM type: YTN; PAM sequence: CTC
tccttcacccttaaggctat

SEQ ID NO: 252807 - DNA, 20 bp, Artificial Sequence
  Description of Artificial Sequence: Synthetic oligonucleotide
  Target: ATXN1; (+) strand; PAM type: YTN; PAM sequence: CTC
cttcacccttaaggctatta

SEQ ID NO: 252808 - DNA, 20 bp, Artificial Sequence
  Description of Artificial Sequence: Synthetic oligonucleotide
  Target: ATXN1; (+) strand; PAM type: YTN; PAM sequence: CTT
cacccttaaggctattagtc

SEQ ID NO: 252809 - DNA, 20 bp, Artificial Sequence
  Description of Artificial Sequence: Synthetic oligonucleotide
  Target: ATXN1; (+) strand; PAM type: YTN; PAM sequence: TTC
acccttaaggctattagtct

SEQ ID NO: 252810 - DNA, 20 bp, Artificial Sequence
  Description of Artificial Sequence: Synthetic oligonucleotide
  Target: ATXN1; (+) strand; PAM type: YTN; PAM sequence: CTT
aaggctattagtcttcacga

SEQ ID NO: 252811 - DNA, 20 bp, Artificial Sequence
  Description of Artificial Sequence: Synthetic oligonucleotide
  Target: ATXN1; (+) strand; PAM type: YTN; PAM sequence: TTA
aggctattagtcttcacgat

SEQ ID NO: 252812 - DNA, 20 bp, Artificial Sequence
  Description of Artificial Sequence: Synthetic oligonucleotide
  Target: ATXN1; (+) strand; PAM type: YTN; PAM sequence: CTA
ttagtcttcacgataaaaaa

SEQ ID NO: 252813 - DNA, 20 bp, Artificial Sequence
  Description of Artificial Sequence: Synthetic oligonucleotide
  Target: ATXN1; (+) strand; PAM type: YTN; PAM sequence: TTA
gtcttcacgataaaaaattt

SEQ ID NO: 252814 - DNA, 20 bp, Artificial Sequence
  Description of Artificial Sequence: Synthetic oligonucleotide
  Target: ATXN1; (+) strand; PAM type: YTN; PAM sequence: CTT
cacgataaaaaatttctagg

SEQ ID NO: 252815 - DNA, 20 bp, Artificial Sequence
  Description of Artificial Sequence: Synthetic oligonucleotide
  Target: ATXN1; (+) strand; PAM type: YTN; PAM sequence: TTC
acgataaaaaatttctaggt

SEQ ID NO: 252816 - DNA, 20 bp, Artificial Sequence
  Description of Artificial Sequence: Synthetic oligonucleotide
  Target: ATXN1; (+) strand; PAM type: YTN; PAM sequence: TTT
ctaggtagagatagatgctt

SEQ ID NO: 252817 - DNA, 20 bp, Artificial Sequence
  Description of Artificial Sequence: Synthetic oligonucleotide
  Target: ATXN1; (+) strand; PAM type: YTN; PAM sequence: TTC
taggtagagatagatgcttg

SEQ ID NO: 252818 - DNA, 20 bp, Artificial Sequence
  Description of Artificial Sequence: Synthetic oligonucleotide
  Target: ATXN1; (+) strand; PAM type: YTN; PAM sequence: CTA
ggtagagatagatgcttggg

SEQ ID NO: 252819 - DNA, 20 bp, Artificial Sequence
  Description of Artificial Sequence: Synthetic oligonucleotide
  Target: ATXN1; (+) strand; PAM type: YTN; PAM sequence: CTT
ggggttctaaaagagcaagt

SEQ ID NO: 252820 - DNA, 20 bp, Artificial Sequence
  Description of Artificial Sequence: Synthetic oligonucleotide
  Target: ATXN1; (+) strand; PAM type: YTN; PAM sequence: TTG
gggttctaaaagagcaagtg

SEQ ID NO: 252821 - DNA, 20 bp, Artificial Sequence
  Description of Artificial Sequence: Synthetic oligonucleotide
  Target: ATXN1; (+) strand; PAM type: YTN; PAM sequence: TTC
taaaagagcaagtggtaatc

SEQ ID NO: 252822 - DNA, 20 bp, Artificial Sequence
  Description of Artificial Sequence: Synthetic oligonucleotide
  Target: ATXN1; (+) strand; PAM type: YTN; PAM sequence: CTA
aaagagcaagtggtaatcct

SEQ ID NO: 252823 - DNA, 20 bp, Artificial Sequence
  Description of Artificial Sequence: Synthetic oligonucleotide
  Target: ATXN1; (+) strand; PAM type: YTN; PAM sequence: CTC
acatacgatgacacattcca

SEQ ID NO: 252824 - DNA, 20 bp, Artificial Sequence
  Description of Artificial Sequence: Synthetic oligonucleotide
  Target: ATXN1; (+) strand; PAM type: YTN; PAM sequence: TTC
cagcctctaaagcagtctgc

SEQ ID NO: 252825 - DNA, 20 bp, Artificial Sequence
  Description of Artificial Sequence: Synthetic oligonucleotide
  Target: ATXN1; (+) strand; PAM type: YTN; PAM sequence: CTC
taaagcagtctgcattacag

SEQ ID NO: 252826 - DNA, 20 bp, Artificial Sequence
  Description of Artificial Sequence: Synthetic oligonucleotide
  Target: ATXN1; (+) strand; PAM type: YTN; PAM sequence: CTA
aagcagtctgcattacagga

SEQ ID NO: 252827 - DNA, 20 bp, Artificial Sequence
  Description of Artificial Sequence: Synthetic oligonucleotide
  Target: ATXN1; (+) strand; PAM type: YTN; PAM sequence: CTG
cattacaggatcattattat

SEQ ID NO: 252828 - DNA, 20 bp, Artificial Sequence
  Description of Artificial Sequence: Synthetic oligonucleotide
  Target: ATXN1; (+) strand; PAM type: YTN; PAM sequence: TTA
caggatcattattatttttt

SEQ ID NO: 252829 - DNA, 20 bp, Artificial Sequence
  Description of Artificial Sequence: Synthetic oligonucleotide
  Target: ATXN1; (+) strand; PAM type: YTN; PAM sequence: TTA
ttattttttccagcaaagaa

SEQ ID NO: 252830 - DNA, 20 bp, Artificial Sequence
  Description of Artificial Sequence: Synthetic oligonucleotide
  Target: ATXN1; (+) strand; PAM type: YTN; PAM sequence: TTA
ttttttccagcaaagaagcc

SEQ ID NO: 252831 - DNA, 20 bp, Artificial Sequence
  Description of Artificial Sequence: Synthetic oligonucleotide
  Target: ATXN1; (+) strand; PAM type: YTN; PAM sequence: TTT
tttccagcaaagaagccaca

SEQ ID NO: 252832 - DNA, 20 bp, Artificial Sequence
  Description of Artificial Sequence: Synthetic oligonucleotide
  Target: ATXN1; (+) strand; PAM type: YTN; PAM sequence: TTT
ttccagcaaagaagccacaa

SEQ ID NO: 252833 - DNA, 20 bp, Artificial Sequence
  Description of Artificial Sequence: Synthetic oligonucleotide
  Target: ATXN1; (+) strand; PAM type: YTN; PAM sequence: TTT
tccagcaaagaagccacaat

SEQ ID NO: 252834 - DNA, 20 bp, Artificial Sequence
  Description of Artificial Sequence: Synthetic oligonucleotide
  Target: ATXN1; (+) strand; PAM type: YTN; PAM sequence: TTT
ccagcaaagaagccacaatt

SEQ ID NO: 252835 - DNA, 20 bp, Artificial Sequence
  Description of Artificial Sequence: Synthetic oligonucleotide
  Target: ATXN1; (+) strand; PAM type: YTN; PAM sequence: TTC
cagcaaagaagccacaattc

SEQ ID NO: 252836 - DNA, 20 bp, Artificial Sequence
  Description of Artificial Sequence: Synthetic oligonucleotide
  Target: ATXN1; (+) strand; PAM type: YTN; PAM sequence: TTC
aggaatctatgcaaaaataa

SEQ ID NO: 252837 - DNA, 20 bp, Artificial Sequence
  Description of Artificial Sequence: Synthetic oligonucleotide
  Target: ATXN1; (+) strand; PAM type: YTN; PAM sequence: CTA
tgcaaaaataattaagtgaa

SEQ ID NO: 252838 - DNA, 20 bp, Artificial Sequence
  Description of Artificial Sequence: Synthetic oligonucleotide
  Target: ATXN1; (+) strand; PAM type: YTN; PAM sequence: TTA
agtgaaggttgctccatcaa

SEQ ID NO: 252839 - DNA, 20 bp, Artificial Sequence
  Description of Artificial Sequence: Synthetic oligonucleotide
  Target: ATXN1; (+) strand; PAM type: YTN; PAM sequence: TTG
ctccatcaagtttccatcaa

SEQ ID NO: 252840 - DNA, 20 bp, Artificial Sequence
  Description of Artificial Sequence: Synthetic oligonucleotide
  Target: ATXN1; (+) strand; PAM type: YTN; PAM sequence: CTC
catcaagtttccatcaatca

SEQ ID NO: 252841 - DNA, 20 bp, Artificial Sequence
  Description of Artificial Sequence: Synthetic oligonucleotide
  Target: ATXN1; (+) strand; PAM type: YTN; PAM sequence: TTT
ccatcaatcactcctccttg

SEQ ID NO: 252842 - DNA, 20 bp, Artificial Sequence
  Description of Artificial Sequence: Synthetic oligonucleotide
  Target: ATXN1; (+) strand; PAM type: YTN; PAM sequence: TTC
catcaatcactcctccttgc

SEQ ID NO: 252843 - DNA, 20 bp, Artificial Sequence
  Description of Artificial Sequence: Synthetic oligonucleotide
  Target: ATXN1; (+) strand; PAM type: YTN; PAM sequence: CTC
ctccttgccattctgccctt

SEQ ID NO: 252844 - DNA, 20 bp, Artificial Sequence
  Description of Artificial Sequence: Synthetic oligonucleotide
  Target: ATXN1; (+) strand; PAM type: YTN; PAM sequence: CTC
cttgccattctgcccttcct

SEQ ID NO: 252845 - DNA, 20 bp, Artificial Sequence
  Description of Artificial Sequence: Synthetic oligonucleotide
  Target: ATXN1; (+) strand; PAM type: YTN; PAM sequence: CTT
gccattctgcccttcctgag

SEQ ID NO: 252846 - DNA, 20 bp, Artificial Sequence
  Description of Artificial Sequence: Synthetic oligonucleotide
  Target: ATXN1; (+) strand; PAM type: YTN; PAM sequence: TTG
ccattctgcccttcctgaga

SEQ ID NO: 252847 - DNA, 20 bp, Artificial Sequence
  Description of Artificial Sequence: Synthetic oligonucleotide
  Target: ATXN1; (+) strand; PAM type: YTN; PAM sequence: TTC
tgcccttcctgagatgacaa

SEQ ID NO: 252848 - DNA, 20 bp, Artificial Sequence
  Description of Artificial Sequence: Synthetic oligonucleotide
  Target: ATXN1; (+) strand; PAM type: YTN; PAM sequence: CTG
cccttcctgagatgacaaca

SEQ ID NO: 252849 - DNA, 20 bp, Artificial Sequence
  Description of Artificial Sequence: Synthetic oligonucleotide
  Target: ATXN1; (+) strand; PAM type: YTN; PAM sequence: CTT
cctgagatgacaacatgtca

SEQ ID NO: 252850 - DNA, 20 bp, Artificial Sequence
  Description of Artificial Sequence: Synthetic oligonucleotide
  Target: ATXN1; (+) strand; PAM type: YTN; PAM sequence: TTC
ctgagatgacaacatgtcag

SEQ ID NO: 252851 - DNA, 20 bp, Artificial Sequence
  Description of Artificial Sequence: Synthetic oligonucleotide
  Target: ATXN1; (+) strand; PAM type: YTN; PAM sequence: CTG
agatgacaacatgtcagctg

SEQ ID NO: 252852 - DNA, 20 bp, Artificial Sequence
  Description of Artificial Sequence: Synthetic oligonucleotide
  Target: ATXN1; (+) strand; PAM type: YTN; PAM sequence: CTG
ctttgaacaagatctacatc

SEQ ID NO: 252853 - DNA, 20 bp, Artificial Sequence
  Description of Artificial Sequence: Synthetic oligonucleotide
  Target: ATXN1; (+) strand; PAM type: YTN; PAM sequence: CTT
tgaacaagatctacatcgcg

SEQ ID NO: 252854 - DNA, 20 bp, Artificial Sequence
  Description of Artificial Sequence: Synthetic oligonucleotide
  Target: ATXN1; (+) strand; PAM type: YTN; PAM sequence: TTT
gaacaagatctacatcgcgt

SEQ ID NO: 252855 - DNA, 20 bp, Artificial Sequence
  Description of Artificial Sequence: Synthetic oligonucleotide
  Target: ATXN1; (+) strand; PAM type: YTN; PAM sequence: TTG
aacaagatctacatcgcgtt

SEQ ID NO: 252856 - DNA, 20 bp, Artificial Sequence
  Description of Artificial Sequence: Synthetic oligonucleotide
  Target: ATXN1; (+) strand; PAM type: YTN; PAM sequence: CTA
catcgcgttctctgcattgc

SEQ ID NO: 252857 - DNA, 20 bp, Artificial Sequence
  Description of Artificial Sequence: Synthetic oligonucleotide
  Target: ATXN1; (+) strand; PAM type: YTN; PAM sequence: TTC
tctgcattgcacttgctgct

SEQ ID NO: 252858 - DNA, 20 bp, Artificial Sequence
  Description of Artificial Sequence: Synthetic oligonucleotide
  Target: ATXN1; (+) strand; PAM type: YTN; PAM sequence: CTC
tgcattgcacttgctgctgc

SEQ ID NO: 252859 - DNA, 20 bp, Artificial Sequence
  Description of Artificial Sequence: Synthetic oligonucleotide
  Target: ATXN1; (+) strand; PAM type: YTN; PAM sequence: CTG
cattgcacttgctgctgctt

SEQ ID NO: 252860 - DNA, 20 bp, Artificial Sequence
  Description of Artificial Sequence: Synthetic oligonucleotide
  Target: ATXN1; (+) strand; PAM type: YTN; PAM sequence: TTG
cacttgctgctgctttgtag

SEQ ID NO: 252861 - DNA, 20 bp, Artificial Sequence
  Description of Artificial Sequence: Synthetic oligonucleotide
  Target: ATXN1; (+) strand; PAM type: YTN; PAM sequence: CTT
gctgctgctttgtagtctgc

SEQ ID NO: 252862 - DNA, 20 bp, Artificial Sequence
  Description of Artificial Sequence: Synthetic oligonucleotide
  Target: ATXN1; (+) strand; PAM type: YTN; PAM sequence: TTG
ctgctgctttgtagtctgct

SEQ ID NO: 252863 - DNA, 20 bp, Artificial Sequence
  Description of Artificial Sequence: Synthetic oligonucleotide
  Target: ATXN1; (+) strand; PAM type: YTN; PAM sequence: CTG
ctgctttgtagtctgctggg

SEQ ID NO: 252864 - DNA, 20 bp, Artificial Sequence
  Description of Artificial Sequence: Synthetic oligonucleotide
  Target: ATXN1; (+) strand; PAM type: YTN; PAM sequence: CTG
ctttgtagtctgctgggtag

SEQ ID NO: 252865 - DNA, 20 bp, Artificial Sequence
  Description of Artificial Sequence: Synthetic oligonucleotide
  Target: ATXN1; (+) strand; PAM type: YTN; PAM sequence: CTT
tgtagtctgctgggtagtgg

SEQ ID NO: 252866 - DNA, 20 bp, Artificial Sequence
  Description of Artificial Sequence: Synthetic oligonucleotide
  Target: ATXN1; (+) strand; PAM type: YTN; PAM sequence: TTT
gtagtctgctgggtagtggt

SEQ ID NO: 252867 - DNA, 20 bp, Artificial Sequence
  Description of Artificial Sequence: Synthetic oligonucleotide
  Target: ATXN1; (+) strand; PAM type: YTN; PAM sequence: TTG
tagtctgctgggtagtggtg

SEQ ID NO: 252868 - DNA, 20 bp, Artificial Sequence
  Description of Artificial Sequence: Synthetic oligonucleotide
  Target: ATXN1; (+) strand; PAM type: YTN; PAM sequence: CTG
ctgggtagtggtgacagcgc

SEQ ID NO: 252869 - DNA, 20 bp, Artificial Sequence
  Description of Artificial Sequence: Synthetic oligonucleotide
  Target: ATXN1; (+) strand; PAM type: YTN; PAM sequence: CTG
ggtagtggtgacagcgcgtt

SEQ ID NO: 252870 - DNA, 20 bp, Artificial Sequence
  Description of Artificial Sequence: Synthetic oligonucleotide
  Target: ATXN1; (+) strand; PAM type: YTN; PAM sequence: TTA
accataaaaaaatggggagt

SEQ ID NO: 252871 - DNA, 20 bp, Artificial Sequence
  Description of Artificial Sequence: Synthetic oligonucleotide
  Target: ATXN1; (+) strand; PAM type: YTN; PAM sequence: TTC
aggactggagggggctgaga

SEQ ID NO: 252872 - DNA, 20 bp, Artificial Sequence
  Description of Artificial Sequence: Synthetic oligonucleotide
  Target: ATXN1; (+) strand; PAM type: YTN; PAM sequence: CTG
gagggggctgagaacatttt

SEQ ID NO: 252873 - DNA, 20 bp, Artificial Sequence
  Description of Artificial Sequence: Synthetic oligonucleotide
  Target: ATXN1; (+) strand; PAM type: YTN; PAM sequence: CTG
agaacattttaacatatttg

SEQ ID NO: 252874 - DNA, 20 bp, Artificial Sequence
  Description of Artificial Sequence: Synthetic oligonucleotide
  Target: ATXN1; (+) strand; PAM type: YTN; PAM sequence: TTT
taacatatttgcaaaggcac

SEQ ID NO: 252875 - DNA, 20 bp, Artificial Sequence
  Description of Artificial Sequence: Synthetic oligonucleotide
  Target: ATXN1; (+) strand; PAM type: YTN; PAM sequence: TTT
aacatatttgcaaaggcaca

SEQ ID NO: 252876 - DNA, 20 bp, Artificial Sequence
  Description of Artificial Sequence: Synthetic oligonucleotide
  Target: ATXN1; (+) strand; PAM type: YTN; PAM sequence: TTA
acatatttgcaaaggcacaa

SEQ ID NO: 252877 - DNA, 20 bp, Artificial Sequence
  Description of Artificial Sequence: Synthetic oligonucleotide
  Target: ATXN1; (+) strand; PAM type: YTN; PAM sequence: TTT
gcaaaggcacaagattgtaa

SEQ ID NO: 252878 - DNA, 20 bp, Artificial Sequence
  Description of Artificial Sequence: Synthetic oligonucleotide
  Target: ATXN1; (+) strand; PAM type: YTN; PAM sequence: TTG
caaaggcacaagattgtaag

SEQ ID NO: 252879 - DNA, 20 bp, Artificial Sequence
  Description of Artificial Sequence: Synthetic oligonucleotide
  Target: ATXN1; (+) strand; PAM type: YTN; PAM sequence: TTG
taagaatagttatgctgaga

SEQ ID NO: 252880 - DNA, 20 bp, Artificial Sequence
  Description of Artificial Sequence: Synthetic oligonucleotide
  Target: ATXN1; (+) strand; PAM type: YTN; PAM sequence: TTA
tgctgagaacttaaactttt

SEQ ID NO: 252881 - DNA, 20 bp, Artificial Sequence
  Description of Artificial Sequence: Synthetic oligonucleotide
  Target: ATXN1; (+) strand; PAM type: YTN; PAM sequence: CTG
agaacttaaacttttgcttt

SEQ ID NO: 252882 - DNA, 20 bp, Artificial Sequence
  Description of Artificial Sequence: Synthetic oligonucleotide
  Target: ATXN1; (+) strand; PAM type: YTN; PAM sequence: CTT
aaacttttgctttcagatca

SEQ ID NO: 252883 - DNA, 20 bp, Artificial Sequence
  Description of Artificial Sequence: Synthetic oligonucleotide
  Target: ATXN1; (+) strand; PAM type: YTN; PAM sequence: TTA
aacttttgctttcagatcag

SEQ ID NO: 252884 - DNA, 20 bp, Artificial Sequence
  Description of Artificial Sequence: Synthetic oligonucleotide
  Target: ATXN1; (+) strand; PAM type: YTN; PAM sequence: CTT
ttgctttcagatcagactga

SEQ ID NO: 252885 - DNA, 20 bp, Artificial Sequence
  Description of Artificial Sequence: Synthetic oligonucleotide
  Target: ATXN1; (+) strand; PAM type: YTN; PAM sequence: TTT
tgctttcagatcagactgaa

SEQ ID NO: 252886 - DNA, 20 bp, Artificial Sequence
  Description of Artificial Sequence: Synthetic oligonucleotide
  Target: ATXN1; (+) strand; PAM type: YTN; PAM sequence: TTT
gctttcagatcagactgaac

SEQ ID NO: 252887 - DNA, 20 bp, Artificial Sequence
  Description of Artificial Sequence: Synthetic oligonucleotide
  Target: ATXN1; (+) strand; PAM type: YTN; PAM sequence: TTG
ctttcagatcagactgaact

SEQ ID NO: 252888 - DNA, 20 bp, Artificial Sequence
  Description of Artificial Sequence: Synthetic oligonucleotide
  Target: ATXN1; (+) strand; PAM type: YTN; PAM sequence: CTT
tcagatcagactgaactctt

SEQ ID NO: 252889 - DNA, 20 bp, Artificial Sequence
  Description of Artificial Sequence: Synthetic oligonucleotide
  Target: ATXN1; (+) strand; PAM type: YTN; PAM sequence: TTT
cagatcagactgaactctta

SEQ ID NO: 252890 - DNA, 20 bp, Artificial Sequence
  Description of Artificial Sequence: Synthetic oligonucleotide
  Target: ATXN1; (+) strand; PAM type: YTN; PAM sequence: TTC
agatcagactgaactcttaa

SEQ ID NO: 252891 - DNA, 20 bp, Artificial Sequence
  Description of Artificial Sequence: Synthetic oligonucleotide
  Target: ATXN1; (+) strand; PAM type: YTN; PAM sequence: CTG
aactcttaacacttttacat

SEQ ID NO: 252892 - DNA, 20 bp, Artificial Sequence
  Description of Artificial Sequence: Synthetic oligonucleotide
  Target: ATXN1; (+) strand; PAM type: YTN; PAM sequence: CTC
ttaacacttttacatgaaag

SEQ ID NO: 252893 - DNA, 20 bp, Artificial Sequence
  Description of Artificial Sequence: Synthetic oligonucleotide
  Target: ATXN1; (+) strand; PAM type: YTN; PAM sequence: CTT
aacacttttacatgaaagaa

SEQ ID NO: 252894 - DNA, 20 bp, Artificial Sequence
  Description of Artificial Sequence: Synthetic oligonucleotide
  Target: ATXN1; (+) strand; PAM type: YTN; PAM sequence: TTA
acacttttacatgaaagaaa

SEQ ID NO: 252895 - DNA, 20 bp, Artificial Sequence
  Description of Artificial Sequence: Synthetic oligonucleotide
  Target: ATXN1; (+) strand; PAM type: YTN; PAM sequence: CTT
ttacatgaaagaaatgcaag

SEQ ID NO: 252896 - DNA, 20 bp, Artificial Sequence
  Description of Artificial Sequence: Synthetic oligonucleotide
  Target: ATXN1; (+) strand; PAM type: YTN; PAM sequence: TTT
tacatgaaagaaatgcaagg

SEQ ID NO: 252897 - DNA, 20 bp, Artificial Sequence
  Description of Artificial Sequence: Synthetic oligonucleotide
  Target: ATXN1; (+) strand; PAM type: YTN; PAM sequence: TTT
acatgaaagaaatgcaagga

SEQ ID NO: 252898 - DNA, 20 bp, Artificial Sequence
  Description of Artificial Sequence: Synthetic oligonucleotide
  Target: ATXN1; (+) strand; PAM type: YTN; PAM sequence: TTA
catgaaagaaatgcaaggag

SEQ ID NO: 252899 - DNA, 20 bp, Artificial Sequence
  Description of Artificial Sequence: Synthetic oligonucleotide
  Target: ATXN1; (+) strand; PAM type: YTN; PAM sequence: CTA
tgataaaaccaatacattaa

SEQ ID NO: 252900 - DNA, 20 bp, Artificial Sequence
  Description of Artificial Sequence: Synthetic oligonucleotide
  Target: ATXN1; (+) strand; PAM type: YTN; PAM sequence: TTA
acatatgtggatatcgtgtg

SEQ ID NO: 252901 - DNA, 20 bp, Artificial Sequence
  Description of Artificial Sequence: Synthetic oligonucleotide
  Target: ATXN1; (+) strand; PAM type: YTN; PAM sequence: CTC
tagaaagtcaggagagcaaa

SEQ ID NO: 252902 - DNA, 20 bp, Artificial Sequence
  Description of Artificial Sequence: Synthetic oligonucleotide
  Target: ATXN1; (+) strand; PAM type: YTN; PAM sequence: CTA
gaaagtcaggagagcaaatg

SEQ ID NO: 252903 - DNA, 20 bp, Artificial Sequence
  Description of Artificial Sequence: Synthetic oligonucleotide
  Target: ATXN1; (+) strand; PAM type: YTN; PAM sequence: CTC
cttgagttattctgatctgc

SEQ ID NO: 252904 - DNA, 20 bp, Artificial Sequence
  Description of Artificial Sequence: Synthetic oligonucleotide
  Target: ATXN1; (+) strand; PAM type: YTN; PAM sequence: CTT
gagttattctgatctgctgc

SEQ ID NO: 252905 - DNA, 20 bp, Artificial Sequence
  Description of Artificial Sequence: Synthetic oligonucleotide
  Target: ATXN1; (+) strand; PAM type: YTN; PAM sequence: TTG
agttattctgatctgctgca

SEQ ID NO: 252906 - DNA, 20 bp, Artificial Sequence
  Description of Artificial Sequence: Synthetic oligonucleotide
  Target: ATXN1; (+) strand; PAM type: YTN; PAM sequence: TTA
ttctgatctgctgcacaagg

SEQ ID NO: 252907 - DNA, 20 bp, Artificial Sequence
  Description of Artificial Sequence: Synthetic oligonucleotide
  Target: ATXN1; (+) strand; PAM type: YTN; PAM sequence: TTC
tgatctgctgcacaaggcca

SEQ ID NO: 252908 - DNA, 20 bp, Artificial Sequence
  Description of Artificial Sequence: Synthetic oligonucleotide
  Target: ATXN1; (+) strand; PAM type: YTN; PAM sequence: CTG
atctgctgcacaaggccacc

SEQ ID NO: 252909 - DNA, 20 bp, Artificial Sequence
  Description of Artificial Sequence: Synthetic oligonucleotide
  Target: ATXN1; (+) strand; PAM type: YTN; PAM sequence: CTG
ctgcacaaggccaccagggc

SEQ ID NO: 252910 - DNA, 20 bp, Artificial Sequence
  Description of Artificial Sequence: Synthetic oligonucleotide
  Target: ATXN1; (+) strand; PAM type: YTN; PAM sequence: CTG
cacaaggccaccagggctgg

SEQ ID NO: 252911 - DNA, 20 bp, Artificial Sequence
  Description of Artificial Sequence: Synthetic oligonucleotide
  Target: ATXN1; (+) strand; PAM type: YTN; PAM sequence: CTG
ggtctctgacactgataaca

SEQ ID NO: 252912 - DNA, 20 bp, Artificial Sequence
  Description of Artificial Sequence: Synthetic oligonucleotide
  Target: ATXN1; (+) strand; PAM type: YTN; PAM sequence: CTC
tgacactgataacaggtctc

SEQ ID NO: 252913 - DNA, 20 bp, Artificial Sequence
  Description of Artificial Sequence: Synthetic oligonucleotide
  Target: ATXN1; (+) strand; PAM type: YTN; PAM sequence: CTG
acactgataacaggtctctg

SEQ ID NO: 252914 - DNA, 20 bp, Artificial Sequence
  Description of Artificial Sequence: Synthetic oligonucleotide
  Target: ATXN1; (+) strand; PAM type: YTN; PAM sequence: CTG
ataacaggtctctggtgaag

SEQ ID NO: 252915 - DNA, 20 bp, Artificial Sequence
  Description of Artificial Sequence: Synthetic oligonucleotide
  Target: ATXN1; (+) strand; PAM type: YTN; PAM sequence: CTC
tggtgaaggaccttgtgtaa

SEQ ID NO: 252916 - DNA, 20 bp, Artificial Sequence
  Description of Artificial Sequence: Synthetic oligonucleotide
  Target: ATXN1; (+) strand; PAM type: YTN; PAM sequence: CTG
gtgaaggaccttgtgtaaag

SEQ ID NO: 252917 - DNA, 20 bp, Artificial Sequence
  Description of Artificial Sequence: Synthetic oligonucleotide
  Target: ATXN1; (+) strand; PAM type: YTN; PAM sequence: CTT
gtgtaaagagtataatggta

SEQ ID NO: 252918 - DNA, 20 bp, Artificial Sequence
  Description of Artificial Sequence: Synthetic oligonucleotide
  Target: ATXN1; (+) strand; PAM type: YTN; PAM sequence: TTG
tgtaaagagtataatggtaa

SEQ ID NO: 252919 - DNA, 20 bp, Artificial Sequence
  Description of Artificial Sequence: Synthetic oligonucleotide
  Target: ATXN1; (+) strand; PAM type: YTN; PAM sequence: TTA
ggactaaaagatgtacatag

SEQ ID NO: 252920 - DNA, 20 bp, Artificial Sequence
  Description of Artificial Sequence: Synthetic oligonucleotide
  Target: ATXN1; (+) strand; PAM type: YTN; PAM sequence: CTA
aaagatgtacatagagagaa

SEQ ID NO: 252921 - DNA, 20 bp, Artificial Sequence
  Description of Artificial Sequence: Synthetic oligonucleotide
  Target: ATXN1; (+) strand; PAM type: YTN; PAM sequence: CTC
cttgggctcataggctgaat

SEQ ID NO: 252922 - DNA, 20 bp, Artificial Sequence
  Description of Artificial Sequence: Synthetic oligonucleotide
  Target: ATXN1; (+) strand; PAM type: YTN; PAM sequence: CTT
gggctcataggctgaatgcc

SEQ ID NO: 252923 - DNA, 20 bp, Artificial Sequence
  Description of Artificial Sequence: Synthetic oligonucleotide
  Target: ATXN1; (+) strand; PAM type: YTN; PAM sequence: TTG
ggctcataggctgaatgcct

SEQ ID NO: 252924 - DNA, 20 bp, Artificial Sequence
  Description of Artificial Sequence: Synthetic oligonucleotide
  Target: ATXN1; (+) strand; PAM type: YTN; PAM sequence: CTC
ataggctgaatgcctctgaa

SEQ ID NO: 252925 - DNA, 20 bp, Artificial Sequence
  Description of Artificial Sequence: Synthetic oligonucleotide
  Target: ATXN1; (+) strand; PAM type: YTN; PAM sequence: CTG
aatgcctctgaacatgaaca

SEQ ID NO: 252926 - DNA, 20 bp, Artificial Sequence
  Description of Artificial Sequence: Synthetic oligonucleotide
  Target: ATXN1; (+) strand; PAM type: YTN; PAM sequence: CTC
tgaacatgaacaggatgtta

SEQ ID NO: 252927 - DNA, 20 bp, Artificial Sequence
  Description of Artificial Sequence: Synthetic oligonucleotide
  Target: ATXN1; (+) strand; PAM type: YTN; PAM sequence: CTG
aacatgaacaggatgttact

SEQ ID NO: 252928 - DNA, 20 bp, Artificial Sequence
  Description of Artificial Sequence: Synthetic oligonucleotide
  Target: ATXN1; (+) strand; PAM type: YTN; PAM sequence: TTA
ctccttcaaatcacttttta

SEQ ID NO: 252929 - DNA, 20 bp, Artificial Sequence
  Description of Artificial Sequence: Synthetic oligonucleotide
  Target: ATXN1; (+) strand; PAM type: YTN; PAM sequence: CTC
cttcaaatcactttttaaaa

SEQ ID NO: 252930 - DNA, 20 bp, Artificial Sequence
  Description of Artificial Sequence: Synthetic oligonucleotide
  Target: ATXN1; (+) strand; PAM type: YTN; PAM sequence: CTT
caaatcactttttaaaaata

SEQ ID NO: 252931 - DNA, 20 bp, Artificial Sequence
  Description of Artificial Sequence: Synthetic oligonucleotide
  Target: ATXN1; (+) strand; PAM type: YTN; PAM sequence: TTC
aaatcactttttaaaaatat

SEQ ID NO: 252932 - DNA, 20 bp, Artificial Sequence
  Description of Artificial Sequence: Synthetic oligonucleotide
  Target: ATXN1; (+) strand; PAM type: YTN; PAM sequence: CTT
tttaaaaatattttgattat

SEQ ID NO: 252933 - DNA, 20 bp, Artificial Sequence
  Description of Artificial Sequence: Synthetic oligonucleotide
  Target: ATXN1; (+) strand; PAM type: YTN; PAM sequence: TTT
ttaaaaatattttgattatt

SEQ ID NO: 252934 - DNA, 20 bp, Artificial Sequence
  Description of Artificial Sequence: Synthetic oligonucleotide
  Target: ATXN1; (+) strand; PAM type: YTN; PAM sequence: TTT
taaaaatattttgattattt

SEQ ID NO: 252935 - DNA, 20 bp, Artificial Sequence
  Description of Artificial Sequence: Synthetic oligonucleotide
  Target: ATXN1; (+) strand; PAM type: YTN; PAM sequence: TTT
aaaaatattttgattatttt

SEQ ID NO: 252936 - DNA, 20 bp, Artificial Sequence
  Description of Artificial Sequence: Synthetic oligonucleotide
  Target: ATXN1; (+) strand; PAM type: YTN; PAM sequence: TTA
aaaatattttgattattttt

SEQ ID NO: 252937 - DNA, 20 bp, Artificial Sequence
  Description of Artificial Sequence: Synthetic oligonucleotide
  Target: ATXN1; (+) strand; PAM type: YTN; PAM sequence: TTT
tgattatttttaaaggagac

SEQ ID NO: 252938 - DNA, 20 bp, Artificial Sequence
  Description of Artificial Sequence: Synthetic oligonucleotide
  Target: ATXN1; (+) strand; PAM type: YTN; PAM sequence: TTT
gattatttttaaaggagacg

SEQ ID NO: 252939 - DNA, 20 bp, Artificial Sequence
  Description of Artificial Sequence: Synthetic oligonucleotide
  Target: ATXN1; (+) strand; PAM type: YTN; PAM sequence: TTG
attatttttaaaggagacgg

SEQ ID NO: 252940 - DNA, 20 bp, Artificial Sequence
  Description of Artificial Sequence: Synthetic oligonucleotide
  Target: ATXN1; (+) strand; PAM type: YTN; PAM sequence: TTA
tttttaaaggagacggggtt

SEQ ID NO: 252941 - DNA, 20 bp, Artificial Sequence
  Description of Artificial Sequence: Synthetic oligonucleotide
  Target: ATXN1; (+) strand; PAM type: YTN; PAM sequence: TTT
ttaaaggagacggggtttca

SEQ ID NO: 252942 - DNA, 20 bp, Artificial Sequence
  Description of Artificial Sequence: Synthetic oligonucleotide
  Target: ATXN1; (+) strand; PAM type: YTN; PAM sequence: TTT
taaaggagacggggtttcac

SEQ ID NO: 252943 - DNA, 20 bp, Artificial Sequence
  Description of Artificial Sequence: Synthetic oligonucleotide
  Target: ATXN1; (+) strand; PAM type: YTN; PAM sequence: TTT
aaaggagacggggtttcact

SEQ ID NO: 252944 - DNA, 20 bp, Artificial Sequence
  Description of Artificial Sequence: Synthetic oligonucleotide
  Target: ATXN1; (+) strand; PAM type: YTN; PAM sequence: TTA
aaggagacggggtttcacta

SEQ ID NO: 252945 - DNA, 20 bp, Artificial Sequence
  Description of Artificial Sequence: Synthetic oligonucleotide
  Target: ATXN1; (+) strand; PAM type: YTN; PAM sequence: TTT
cactatgttgcccaggctgg

SEQ ID NO: 252946 - DNA, 20 bp, Artificial Sequence
  Description of Artificial Sequence: Synthetic oligonucleotide
  Target: ATXN1; (+) strand; PAM type: YTN; PAM sequence: TTC
actatgttgcccaggctggt

SEQ ID NO: 252947 - DNA, 20 bp, Artificial Sequence
  Description of Artificial Sequence: Synthetic oligonucleotide
  Target: ATXN1; (+) strand; PAM type: YTN; PAM sequence: CTA
tgttgcccaggctggtctca

SEQ ID NO: 252948 - DNA, 20 bp, Artificial Sequence
  Description of Artificial Sequence: Synthetic oligonucleotide
  Target: ATXN1; (+) strand; PAM type: YTN; PAM sequence: TTG
cccaggctggtctcaaactc

SEQ ID NO: 252949 - DNA, 20 bp, Artificial Sequence
  Description of Artificial Sequence: Synthetic oligonucleotide
  Target: ATXN1; (+) strand; PAM type: YTN; PAM sequence: CTG
gtctcaaactcctgggctca

SEQ ID NO: 252950 - DNA, 20 bp, Artificial Sequence
  Description of Artificial Sequence: Synthetic oligonucleotide
  Target: ATXN1; (+) strand; PAM type: YTN; PAM sequence: CTC
aaactcctgggctcaagcaa

SEQ ID NO: 252951 - DNA, 20 bp, Artificial Sequence
  Description of Artificial Sequence: Synthetic oligonucleotide
  Target: ATXN1; (+) strand; PAM type: YTN; PAM sequence: CTC
ctgggctcaagcaatctgcc

SEQ ID NO: 252952 - DNA, 20 bp, Artificial Sequence
  Description of Artificial Sequence: Synthetic oligonucleotide
  Target: ATXN1; (+) strand; PAM type: YTN; PAM sequence: CTG
ggctcaagcaatctgcctgc

SEQ ID NO: 252953 - DNA, 20 bp, Artificial Sequence
  Description of Artificial Sequence: Synthetic oligonucleotide
  Target: ATXN1; (+) strand; PAM type: YTN; PAM sequence: CTC
aagcaatctgcctgcctcag

SEQ ID NO: 252954 - DNA, 20 bp, Artificial Sequence
  Description of Artificial Sequence: Synthetic oligonucleotide
  Target: ATXN1; (+) strand; PAM type: YTN; PAM sequence: CTG
cctgcctcagcctcccaaag

SEQ ID NO: 252955 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaaagtgct

SEQ ID NO: 252956 - DNA, 20 bp, Artificial Sequence
  Description of Artificial Sequence: Synthetic oligonucleotide
  Target: ATXN1; (+) strand; PAM type: YTN; PAM sequence: CTC
agcctcccaaagtgctagga

SEQ ID NO: 252957 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctaggattacag

SEQ ID NO: 252958 - DNA, 20 bp, Artificial Sequence
  Description of Artificial Sequence: Synthetic oligonucleotide
  Target: ATXN1; (+) strand; PAM type: YTN; PAM sequence: CTA
ggattacaggcgtgaactac

SEQ ID NO: 252959 - DNA, 20 bp, Artificial Sequence
  Description of Artificial Sequence: Synthetic oligonucleotide
  Target: ATXN1; (+) strand; PAM type: YTN; PAM sequence: TTA
caggcgtgaactaccgtgcc

SEQ ID NO: 252960 - DNA, 20 bp, Artificial Sequence
  Description of Artificial Sequence: Synthetic oligonucleotide
  Target: ATXN1; (+) strand; PAM type: YTN; PAM sequence: CTA
ccgtgcccagcctcccctat

SEQ ID NO: 252961 - DNA, 20 bp, Artificial Sequence
  Description of Artificial Sequence: Synthetic oligonucleotide
  Target: ATXN1; (+) strand; PAM type: YTN; PAM sequence: CTC
ccctatatcatttttactcc

SEQ ID NO: 252962 - DNA, 20 bp, Artificial Sequence
  Description of Artificial Sequence: Synthetic oligonucleotide
  Target: ATXN1; (+) strand; PAM type: YTN; PAM sequence: CTA
tatcatttttactcccaggg

SEQ ID NO: 252963 - DNA, 20 bp, Artificial Sequence
  Description of Artificial Sequence: Synthetic oligonucleotide
  Target: ATXN1; (+) strand; PAM type: YTN; PAM sequence: TTT
ttactcccagggctactatt

SEQ ID NO: 252964 - DNA, 20 bp, Artificial Sequence
  Description of Artificial Sequence: Synthetic oligonucleotide
  Target: ATXN1; (+) strand; PAM type: YTN; PAM sequence: TTT
tactcccagggctactattt

SEQ ID NO: 252965 - DNA, 20 bp, Artificial Sequence
  Description of Artificial Sequence: Synthetic oligonucleotide
  Target: ATXN1; (+) strand; PAM type: YTN; PAM sequence: TTT
actcccagggctactatttc

SEQ ID NO: 252966 - DNA, 20 bp, Artificial Sequence
  Description of Artificial Sequence: Synthetic oligonucleotide
  Target: ATXN1; (+) strand; PAM type: YTN; PAM sequence: TTA
ctcccagggctactatttct

SEQ ID NO: 252967 - DNA, 20 bp, Artificial Sequence
  Description of Artificial Sequence: Synthetic oligonucleotide
  Target: ATXN1; (+) strand; PAM type: YTN; PAM sequence: CTC
ccagggctactatttctttg

SEQ ID NO: 252968 - DNA, 20 bp, Artificial Sequence
  Description of Artificial Sequence: Synthetic oligonucleotide
  Target: ATXN1; (+) strand; PAM type: YTN; PAM sequence: CTA
ctatttctttgaggacaagg

SEQ ID NO: 252969 - DNA, 20 bp, Artificial Sequence
  Description of Artificial Sequence: Synthetic oligonucleotide
  Target: ATXN1; (+) strand; PAM type: YTN; PAM sequence: CTA
tttctttgaggacaaggact

SEQ ID NO: 252970 - DNA, 20 bp, Artificial Sequence
  Description of Artificial Sequence: Synthetic oligonucleotide
  Target: ATXN1; (+) strand; PAM type: YTN; PAM sequence: TTT
ctttgaggacaaggactgtg

SEQ ID NO: 252971 - DNA, 20 bp, Artificial Sequence
  Description of Artificial Sequence: Synthetic oligonucleotide
  Target: ATXN1; (+) strand; PAM type: YTN; PAM sequence: TTC
tttgaggacaaggactgtgt

SEQ ID NO: 252972 - DNA, 20 bp, Artificial Sequence
  Description of Artificial Sequence: Synthetic oligonucleotide
  Target: ATXN1; (+) strand; PAM type: YTN; PAM sequence: CTT
tgaggacaaggactgtgtct

SEQ ID NO: 252973 - DNA, 20 bp, Artificial Sequence
  Description of Artificial Sequence: Synthetic oligonucleotide
  Target: ATXN1; (+) strand; PAM type: YTN; PAM sequence: TTT
gaggacaaggactgtgtctt

SEQ ID NO: 252974 - DNA, 20 bp, Artificial Sequence
  Description of Artificial Sequence: Synthetic oligonucleotide
  Target: ATXN1; (+) strand; PAM type: YTN; PAM sequence: TTG
aggacaaggactgtgtctta

SEQ ID NO: 252975 - DNA, 20 bp, Artificial Sequence
  Description of Artificial Sequence: Synthetic oligonucleotide
  Target: ATXN1; (+) strand; PAM type: YTN; PAM sequence: CTG
tgtcttagtcattgtagtat

SEQ ID NO: 252976 - DNA, 20 bp, Artificial Sequence
  Description of Artificial Sequence: Synthetic oligonucleotide
  Target: ATXN1; (+) strand; PAM type: YTN; PAM sequence: CTT
agtcattgtagtatgatgcg

SEQ ID NO: 252977 - DNA, 20 bp, Artificial Sequence
  Description of Artificial Sequence: Synthetic oligonucleotide
  Target: ATXN1; (+) strand; PAM type: YTN; PAM sequence: TTA
gtcattgtagtatgatgcgt

SEQ ID NO: 252978 - DNA, 20 bp, Artificial Sequence
  Description of Artificial Sequence: Synthetic oligonucleotide
  Target: ATXN1; (+) strand; PAM type: YTN; PAM sequence: TTG
tagtatgatgcgtctaatag

SEQ ID NO: 252979 - DNA, 20 bp, Artificial Sequence
  Description of Artificial Sequence: Synthetic oligonucleotide
  Target: ATXN1; (+) strand; PAM type: YTN; PAM sequence: CTA
atagtacctgacacatagca

SEQ ID NO: 252980 - DNA, 20 bp, Artificial Sequence
  Description of Artificial Sequence: Synthetic oligonucleotide
  Target: ATXN1; (+) strand; PAM type: YTN; PAM sequence: CTG
acacatagcagatgcttagt

SEQ ID NO: 252981 - DNA, 20 bp, Artificial Sequence
  Description of Artificial Sequence: Synthetic oligonucleotide
  Target: ATXN1; (+) strand; PAM type: YTN; PAM sequence: CTT
agtgcatgttagcttgttaa

SEQ ID NO: 252982 - DNA, 20 bp, Artificial Sequence
  Description of Artificial Sequence: Synthetic oligonucleotide
  Target: ATXN1; (+) strand; PAM type: YTN; PAM sequence: TTA
gtgcatgttagcttgttaaa

SEQ ID NO: 252983 - DNA, 20 bp, Artificial Sequence
  Description of Artificial Sequence: Synthetic oligonucleotide
  Target: ATXN1; (+) strand; PAM type: YTN; PAM sequence: TTA
gcttgttaaatacatgcatc

SEQ ID NO: 252984 - DNA, 20 bp, Artificial Sequence
  Description of Artificial Sequence: Synthetic oligonucleotide
  Target: ATXN1; (+) strand; PAM type: YTN; PAM sequence: CTT
gttaaatacatgcatctggc

SEQ ID NO: 252985 - DNA, 20 bp, Artificial Sequence
  Description of Artificial Sequence: Synthetic oligonucleotide
  Target: ATXN1; (+) strand; PAM type: YTN; PAM sequence: TTG
ttaaatacatgcatctggca

SEQ ID NO: 252986 - DNA, 20 bp, Artificial Sequence
  Description of Artificial Sequence: Synthetic oligonucleotide
  Target: ATXN1; (+) strand; PAM type: YTN; PAM sequence: TTA
aatacatgcatctggcacaa

SEQ ID NO: 252987 - DNA, 20 bp, Artificial Sequence
  Description of Artificial Sequence: Synthetic oligonucleotide
  Target: ATXN1; (+) strand; PAM type: YTN; PAM sequence: CTG
gcacaagggatcaagcaaat

SEQ ID NO: 252988 - DNA, 20 bp, Artificial Sequence
  Description of Artificial Sequence: Synthetic oligonucleotide
  Target: ATXN1; (+) strand; PAM type: YTN; PAM sequence: CTC
tgaatgacagattgactagg

SEQ ID NO: 252989 - DNA, 20 bp, Artificial Sequence
  Description of Artificial Sequence: Synthetic oligonucleotide
  Target: ATXN1; (+) strand; PAM type: YTN; PAM sequence: CTG
aatgacagattgactaggaa

SEQ ID NO: 252990 - DNA, 20 bp, Artificial Sequence
  Description of Artificial Sequence: Synthetic oligonucleotide
  Target: ATXN1; (+) strand; PAM type: YTN; PAM sequence: TTG
actaggaagagcgggagatc

SEQ ID NO: 252991 - DNA, 20 bp, Artificial Sequence
  Description of Artificial Sequence: Synthetic oligonucleotide
  Target: ATXN1; (+) strand; PAM type: YTN; PAM sequence: CTA
ggaagagcgggagatcaatg

SEQ ID NO: 252992 - DNA, 20 bp, Artificial Sequence
  Description of Artificial Sequence: Synthetic oligonucleotide
  Target: ATXN1; (+) strand; PAM type: YTN; PAM sequence: CTC
aatggtggtcacggatcagc

SEQ ID NO: 252993 - DNA, 20 bp, Artificial Sequence
  Description of Artificial Sequence: Synthetic oligonucleotide
  Target: ATXN1; (+) strand; PAM type: YTN; PAM sequence: CTC
tcaactaaccatgagaaccc

SEQ ID NO: 252994 - DNA, 20 bp, Artificial Sequence
  Description of Artificial Sequence: Synthetic oligonucleotide
  Target: ATXN1; (+) strand; PAM type: YTN; PAM sequence: CTC
aactaaccatgagaacccgg

SEQ ID NO: 252995 - DNA, 20 bp, Artificial Sequence
  Description of Artificial Sequence: Synthetic oligonucleotide
  Target: ATXN1; (+) strand; PAM type: YTN; PAM sequence: CTA
accatgagaacccggatgaa

SEQ ID NO: 252996 - DNA, 20 bp, Artificial Sequence
  Description of Artificial Sequence: Synthetic oligonucleotide
  Target: ATXN1; (+) strand; PAM type: YTN; PAM sequence: CTA
ggttaagctgatcttttccc

SEQ ID NO: 252997 - DNA, 20 bp, Artificial Sequence
  Description of Artificial Sequence: Synthetic oligonucleotide
  Target: ATXN1; (+) strand; PAM type: YTN; PAM sequence: TTA
agctgatcttttcccctcct

SEQ ID NO: 252998 - DNA, 20 bp, Artificial Sequence
  Description of Artificial Sequence: Synthetic oligonucleotide
  Target: ATXN1; (+) strand; PAM type: YTN; PAM sequence: CTG
atcttttcccctcctcatta

SEQ ID NO: 252999 - DNA, 20 bp, Artificial Sequence
  Description of Artificial Sequence: Synthetic oligonucleotide
  Target: ATXN1; (+) strand; PAM type: YTN; PAM sequence: CTT
ttcccctcctcattaaattg

SEQ ID NO: 253000 - DNA, 20 bp, Artificial Sequence
  Description of Artificial Sequence: Synthetic oligonucleotide
  Target: ATXN1; (+) strand; PAM type: YTN; PAM sequence: TTT
tcccctcctcattaaattgc

SEQ ID NO: 253001 - DNA, 20 bp, Artificial Sequence
  Description of Artificial Sequence: Synthetic oligonucleotide
  Target: ATXN1; (+) strand; PAM type: YTN; PAM sequence: TTT
cccctcctcattaaattgcc

SEQ ID NO: 253002 - DNA, 20 bp, Artificial Sequence
  Description of Artificial Sequence: Synthetic oligonucleotide
  Target: ATXN1; (+) strand; PAM type: YTN; PAM sequence: TTC
ccctcctcattaaattgcca

SEQ ID NO: 253003 - DNA, 20 bp, Artificial Sequence
  Description of Artificial Sequence: Synthetic oligonucleotide
  Target: ATXN1; (+) strand; PAM type: YTN; PAM sequence: CTC
ctcattaaattgccattgct

SEQ ID NO: 253004 - DNA, 20 bp, Artificial Sequence
  Description of Artificial Sequence: Synthetic oligonucleotide
  Target: ATXN1; (+) strand; PAM type: YTN; PAM sequence: CTC
attaaattgccattgctccc

SEQ ID NO: 253005 - DNA, 20 bp, Artificial Sequence
  Description of Artificial Sequence: Synthetic oligonucleotide
  Target: ATXN1; (+) strand; PAM type: YTN; PAM sequence: TTA
aattgccattgctccctata

SEQ ID NO: 253006 - DNA, 20 bp, Artificial Sequence
  Description of Artificial Sequence: Synthetic oligonucleotide
  Target: ATXN1; (+) strand; PAM type: YTN; PAM sequence: TTG
ccattgctccctatagggtc

SEQ ID NO: 253007 - DNA, 20 bp, Artificial Sequence
  Description of Artificial Sequence: Synthetic oligonucleotide
  Target: ATXN1; (+) strand; PAM type: YTN; PAM sequence: TTG
ctccctatagggtcatcaga

SEQ ID NO: 253008 - DNA, 20 bp, Artificial Sequence
  Description of Artificial Sequence: Synthetic oligonucleotide
  Target: ATXN1; (+) strand; PAM type: YTN; PAM sequence: CTC
cctatagggtcatcagaaag

SEQ ID NO: 253009 - DNA, 20 bp, Artificial Sequence
  Description of Artificial Sequence: Synthetic oligonucleotide
  Target: ATXN1; (+) strand; PAM type: YTN; PAM sequence: CTA
tagggtcatcagaaagcctg

SEQ ID NO: 253010 - DNA, 20 bp, Artificial Sequence
  Description of Artificial Sequence: Synthetic oligonucleotide
  Target: ATXN1; (+) strand; PAM type: YTN; PAM sequence: CTG
gatatggcccctgtggaggc

SEQ ID NO: 253011 - DNA, 20 bp, Artificial Sequence
  Description of Artificial Sequence: Synthetic oligonucleotide
  Target: ATXN1; (+) strand; PAM type: YTN; PAM sequence: CTG
tggaggcaccacatatctct

SEQ ID NO: 253012 - DNA, 20 bp, Artificial Sequence
  Description of Artificial Sequence: Synthetic oligonucleotide
  Target: ATXN1; (+) strand; PAM type: YTN; PAM sequence: CTC
tgaatgctgagtaaaacaga

SEQ ID NO: 253013 - DNA, 20 bp, Artificial Sequence
  Description of Artificial Sequence: Synthetic oligonucleotide
  Target: ATXN1; (+) strand; PAM type: YTN; PAM sequence: CTG
aatgctgagtaaaacagata

SEQ ID NO: 253014 - DNA, 20 bp, Artificial Sequence
  Description of Artificial Sequence: Synthetic oligonucleotide
  Target: ATXN1; (+) strand; PAM type: YTN; PAM sequence: CTG
agtaaaacagataatgtaga

SEQ ID NO: 253015 - DNA, 20 bp, Artificial Sequence
  Description of Artificial Sequence: Synthetic oligonucleotide
  Target: ATXN1; (+) strand; PAM type: YTN; PAM sequence: CTT
cttcactgaaagttcactgt

SEQ ID NO: 253016 - DNA, 20 bp, Artificial Sequence
  Description of Artificial Sequence: Synthetic oligonucleotide
  Target: ATXN1; (+) strand; PAM type: YTN; PAM sequence: TTC
ttcactgaaagttcactgtg

SEQ ID NO: 253017 - DNA, 20 bp, Artificial Sequence
  Description of Artificial Sequence: Synthetic oligonucleotide
  Target: ATXN1; (+) strand; PAM type: YTN; PAM sequence: CTT
cactgaaagttcactgtgga

SEQ ID NO: 253018 - DNA, 20 bp, Artificial Sequence
  Description of Artificial Sequence: Synthetic oligonucleotide
  Target: ATXN1; (+) strand; PAM type: YTN; PAM sequence: TTC
actgaaagttcactgtggaa

SEQ ID NO: 253019 - DNA, 20 bp, Artificial Sequence
  Description of Artificial Sequence: Synthetic oligonucleotide
  Target: ATXN1; (+) strand; PAM type: YTN; PAM sequence: CTG
aaagttcactgtggaagacc

SEQ ID NO: 253020 - DNA, 20 bp, Artificial Sequence
  Description of Artificial Sequence: Synthetic oligonucleotide
  Target: ATXN1; (+) strand; PAM type: YTN; PAM sequence: TTC
actgtggaagacctctccat

SEQ ID NO: 253021 - DNA, 20 bp, Artificial Sequence
  Description of Artificial Sequence: Synthetic oligonucleotide
  Target: ATXN1; (+) strand; PAM type: YTN; PAM sequence: CTG
tggaagacctctccatcagc

SEQ ID NO: 253022 - DNA, 20 bp, Artificial Sequence
  Description of Artificial Sequence: Synthetic oligonucleotide
  Target: ATXN1; (+) strand; PAM type: YTN; PAM sequence: CTC
tccatcagccactgagaggg

SEQ ID NO: 253023 - DNA, 20 bp, Artificial Sequence
  Description of Artificial Sequence: Synthetic oligonucleotide
  Target: ATXN1; (+) strand; PAM type: YTN; PAM sequence: CTC
catcagccactgagagggag

SEQ ID NO: 253024 - DNA, 20 bp, Artificial Sequence
  Description of Artificial Sequence: Synthetic oligonucleotide
  Target: ATXN1; (+) strand; PAM type: YTN; PAM sequence: CTG
agagggaggtggtgccctgc

SEQ ID NO: 253025 - DNA, 20 bp, Artificial Sequence
  Description of Artificial Sequence: Synthetic oligonucleotide
  Target: ATXN1; (+) strand; PAM type: YTN; PAM sequence: CTG
ctacttgggtacagaagtca

SEQ ID NO: 253026 - DNA, 20 bp, Artificial Sequence
  Description of Artificial Sequence: Synthetic oligonucleotide
  Target: ATXN1; (+) strand; PAM type: YTN; PAM sequence: CTA
cttgggtacagaagtcaaac

SEQ ID NO: 253027 - DNA, 20 bp, Artificial Sequence
  Description of Artificial Sequence: Synthetic oligonucleotide
  Target: ATXN1; (+) strand; PAM type: YTN; PAM sequence: CTT
gggtacagaagtcaaactca

SEQ ID NO: 253028 - DNA, 20 bp, Artificial Sequence
  Description of Artificial Sequence: Synthetic oligonucleotide
  Target: ATXN1; (+) strand; PAM type: YTN; PAM sequence: TTG
ggtacagaagtcaaactcag

SEQ ID NO: 253029 - DNA, 20 bp, Artificial Sequence
  Description of Artificial Sequence: Synthetic oligonucleotide
  Target: ATXN1; (+) strand; PAM type: YTN; PAM sequence: CTC
agactatgcttgctcgtgat

SEQ ID NO: 253030 - DNA, 20 bp, Artificial Sequence
  Description of Artificial Sequence: Synthetic oligonucleotide
  Target: ATXN1; (+) strand; PAM type: YTN; PAM sequence: CTA
tgcttgctcgtgattctcaa

SEQ ID NO: 253031 - DNA, 20 bp, Artificial Sequence
  Description of Artificial Sequence: Synthetic oligonucleotide
  Target: ATXN1; (+) strand; PAM type: YTN; PAM sequence: CTT
gctcgtgattctcaaacaag

SEQ ID NO: 253032 - DNA, 20 bp, Artificial Sequence
  Description of Artificial Sequence: Synthetic oligonucleotide
  Target: ATXN1; (+) strand; PAM type: YTN; PAM sequence: TTG
ctcgtgattctcaaacaagg

SEQ ID NO: 253033 - DNA, 20 bp, Artificial Sequence
  Description of Artificial Sequence: Synthetic oligonucleotide
  Target: ATXN1; (+) strand; PAM type: YTN; PAM sequence: CTC
gtgattctcaaacaaggcag

SEQ ID NO: 253034 - DNA, 20 bp, Artificial Sequence
  Description of Artificial Sequence: Synthetic oligonucleotide
  Target: ATXN1; (+) strand; PAM type: YTN; PAM sequence: TTC
tcaaacaaggcaggggttac

SEQ ID NO: 253035 - DNA, 20 bp, Artificial Sequence
  Description of Artificial Sequence: Synthetic oligonucleotide
  Target: ATXN1; (+) strand; PAM type: YTN; PAM sequence: CTC
aaacaaggcaggggttaccc

SEQ ID NO: 253036 - DNA, 20 bp, Artificial Sequence
  Description of Artificial Sequence: Synthetic oligonucleotide
  Target: ATXN1; (+) strand; PAM type: YTN; PAM sequence: TTA
ccctcccagggacatctgaa

SEQ ID NO: 253037 - DNA, 20 bp, Artificial Sequence
  Description of Artificial Sequence: Synthetic oligonucleotide
  Target: ATXN1; (+) strand; PAM type: YTN; PAM sequence: CTC
ccagggacatctgaaaagga

SEQ ID NO: 253038 - DNA, 20 bp, Artificial Sequence
  Description of Artificial Sequence: Synthetic oligonucleotide
  Target: ATXN1; (+) strand; PAM type: YTN; PAM sequence: CTG
aaaaggagtggggccattct

SEQ ID NO: 253039 - DNA, 20 bp, Artificial Sequence
  Description of Artificial Sequence: Synthetic oligonucleotide
  Target: ATXN1; (+) strand; PAM type: YTN; PAM sequence: TTC
tgaatccttaaaacaacttg

SEQ ID NO: 253040 - DNA, 20 bp, Artificial Sequence
  Description of Artificial Sequence: Synthetic oligonucleotide
  Target: ATXN1; (+) strand; PAM type: YTN; PAM sequence: CTG
aatccttaaaacaacttgga

SEQ ID NO: 253041 - DNA, 20 bp, Artificial Sequence
  Description of Artificial Sequence: Synthetic oligonucleotide
  Target: ATXN1; (+) strand; PAM type: YTN; PAM sequence: CTT
aaaacaacttggaaacattg

SEQ ID NO: 253042 - DNA, 20 bp, Artificial Sequence
  Description of Artificial Sequence: Synthetic oligonucleotide
  Target: ATXN1; (+) strand; PAM type: YTN; PAM sequence: TTA
aaacaacttggaaacattgt

SEQ ID NO: 253043 - DNA, 20 bp, Artificial Sequence
  Description of Artificial Sequence: Synthetic oligonucleotide
  Target: ATXN1; (+) strand; PAM type: YTN; PAM sequence: CTT
ggaaacattgttgggatgag

SEQ ID NO: 253044 - DNA, 20 bp, Artificial Sequence
  Description of Artificial Sequence: Synthetic oligonucleotide
  Target: ATXN1; (+) strand; PAM type: YTN; PAM sequence: TTG
gaaacattgttgggatgagt

SEQ ID NO: 253045 - DNA, 20 bp, Artificial Sequence
  Description of Artificial Sequence: Synthetic oligonucleotide
  Target: ATXN1; (+) strand; PAM type: YTN; PAM sequence: TTG
ttgggatgagtaggtaggga

SEQ ID NO: 253046 - DNA, 20 bp, Artificial Sequence
  Description of Artificial Sequence: Synthetic oligonucleotide
  Target: ATXN1; (+) strand; PAM type: YTN; PAM sequence: TTG
ggatgagtaggtagggatga

SEQ ID NO: 253047 - DNA, 20 bp, Artificial Sequence
  Description of Artificial Sequence: Synthetic oligonucleotide
  Target: ATXN1; (+) strand; PAM type: YTN; PAM sequence: CTT
gttgtgttgtcatgagcggg

SEQ ID NO: 253048 - DNA, 20 bp, Artificial Sequence
  Description of Artificial Sequence: Synthetic oligonucleotide
  Target: ATXN1; (+) strand; PAM type: YTN; PAM sequence: TTG
ttgtgttgtcatgagcggga

SEQ ID NO: 253049 - DNA, 20 bp, Artificial Sequence
  Description of Artificial Sequence: Synthetic oligonucleotide
  Target: ATXN1; (+) strand; PAM type: YTN; PAM sequence: TTG
tgttgtcatgagcgggagag

SEQ ID NO: 253050 - DNA, 20 bp, Artificial Sequence
  Description of Artificial Sequence: Synthetic oligonucleotide
  Target: ATXN1; (+) strand; PAM type: YTN; PAM sequence: TTG
tcatgagcgggagagctctg

SEQ ID NO: 253051 - DNA, 20 bp, Artificial Sequence
  Description of Artificial Sequence: Synthetic oligonucleotide
  Target: ATXN1; (+) strand; PAM type: YTN; PAM sequence: CTC
tgcatagcagagggccgtcc

SEQ ID NO: 253052 - DNA, 20 bp, Artificial Sequence
  Description of Artificial Sequence: Synthetic oligonucleotide
  Target: ATXN1; (+) strand; PAM type: YTN; PAM sequence: CTG
catagcagagggccgtcctg

SEQ ID NO: 253053 - DNA, 20 bp, Artificial Sequence
  Description of Artificial Sequence: Synthetic oligonucleotide
  Target: ATXN1; (+) strand; PAM type: YTN; PAM sequence: CTG
cctgcttcgttatgaaacac

SEQ ID NO: 253054 - DNA, 20 bp, Artificial Sequence
  Description of Artificial Sequence: Synthetic oligonucleotide
  Target: ATXN1; (+) strand; PAM type: YTN; PAM sequence: CTG
cttcgttatgaaacactgca

SEQ ID NO: 253055 - DNA, 20 bp, Artificial Sequence
  Description of Artificial Sequence: Synthetic oligonucleotide
  Target: ATXN1; (+) strand; PAM type: YTN; PAM sequence: CTT
cgttatgaaacactgcaact

SEQ ID NO: 253056 - DNA, 20 bp, Artificial Sequence
  Description of Artificial Sequence: Synthetic oligonucleotide
  Target: ATXN1; (+) strand; PAM type: YTN; PAM sequence: TTC
gttatgaaacactgcaactt

SEQ ID NO: 253057 - DNA, 20 bp, Artificial Sequence
  Description of Artificial Sequence: Synthetic oligonucleotide
  Target: ATXN1; (+) strand; PAM type: YTN; PAM sequence: TTA
tgaaacactgcaactttaac

SEQ ID NO: 253058 - DNA, 20 bp, Artificial Sequence
  Description of Artificial Sequence: Synthetic oligonucleotide
  Target: ATXN1; (+) strand; PAM type: YTN; PAM sequence: CTG
caactttaacgaaacactct

SEQ ID NO: 253059 - DNA, 20 bp, Artificial Sequence
  Description of Artificial Sequence: Synthetic oligonucleotide
  Target: ATXN1; (+) strand; PAM type: YTN; PAM sequence: CTT
taacgaaacactctctagaa

SEQ ID NO: 253060 - DNA, 20 bp, Artificial Sequence
  Description of Artificial Sequence: Synthetic oligonucleotide
  Target: ATXN1; (+) strand; PAM type: YTN; PAM sequence: TTT
aacgaaacactctctagaac

SEQ ID NO: 253061 - DNA, 20 bp, Artificial Sequence
  Description of Artificial Sequence: Synthetic oligonucleotide
  Target: ATXN1; (+) strand; PAM type: YTN; PAM sequence: TTA
acgaaacactctctagaaca

SEQ ID NO: 253062 - DNA, 20 bp, Artificial Sequence
  Description of Artificial Sequence: Synthetic oligonucleotide
  Target: ATXN1; (+) strand; PAM type: YTN; PAM sequence: CTC
tctagaacagatagcattgt

SEQ ID NO: 253063 - DNA, 20 bp, Artificial Sequence
  Description of Artificial Sequence: Synthetic oligonucleotide
  Target: ATXN1; (+) strand; PAM type: YTN; PAM sequence: CTC
tagaacagatagcattgtct

SEQ ID NO: 253064 - DNA, 20 bp, Artificial Sequence
  Description of Artificial Sequence: Synthetic oligonucleotide
  Target: ATXN1; (+) strand; PAM type: YTN; PAM sequence: CTA
gaacagatagcattgtctta

SEQ ID NO: 253065 - DNA, 20 bp, Artificial Sequence
  Description of Artificial Sequence: Synthetic oligonucleotide
  Target: ATXN1; (+) strand; PAM type: YTN; PAM sequence: TTG
tcttagggttcttctgtatt

SEQ ID NO: 253066 - DNA, 20 bp, Artificial Sequence
  Description of Artificial Sequence: Synthetic oligonucleotide
  Target: ATXN1; (+) strand; PAM type: YTN; PAM sequence: CTT
agggttcttctgtatttaat

SEQ ID NO: 253067 - DNA, 20 bp, Artificial Sequence
  Description of Artificial Sequence: Synthetic oligonucleotide
  Target: ATXN1; (+) strand; PAM type: YTN; PAM sequence: TTA
gggttcttctgtatttaatt

SEQ ID NO: 253068 - DNA, 20 bp, Artificial Sequence
  Description of Artificial Sequence: Synthetic oligonucleotide
  Target: ATXN1; (+) strand; PAM type: YTN; PAM sequence: TTC
ttctgtatttaattcttcct

SEQ ID NO: 253069 - DNA, 20 bp, Artificial Sequence
  Description of Artificial Sequence: Synthetic oligonucleotide
  Target: ATXN1; (+) strand; PAM type: YTN; PAM sequence: CTT
ctgtatttaattcttccttc

SEQ ID NO: 253070 - DNA, 20 bp, Artificial Sequence
  Description of Artificial Sequence: Synthetic oligonucleotide
  Target: ATXN1; (+) strand; PAM type: YTN; PAM sequence: TTC
tgtatttaattcttccttcc

SEQ ID NO: 253071 - DNA, 20 bp, Artificial Sequence
  Description of Artificial Sequence: Synthetic oligonucleotide
  Target: ATXN1; (+) strand; PAM type: YTN; PAM sequence: CTG
tatttaattcttccttccac

SEQ ID NO: 253072 - DNA, 20 bp, Artificial Sequence
  Description of Artificial Sequence: Synthetic oligonucleotide
  Target: ATXN1; (+) strand; PAM type: YTN; PAM sequence: TTT
aattcttccttccacataaa

SEQ ID NO: 253073 - DNA, 20 bp, Artificial Sequence
  Description of Artificial Sequence: Synthetic oligonucleotide
  Target: ATXN1; (+) strand; PAM type: YTN; PAM sequence: TTA
attcttccttccacataaaa

SEQ ID NO: 253074 - DNA, 20 bp, Artificial Sequence
  Description of Artificial Sequence: Synthetic oligonucleotide
  Target: ATXN1; (+) strand; PAM type: YTN; PAM sequence: TTC
ttccttccacataaaatatc

SEQ ID NO: 253075 - DNA, 20 bp, Artificial Sequence
  Description of Artificial Sequence: Synthetic oligonucleotide
  Target: ATXN1; (+) strand; PAM type: YTN; PAM sequence: CTT
ccttccacataaaatatcga

SEQ ID NO: 253076 - DNA, 20 bp, Artificial Sequence
  Description of Artificial Sequence: Synthetic oligonucleotide
  Target: ATXN1; (+) strand; PAM type: YTN; PAM sequence: TTC
cttccacataaaatatcgaa

SEQ ID NO: 253077 - DNA, 20 bp, Artificial Sequence
  Description of Artificial Sequence: Synthetic oligonucleotide
  Target: ATXN1; (+) strand; PAM type: YTN; PAM sequence: CTT
ccacataaaatatcgaatca

SEQ ID NO: 253078 - DNA, 20 bp, Artificial Sequence
  Description of Artificial Sequence: Synthetic oligonucleotide
  Target: ATXN1; (+) strand; PAM type: YTN; PAM sequence: TTC
cacataaaatatcgaatcag

SEQ ID NO: 253079 - DNA, 20 bp, Artificial Sequence
  Description of Artificial Sequence: Synthetic oligonucleotide
  Target: ATXN1; (+) strand; PAM type: YTN; PAM sequence: CTA
tcagatatctcctgtcaaaa

SEQ ID NO: 253080 - DNA, 20 bp, Artificial Sequence
  Description of Artificial Sequence: Synthetic oligonucleotide
  Target: ATXN1; (+) strand; PAM type: YTN; PAM sequence: CTC
ctgtcaaaaatataatacct

SEQ ID NO: 253081 - DNA, 20 bp, Artificial Sequence
  Description of Artificial Sequence: Synthetic oligonucleotide
  Target: ATXN1; (+) strand; PAM type: YTN; PAM sequence: CTG
tcaaaaatataatacctgag

SEQ ID NO: 253082 - DNA, 20 bp, Artificial Sequence
  Description of Artificial Sequence: Synthetic oligonucleotide
  Target: ATXN1; (+) strand; PAM type: YTN; PAM sequence: CTG
aggatatctgcaataatttt

SEQ ID NO: 253083 - DNA, 20 bp, Artificial Sequence
  Description of Artificial Sequence: Synthetic oligonucleotide
  Target: ATXN1; (+) strand; PAM type: YTN; PAM sequence: CTG
caataattttaatagttacc

SEQ ID NO: 253084 - DNA, 20 bp, Artificial Sequence
  Description of Artificial Sequence: Synthetic oligonucleotide
  Target: ATXN1; (+) strand; PAM type: YTN; PAM sequence: TTT
taatagttaccattgaccaa

SEQ ID NO: 253085 - DNA, 20 bp, Artificial Sequence
  Description of Artificial Sequence: Synthetic oligonucleotide
  Target: ATXN1; (+) strand; PAM type: YTN; PAM sequence: TTT
aatagttaccattgaccaaa

SEQ ID NO: 253086 - DNA, 20 bp, Artificial Sequence
  Description of Artificial Sequence: Synthetic oligonucleotide
  Target: ATXN1; (+) strand; PAM type: YTN; PAM sequence: TTA
atagttaccattgaccaaac

SEQ ID NO: 253087 - DNA, 20 bp, Artificial Sequence
  Description of Artificial Sequence: Synthetic oligonucleotide
  Target: ATXN1; (+) strand; PAM type: YTN; PAM sequence: TTA
ccattgaccaaacatccact

SEQ ID NO: 253088 - DNA, 20 bp, Artificial Sequence
  Description of Artificial Sequence: Synthetic oligonucleotide
  Target: ATXN1; (+) strand; PAM type: YTN; PAM sequence: TTG
accaaacatccactacatgc

SEQ ID NO: 253089 - DNA, 20 bp, Artificial Sequence
  Description of Artificial Sequence: Synthetic oligonucleotide
  Target: ATXN1; (+) strand; PAM type: YTN; PAM sequence: CTA
catgccaggtagtgtacaat

SEQ ID NO: 253090 - DNA, 20 bp, Artificial Sequence
  Description of Artificial Sequence: Synthetic oligonucleotide
  Target: ATXN1; (+) strand; PAM type: YTN; PAM sequence: CTA
aatcttaacaacaacaacaa

SEQ ID NO: 253091 - DNA, 20 bp, Artificial Sequence
  Description of Artificial Sequence: Synthetic oligonucleotide
  Target: ATXN1; (+) strand; PAM type: YTN; PAM sequence: CTT
aacaacaacaacaatgaatt

SEQ ID NO: 253092 - DNA, 20 bp, Artificial Sequence
  Description of Artificial Sequence: Synthetic oligonucleotide
  Target: ATXN1; (+) strand; PAM type: YTN; PAM sequence: TTA
acaacaacaacaatgaattt

SEQ ID NO: 253093 - DNA, 20 bp, Artificial Sequence
  Description of Artificial Sequence: Synthetic oligonucleotide
  Target: ATXN1; (+) strand; PAM type: YTN; PAM sequence: TTT
agtggatactttttaaaact

SEQ ID NO: 253094 - DNA, 20 bp, Artificial Sequence
  Description of Artificial Sequence: Synthetic oligonucleotide
  Target: ATXN1; (+) strand; PAM type: YTN; PAM sequence: TTA
gtggatactttttaaaactc

SEQ ID NO: 253095 - DNA, 20 bp, Artificial Sequence
  Description of Artificial Sequence: Synthetic oligonucleotide
  Target: ATXN1; (+) strand; PAM type: YTN; PAM sequence: CTT
tttaaaactcccaattgcat

SEQ ID NO: 253096 - DNA, 20 bp, Artificial Sequence
  Description of Artificial Sequence: Synthetic oligonucleotide
  Target: ATXN1; (+) strand; PAM type: YTN; PAM sequence: TTT
ttaaaactcccaattgcata

SEQ ID NO: 253097 - DNA, 20 bp, Artificial Sequence
  Description of Artificial Sequence: Synthetic oligonucleotide
  Target: ATXN1; (+) strand; PAM type: YTN; PAM sequence: TTT
taaaactcccaattgcataa

SEQ ID NO: 253098 - DNA, 20 bp, Artificial Sequence
  Description of Artificial Sequence: Synthetic oligonucleotide
  Target: ATXN1; (+) strand; PAM type: YTN; PAM sequence: TTT
aaaactcccaattgcataaa

SEQ ID NO: 253099 - DNA, 20 bp, Artificial Sequence
  Description of Artificial Sequence: Synthetic oligonucleotide
  Target: ATXN1; (+) strand; PAM type: YTN; PAM sequence: TTA
aaactcccaattgcataaat

SEQ ID NO: 253100 - DNA, 20 bp, Artificial Sequence
  Description of Artificial Sequence: Synthetic oligonucleotide
  Target: ATXN1; (+) strand; PAM type: YTN; PAM sequence: CTC
ccaattgcataaattcagcc

SEQ ID NO: 253101 - DNA, 20 bp, Artificial Sequence
  Description of Artificial Sequence: Synthetic oligonucleotide
  Target: ATXN1; (+) strand; PAM type: YTN; PAM sequence: TTG
cataaattcagccagagagg

SEQ ID NO: 253102 - DNA, 20 bp, Artificial Sequence
  Description of Artificial Sequence: Synthetic oligonucleotide
  Target: ATXN1; (+) strand; PAM type: YTN; PAM sequence: TTC
agccagagaggaaaaaagca

SEQ ID NO: 253103 - DNA, 20 bp, Artificial Sequence
  Description of Artificial Sequence: Synthetic oligonucleotide
  Target: ATXN1; (+) strand; PAM type: YTN; PAM sequence: CTA
atctaagcaacttaccagtc

SEQ ID NO: 253104 - DNA, 20 bp, Artificial Sequence
  Description of Artificial Sequence: Synthetic oligonucleotide
  Target: ATXN1; (+) strand; PAM type: YTN; PAM sequence: CTA
agcaacttaccagtcagtgg

SEQ ID NO: 253105 - DNA, 20 bp, Artificial Sequence
  Description of Artificial Sequence: Synthetic oligonucleotide
  Target: ATXN1; (+) strand; PAM type: YTN; PAM sequence: CTT
accagtcagtggaggagcca

SEQ ID NO: 253106 - DNA, 20 bp, Artificial Sequence
  Description of Artificial Sequence: Synthetic oligonucleotide
  Target: ATXN1; (+) strand; PAM type: YTN; PAM sequence: TTA
ccagtcagtggaggagccaa

SEQ ID NO: 253107 - DNA, 20 bp, Artificial Sequence
  Description of Artificial Sequence: Synthetic oligonucleotide
  Target: ATXN1; (+) strand; PAM type: YTN; PAM sequence: TTC
ctccgaccccaagtccatag

SEQ ID NO: 253108 - DNA, 20 bp, Artificial Sequence
  Description of Artificial Sequence: Synthetic oligonucleotide
  Target: ATXN1; (+) strand; PAM type: YTN; PAM sequence: CTC
cgaccccaagtccatagatg

SEQ ID NO: 253109 - DNA, 20 bp, Artificial Sequence
  Description of Artificial Sequence: Synthetic oligonucleotide
  Target: ATXN1; (+) strand; PAM type: YTN; PAM sequence: TTA
aacgacaatcttggttttca

SEQ ID NO: 253110 - DNA, 20 bp, Artificial Sequence
  Description of Artificial Sequence: Synthetic oligonucleotide
  Target: ATXN1; (+) strand; PAM type: YTN; PAM sequence: CTT
ggttttcatgatggccaata

SEQ ID NO: 253111 - DNA, 20 bp, Artificial Sequence
  Description of Artificial Sequence: Synthetic oligonucleotide
  Target: ATXN1; (+) strand; PAM type: YTN; PAM sequence: TTG
gttttcatgatggccaataa

SEQ ID NO: 253112 - DNA, 20 bp, Artificial Sequence
  Description of Artificial Sequence: Synthetic oligonucleotide
  Target: ATXN1; (+) strand; PAM type: YTN; PAM sequence: TTT
tcatgatggccaataaccca

SEQ ID NO: 253113 - DNA, 20 bp, Artificial Sequence
  Description of Artificial Sequence: Synthetic oligonucleotide
  Target: ATXN1; (+) strand; PAM type: YTN; PAM sequence: TTT
catgatggccaataacccaa

SEQ ID NO: 253114 - DNA, 20 bp, Artificial Sequence
  Description of Artificial Sequence: Synthetic oligonucleotide
  Target: ATXN1; (+) strand; PAM type: YTN; PAM sequence: TTC
atgatggccaataacccaaa

SEQ ID NO: 253115 - DNA, 20 bp, Artificial Sequence
  Description of Artificial Sequence: Synthetic oligonucleotide
  Target: ATXN1; (+) strand; PAM type: YTN; PAM sequence: CTA
ctatgcacaggggagtgtga

SEQ ID NO: 253116 - DNA, 20 bp, Artificial Sequence
  Description of Artificial Sequence: Synthetic oligonucleotide
  Target: ATXN1; (+) strand; PAM type: YTN; PAM sequence: CTA
tgcacaggggagtgtgaaga

SEQ ID NO: 253117 - DNA, 20 bp, Artificial Sequence
  Description of Artificial Sequence: Synthetic oligonucleotide
  Target: ATXN1; (+) strand; PAM type: YTN; PAM sequence: CTT
gaccactgacagtctcttaa

SEQ ID NO: 253118 - DNA, 20 bp, Artificial Sequence
  Description of Artificial Sequence: Synthetic oligonucleotide
  Target: ATXN1; (+) strand; PAM type: YTN; PAM sequence: TTG
accactgacagtctcttaac

SEQ ID NO: 253119 - DNA, 20 bp, Artificial Sequence
  Description of Artificial Sequence: Synthetic oligonucleotide
  Target: ATXN1; (+) strand; PAM type: YTN; PAM sequence: CTG
acagtctcttaaccaaagaa

SEQ ID NO: 253120 - DNA, 20 bp, Artificial Sequence
  Description of Artificial Sequence: Synthetic oligonucleotide
  Target: ATXN1; (+) strand; PAM type: YTN; PAM sequence: CTC
ttaaccaaagaatctgcagt

SEQ ID NO: 253121 - DNA, 20 bp, Artificial Sequence
  Description of Artificial Sequence: Synthetic oligonucleotide
  Target: ATXN1; (+) strand; PAM type: YTN; PAM sequence: CTT
aaccaaagaatctgcagtca

SEQ ID NO: 253122 - DNA, 20 bp, Artificial Sequence
  Description of Artificial Sequence: Synthetic oligonucleotide
  Target: ATXN1; (+) strand; PAM type: YTN; PAM sequence: TTA
accaaagaatctgcagtcac

SEQ ID NO: 253123 - DNA, 20 bp, Artificial Sequence
  Description of Artificial Sequence: Synthetic oligonucleotide
  Target: ATXN1; (+) strand; PAM type: YTN; PAM sequence: CTG
cagtcacggtgaaaggggct

SEQ ID NO: 253124 - DNA, 20 bp, Artificial Sequence
  Description of Artificial Sequence: Synthetic oligonucleotide
  Target: ATXN1; (+) strand; PAM type: YTN; PAM sequence: CTG
caggtcccatgcaatgctgt

SEQ ID NO: 253125 - DNA, 20 bp, Artificial Sequence
  Description of Artificial Sequence: Synthetic oligonucleotide
  Target: ATXN1; (+) strand; PAM type: YTN; PAM sequence: CTG
tcagctgcaggcctgggaag

SEQ ID NO: 253126 - DNA, 20 bp, Artificial Sequence
  Description of Artificial Sequence: Synthetic oligonucleotide
  Target: ATXN1; (+) strand; PAM type: YTN; PAM sequence: CTG
caggcctgggaagagttcca

SEQ ID NO: 253127 - DNA, 20 bp, Artificial Sequence
  Description of Artificial Sequence: Synthetic oligonucleotide
  Target: ATXN1; (+) strand; PAM type: YTN; PAM sequence: CTG
ggaagagttccatcagcagt

SEQ ID NO: 253128 - DNA, 20 bp, Artificial Sequence
  Description of Artificial Sequence: Synthetic oligonucleotide
  Target: ATXN1; (+) strand; PAM type: YTN; PAM sequence: TTC
catcagcagtaatgatgaac

SEQ ID NO: 253129 - DNA, 20 bp, Artificial Sequence
  Description of Artificial Sequence: Synthetic oligonucleotide
  Target: ATXN1; (+) strand; PAM type: YTN; PAM sequence: CTT
attatgtgtatctatctcac

SEQ ID NO: 253130 - DNA, 20 bp, Artificial Sequence
  Description of Artificial Sequence: Synthetic oligonucleotide
  Target: ATXN1; (+) strand; PAM type: YTN; PAM sequence: TTA
ttatgtgtatctatctcact

SEQ ID NO: 253131 - DNA, 20 bp, Artificial Sequence
  Description of Artificial Sequence: Synthetic oligonucleotide
  Target: ATXN1; (+) strand; PAM type: YTN; PAM sequence: TTA
tgtgtatctatctcactgcc

SEQ ID NO: 253132 - DNA, 20 bp, Artificial Sequence
  Description of Artificial Sequence: Synthetic oligonucleotide
  Target: ATXN1; (+) strand; PAM type: YTN; PAM sequence: CTA
tctcactgccttcttgacag

SEQ ID NO: 253133 - DNA, 20 bp, Artificial Sequence
  Description of Artificial Sequence: Synthetic oligonucleotide
  Target: ATXN1; (+) strand; PAM type: YTN; PAM sequence: CTC
actgccttcttgacaggatc

SEQ ID NO: 253134 - DNA, 20 bp, Artificial Sequence
  Description of Artificial Sequence: Synthetic oligonucleotide
  Target: ATXN1; (+) strand; PAM type: YTN; PAM sequence: CTG
ccttcttgacaggatctctg

SEQ ID NO: 253135 - DNA, 20 bp, Artificial Sequence
  Description of Artificial Sequence: Synthetic oligonucleotide
  Target: ATXN1; (+) strand; PAM type: YTN; PAM sequence: CTT
cttgacaggatctctgctac

SEQ ID NO: 253136 - DNA, 20 bp, Artificial Sequence
  Description of Artificial Sequence: Synthetic oligonucleotide
  Target: ATXN1; (+) strand; PAM type: YTN; PAM sequence: TTC
ttgacaggatctctgctacc

SEQ ID NO: 253137 - DNA, 20 bp, Artificial Sequence
  Description of Artificial Sequence: Synthetic oligonucleotide
  Target: ATXN1; (+) strand; PAM type: YTN; PAM sequence: CTT
gacaggatctctgctaccaa

SEQ ID NO: 253138 - DNA, 20 bp, Artificial Sequence
  Description of Artificial Sequence: Synthetic oligonucleotide
  Target: ATXN1; (+) strand; PAM type: YTN; PAM sequence: TTG
acaggatctctgctaccaaa

SEQ ID NO: 253139 - DNA, 20 bp, Artificial Sequence
  Description of Artificial Sequence: Synthetic oligonucleotide
  Target: ATXN1; (+) strand; PAM type: YTN; PAM sequence: CTC
tgctaccaaaatacagaact

SEQ ID NO: 253140 - DNA, 20 bp, Artificial Sequence
  Description of Artificial Sequence: Synthetic oligonucleotide
  Target: ATXN1; (+) strand; PAM type: YTN; PAM sequence: CTG
ctaccaaaatacagaacttt

SEQ ID NO: 253141 - DNA, 20 bp, Artificial Sequence
  Description of Artificial Sequence: Synthetic oligonucleotide
  Target: ATXN1; (+) strand; PAM type: YTN; PAM sequence: CTA
ccaaaatacagaactttcct

SEQ ID NO: 253142 - DNA, 20 bp, Artificial Sequence
  Description of Artificial Sequence: Synthetic oligonucleotide
  Target: ATXN1; (+) strand; PAM type: YTN; PAM sequence: CTT
tcctgagagtgattcttcac

SEQ ID NO: 253143 - DNA, 20 bp, Artificial Sequence
  Description of Artificial Sequence: Synthetic oligonucleotide
  Target: ATXN1; (+) strand; PAM type: YTN; PAM sequence: TTT
cctgagagtgattcttcaca

SEQ ID NO: 253144 - DNA, 20 bp, Artificial Sequence
  Description of Artificial Sequence: Synthetic oligonucleotide
  Target: ATXN1; (+) strand; PAM type: YTN; PAM sequence: TTC
ctgagagtgattcttcacat

SEQ ID NO: 253145 - DNA, 20 bp, Artificial Sequence
  Description of Artificial Sequence: Synthetic oligonucleotide
  Target: ATXN1; (+) strand; PAM type: YTN; PAM sequence: CTG
agagtgattcttcacataaa

SEQ ID NO: 253146 - DNA, 20 bp, Artificial Sequence
  Description of Artificial Sequence: Synthetic oligonucleotide
  Target: ATXN1; (+) strand; PAM type: YTN; PAM sequence: TTC
ttcacataaaaacacatgaa

SEQ ID NO: 253147 - DNA, 20 bp, Artificial Sequence
  Description of Artificial Sequence: Synthetic oligonucleotide
  Target: ATXN1; (+) strand; PAM type: YTN; PAM sequence: CTT
cacataaaaacacatgaaat

SEQ ID NO: 253148 - DNA, 20 bp, Artificial Sequence
  Description of Artificial Sequence: Synthetic oligonucleotide
  Target: ATXN1; (+) strand; PAM type: YTN; PAM sequence: TTC
acataaaaacacatgaaatt

SEQ ID NO: 253149 - DNA, 20 bp, Artificial Sequence
  Description of Artificial Sequence: Synthetic oligonucleotide
  Target: ATXN1; (+) strand; PAM type: YTN; PAM sequence: TTC
ctcaaaaaaactgaggatca

SEQ ID NO: 253150 - DNA, 20 bp, Artificial Sequence
  Description of Artificial Sequence: Synthetic oligonucleotide
  Target: ATXN1; (+) strand; PAM type: YTN; PAM sequence: CTC
aaaaaaactgaggatcaagt

SEQ ID NO: 253151 - DNA, 20 bp, Artificial Sequence
  Description of Artificial Sequence: Synthetic oligonucleotide
  Target: ATXN1; (+) strand; PAM type: YTN; PAM sequence: CTG
aggatcaagtggtggtttct

SEQ ID NO: 253152 - DNA, 20 bp, Artificial Sequence
  Description of Artificial Sequence: Synthetic oligonucleotide
  Target: ATXN1; (+) strand; PAM type: YTN; PAM sequence: TTT
ctctgagtagcactagattg

SEQ ID NO: 253153 - DNA, 20 bp, Artificial Sequence
  Description of Artificial Sequence: Synthetic oligonucleotide
  Target: ATXN1; (+) strand; PAM type: YTN; PAM sequence: TTC
tctgagtagcactagattgt

SEQ ID NO: 253154 - DNA, 20 bp, Artificial Sequence
  Description of Artificial Sequence: Synthetic oligonucleotide
  Target: ATXN1; (+) strand; PAM type: YTN; PAM sequence: CTC
tgagtagcactagattgtct

SEQ ID NO: 253155 - DNA, 20 bp, Artificial Sequence
  Description of Artificial Sequence: Synthetic oligonucleotide
  Target: ATXN1; (+) strand; PAM type: YTN; PAM sequence: CTG
agtagcactagattgtctgc

SEQ ID NO: 253156 - DNA, 20 bp, Artificial Sequence
  Description of Artificial Sequence: Synthetic oligonucleotide
  Target: ATXN1; (+) strand; PAM type: YTN; PAM sequence: CTA
gattgtctgcttccatcaga

SEQ ID NO: 253157 - DNA, 20 bp, Artificial Sequence
  Description of Artificial Sequence: Synthetic oligonucleotide
  Target: ATXN1; (+) strand; PAM type: YTN; PAM sequence: TTG
tctgcttccatcagacatat

SEQ ID NO: 253158 - DNA, 20 bp, Artificial Sequence
  Description of Artificial Sequence: Synthetic oligonucleotide
  Target: ATXN1; (+) strand; PAM type: YTN; PAM sequence: CTG
cttccatcagacatatggac

SEQ ID NO: 253159 - DNA, 20 bp, Artificial Sequence
  Description of Artificial Sequence: Synthetic oligonucleotide
  Target: ATXN1; (+) strand; PAM type: YTN; PAM sequence: CTT
ccatcagacatatggactct

SEQ ID NO: 253160 - DNA, 20 bp, Artificial Sequence
  Description of Artificial Sequence: Synthetic oligonucleotide
  Target: ATXN1; (+) strand; PAM type: YTN; PAM sequence: TTC
catcagacatatggactctc

SEQ ID NO: 253161 - DNA, 20 bp, Artificial Sequence
  Description of Artificial Sequence: Synthetic oligonucleotide
  Target: ATXN1; (+) strand; PAM type: YTN; PAM sequence: CTC
tcctaagacccgggaagacc

SEQ ID NO: 253162 - DNA, 20 bp, Artificial Sequence
  Description of Artificial Sequence: Synthetic oligonucleotide
  Target: ATXN1; (+) strand; PAM type: YTN; PAM sequence: CTC
ctaagacccgggaagaccac

SEQ ID NO: 253163 - DNA, 20 bp, Artificial Sequence
  Description of Artificial Sequence: Synthetic oligonucleotide
  Target: ATXN1; (+) strand; PAM type: YTN; PAM sequence: CTA
agacccgggaagaccacagg

SEQ ID NO: 253164 - DNA, 20 bp, Artificial Sequence
  Description of Artificial Sequence: Synthetic oligonucleotide
  Target: ATXN1; (+) strand; PAM type: YTN; PAM sequence: CTT
ttgaaataaggatgcaggag

SEQ ID NO: 253165 - DNA, 20 bp, Artificial Sequence
  Description of Artificial Sequence: Synthetic oligonucleotide
  Target: ATXN1; (+) strand; PAM type: YTN; PAM sequence: TTT
tgaaataaggatgcaggaga

SEQ ID NO: 253166 - DNA, 20 bp, Artificial Sequence
  Description of Artificial Sequence: Synthetic oligonucleotide
  Target: ATXN1; (+) strand; PAM type: YTN; PAM sequence: TTT
gaaataaggatgcaggagaa

SEQ ID NO: 253167 - DNA, 20 bp, Artificial Sequence
  Description of Artificial Sequence: Synthetic oligonucleotide
  Target: ATXN1; (+) strand; PAM type: YTN; PAM sequence: TTG
aaataaggatgcaggagaaa

SEQ ID NO: 253168 - DNA, 20 bp, Artificial Sequence
  Description of Artificial Sequence: Synthetic oligonucleotide
  Target: ATXN1; (+) strand; PAM type: YTN; PAM sequence: TTC
tgctacgtcaaataaagtgt

SEQ ID NO: 253169 - DNA, 20 bp, Artificial Sequence
  Description of Artificial Sequence: Synthetic oligonucleotide
  Target: ATXN1; (+) strand; PAM type: YTN; PAM sequence: CTG
ctacgtcaaataaagtgtat

SEQ ID NO: 253170 - DNA, 20 bp, Artificial Sequence
  Description of Artificial Sequence: Synthetic oligonucleotide
  Target: ATXN1; (+) strand; PAM type: YTN; PAM sequence: CTA
cgtcaaataaagtgtattag

SEQ ID NO: 253171 - DNA, 20 bp, Artificial Sequence
  Description of Artificial Sequence: Synthetic oligonucleotide
  Target: ATXN1; (+) strand; PAM type: YTN; PAM sequence: TTA
gattaggtctagtatttatc

SEQ ID NO: 253172 - DNA, 20 bp, Artificial Sequence
  Description of Artificial Sequence: Synthetic oligonucleotide
  Target: ATXN1; (+) strand; PAM type: YTN; PAM sequence: TTA
ggtctagtatttatcttcta

SEQ ID NO: 253173 - DNA, 20 bp, Artificial Sequence
  Description of Artificial Sequence: Synthetic oligonucleotide
  Target: ATXN1; (+) strand; PAM type: YTN; PAM sequence: CTA
gtatttatcttctaaaggaa

SEQ ID NO: 253174 - DNA, 20 bp, Artificial Sequence
  Description of Artificial Sequence: Synthetic oligonucleotide
  Target: ATXN1; (+) strand; PAM type: YTN; PAM sequence: TTT
atcttctaaaggaagtctgc

SEQ ID NO: 253175 - DNA, 20 bp, Artificial Sequence
  Description of Artificial Sequence: Synthetic oligonucleotide
  Target: ATXN1; (+) strand; PAM type: YTN; PAM sequence: TTA
tcttctaaaggaagtctgct

SEQ ID NO: 253176 - DNA, 20 bp, Artificial Sequence
  Description of Artificial Sequence: Synthetic oligonucleotide
  Target: ATXN1; (+) strand; PAM type: YTN; PAM sequence: CTT
ctaaaggaagtctgctgtcc

SEQ ID NO: 253177 - DNA, 20 bp, Artificial Sequence
  Description of Artificial Sequence: Synthetic oligonucleotide
  Target: ATXN1; (+) strand; PAM type: YTN; PAM sequence: TTC
taaaggaagtctgctgtcct

SEQ ID NO: 253178 - DNA, 20 bp, Artificial Sequence
  Description of Artificial Sequence: Synthetic oligonucleotide
  Target: ATXN1; (+) strand; PAM type: YTN; PAM sequence: CTA
aaggaagtctgctgtcctca

SEQ ID NO: 253179 - DNA, 20 bp, Artificial Sequence
  Description of Artificial Sequence: Synthetic oligonucleotide
  Target: ATXN1; (+) strand; PAM type: YTN; PAM sequence: CTG
ctgtcctcacagttgggaac

SEQ ID NO: 253180 - DNA, 20 bp, Artificial Sequence
  Description of Artificial Sequence: Synthetic oligonucleotide
  Target: ATXN1; (+) strand; PAM type: YTN; PAM sequence: CTG
tcctcacagttgggaacttc

SEQ ID NO: 253181 - DNA, 20 bp, Artificial Sequence
  Description of Artificial Sequence: Synthetic oligonucleotide
  Target: ATXN1; (+) strand; PAM type: YTN; PAM sequence: CTC
acagttgggaacttcacatg

SEQ ID NO: 253182 - DNA, 20 bp, Artificial Sequence
  Description of Artificial Sequence: Synthetic oligonucleotide
  Target: ATXN1; (+) strand; PAM type: YTN; PAM sequence: TTG
ggaacttcacatgtgatttc

SEQ ID NO: 253183 - DNA, 20 bp, Artificial Sequence
  Description of Artificial Sequence: Synthetic oligonucleotide
  Target: ATXN1; (+) strand; PAM type: YTN; PAM sequence: CTT
cacatgtgatttctatcagc

SEQ ID NO: 253184 - DNA, 20 bp, Artificial Sequence
  Description of Artificial Sequence: Synthetic oligonucleotide
  Target: ATXN1; (+) strand; PAM type: YTN; PAM sequence: TTC
acatgtgatttctatcagca

SEQ ID NO: 253185 - DNA, 20 bp, Artificial Sequence
  Description of Artificial Sequence: Synthetic oligonucleotide
  Target: ATXN1; (+) strand; PAM type: YTN; PAM sequence: TTT
ctatcagcattttatggacc

SEQ ID NO: 253186 - DNA, 20 bp, Artificial Sequence
  Description of Artificial Sequence: Synthetic oligonucleotide
  Target: ATXN1; (+) strand; PAM type: YTN; PAM sequence: TTC
tatcagcattttatggacca

SEQ ID NO: 253187 - DNA, 20 bp, Artificial Sequence
  Description of Artificial Sequence: Synthetic oligonucleotide
  Target: ATXN1; (+) strand; PAM type: YTN; PAM sequence: CTA
tcagcattttatggaccata

SEQ ID NO: 253188 - DNA, 20 bp, Artificial Sequence
  Description of Artificial Sequence: Synthetic oligonucleotide
  Target: ATXN1; (+) strand; PAM type: YTN; PAM sequence: TTT
tatggaccatatcagaaagc

SEQ ID NO: 253189 - DNA, 20 bp, Artificial Sequence
  Description of Artificial Sequence: Synthetic oligonucleotide
  Target: ATXN1; (+) strand; PAM type: YTN; PAM sequence: TTT
atggaccatatcagaaagct

SEQ ID NO: 253190 - DNA, 20 bp, Artificial Sequence
  Description of Artificial Sequence: Synthetic oligonucleotide
  Target: ATXN1; (+) strand; PAM type: YTN; PAM sequence: TTA
tggaccatatcagaaagctg

SEQ ID NO: 253191 - DNA, 20 bp, Artificial Sequence
  Description of Artificial Sequence: Synthetic oligonucleotide
  Target: ATXN1; (+) strand; PAM type: YTN; PAM sequence: CTG
gcatgattcaataagattca

SEQ ID NO: 253192 - DNA, 20 bp, Artificial Sequence
  Description of Artificial Sequence: Synthetic oligonucleotide
  Target: ATXN1; (+) strand; PAM type: YTN; PAM sequence: TTC
aataagattcagaaaagatg

SEQ ID NO: 253193 - DNA, 20 bp, Artificial Sequence
  Description of Artificial Sequence: Synthetic oligonucleotide
  Target: ATXN1; (+) strand; PAM type: YTN; PAM sequence: TTC
agaaaagatgagaccccagg

SEQ ID NO: 253194 - DNA, 20 bp, Artificial Sequence
  Description of Artificial Sequence: Synthetic oligonucleotide
  Target: ATXN1; (+) strand; PAM type: YTN; PAM sequence: CTA
accacagcccagctagtgga

SEQ ID NO: 253195 - DNA, 20 bp, Artificial Sequence
  Description of Artificial Sequence: Synthetic oligonucleotide
  Target: ATXN1; (+) strand; PAM type: YTN; PAM sequence: CTA
gtggaatgctatgtgacctt

SEQ ID NO: 253196 - DNA, 20 bp, Artificial Sequence
  Description of Artificial Sequence: Synthetic oligonucleotide
  Target: ATXN1; (+) strand; PAM type: YTN; PAM sequence: CTA
tgtgacctttagtgacttgt

SEQ ID NO: 253197 - DNA, 20 bp, Artificial Sequence
  Description of Artificial Sequence: Synthetic oligonucleotide
  Target: ATXN1; (+) strand; PAM type: YTN; PAM sequence: CTT
tagtgacttgttttaacatt

SEQ ID NO: 253198 - DNA, 20 bp, Artificial Sequence
  Description of Artificial Sequence: Synthetic oligonucleotide
  Target: ATXN1; (+) strand; PAM type: YTN; PAM sequence: TTT
agtgacttgttttaacattc

SEQ ID NO: 253199 - DNA, 20 bp, Artificial Sequence
  Description of Artificial Sequence: Synthetic oligonucleotide
  Target: ATXN1; (+) strand; PAM type: YTN; PAM sequence: TTA
gtgacttgttttaacattct

SEQ ID NO: 253200 - DNA, 20 bp, Artificial Sequence
  Description of Artificial Sequence: Synthetic oligonucleotide
  Target: ATXN1; (+) strand; PAM type: YTN; PAM sequence: CTT
gttttaacattctcatgcct

SEQ ID NO: 253201 - DNA, 20 bp, Artificial Sequence
  Description of Artificial Sequence: Synthetic oligonucleotide
  Target: ATXN1; (+) strand; PAM type: YTN; PAM sequence: TTG
ttttaacattctcatgcctc

SEQ ID NO: 253202 - DNA, 20 bp, Artificial Sequence
  Description of Artificial Sequence: Synthetic oligonucleotide
  Target: ATXN1; (+) strand; PAM type: YTN; PAM sequence: TTT
taacattctcatgcctctgc

SEQ ID NO: 253203 - DNA, 20 bp, Artificial Sequence
  Description of Artificial Sequence: Synthetic oligonucleotide
  Target: ATXN1; (+) strand; PAM type: YTN; PAM sequence: TTT
aacattctcatgcctctgct

SEQ ID NO: 253204 - DNA, 20 bp, Artificial Sequence
  Description of Artificial Sequence: Synthetic oligonucleotide
  Target: ATXN1; (+) strand; PAM type: YTN; PAM sequence: TTA
acattctcatgcctctgctc

SEQ ID NO: 253205 - DNA, 20 bp, Artificial Sequence
  Description of Artificial Sequence: Synthetic oligonucleotide
  Target: ATXN1; (+) strand; PAM type: YTN; PAM sequence: TTC
tcatgcctctgctcatgggt

SEQ ID NO: 253206 - DNA, 20 bp, Artificial Sequence
  Description of Artificial Sequence: Synthetic oligonucleotide
  Target: ATXN1; (+) strand; PAM type: YTN; PAM sequence: CTC
atgcctctgctcatgggtta

SEQ ID NO: 253207 - DNA, 20 bp, Artificial Sequence
  Description of Artificial Sequence: Synthetic oligonucleotide
  Target: ATXN1; (+) strand; PAM type: YTN; PAM sequence: CTC
tgctcatgggttactgaact

SEQ ID NO: 253208 - DNA, 20 bp, Artificial Sequence
  Description of Artificial Sequence: Synthetic oligonucleotide
  Target: ATXN1; (+) strand; PAM type: YTN; PAM sequence: CTG
ctcatgggttactgaacttt

SEQ ID NO: 253209 - DNA, 20 bp, Artificial Sequence
  Description of Artificial Sequence: Synthetic oligonucleotide
  Target: ATXN1; (+) strand; PAM type: YTN; PAM sequence: CTC
atgggttactgaacttttct

SEQ ID NO: 253210 - DNA, 20 bp, Artificial Sequence
  Description of Artificial Sequence: Synthetic oligonucleotide
  Target: ATXN1; (+) strand; PAM type: YTN; PAM sequence: TTA
ctgaacttttctaatccaag

SEQ ID NO: 253211 - DNA, 20 bp, Artificial Sequence
  Description of Artificial Sequence: Synthetic oligonucleotide
  Target: ATXN1; (+) strand; PAM type: YTN; PAM sequence: CTG
aacttttctaatccaagggt

SEQ ID NO: 253212 - DNA, 20 bp, Artificial Sequence
  Description of Artificial Sequence: Synthetic oligonucleotide
  Target: ATXN1; (+) strand; PAM type: YTN; PAM sequence: CTT
ttctaatccaagggtctctg

SEQ ID NO: 253213 - DNA, 20 bp, Artificial Sequence
  Description of Artificial Sequence: Synthetic oligonucleotide
  Target: ATXN1; (+) strand; PAM type: YTN; PAM sequence: TTT
tctaatccaagggtctctgc

SEQ ID NO: 253214 - DNA, 20 bp, Artificial Sequence
  Description of Artificial Sequence: Synthetic oligonucleotide
  Target: ATXN1; (+) strand; PAM type: YTN; PAM sequence: TTT
ctaatccaagggtctctgca

SEQ ID NO: 253215 - DNA, 20 bp, Artificial Sequence
  Description of Artificial Sequence: Synthetic oligonucleotide
  Target: ATXN1; (+) strand; PAM type: YTN; PAM sequence: TTC
taatccaagggtctctgcat

SEQ ID NO: 253216 - DNA, 20 bp, Artificial Sequence
  Description of Artificial Sequence: Synthetic oligonucleotide
  Target: ATXN1; (+) strand; PAM type: YTN; PAM sequence: CTA
atccaagggtctctgcatcc

SEQ ID NO: 253217 - DNA, 20 bp, Artificial Sequence
  Description of Artificial Sequence: Synthetic oligonucleotide
  Target: ATXN1; (+) strand; PAM type: YTN; PAM sequence: CTC
tgcatcctacagtctgtaaa

SEQ ID NO: 253218 - DNA, 20 bp, Artificial Sequence
  Description of Artificial Sequence: Synthetic oligonucleotide
  Target: ATXN1; (+) strand; PAM type: YTN; PAM sequence: CTG
catcctacagtctgtaaagc

SEQ ID NO: 253219 - DNA, 20 bp, Artificial Sequence
  Description of Artificial Sequence: Synthetic oligonucleotide
  Target: ATXN1; (+) strand; PAM type: YTN; PAM sequence: CTA
cagtctgtaaagctaattca

SEQ ID NO: 253220 - DNA, 20 bp, Artificial Sequence
  Description of Artificial Sequence: Synthetic oligonucleotide
  Target: ATXN1; (+) strand; PAM type: YTN; PAM sequence: CTG
taaagctaattcataggctt

SEQ ID NO: 253221 - DNA, 20 bp, Artificial Sequence
  Description of Artificial Sequence: Synthetic oligonucleotide
  Target: ATXN1; (+) strand; PAM type: YTN; PAM sequence: CTA
attcataggcttgctgcaaa

SEQ ID NO: 253222 - DNA, 20 bp, Artificial Sequence
  Description of Artificial Sequence: Synthetic oligonucleotide
  Target: ATXN1; (+) strand; PAM type: YTN; PAM sequence: TTC
ataggcttgctgcaaagata

SEQ ID NO: 253223 - DNA, 20 bp, Artificial Sequence
  Description of Artificial Sequence: Synthetic oligonucleotide
  Target: ATXN1; (+) strand; PAM type: YTN; PAM sequence: CTT
gctgcaaagataaatactgc

SEQ ID NO: 253224 - DNA, 20 bp, Artificial Sequence
  Description of Artificial Sequence: Synthetic oligonucleotide
  Target: ATXN1; (+) strand; PAM type: YTN; PAM sequence: TTG
ctgcaaagataaatactgct

SEQ ID NO: 253225 - DNA, 20 bp, Artificial Sequence
  Description of Artificial Sequence: Synthetic oligonucleotide
  Target: ATXN1; (+) strand; PAM type: YTN; PAM sequence: CTG
caaagataaatactgcttta

SEQ ID NO: 253226 - DNA, 20 bp, Artificial Sequence
  Description of Artificial Sequence: Synthetic oligonucleotide
  Target: ATXN1; (+) strand; PAM type: YTN; PAM sequence: CTG
ctttagattcaagtaagctc

SEQ ID NO: 253227 - DNA, 20 bp, Artificial Sequence
  Description of Artificial Sequence: Synthetic oligonucleotide
  Target: ATXN1; (+) strand; PAM type: YTN; PAM sequence: CTT
tagattcaagtaagctctgg

SEQ ID NO: 253228 - DNA, 20 bp, Artificial Sequence
  Description of Artificial Sequence: Synthetic oligonucleotide
  Target: ATXN1; (+) strand; PAM type: YTN; PAM sequence: TTT
agattcaagtaagctctgga

SEQ ID NO: 253229 - DNA, 20 bp, Artificial Sequence
  Description of Artificial Sequence: Synthetic oligonucleotide
  Target: ATXN1; (+) strand; PAM type: YTN; PAM sequence: TTA
gattcaagtaagctctggat

SEQ ID NO: 253230 - DNA, 20 bp, Artificial Sequence
  Description of Artificial Sequence: Synthetic oligonucleotide
  Target: ATXN1; (+) strand; PAM type: YTN; PAM sequence: TTC
aagtaagctctggatatgac

SEQ ID NO: 253231 - DNA, 20 bp, Artificial Sequence
  Description of Artificial Sequence: Synthetic oligonucleotide
  Target: ATXN1; (+) strand; PAM type: YTN; PAM sequence: CTC
tggatatgactgtaagaaat

SEQ ID NO: 253232 - DNA, 20 bp, Artificial Sequence
  Description of Artificial Sequence: Synthetic oligonucleotide
  Target: ATXN1; (+) strand; PAM type: YTN; PAM sequence: CTG
gatatgactgtaagaaatat

SEQ ID NO: 253233 - DNA, 20 bp, Artificial Sequence
  Description of Artificial Sequence: Synthetic oligonucleotide
  Target: ATXN1; (+) strand; PAM type: YTN; PAM sequence: CTG
taagaaatatataattatca

SEQ ID NO: 253234 - DNA, 20 bp, Artificial Sequence
  Description of Artificial Sequence: Synthetic oligonucleotide
  Target: ATXN1; (+) strand; PAM type: YTN; PAM sequence: TTA
tcattatttaaaaaaaatag

SEQ ID NO: 253235 - DNA, 20 bp, Artificial Sequence
  Description of Artificial Sequence: Synthetic oligonucleotide
  Target: ATXN1; (+) strand; PAM type: YTN; PAM sequence: TTA
tttaaaaaaaatagaacaag

SEQ ID NO: 253236 - DNA, 20 bp, Artificial Sequence
  Description of Artificial Sequence: Synthetic oligonucleotide
  Target: ATXN1; (+) strand; PAM type: YTN; PAM sequence: TTT
aaaaaaaatagaacaagaga

SEQ ID NO: 253237 - DNA, 20 bp, Artificial Sequence
  Description of Artificial Sequence: Synthetic oligonucleotide
  Target: ATXN1; (+) strand; PAM type: YTN; PAM sequence: TTA
aaaaaaatagaacaagagac

SEQ ID NO: 253238 - DNA, 20 bp, Artificial Sequence
  Description of Artificial Sequence: Synthetic oligonucleotide
  Target: ATXN1; (+) strand; PAM type: YTN; PAM sequence: CTT
tctattttactttgtttata

SEQ ID NO: 253239 - DNA, 20 bp, Artificial Sequence
  Description of Artificial Sequence: Synthetic oligonucleotide
  Target: ATXN1; (+) strand; PAM type: YTN; PAM sequence: TTT
ctattttactttgtttatac

SEQ ID NO: 253240 - DNA, 20 bp, Artificial Sequence
  Description of Artificial Sequence: Synthetic oligonucleotide
  Target: ATXN1; (+) strand; PAM type: YTN; PAM sequence: TTC
tattttactttgtttatact

SEQ ID NO: 253241 - DNA, 20 bp, Artificial Sequence
  Description of Artificial Sequence: Synthetic oligonucleotide
  Target: ATXN1; (+) strand; PAM type: YTN; PAM sequence: CTA
ttttactttgtttatactgc

SEQ ID NO: 253242 - DNA, 20 bp, Artificial Sequence
  Description of Artificial Sequence: Synthetic oligonucleotide
  Target: ATXN1; (+) strand; PAM type: YTN; PAM sequence: TTT
tactttgtttatactgccct

SEQ ID NO: 253243 - DNA, 20 bp, Artificial Sequence
  Description of Artificial Sequence: Synthetic oligonucleotide
  Target: ATXN1; (+) strand; PAM type: YTN; PAM sequence: TTT
actttgtttatactgccctc

SEQ ID NO: 253244 - DNA, 20 bp, Artificial Sequence
  Description of Artificial Sequence: Synthetic oligonucleotide
  Target: ATXN1; (+) strand; PAM type: YTN; PAM sequence: TTA
ctttgtttatactgccctcc

SEQ ID NO: 253245 - DNA, 20 bp, Artificial Sequence
  Description of Artificial Sequence: Synthetic oligonucleotide
  Target: ATXN1; (+) strand; PAM type: YTN; PAM sequence: CTT
tgtttatactgccctcctga

SEQ ID NO: 253246 - DNA, 20 bp, Artificial Sequence
  Description of Artificial Sequence: Synthetic oligonucleotide
  Target: ATXN1; (+) strand; PAM type: YTN; PAM sequence: TTT
gtttatactgccctcctgac

SEQ ID NO: 253247 - DNA, 20 bp, Artificial Sequence
  Description of Artificial Sequence: Synthetic oligonucleotide
  Target: ATXN1; (+) strand; PAM type: YTN; PAM sequence: TTG
tttatactgccctcctgacc

SEQ ID NO: 253248 - DNA, 20 bp, Artificial Sequence
  Description of Artificial Sequence: Synthetic oligonucleotide
  Target: ATXN1; (+) strand; PAM type: YTN; PAM sequence: TTT
atactgccctcctgaccaat

SEQ ID NO: 253249 - DNA, 20 bp, Artificial Sequence
  Description of Artificial Sequence: Synthetic oligonucleotide
  Target: ATXN1; (+) strand; PAM type: YTN; PAM sequence: TTA
tactgccctcctgaccaatg

SEQ ID NO: 253250 - DNA, 20 bp, Artificial Sequence
  Description of Artificial Sequence: Synthetic oligonucleotide
  Target: ATXN1; (+) strand; PAM type: YTN; PAM sequence: CTG
ccctcctgaccaatgctgtc

SEQ ID NO: 253251 - DNA, 20 bp, Artificial Sequence
  Description of Artificial Sequence: Synthetic oligonucleotide
  Target: ATXN1; (+) strand; PAM type: YTN; PAM sequence: CTC
ctgaccaatgctgtcttcat

SEQ ID NO: 253252 - DNA, 20 bp, Artificial Sequence
  Description of Artificial Sequence: Synthetic oligonucleotide
  Target: ATXN1; (+) strand; PAM type: YTN; PAM sequence: CTG
accaatgctgtcttcattta

SEQ ID NO: 253253 - DNA, 20 bp, Artificial Sequence
  Description of Artificial Sequence: Synthetic oligonucleotide
  Target: ATXN1; (+) strand; PAM type: YTN; PAM sequence: CTG
tcttcatttacttaattacc

SEQ ID NO: 253254 - DNA, 20 bp, Artificial Sequence
  Description of Artificial Sequence: Synthetic oligonucleotide
  Target: ATXN1; (+) strand; PAM type: YTN; PAM sequence: CTT
catttacttaattaccatcc

SEQ ID NO: 253255 - DNA, 20 bp, Artificial Sequence
  Description of Artificial Sequence: Synthetic oligonucleotide
  Target: ATXN1; (+) strand; PAM type: YTN; PAM sequence: TTC
atttacttaattaccatcca

SEQ ID NO: 253256 - DNA, 20 bp, Artificial Sequence
  Description of Artificial Sequence: Synthetic oligonucleotide
  Target: ATXN1; (+) strand; PAM type: YTN; PAM sequence: TTT
acttaattaccatccatcat

SEQ ID NO: 253257 - DNA, 20 bp, Artificial Sequence
  Description of Artificial Sequence: Synthetic oligonucleotide
  Target: ATXN1; (+) strand; PAM type: YTN; PAM sequence: TTA
cttaattaccatccatcatc

SEQ ID NO: 253258 - DNA, 20 bp, Artificial Sequence
  Description of Artificial Sequence: Synthetic oligonucleotide
  Target: ATXN1; (+) strand; PAM type: YTN; PAM sequence: CTT
aattaccatccatcatcctt

SEQ ID NO: 253259 - DNA, 20 bp, Artificial Sequence
  Description of Artificial Sequence: Synthetic oligonucleotide
  Target: ATXN1; (+) strand; PAM type: YTN; PAM sequence: TTA
attaccatccatcatccttg

SEQ ID NO: 253260 - DNA, 20 bp, Artificial Sequence
  Description of Artificial Sequence: Synthetic oligonucleotide
  Target: ATXN1; (+) strand; PAM type: YTN; PAM sequence: TTA
ccatccatcatccttgtctt

SEQ ID NO: 253261 - DNA, 20 bp, Artificial Sequence
  Description of Artificial Sequence: Synthetic oligonucleotide
  Target: ATXN1; (+) strand; PAM type: YTN; PAM sequence: CTT
gtcttttcctgagcactatg

SEQ ID NO: 253262 - DNA, 20 bp, Artificial Sequence
  Description of Artificial Sequence: Synthetic oligonucleotide
  Target: ATXN1; (+) strand; PAM type: YTN; PAM sequence: TTG
tcttttcctgagcactatgt

SEQ ID NO: 253263 - DNA, 20 bp, Artificial Sequence
  Description of Artificial Sequence: Synthetic oligonucleotide
  Target: ATXN1; (+) strand; PAM type: YTN; PAM sequence: CTT
ttcctgagcactatgtgcct

SEQ ID NO: 253264 - DNA, 20 bp, Artificial Sequence
  Description of Artificial Sequence: Synthetic oligonucleotide
  Target: ATXN1; (+) strand; PAM type: YTN; PAM sequence: TTT
tcctgagcactatgtgccta

SEQ ID NO: 253265 - DNA, 20 bp, Artificial Sequence
  Description of Artificial Sequence: Synthetic oligonucleotide
  Target: ATXN1; (+) strand; PAM type: YTN; PAM sequence: TTT
cctgagcactatgtgcctaa

SEQ ID NO: 253266 - DNA, 20 bp, Artificial Sequence
  Description of Artificial Sequence: Synthetic oligonucleotide
  Target: ATXN1; (+) strand; PAM type: YTN; PAM sequence: TTC
ctgagcactatgtgcctaaa

SEQ ID NO: 253267 - DNA, 20 bp, Artificial Sequence
  Description of Artificial Sequence: Synthetic oligonucleotide
  Target: ATXN1; (+) strand; PAM type: YTN; PAM sequence: CTG
agcactatgtgcctaaatta

SEQ ID NO: 253268 - DNA, 20 bp, Artificial Sequence
  Description of Artificial Sequence: Synthetic oligonucleotide
  Target: ATXN1; (+) strand; PAM type: YTN; PAM sequence: CTA
tgtgcctaaattaaaaagat

SEQ ID NO: 253269 - DNA, 20 bp, Artificial Sequence
  Description of Artificial Sequence: Synthetic oligonucleotide
  Target: ATXN1; (+) strand; PAM type: YTN; PAM sequence: CTA
aattaaaaagatgatagtgg

SEQ ID NO: 253270 - DNA, 20 bp, Artificial Sequence
  Description of Artificial Sequence: Synthetic oligonucleotide
  Target: ATXN1; (+) strand; PAM type: YTN; PAM sequence: TTA
aaaagatgatagtggcccgg

SEQ ID NO: 253271 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 253272 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 253273 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggcgggcag

SEQ ID NO: 253274 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggcgggcaga

SEQ ID NO: 253275 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggcgggcagat

SEQ ID NO: 253276 - DNA, 20 bp, Artificial Sequence
  Description of Artificial Sequence: Synthetic oligonucleotide
  Target: ATXN1; (+) strand; PAM type: YTN; PAM sequence: TTC
gagagaccagcctgaccaac

SEQ ID NO: 253277 - DNA, 20 bp, Artificial Sequence
  Description of Artificial Sequence: Synthetic oligonucleotide
  Target: ATXN1; (+) strand; PAM type: YTN; PAM sequence: CTG
accaacatggtgaaacctcg

SEQ ID NO: 253278 - DNA, 20 bp, Artificial Sequence
  Description of Artificial Sequence: Synthetic oligonucleotide
  Target: ATXN1; (+) strand; PAM type: YTN; PAM sequence: CTC
gtctgtactaaaagtacaaa

SEQ ID NO: 253279 - DNA, 20 bp, Artificial Sequence
  Description of Artificial Sequence: Synthetic oligonucleotide
  Target: ATXN1; (+) strand; PAM type: YTN; PAM sequence: CTG
tactaaaagtacaaaaatta

SEQ ID NO: 253280 - DNA, 20 bp, Artificial Sequence
  Description of Artificial Sequence: Synthetic oligonucleotide
  Target: ATXN1; (+) strand; PAM type: YTN; PAM sequence: CTA
aaagtacaaaaattagccgg

SEQ ID NO: 253281 - DNA, 20 bp, Artificial Sequence
  Description of Artificial Sequence: Synthetic oligonucleotide
  Target: ATXN1; (+) strand; PAM type: YTN; PAM sequence: TTA
gccgggcgtggtggcacgcg

SEQ ID NO: 253282 - DNA, 20 bp, Artificial Sequence
  Description of Artificial Sequence: Synthetic oligonucleotide
  Target: ATXN1; (+) strand; PAM type: YTN; PAM sequence: CTG
tcatctcagctactcgggag

SEQ ID NO: 253283 - DNA, 20 bp, Artificial Sequence
  Description of Artificial Sequence: Synthetic oligonucleotide
  Target: ATXN1; (+) strand; PAM type: YTN; PAM sequence: CTC
agctactcgggaggctgagg

SEQ ID NO: 253284 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggctgaggcagga

SEQ ID NO: 253285 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcaggagaa

SEQ ID NO: 253286 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcgcttgaa

SEQ ID NO: 253287 - DNA, 20 bp, Artificial Sequence
  Description of Artificial Sequence: Synthetic oligonucleotide
  Target: ATXN1; (+) strand; PAM type: YTN; PAM sequence: CTT
gaacccgggaggcggaggtt

SEQ ID NO: 253288 - DNA, 20 bp, Artificial Sequence
  Description of Artificial Sequence: Synthetic oligonucleotide
  Target: ATXN1; (+) strand; PAM type: YTN; PAM sequence: TTG
aacccgggaggcggaggttg

SEQ ID NO: 253289 - DNA, 20 bp, Artificial Sequence
  Description of Artificial Sequence: Synthetic oligonucleotide
  Target: ATXN1; (+) strand; PAM type: YTN; PAM sequence: TTG
tagtgagtggagatggcgcc

SEQ ID NO: 253290 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgagtgacag

SEQ ID NO: 253291 - DNA, 20 bp, Artificial Sequence
  Description of Artificial Sequence: Synthetic oligonucleotide
  Target: ATXN1; (+) strand; PAM type: YTN; PAM sequence: CTC
cagcctgagtgacagagcga

SEQ ID NO: 253292 - DNA, 20 bp, Artificial Sequence
  Description of Artificial Sequence: Synthetic oligonucleotide
  Target: ATXN1; (+) strand; PAM type: YTN; PAM sequence: CTG
agtgacagagcgagactcca

SEQ ID NO: 253293 - DNA, 20 bp, Artificial Sequence
  Description of Artificial Sequence: Synthetic oligonucleotide
  Target: ATXN1; (+) strand; PAM type: YTN; PAM sequence: CTC
catctccaaaaaaaaagaaa

SEQ ID NO: 253294 - DNA, 20 bp, Artificial Sequence
  Description of Artificial Sequence: Synthetic oligonucleotide
  Target: ATXN1; (+) strand; PAM type: YTN; PAM sequence: CTC
caaaaaaaaagaaaaaaaaa

SEQ ID NO: 253295 - DNA, 20 bp, Artificial Sequence
  Description of Artificial Sequence: Synthetic oligonucleotide
  Target: ATXN1; (+) strand; PAM type: YTN; PAM sequence: CTT
ggtagcaaatatacacggaa

SEQ ID NO: 253296 - DNA, 20 bp, Artificial Sequence
  Description of Artificial Sequence: Synthetic oligonucleotide
  Target: ATXN1; (+) strand; PAM type: YTN; PAM sequence: TTG
gtagcaaatatacacggaaa

SEQ ID NO: 253297 - DNA, 20 bp, Artificial Sequence
  Description of Artificial Sequence: Synthetic oligonucleotide
  Target: ATXN1; (+) strand; PAM type: YTN; PAM sequence: TTT
ccatgtggtttatgcagttc

SEQ ID NO: 253298 - DNA, 20 bp, Artificial Sequence
  Description of Artificial Sequence: Synthetic oligonucleotide
  Target: ATXN1; (+) strand; PAM type: YTN; PAM sequence: TTC
catgtggtttatgcagttct

SEQ ID NO: 253299 - DNA, 20 bp, Artificial Sequence
  Description of Artificial Sequence: Synthetic oligonucleotide
  Target: ATXN1; (+) strand; PAM type: YTN; PAM sequence: TTT
atgcagttctaaaagaaagc

SEQ ID NO: 253300 - DNA, 20 bp, Artificial Sequence
  Description of Artificial Sequence: Synthetic oligonucleotide
  Target: ATXN1; (+) strand; PAM type: YTN; PAM sequence: TTA
tgcagttctaaaagaaagcg

SEQ ID NO: 253301 - DNA, 20 bp, Artificial Sequence
  Description of Artificial Sequence: Synthetic oligonucleotide
  Target: ATXN1; (+) strand; PAM type: YTN; PAM sequence: TTC
taaaagaaagcgacagatat

SEQ ID NO: 253302 - DNA, 20 bp, Artificial Sequence
  Description of Artificial Sequence: Synthetic oligonucleotide
  Target: ATXN1; (+) strand; PAM type: YTN; PAM sequence: CTA
aaagaaagcgacagatattg

SEQ ID NO: 253303 - DNA, 20 bp, Artificial Sequence
  Description of Artificial Sequence: Synthetic oligonucleotide
  Target: ATXN1; (+) strand; PAM type: YTN; PAM sequence: TTG
catttactgtagacccactt

SEQ ID NO: 253304 - DNA, 20 bp, Artificial Sequence
  Description of Artificial Sequence: Synthetic oligonucleotide
  Target: ATXN1; (+) strand; PAM type: YTN; PAM sequence: TTT
actgtagacccacttcccaa

SEQ ID NO: 253305 - DNA, 20 bp, Artificial Sequence
  Description of Artificial Sequence: Synthetic oligonucleotide
  Target: ATXN1; (+) strand; PAM type: YTN; PAM sequence: TTA
ctgtagacccacttcccaat

SEQ ID NO: 253306 - DNA, 20 bp, Artificial Sequence
  Description of Artificial Sequence: Synthetic oligonucleotide
  Target: ATXN1; (+) strand; PAM type: YTN; PAM sequence: CTG
tagacccacttcccaatttc

SEQ ID NO: 253307 - DNA, 20 bp, Artificial Sequence
  Description of Artificial Sequence: Synthetic oligonucleotide
  Target: ATXN1; (+) strand; PAM type: YTN; PAM sequence: CTT
cccaatttcatttgacttcc

SEQ ID NO: 253308 - DNA, 20 bp, Artificial Sequence
  Description of Artificial Sequence: Synthetic oligonucleotide
  Target: ATXN1; (+) strand; PAM type: YTN; PAM sequence: TTC
ccaatttcatttgacttcct

SEQ ID NO: 253309 - DNA, 20 bp, Artificial Sequence
  Description of Artificial Sequence: Synthetic oligonucleotide
  Target: ATXN1; (+) strand; PAM type: YTN; PAM sequence: TTT
catttgacttccttttgcct

SEQ ID NO: 253310 - DNA, 20 bp, Artificial Sequence
  Description of Artificial Sequence: Synthetic oligonucleotide
  Target: ATXN1; (+) strand; PAM type: YTN; PAM sequence: TTC
atttgacttccttttgcctt

SEQ ID NO: 253311 - DNA, 20 bp, Artificial Sequence
  Description of Artificial Sequence: Synthetic oligonucleotide
  Target: ATXN1; (+) strand; PAM type: YTN; PAM sequence: TTT
gacttccttttgccttgaga

SEQ ID NO: 253312 - DNA, 20 bp, Artificial Sequence
  Description of Artificial Sequence: Synthetic oligonucleotide
  Target: ATXN1; (+) strand; PAM type: YTN; PAM sequence: TTG
acttccttttgccttgagag

SEQ ID NO: 253313 - DNA, 20 bp, Artificial Sequence
  Description of Artificial Sequence: Synthetic oligonucleotide
  Target: ATXN1; (+) strand; PAM type: YTN; PAM sequence: CTT
ccttttgccttgagagtcct

SEQ ID NO: 253314 - DNA, 20 bp, Artificial Sequence
  Description of Artificial Sequence: Synthetic oligonucleotide
  Target: ATXN1; (+) strand; PAM type: YTN; PAM sequence: TTC
cttttgccttgagagtcctt

SEQ ID NO: 253315 - DNA, 20 bp, Artificial Sequence
  Description of Artificial Sequence: Synthetic oligonucleotide
  Target: ATXN1; (+) strand; PAM type: YTN; PAM sequence: CTT
ttgccttgagagtccttaat

SEQ ID NO: 253316 - DNA, 20 bp, Artificial Sequence
  Description of Artificial Sequence: Synthetic oligonucleotide
  Target: ATXN1; (+) strand; PAM type: YTN; PAM sequence: TTT
tgccttgagagtccttaatt

SEQ ID NO: 253317 - DNA, 20 bp, Artificial Sequence
  Description of Artificial Sequence: Synthetic oligonucleotide
  Target: ATXN1; (+) strand; PAM type: YTN; PAM sequence: TTT
gccttgagagtccttaattt

SEQ ID NO: 253318 - DNA, 20 bp, Artificial Sequence
  Description of Artificial Sequence: Synthetic oligonucleotide
  Target: ATXN1; (+) strand; PAM type: YTN; PAM sequence: TTG
ccttgagagtccttaatttt

SEQ ID NO: 253319 - DNA, 20 bp, Artificial Sequence
  Description of Artificial Sequence: Synthetic oligonucleotide
  Target: ATXN1; (+) strand; PAM type: YTN; PAM sequence: CTT
gagagtccttaattttcttg

SEQ ID NO: 253320 - DNA, 20 bp, Artificial Sequence
  Description of Artificial Sequence: Synthetic oligonucleotide
  Target: ATXN1; (+) strand; PAM type: YTN; PAM sequence: TTG
agagtccttaattttcttgt

SEQ ID NO: 253321 - DNA, 20 bp, Artificial Sequence
  Description of Artificial Sequence: Synthetic oligonucleotide
  Target: ATXN1; (+) strand; PAM type: YTN; PAM sequence: CTT
aattttcttgtcttctttag

SEQ ID NO: 253322 - DNA, 20 bp, Artificial Sequence
  Description of Artificial Sequence: Synthetic oligonucleotide
  Target: ATXN1; (+) strand; PAM type: YTN; PAM sequence: TTA
attttcttgtcttctttagg

SEQ ID NO: 253323 - DNA, 20 bp, Artificial Sequence
  Description of Artificial Sequence: Synthetic oligonucleotide
  Target: ATXN1; (+) strand; PAM type: YTN; PAM sequence: TTT
tcttgtcttctttaggctgt

SEQ ID NO: 253324 - DNA, 20 bp, Artificial Sequence
  Description of Artificial Sequence: Synthetic oligonucleotide
  Target: ATXN1; (+) strand; PAM type: YTN; PAM sequence: TTT
cttgtcttctttaggctgta

SEQ ID NO: 253325 - DNA, 20 bp, Artificial Sequence
  Description of Artificial Sequence: Synthetic oligonucleotide
  Target: ATXN1; (+) strand; PAM type: YTN; PAM sequence: TTC
ttgtcttctttaggctgtaa

SEQ ID NO: 253326 - DNA, 20 bp, Artificial Sequence
  Description of Artificial Sequence: Synthetic oligonucleotide
  Target: ATXN1; (+) strand; PAM type: YTN; PAM sequence: CTT
gtcttctttaggctgtaaga

SEQ ID NO: 253327 - DNA, 20 bp, Artificial Sequence
  Description of Artificial Sequence: Synthetic oligonucleotide
  Target: ATXN1; (+) strand; PAM type: YTN; PAM sequence: TTG
tcttctttaggctgtaagac

SEQ ID NO: 253328 - DNA, 20 bp, Artificial Sequence
  Description of Artificial Sequence: Synthetic oligonucleotide
  Target: ATXN1; (+) strand; PAM type: YTN; PAM sequence: CTT
ctttaggctgtaagactact

SEQ ID NO: 253329 - DNA, 20 bp, Artificial Sequence
  Description of Artificial Sequence: Synthetic oligonucleotide
  Target: ATXN1; (+) strand; PAM type: YTN; PAM sequence: TTC
tttaggctgtaagactactg

SEQ ID NO: 253330 - DNA, 20 bp, Artificial Sequence
  Description of Artificial Sequence: Synthetic oligonucleotide
  Target: ATXN1; (+) strand; PAM type: YTN; PAM sequence: CTT
taggctgtaagactactgaa

SEQ ID NO: 253331 - DNA, 20 bp, Artificial Sequence
  Description of Artificial Sequence: Synthetic oligonucleotide
  Target: ATXN1; (+) strand; PAM type: YTN; PAM sequence: TTT
aggctgtaagactactgaat

SEQ ID NO: 253332 - DNA, 20 bp, Artificial Sequence
  Description of Artificial Sequence: Synthetic oligonucleotide
  Target: ATXN1; (+) strand; PAM type: YTN; PAM sequence: TTA
ggctgtaagactactgaatg

SEQ ID NO: 253333 - DNA, 20 bp, Artificial Sequence
  Description of Artificial Sequence: Synthetic oligonucleotide
  Target: ATXN1; (+) strand; PAM type: YTN; PAM sequence: CTG
taagactactgaatgaatga

SEQ ID NO: 253334 - DNA, 20 bp, Artificial Sequence
  Description of Artificial Sequence: Synthetic oligonucleotide
  Target: ATXN1; (+) strand; PAM type: YTN; PAM sequence: CTA
ctgaatgaatgaaggggagg

SEQ ID NO: 253335 - DNA, 20 bp, Artificial Sequence
  Description of Artificial Sequence: Synthetic oligonucleotide
  Target: ATXN1; (+) strand; PAM type: YTN; PAM sequence: CTG
aatgaatgaaggggaggcag

SEQ ID NO: 253336 - DNA, 20 bp, Artificial Sequence
  Description of Artificial Sequence: Synthetic oligonucleotide
  Target: ATXN1; (+) strand; PAM type: YTN; PAM sequence: CTT
ggtttctgaacttatcgaca

SEQ ID NO: 253337 - DNA, 20 bp, Artificial Sequence
  Description of Artificial Sequence: Synthetic oligonucleotide
  Target: ATXN1; (+) strand; PAM type: YTN; PAM sequence: TTG
gtttctgaacttatcgacaa

SEQ ID NO: 253338 - DNA, 20 bp, Artificial Sequence
  Description of Artificial Sequence: Synthetic oligonucleotide
  Target: ATXN1; (+) strand; PAM type: YTN; PAM sequence: TTT
ctgaacttatcgacaatcct

SEQ ID NO: 253339 - DNA, 20 bp, Artificial Sequence
  Description of Artificial Sequence: Synthetic oligonucleotide
  Target: ATXN1; (+) strand; PAM type: YTN; PAM sequence: TTC
tgaacttatcgacaatcctt

SEQ ID NO: 253340 - DNA, 20 bp, Artificial Sequence
  Description of Artificial Sequence: Synthetic oligonucleotide
  Target: ATXN1; (+) strand; PAM type: YTN; PAM sequence: CTG
aacttatcgacaatcctttc

SEQ ID NO: 253341 - DNA, 20 bp, Artificial Sequence
  Description of Artificial Sequence: Synthetic oligonucleotide
  Target: ATXN1; (+) strand; PAM type: YTN; PAM sequence: CTT
atcgacaatcctttcactac

SEQ ID NO: 253342 - DNA, 20 bp, Artificial Sequence
  Description of Artificial Sequence: Synthetic oligonucleotide
  Target: ATXN1; (+) strand; PAM type: YTN; PAM sequence: TTA
tcgacaatcctttcactaca

SEQ ID NO: 253343 - DNA, 20 bp, Artificial Sequence
  Description of Artificial Sequence: Synthetic oligonucleotide
  Target: ATXN1; (+) strand; PAM type: YTN; PAM sequence: CTT
tcactacaagaactacgcag

SEQ ID NO: 253344 - DNA, 20 bp, Artificial Sequence
  Description of Artificial Sequence: Synthetic oligonucleotide
  Target: ATXN1; (+) strand; PAM type: YTN; PAM sequence: TTT
cactacaagaactacgcagc

SEQ ID NO: 253345 - DNA, 20 bp, Artificial Sequence
  Description of Artificial Sequence: Synthetic oligonucleotide
  Target: ATXN1; (+) strand; PAM type: YTN; PAM sequence: TTC
actacaagaactacgcagca

SEQ ID NO: 253346 - DNA, 20 bp, Artificial Sequence
  Description of Artificial Sequence: Synthetic oligonucleotide
  Target: ATXN1; (+) strand; PAM type: YTN; PAM sequence: CTA
caagaactacgcagcagata

SEQ ID NO: 253347 - DNA, 20 bp, Artificial Sequence
  Description of Artificial Sequence: Synthetic oligonucleotide
  Target: ATXN1; (+) strand; PAM type: YTN; PAM sequence: CTA
cgcagcagataaaaagcgag

SEQ ID NO: 253348 - DNA, 20 bp, Artificial Sequence
  Description of Artificial Sequence: Synthetic oligonucleotide
  Target: ATXN1; (+) strand; PAM type: YTN; PAM sequence: CTT
ctgctcattttccttctgga

SEQ ID NO: 253349 - DNA, 20 bp, Artificial Sequence
  Description of Artificial Sequence: Synthetic oligonucleotide
  Target: ATXN1; (+) strand; PAM type: YTN; PAM sequence: TTC
tgctcattttccttctggag

SEQ ID NO: 253350 - DNA, 20 bp, Artificial Sequence
  Description of Artificial Sequence: Synthetic oligonucleotide
  Target: ATXN1; (+) strand; PAM type: YTN; PAM sequence: CTG
ctcattttccttctggagga

SEQ ID NO: 253351 - DNA, 20 bp, Artificial Sequence
  Description of Artificial Sequence: Synthetic oligonucleotide
  Target: ATXN1; (+) strand; PAM type: YTN; PAM sequence: CTC
attttccttctggaggaaaa

SEQ ID NO: 253352 - DNA, 20 bp, Artificial Sequence
  Description of Artificial Sequence: Synthetic oligonucleotide
  Target: ATXN1; (+) strand; PAM type: YTN; PAM sequence: TTT
tccttctggaggaaaagaaa

SEQ ID NO: 253353 - DNA, 20 bp, Artificial Sequence
  Description of Artificial Sequence: Synthetic oligonucleotide
  Target: ATXN1; (+) strand; PAM type: YTN; PAM sequence: TTT
ccttctggaggaaaagaaaa

SEQ ID NO: 253354 - DNA, 20 bp, Artificial Sequence
  Description of Artificial Sequence: Synthetic oligonucleotide
  Target: ATXN1; (+) strand; PAM type: YTN; PAM sequence: TTC
cttctggaggaaaagaaaac

SEQ ID NO: 253355 - DNA, 20 bp, Artificial Sequence
  Description of Artificial Sequence: Synthetic oligonucleotide
  Target: ATXN1; (+) strand; PAM type: YTN; PAM sequence: CTT
ctggaggaaaagaaaacata

SEQ ID NO: 253356 - DNA, 20 bp, Artificial Sequence
  Description of Artificial Sequence: Synthetic oligonucleotide
  Target: ATXN1; (+) strand; PAM type: YTN; PAM sequence: TTC
tggaggaaaagaaaacatag

SEQ ID NO: 253357 - DNA, 20 bp, Artificial Sequence
  Description of Artificial Sequence: Synthetic oligonucleotide
  Target: ATXN1; (+) strand; PAM type: YTN; PAM sequence: CTG
gaggaaaagaaaacatagaa

SEQ ID NO: 253358 - DNA, 20 bp, Artificial Sequence
  Description of Artificial Sequence: Synthetic oligonucleotide
  Target: ATXN1; (+) strand; PAM type: YTN; PAM sequence: TTG
aaaagggttaatggaaagca

SEQ ID NO: 253359 - DNA, 20 bp, Artificial Sequence
  Description of Artificial Sequence: Synthetic oligonucleotide
  Target: ATXN1; (+) strand; PAM type: YTN; PAM sequence: TTA
atggaaagcactaactaaac

SEQ ID NO: 253360 - DNA, 20 bp, Artificial Sequence
  Description of Artificial Sequence: Synthetic oligonucleotide
  Target: ATXN1; (+) strand; PAM type: YTN; PAM sequence: CTA
actaaacattcaggtgtacc

SEQ ID NO: 253361 - DNA, 20 bp, Artificial Sequence
  Description of Artificial Sequence: Synthetic oligonucleotide
  Target: ATXN1; (+) strand; PAM type: YTN; PAM sequence: CTA
aacattcaggtgtaccctga

SEQ ID NO: 253362 - DNA, 20 bp, Artificial Sequence
  Description of Artificial Sequence: Synthetic oligonucleotide
  Target: ATXN1; (+) strand; PAM type: YTN; PAM sequence: TTC
aggtgtaccctgactcacat

SEQ ID NO: 253363 - DNA, 20 bp, Artificial Sequence
  Description of Artificial Sequence: Synthetic oligonucleotide
  Target: ATXN1; (+) strand; PAM type: YTN; PAM sequence: CTG
actcacataggcactgcaat

SEQ ID NO: 253364 - DNA, 20 bp, Artificial Sequence
  Description of Artificial Sequence: Synthetic oligonucleotide
  Target: ATXN1; (+) strand; PAM type: YTN; PAM sequence: CTC
acataggcactgcaatcgtt

SEQ ID NO: 253365 - DNA, 20 bp, Artificial Sequence
  Description of Artificial Sequence: Synthetic oligonucleotide
  Target: ATXN1; (+) strand; PAM type: YTN; PAM sequence: CTG
caatcgttctatttcaaata

SEQ ID NO: 253366 - DNA, 20 bp, Artificial Sequence
  Description of Artificial Sequence: Synthetic oligonucleotide
  Target: ATXN1; (+) strand; PAM type: YTN; PAM sequence: TTC
tatttcaaataagtgggacc

SEQ ID NO: 253367 - DNA, 20 bp, Artificial Sequence
  Description of Artificial Sequence: Synthetic oligonucleotide
  Target: ATXN1; (+) strand; PAM type: YTN; PAM sequence: CTA
tttcaaataagtgggaccag

SEQ ID NO: 253368 - DNA, 20 bp, Artificial Sequence
  Description of Artificial Sequence: Synthetic oligonucleotide
  Target: ATXN1; (+) strand; PAM type: YTN; PAM sequence: TTT
caaataagtgggaccagccc

SEQ ID NO: 253369 - DNA, 20 bp, Artificial Sequence
  Description of Artificial Sequence: Synthetic oligonucleotide
  Target: ATXN1; (+) strand; PAM type: YTN; PAM sequence: TTC
aaataagtgggaccagccca

SEQ ID NO: 253370 - DNA, 20 bp, Artificial Sequence
  Description of Artificial Sequence: Synthetic oligonucleotide
  Target: ATXN1; (+) strand; PAM type: YTN; PAM sequence: CTC
acaggttcattgcacacaac

SEQ ID NO: 253371 - DNA, 20 bp, Artificial Sequence
  Description of Artificial Sequence: Synthetic oligonucleotide
  Target: ATXN1; (+) strand; PAM type: YTN; PAM sequence: TTC
attgcacacaactaaatgct

SEQ ID NO: 253372 - DNA, 20 bp, Artificial Sequence
  Description of Artificial Sequence: Synthetic oligonucleotide
  Target: ATXN1; (+) strand; PAM type: YTN; PAM sequence: TTG
cacacaactaaatgcttaac

SEQ ID NO: 253373 - DNA, 20 bp, Artificial Sequence
  Description of Artificial Sequence: Synthetic oligonucleotide
  Target: ATXN1; (+) strand; PAM type: YTN; PAM sequence: CTA
aatgcttaacctgttccttc

SEQ ID NO: 253374 - DNA, 20 bp, Artificial Sequence
  Description of Artificial Sequence: Synthetic oligonucleotide
  Target: ATXN1; (+) strand; PAM type: YTN; PAM sequence: CTT
aacctgttccttccaacagc

SEQ ID NO: 253375 - DNA, 20 bp, Artificial Sequence
  Description of Artificial Sequence: Synthetic oligonucleotide
  Target: ATXN1; (+) strand; PAM type: YTN; PAM sequence: TTA
acctgttccttccaacagca

SEQ ID NO: 253376 - DNA, 20 bp, Artificial Sequence
  Description of Artificial Sequence: Synthetic oligonucleotide
  Target: ATXN1; (+) strand; PAM type: YTN; PAM sequence: CTG
ttccttccaacagcaggtgt

SEQ ID NO: 253377 - DNA, 20 bp, Artificial Sequence
  Description of Artificial Sequence: Synthetic oligonucleotide
  Target: ATXN1; (+) strand; PAM type: YTN; PAM sequence: TTC
cttccaacagcaggtgtcat

SEQ ID NO: 253378 - DNA, 20 bp, Artificial Sequence
  Description of Artificial Sequence: Synthetic oligonucleotide
  Target: ATXN1; (+) strand; PAM type: YTN; PAM sequence: CTT
ccaacagcaggtgtcatgtg

SEQ ID NO: 253379 - DNA, 20 bp, Artificial Sequence
  Description of Artificial Sequence: Synthetic oligonucleotide
  Target: ATXN1; (+) strand; PAM type: YTN; PAM sequence: TTC
caacagcaggtgtcatgtgc

SEQ ID NO: 253380 - DNA, 20 bp, Artificial Sequence
  Description of Artificial Sequence: Synthetic oligonucleotide
  Target: ATXN1; (+) strand; PAM type: YTN; PAM sequence: CTA
gcccaggatcagtattaaga

SEQ ID NO: 253381 - DNA, 20 bp, Artificial Sequence
  Description of Artificial Sequence: Synthetic oligonucleotide
  Target: ATXN1; (+) strand; PAM type: YTN; PAM sequence: TTA
agagtcctgtgtacgttcac

SEQ ID NO: 253382 - DNA, 20 bp, Artificial Sequence
  Description of Artificial Sequence: Synthetic oligonucleotide
  Target: ATXN1; (+) strand; PAM type: YTN; PAM sequence: CTG
tgtacgttcaccttttgtaa

SEQ ID NO: 253383 - DNA, 20 bp, Artificial Sequence
  Description of Artificial Sequence: Synthetic oligonucleotide
  Target: ATXN1; (+) strand; PAM type: YTN; PAM sequence: TTC
accttttgtaaatcctctca

SEQ ID NO: 253384 - DNA, 20 bp, Artificial Sequence
  Description of Artificial Sequence: Synthetic oligonucleotide
  Target: ATXN1; (+) strand; PAM type: YTN; PAM sequence: CTT
ttgtaaatcctctcactgac

SEQ ID NO: 253385 - DNA, 20 bp, Artificial Sequence
  Description of Artificial Sequence: Synthetic oligonucleotide
  Target: ATXN1; (+) strand; PAM type: YTN; PAM sequence: TTT
tgtaaatcctctcactgact

SEQ ID NO: 253386 - DNA, 20 bp, Artificial Sequence
  Description of Artificial Sequence: Synthetic oligonucleotide
  Target: ATXN1; (+) strand; PAM type: YTN; PAM sequence: TTT
gtaaatcctctcactgactc

SEQ ID NO: 253387 - DNA, 20 bp, Artificial Sequence
  Description of Artificial Sequence: Synthetic oligonucleotide
  Target: ATXN1; (+) strand; PAM type: YTN; PAM sequence: TTG
taaatcctctcactgactca

SEQ ID NO: 253388 - DNA, 20 bp, Artificial Sequence
  Description of Artificial Sequence: Synthetic oligonucleotide
  Target: ATXN1; (+) strand; PAM type: YTN; PAM sequence: CTC
tcactgactcactgcaccaa

SEQ ID NO: 253389 - DNA, 20 bp, Artificial Sequence
  Description of Artificial Sequence: Synthetic oligonucleotide
  Target: ATXN1; (+) strand; PAM type: YTN; PAM sequence: CTC
actgactcactgcaccaagc

SEQ ID NO: 253390 - DNA, 20 bp, Artificial Sequence
  Description of Artificial Sequence: Synthetic oligonucleotide
  Target: ATXN1; (+) strand; PAM type: YTN; PAM sequence: CTG
actcactgcaccaagctatg

SEQ ID NO: 253391 - DNA, 20 bp, Artificial Sequence
  Description of Artificial Sequence: Synthetic oligonucleotide
  Target: ATXN1; (+) strand; PAM type: YTN; PAM sequence: CTC
actgcaccaagctatgttct

SEQ ID NO: 253392 - DNA, 20 bp, Artificial Sequence
  Description of Artificial Sequence: Synthetic oligonucleotide
  Target: ATXN1; (+) strand; PAM type: YTN; PAM sequence: CTG
caccaagctatgttcttgct

SEQ ID NO: 253393 - DNA, 20 bp, Artificial Sequence
  Description of Artificial Sequence: Synthetic oligonucleotide
  Target: ATXN1; (+) strand; PAM type: YTN; PAM sequence: CTA
tgttcttgctattcatttcc

SEQ ID NO: 253394 - DNA, 20 bp, Artificial Sequence
  Description of Artificial Sequence: Synthetic oligonucleotide
  Target: ATXN1; (+) strand; PAM type: YTN; PAM sequence: TTC
ttgctattcatttcccaaaa

SEQ ID NO: 253395 - DNA, 20 bp, Artificial Sequence
  Description of Artificial Sequence: Synthetic oligonucleotide
  Target: ATXN1; (+) strand; PAM type: YTN; PAM sequence: CTT
gctattcatttcccaaaatt

SEQ ID NO: 253396 - DNA, 20 bp, Artificial Sequence
  Description of Artificial Sequence: Synthetic oligonucleotide
  Target: ATXN1; (+) strand; PAM type: YTN; PAM sequence: TTG
ctattcatttcccaaaatta

SEQ ID NO: 253397 - DNA, 20 bp, Artificial Sequence
  Description of Artificial Sequence: Synthetic oligonucleotide
  Target: ATXN1; (+) strand; PAM type: YTN; PAM sequence: CTA
ttcatttcccaaaattagat

SEQ ID NO: 253398 - DNA, 20 bp, Artificial Sequence
  Description of Artificial Sequence: Synthetic oligonucleotide
  Target: ATXN1; (+) strand; PAM type: YTN; PAM sequence: TTC
atttcccaaaattagatttc

SEQ ID NO: 253399 - DNA, 20 bp, Artificial Sequence
  Description of Artificial Sequence: Synthetic oligonucleotide
  Target: ATXN1; (+) strand; PAM type: YTN; PAM sequence: TTT
cccaaaattagatttcctta

SEQ ID NO: 253400 - DNA, 20 bp, Artificial Sequence
  Description of Artificial Sequence: Synthetic oligonucleotide
  Target: ATXN1; (+) strand; PAM type: YTN; PAM sequence: TTC
ccaaaattagatttccttac

SEQ ID NO: 253401 - DNA, 20 bp, Artificial Sequence
  Description of Artificial Sequence: Synthetic oligonucleotide
  Target: ATXN1; (+) strand; PAM type: YTN; PAM sequence: TTA
gatttccttactgcaagaaa

SEQ ID NO: 253402 - DNA, 20 bp, Artificial Sequence
  Description of Artificial Sequence: Synthetic oligonucleotide
  Target: ATXN1; (+) strand; PAM type: YTN; PAM sequence: TTT
ccttactgcaagaaatacat

SEQ ID NO: 253403 - DNA, 20 bp, Artificial Sequence
  Description of Artificial Sequence: Synthetic oligonucleotide
  Target: ATXN1; (+) strand; PAM type: YTN; PAM sequence: TTC
cttactgcaagaaatacata

SEQ ID NO: 253404 - DNA, 20 bp, Artificial Sequence
  Description of Artificial Sequence: Synthetic oligonucleotide
  Target: ATXN1; (+) strand; PAM type: YTN; PAM sequence: CTT
actgcaagaaatacatacag

SEQ ID NO: 253405 - DNA, 20 bp, Artificial Sequence
  Description of Artificial Sequence: Synthetic oligonucleotide
  Target: ATXN1; (+) strand; PAM type: YTN; PAM sequence: TTA
ctgcaagaaatacatacaga

SEQ ID NO: 253406 - DNA, 20 bp, Artificial Sequence
  Description of Artificial Sequence: Synthetic oligonucleotide
  Target: ATXN1; (+) strand; PAM type: YTN; PAM sequence: CTG
caagaaatacatacagatta

SEQ ID NO: 253407 - DNA, 20 bp, Artificial Sequence
  Description of Artificial Sequence: Synthetic oligonucleotide
  Target: ATXN1; (+) strand; PAM type: YTN; PAM sequence: TTA
ttaataggcctactccttat

SEQ ID NO: 253408 - DNA, 20 bp, Artificial Sequence
  Description of Artificial Sequence: Synthetic oligonucleotide
  Target: ATXN1; (+) strand; PAM type: YTN; PAM sequence: TTA
ataggcctactccttatttt

SEQ ID NO: 253409 - DNA, 20 bp, Artificial Sequence
  Description of Artificial Sequence: Synthetic oligonucleotide
  Target: ATXN1; (+) strand; PAM type: YTN; PAM sequence: CTA
ctccttattttaaatataag

SEQ ID NO: 253410 - DNA, 20 bp, Artificial Sequence
  Description of Artificial Sequence: Synthetic oligonucleotide
  Target: ATXN1; (+) strand; PAM type: YTN; PAM sequence: CTC
cttattttaaatataaggat

SEQ ID NO: 253411 - DNA, 20 bp, Artificial Sequence
  Description of Artificial Sequence: Synthetic oligonucleotide
  Target: ATXN1; (+) strand; PAM type: YTN; PAM sequence: CTT
attttaaatataaggatagt

SEQ ID NO: 253412 - DNA, 20 bp, Artificial Sequence
  Description of Artificial Sequence: Synthetic oligonucleotide
  Target: ATXN1; (+) strand; PAM type: YTN; PAM sequence: TTA
ttttaaatataaggatagtg

SEQ ID NO: 253413 - DNA, 20 bp, Artificial Sequence
  Description of Artificial Sequence: Synthetic oligonucleotide
  Target: ATXN1; (+) strand; PAM type: YTN; PAM sequence: TTT
taaatataaggatagtgaag

SEQ ID NO: 253414 - DNA, 20 bp, Artificial Sequence
  Description of Artificial Sequence: Synthetic oligonucleotide
  Target: ATXN1; (+) strand; PAM type: YTN; PAM sequence: TTT
aaatataaggatagtgaagc

SEQ ID NO: 253415 - DNA, 20 bp, Artificial Sequence
  Description of Artificial Sequence: Synthetic oligonucleotide
  Target: ATXN1; (+) strand; PAM type: YTN; PAM sequence: TTA
aatataaggatagtgaagct

SEQ ID NO: 253416 - DNA, 20 bp, Artificial Sequence
  Description of Artificial Sequence: Synthetic oligonucleotide
  Target: ATXN1; (+) strand; PAM type: YTN; PAM sequence: CTT
gttcaaggtgacataaaaag

SEQ ID NO: 253417 - DNA, 20 bp, Artificial Sequence
  Description of Artificial Sequence: Synthetic oligonucleotide
  Target: ATXN1; (+) strand; PAM type: YTN; PAM sequence: TTG
ttcaaggtgacataaaaagt

SEQ ID NO: 253418 - DNA, 20 bp, Artificial Sequence
  Description of Artificial Sequence: Synthetic oligonucleotide
  Target: ATXN1; (+) strand; PAM type: YTN; PAM sequence: TTC
aaggtgacataaaaagtatc

SEQ ID NO: 253419 - DNA, 20 bp, Artificial Sequence
  Description of Artificial Sequence: Synthetic oligonucleotide
  Target: ATXN1; (+) strand; PAM type: YTN; PAM sequence: CTG
taatgtctggctaacacgag

SEQ ID NO: 253420 - DNA, 20 bp, Artificial Sequence
  Description of Artificial Sequence: Synthetic oligonucleotide
  Target: ATXN1; (+) strand; PAM type: YTN; PAM sequence: CTG
gctaacacgagcttcccagg

SEQ ID NO: 253421 - DNA, 20 bp, Artificial Sequence
  Description of Artificial Sequence: Synthetic oligonucleotide
  Target: ATXN1; (+) strand; PAM type: YTN; PAM sequence: CTA
acacgagcttcccaggcttt

SEQ ID NO: 253422 - DNA, 20 bp, Artificial Sequence
  Description of Artificial Sequence: Synthetic oligonucleotide
  Target: ATXN1; (+) strand; PAM type: YTN; PAM sequence: CTT
cccaggctttaagttagcag

SEQ ID NO: 253423 - DNA, 20 bp, Artificial Sequence
  Description of Artificial Sequence: Synthetic oligonucleotide
  Target: ATXN1; (+) strand; PAM type: YTN; PAM sequence: TTC
ccaggctttaagttagcagc

SEQ ID NO: 253424 - DNA, 20 bp, Artificial Sequence
  Description of Artificial Sequence: Synthetic oligonucleotide
  Target: ATXN1; (+) strand; PAM type: YTN; PAM sequence: CTT
taagttagcagctggtccca

SEQ ID NO: 253425 - DNA, 20 bp, Artificial Sequence
  Description of Artificial Sequence: Synthetic oligonucleotide
  Target: ATXN1; (+) strand; PAM type: YTN; PAM sequence: TTT
aagttagcagctggtcccaa

SEQ ID NO: 253426 - DNA, 20 bp, Artificial Sequence
  Description of Artificial Sequence: Synthetic oligonucleotide
  Target: ATXN1; (+) strand; PAM type: YTN; PAM sequence: TTA
agttagcagctggtcccaaa

SEQ ID NO: 253427 - DNA, 20 bp, Artificial Sequence
  Description of Artificial Sequence: Synthetic oligonucleotide
  Target: ATXN1; (+) strand; PAM type: YTN; PAM sequence: TTA
gcagctggtcccaaactaca

SEQ ID NO: 253428 - DNA, 20 bp, Artificial Sequence
  Description of Artificial Sequence: Synthetic oligonucleotide
  Target: ATXN1; (+) strand; PAM type: YTN; PAM sequence: CTG
gtcccaaactacagactcaa

SEQ ID NO: 253429 - DNA, 20 bp, Artificial Sequence
  Description of Artificial Sequence: Synthetic oligonucleotide
  Target: ATXN1; (+) strand; PAM type: YTN; PAM sequence: CTA
cagactcaagtccaccctac

SEQ ID NO: 253430 - DNA, 20 bp, Artificial Sequence
  Description of Artificial Sequence: Synthetic oligonucleotide
  Target: ATXN1; (+) strand; PAM type: YTN; PAM sequence: CTC
aagtccaccctactgctact

SEQ ID NO: 253431 - DNA, 20 bp, Artificial Sequence
  Description of Artificial Sequence: Synthetic oligonucleotide
  Target: ATXN1; (+) strand; PAM type: YTN; PAM sequence: CTA
ctgctactagtactctaact

SEQ ID NO: 253432 - DNA, 20 bp, Artificial Sequence
  Description of Artificial Sequence: Synthetic oligonucleotide
  Target: ATXN1; (+) strand; PAM type: YTN; PAM sequence: CTG
ctactagtactctaactgtg

SEQ ID NO: 253433 - DNA, 20 bp, Artificial Sequence
  Description of Artificial Sequence: Synthetic oligonucleotide
  Target: ATXN1; (+) strand; PAM type: YTN; PAM sequence: CTA
ctagtactctaactgtgaga

SEQ ID NO: 253434 - DNA, 20 bp, Artificial Sequence
  Description of Artificial Sequence: Synthetic oligonucleotide
  Target: ATXN1; (+) strand; PAM type: YTN; PAM sequence: CTA
gtactctaactgtgagatcc

SEQ ID NO: 253435 - DNA, 20 bp, Artificial Sequence
  Description of Artificial Sequence: Synthetic oligonucleotide
  Target: ATXN1; (+) strand; PAM type: YTN; PAM sequence: CTC
taactgtgagatccttgacc

SEQ ID NO: 253436 - DNA, 20 bp, Artificial Sequence
  Description of Artificial Sequence: Synthetic oligonucleotide
  Target: ATXN1; (+) strand; PAM type: YTN; PAM sequence: CTA
actgtgagatccttgaccca

SEQ ID NO: 253437 - DNA, 20 bp, Artificial Sequence
  Description of Artificial Sequence: Synthetic oligonucleotide
  Target: ATXN1; (+) strand; PAM type: YTN; PAM sequence: CTG
tgagatccttgacccatagc

SEQ ID NO: 253438 - DNA, 20 bp, Artificial Sequence
  Description of Artificial Sequence: Synthetic oligonucleotide
  Target: ATXN1; (+) strand; PAM type: YTN; PAM sequence: CTT
gacccatagctctgtacttg

SEQ ID NO: 253439 - DNA, 20 bp, Artificial Sequence
  Description of Artificial Sequence: Synthetic oligonucleotide
  Target: ATXN1; (+) strand; PAM type: YTN; PAM sequence: TTG
acccatagctctgtacttgt

SEQ ID NO: 253440 - DNA, 20 bp, Artificial Sequence
  Description of Artificial Sequence: Synthetic oligonucleotide
  Target: ATXN1; (+) strand; PAM type: YTN; PAM sequence: CTC
tgtacttgttttacttccca

SEQ ID NO: 253441 - DNA, 20 bp, Artificial Sequence
  Description of Artificial Sequence: Synthetic oligonucleotide
  Target: ATXN1; (+) strand; PAM type: YTN; PAM sequence: CTG
tacttgttttacttcccaag

SEQ ID NO: 253442 - DNA, 20 bp, Artificial Sequence
  Description of Artificial Sequence: Synthetic oligonucleotide
  Target: ATXN1; (+) strand; PAM type: YTN; PAM sequence: CTT
gttttacttcccaagaactt

SEQ ID NO: 253443 - DNA, 20 bp, Artificial Sequence
  Description of Artificial Sequence: Synthetic oligonucleotide
  Target: ATXN1; (+) strand; PAM type: YTN; PAM sequence: TTG
ttttacttcccaagaacttc

SEQ ID NO: 253444 - DNA, 20 bp, Artificial Sequence
  Description of Artificial Sequence: Synthetic oligonucleotide
  Target: ATXN1; (+) strand; PAM type: YTN; PAM sequence: TTT
tacttcccaagaacttctgg

SEQ ID NO: 253445 - DNA, 20 bp, Artificial Sequence
  Description of Artificial Sequence: Synthetic oligonucleotide
  Target: ATXN1; (+) strand; PAM type: YTN; PAM sequence: TTT
acttcccaagaacttctggc

SEQ ID NO: 253446 - DNA, 20 bp, Artificial Sequence
  Description of Artificial Sequence: Synthetic oligonucleotide
  Target: ATXN1; (+) strand; PAM type: YTN; PAM sequence: TTA
cttcccaagaacttctggca

SEQ ID NO: 253447 - DNA, 20 bp, Artificial Sequence
  Description of Artificial Sequence: Synthetic oligonucleotide
  Target: ATXN1; (+) strand; PAM type: YTN; PAM sequence: CTT
cccaagaacttctggcaatg

SEQ ID NO: 253448 - DNA, 20 bp, Artificial Sequence
  Description of Artificial Sequence: Synthetic oligonucleotide
  Target: ATXN1; (+) strand; PAM type: YTN; PAM sequence: TTC
ccaagaacttctggcaatgg

SEQ ID NO: 253449 - DNA, 20 bp, Artificial Sequence
  Description of Artificial Sequence: Synthetic oligonucleotide
  Target: ATXN1; (+) strand; PAM type: YTN; PAM sequence: CTT
ctggcaatggtaattctcac

SEQ ID NO: 253450 - DNA, 20 bp, Artificial Sequence
  Description of Artificial Sequence: Synthetic oligonucleotide
  Target: ATXN1; (+) strand; PAM type: YTN; PAM sequence: TTC
tggcaatggtaattctcacc

SEQ ID NO: 253451 - DNA, 20 bp, Artificial Sequence
  Description of Artificial Sequence: Synthetic oligonucleotide
  Target: ATXN1; (+) strand; PAM type: YTN; PAM sequence: CTG
gcaatggtaattctcacctc

SEQ ID NO: 253452 - DNA, 20 bp, Artificial Sequence
  Description of Artificial Sequence: Synthetic oligonucleotide
  Target: ATXN1; (+) strand; PAM type: YTN; PAM sequence: TTC
tcacctctgaatgctgatgt

SEQ ID NO: 253453 - DNA, 20 bp, Artificial Sequence
  Description of Artificial Sequence: Synthetic oligonucleotide
  Target: ATXN1; (+) strand; PAM type: YTN; PAM sequence: CTC
acctctgaatgctgatgttt

SEQ ID NO: 253454 - DNA, 20 bp, Artificial Sequence
  Description of Artificial Sequence: Synthetic oligonucleotide
  Target: ATXN1; (+) strand; PAM type: YTN; PAM sequence: CTC
tgaatgctgatgttttttca

SEQ ID NO: 253455 - DNA, 20 bp, Artificial Sequence
  Description of Artificial Sequence: Synthetic oligonucleotide
  Target: ATXN1; (+) strand; PAM type: YTN; PAM sequence: CTG
aatgctgatgttttttcatt

SEQ ID NO: 253456 - DNA, 20 bp, Artificial Sequence
  Description of Artificial Sequence: Synthetic oligonucleotide
  Target: ATXN1; (+) strand; PAM type: YTN; PAM sequence: CTG
atgttttttcattgccatgt

SEQ ID NO: 253457 - DNA, 20 bp, Artificial Sequence
  Description of Artificial Sequence: Synthetic oligonucleotide
  Target: ATXN1; (+) strand; PAM type: YTN; PAM sequence: TTT
tttcattgccatgttttcag

SEQ ID NO: 253458 - DNA, 20 bp, Artificial Sequence
  Description of Artificial Sequence: Synthetic oligonucleotide
  Target: ATXN1; (+) strand; PAM type: YTN; PAM sequence: TTT
ttcattgccatgttttcagt

SEQ ID NO: 253459 - DNA, 20 bp, Artificial Sequence
  Description of Artificial Sequence: Synthetic oligonucleotide
  Target: ATXN1; (+) strand; PAM type: YTN; PAM sequence: TTT
tcattgccatgttttcagta

SEQ ID NO: 253460 - DNA, 20 bp, Artificial Sequence
  Description of Artificial Sequence: Synthetic oligonucleotide
  Target: ATXN1; (+) strand; PAM type: YTN; PAM sequence: TTT
cattgccatgttttcagtat

SEQ ID NO: 253461 - DNA, 20 bp, Artificial Sequence
  Description of Artificial Sequence: Synthetic oligonucleotide
  Target: ATXN1; (+) strand; PAM type: YTN; PAM sequence: TTC
attgccatgttttcagtatc

SEQ ID NO: 253462 - DNA, 20 bp, Artificial Sequence
  Description of Artificial Sequence: Synthetic oligonucleotide
  Target: ATXN1; (+) strand; PAM type: YTN; PAM sequence: TTG
ccatgttttcagtatctgtt

SEQ ID NO: 253463 - DNA, 20 bp, Artificial Sequence
  Description of Artificial Sequence: Synthetic oligonucleotide
  Target: ATXN1; (+) strand; PAM type: YTN; PAM sequence: TTT
tcagtatctgttgtcctatc

SEQ ID NO: 253464 - DNA, 20 bp, Artificial Sequence
  Description of Artificial Sequence: Synthetic oligonucleotide
  Target: ATXN1; (+) strand; PAM type: YTN; PAM sequence: TTT
cagtatctgttgtcctatca

SEQ ID NO: 253465 - DNA, 20 bp, Artificial Sequence
  Description of Artificial Sequence: Synthetic oligonucleotide
  Target: ATXN1; (+) strand; PAM type: YTN; PAM sequence: TTC
agtatctgttgtcctatcac

SEQ ID NO: 253466 - DNA, 20 bp, Artificial Sequence
  Description of Artificial Sequence: Synthetic oligonucleotide
  Target: ATXN1; (+) strand; PAM type: YTN; PAM sequence: CTG
ttgtcctatcaccttcctgg

SEQ ID NO: 253467 - DNA, 20 bp, Artificial Sequence
  Description of Artificial Sequence: Synthetic oligonucleotide
  Target: ATXN1; (+) strand; PAM type: YTN; PAM sequence: TTG
tcctatcaccttcctggcta

SEQ ID NO: 253468 - DNA, 20 bp, Artificial Sequence
  Description of Artificial Sequence: Synthetic oligonucleotide
  Target: ATXN1; (+) strand; PAM type: YTN; PAM sequence: CTA
tcaccttcctggctaatctt

SEQ ID NO: 253469 - DNA, 20 bp, Artificial Sequence
  Description of Artificial Sequence: Synthetic oligonucleotide
  Target: ATXN1; (+) strand; PAM type: YTN; PAM sequence: CTT
cctggctaatctttattacc

SEQ ID NO: 253470 - DNA, 20 bp, Artificial Sequence
  Description of Artificial Sequence: Synthetic oligonucleotide
  Target: ATXN1; (+) strand; PAM type: YTN; PAM sequence: TTC
ctggctaatctttattaccc

SEQ ID NO: 253471 - DNA, 20 bp, Artificial Sequence
  Description of Artificial Sequence: Synthetic oligonucleotide
  Target: ATXN1; (+) strand; PAM type: YTN; PAM sequence: CTG
gctaatctttattaccctcc

SEQ ID NO: 253472 - DNA, 20 bp, Artificial Sequence
  Description of Artificial Sequence: Synthetic oligonucleotide
  Target: ATXN1; (+) strand; PAM type: YTN; PAM sequence: CTA
atctttattaccctccatgc

SEQ ID NO: 253473 - DNA, 20 bp, Artificial Sequence
  Description of Artificial Sequence: Synthetic oligonucleotide
  Target: ATXN1; (+) strand; PAM type: YTN; PAM sequence: CTT
tattaccctccatgccctgc

SEQ ID NO: 253474 - DNA, 20 bp, Artificial Sequence
  Description of Artificial Sequence: Synthetic oligonucleotide
  Target: ATXN1; (+) strand; PAM type: YTN; PAM sequence: TTT
attaccctccatgccctgca

SEQ ID NO: 253475 - DNA, 20 bp, Artificial Sequence
  Description of Artificial Sequence: Synthetic oligonucleotide
  Target: ATXN1; (+) strand; PAM type: YTN; PAM sequence: TTA
ttaccctccatgccctgcat

SEQ ID NO: 253476 - DNA, 20 bp, Artificial Sequence
  Description of Artificial Sequence: Synthetic oligonucleotide
  Target: ATXN1; (+) strand; PAM type: YTN; PAM sequence: TTA
ccctccatgccctgcatctt

SEQ ID NO: 253477 - DNA, 20 bp, Artificial Sequence
  Description of Artificial Sequence: Synthetic oligonucleotide
  Target: ATXN1; (+) strand; PAM type: YTN; PAM sequence: CTC
catgccctgcatcttgggcc

SEQ ID NO: 253478 - DNA, 20 bp, Artificial Sequence
  Description of Artificial Sequence: Synthetic oligonucleotide
  Target: ATXN1; (+) strand; PAM type: YTN; PAM sequence: CTG
catcttgggccccactgaga

SEQ ID NO: 253479 - DNA, 20 bp, Artificial Sequence
  Description of Artificial Sequence: Synthetic oligonucleotide
  Target: ATXN1; (+) strand; PAM type: YTN; PAM sequence: CTT
gggccccactgagagctttg

SEQ ID NO: 253480 - DNA, 20 bp, Artificial Sequence
  Description of Artificial Sequence: Synthetic oligonucleotide
  Target: ATXN1; (+) strand; PAM type: YTN; PAM sequence: TTG
ggccccactgagagctttgc

SEQ ID NO: 253481 - DNA, 20 bp, Artificial Sequence
  Description of Artificial Sequence: Synthetic oligonucleotide
  Target: ATXN1; (+) strand; PAM type: YTN; PAM sequence: CTG
agagctttgctgggagtatg

SEQ ID NO: 253482 - DNA, 20 bp, Artificial Sequence
  Description of Artificial Sequence: Synthetic oligonucleotide
  Target: ATXN1; (+) strand; PAM type: YTN; PAM sequence: CTT
tgctgggagtatgcatgcaa

SEQ ID NO: 253483 - DNA, 20 bp, Artificial Sequence
  Description of Artificial Sequence: Synthetic oligonucleotide
  Target: ATXN1; (+) strand; PAM type: YTN; PAM sequence: TTT
gctgggagtatgcatgcaag

SEQ ID NO: 253484 - DNA, 20 bp, Artificial Sequence
  Description of Artificial Sequence: Synthetic oligonucleotide
  Target: ATXN1; (+) strand; PAM type: YTN; PAM sequence: TTG
ctgggagtatgcatgcaagc

SEQ ID NO: 253485 - DNA, 20 bp, Artificial Sequence
  Description of Artificial Sequence: Synthetic oligonucleotide
  Target: ATXN1; (+) strand; PAM type: YTN; PAM sequence: CTG
ggagtatgcatgcaagcatc

SEQ ID NO: 253486 - DNA, 20 bp, Artificial Sequence
  Description of Artificial Sequence: Synthetic oligonucleotide
  Target: ATXN1; (+) strand; PAM type: YTN; PAM sequence: CTT
tctctcatacactgcactgc

SEQ ID NO: 253487 - DNA, 20 bp, Artificial Sequence
  Description of Artificial Sequence: Synthetic oligonucleotide
  Target: ATXN1; (+) strand; PAM type: YTN; PAM sequence: TTT
ctctcatacactgcactgcc

SEQ ID NO: 253488 - DNA, 20 bp, Artificial Sequence
  Description of Artificial Sequence: Synthetic oligonucleotide
  Target: ATXN1; (+) strand; PAM type: YTN; PAM sequence: TTC
tctcatacactgcactgcct

SEQ ID NO: 253489 - DNA, 20 bp, Artificial Sequence
  Description of Artificial Sequence: Synthetic oligonucleotide
  Target: ATXN1; (+) strand; PAM type: YTN; PAM sequence: CTC
tcatacactgcactgccttt

SEQ ID NO: 253490 - DNA, 20 bp, Artificial Sequence
  Description of Artificial Sequence: Synthetic oligonucleotide
  Target: ATXN1; (+) strand; PAM type: YTN; PAM sequence: CTC
atacactgcactgcctttgg

SEQ ID NO: 253491 - DNA, 20 bp, Artificial Sequence
  Description of Artificial Sequence: Synthetic oligonucleotide
  Target: ATXN1; (+) strand; PAM type: YTN; PAM sequence: CTG
cactgcctttgggatgcctg

SEQ ID NO: 253492 - DNA, 20 bp, Artificial Sequence
  Description of Artificial Sequence: Synthetic oligonucleotide
  Target: ATXN1; (+) strand; PAM type: YTN; PAM sequence: CTG
cctttgggatgcctgagttc

SEQ ID NO: 253493 - DNA, 20 bp, Artificial Sequence
  Description of Artificial Sequence: Synthetic oligonucleotide
  Target: ATXN1; (+) strand; PAM type: YTN; PAM sequence: CTT
tgggatgcctgagttcatac

SEQ ID NO: 253494 - DNA, 20 bp, Artificial Sequence
  Description of Artificial Sequence: Synthetic oligonucleotide
  Target: ATXN1; (+) strand; PAM type: YTN; PAM sequence: TTT
gggatgcctgagttcatact

SEQ ID NO: 253495 - DNA, 20 bp, Artificial Sequence
  Description of Artificial Sequence: Synthetic oligonucleotide
  Target: ATXN1; (+) strand; PAM type: YTN; PAM sequence: TTG
ggatgcctgagttcatacta

SEQ ID NO: 253496 - DNA, 20 bp, Artificial Sequence
  Description of Artificial Sequence: Synthetic oligonucleotide
  Target: ATXN1; (+) strand; PAM type: YTN; PAM sequence: CTG
agttcatactatttccataa

SEQ ID NO: 253497 - DNA, 20 bp, Artificial Sequence
  Description of Artificial Sequence: Synthetic oligonucleotide
  Target: ATXN1; (+) strand; PAM type: YTN; PAM sequence: TTC
atactatttccataactgcc

SEQ ID NO: 253498 - DNA, 20 bp, Artificial Sequence
  Description of Artificial Sequence: Synthetic oligonucleotide
  Target: ATXN1; (+) strand; PAM type: YTN; PAM sequence: CTA
tttccataactgcccatccc

SEQ ID NO: 253499 - DNA, 20 bp, Artificial Sequence
  Description of Artificial Sequence: Synthetic oligonucleotide
  Target: ATXN1; (+) strand; PAM type: YTN; PAM sequence: TTT
ccataactgcccatccctga

SEQ ID NO: 253500 - DNA, 20 bp, Artificial Sequence
  Description of Artificial Sequence: Synthetic oligonucleotide
  Target: ATXN1; (+) strand; PAM type: YTN; PAM sequence: TTC
cataactgcccatccctgaa

SEQ ID NO: 253501 - DNA, 20 bp, Artificial Sequence
  Description of Artificial Sequence: Synthetic oligonucleotide
  Target: ATXN1; (+) strand; PAM type: YTN; PAM sequence: CTG
cccatccctgaaatagatga

SEQ ID NO: 253502 - DNA, 20 bp, Artificial Sequence
  Description of Artificial Sequence: Synthetic oligonucleotide
  Target: ATXN1; (+) strand; PAM type: YTN; PAM sequence: CTG
aaatagatgaacagtggcct

SEQ ID NO: 253503 - DNA, 20 bp, Artificial Sequence
  Description of Artificial Sequence: Synthetic oligonucleotide
  Target: ATXN1; (+) strand; PAM type: YTN; PAM sequence: CTT
ctctctagtttagaacttgg

SEQ ID NO: 253504 - DNA, 20 bp, Artificial Sequence
  Description of Artificial Sequence: Synthetic oligonucleotide
  Target: ATXN1; (+) strand; PAM type: YTN; PAM sequence: TTC
tctctagtttagaacttggg

SEQ ID NO: 253505 - DNA, 20 bp, Artificial Sequence
  Description of Artificial Sequence: Synthetic oligonucleotide
  Target: ATXN1; (+) strand; PAM type: YTN; PAM sequence: CTC
tctagtttagaacttgggtt

SEQ ID NO: 253506 - DNA, 20 bp, Artificial Sequence
  Description of Artificial Sequence: Synthetic oligonucleotide
  Target: ATXN1; (+) strand; PAM type: YTN; PAM sequence: CTC
tagtttagaacttgggttgt

SEQ ID NO: 253507 - DNA, 20 bp, Artificial Sequence
  Description of Artificial Sequence: Synthetic oligonucleotide
  Target: ATXN1; (+) strand; PAM type: YTN; PAM sequence: CTA
gtttagaacttgggttgtta

SEQ ID NO: 253508 - DNA, 20 bp, Artificial Sequence
  Description of Artificial Sequence: Synthetic oligonucleotide
  Target: ATXN1; (+) strand; PAM type: YTN; PAM sequence: TTT
agaacttgggttgttagact

SEQ ID NO: 253509 - DNA, 20 bp, Artificial Sequence
  Description of Artificial Sequence: Synthetic oligonucleotide
  Target: ATXN1; (+) strand; PAM type: YTN; PAM sequence: TTA
gaacttgggttgttagactc

SEQ ID NO: 253510 - DNA, 20 bp, Artificial Sequence
  Description of Artificial Sequence: Synthetic oligonucleotide
  Target: ATXN1; (+) strand; PAM type: YTN; PAM sequence: CTT
gggttgttagactccttggg

SEQ ID NO: 253511 - DNA, 20 bp, Artificial Sequence
  Description of Artificial Sequence: Synthetic oligonucleotide
  Target: ATXN1; (+) strand; PAM type: YTN; PAM sequence: TTG
ggttgttagactccttgggt

SEQ ID NO: 253512 - DNA, 20 bp, Artificial Sequence
  Description of Artificial Sequence: Synthetic oligonucleotide
  Target: ATXN1; (+) strand; PAM type: YTN; PAM sequence: TTG
ttagactccttgggtctatc

SEQ ID NO: 253513 - DNA, 20 bp, Artificial Sequence
  Description of Artificial Sequence: Synthetic oligonucleotide
  Target: ATXN1; (+) strand; PAM type: YTN; PAM sequence: TTA
gactccttgggtctatctta

SEQ ID NO: 253514 - DNA, 20 bp, Artificial Sequence
  Description of Artificial Sequence: Synthetic oligonucleotide
  Target: ATXN1; (+) strand; PAM type: YTN; PAM sequence: CTC
cttgggtctatcttagcttc

SEQ ID NO: 253515 - DNA, 20 bp, Artificial Sequence
  Description of Artificial Sequence: Synthetic oligonucleotide
  Target: ATXN1; (+) strand; PAM type: YTN; PAM sequence: CTT
gggtctatcttagcttctct

SEQ ID NO: 253516 - DNA, 20 bp, Artificial Sequence
  Description of Artificial Sequence: Synthetic oligonucleotide
  Target: ATXN1; (+) strand; PAM type: YTN; PAM sequence: TTG
ggtctatcttagcttctctc

SEQ ID NO: 253517 - DNA, 20 bp, Artificial Sequence
  Description of Artificial Sequence: Synthetic oligonucleotide
  Target: ATXN1; (+) strand; PAM type: YTN; PAM sequence: CTA
tcttagcttctctccctgtt

SEQ ID NO: 253518 - DNA, 20 bp, Artificial Sequence
  Description of Artificial Sequence: Synthetic oligonucleotide
  Target: ATXN1; (+) strand; PAM type: YTN; PAM sequence: CTT
agcttctctccctgttttca

SEQ ID NO: 253519 - DNA, 20 bp, Artificial Sequence
  Description of Artificial Sequence: Synthetic oligonucleotide
  Target: ATXN1; (+) strand; PAM type: YTN; PAM sequence: TTA
gcttctctccctgttttcag

SEQ ID NO: 253520 - DNA, 20 bp, Artificial Sequence
  Description of Artificial Sequence: Synthetic oligonucleotide
  Target: ATXN1; (+) strand; PAM type: YTN; PAM sequence: CTT
ctctccctgttttcagtttg

SEQ ID NO: 253521 - DNA, 20 bp, Artificial Sequence
  Description of Artificial Sequence: Synthetic oligonucleotide
  Target: ATXN1; (+) strand; PAM type: YTN; PAM sequence: TTC
tctccctgttttcagtttgg

SEQ ID NO: 253522 - DNA, 20 bp, Artificial Sequence
  Description of Artificial Sequence: Synthetic oligonucleotide
  Target: ATXN1; (+) strand; PAM type: YTN; PAM sequence: CTC
tccctgttttcagtttggat

SEQ ID NO: 253523 - DNA, 20 bp, Artificial Sequence
  Description of Artificial Sequence: Synthetic oligonucleotide
  Target: ATXN1; (+) strand; PAM type: YTN; PAM sequence: CTC
cctgttttcagtttggattt

SEQ ID NO: 253524 - DNA, 20 bp, Artificial Sequence
  Description of Artificial Sequence: Synthetic oligonucleotide
  Target: ATXN1; (+) strand; PAM type: YTN; PAM sequence: CTG
ttttcagtttggattttcta

SEQ ID NO: 253525 - DNA, 20 bp, Artificial Sequence
  Description of Artificial Sequence: Synthetic oligonucleotide
  Target: ATXN1; (+) strand; PAM type: YTN; PAM sequence: TTT
tcagtttggattttctacct

SEQ ID NO: 253526 - DNA, 20 bp, Artificial Sequence
  Description of Artificial Sequence: Synthetic oligonucleotide
  Target: ATXN1; (+) strand; PAM type: YTN; PAM sequence: TTT
cagtttggattttctacctc

SEQ ID NO: 253527 - DNA, 20 bp, Artificial Sequence
  Description of Artificial Sequence: Synthetic oligonucleotide
  Target: ATXN1; (+) strand; PAM type: YTN; PAM sequence: TTC
agtttggattttctacctcc

SEQ ID NO: 253528 - DNA, 20 bp, Artificial Sequence
  Description of Artificial Sequence: Synthetic oligonucleotide
  Target: ATXN1; (+) strand; PAM type: YTN; PAM sequence: TTT
ggattttctacctccatttg

SEQ ID NO: 253529 - DNA, 20 bp, Artificial Sequence
  Description of Artificial Sequence: Synthetic oligonucleotide
  Target: ATXN1; (+) strand; PAM type: YTN; PAM sequence: TTG
gattttctacctccatttgg

SEQ ID NO: 253530 - DNA, 20 bp, Artificial Sequence
  Description of Artificial Sequence: Synthetic oligonucleotide
  Target: ATXN1; (+) strand; PAM type: YTN; PAM sequence: TTT
tctacctccatttggcttat

SEQ ID NO: 253531 - DNA, 20 bp, Artificial Sequence
  Description of Artificial Sequence: Synthetic oligonucleotide
  Target: ATXN1; (+) strand; PAM type: YTN; PAM sequence: TTT
ctacctccatttggcttatc

SEQ ID NO: 253532 - DNA, 20 bp, Artificial Sequence
  Description of Artificial Sequence: Synthetic oligonucleotide
  Target: ATXN1; (+) strand; PAM type: YTN; PAM sequence: TTC
tacctccatttggcttatct

SEQ ID NO: 253533 - DNA, 20 bp, Artificial Sequence
  Description of Artificial Sequence: Synthetic oligonucleotide
  Target: ATXN1; (+) strand; PAM type: YTN; PAM sequence: CTA
cctccatttggcttatctat

SEQ ID NO: 253534 - DNA, 20 bp, Artificial Sequence
  Description of Artificial Sequence: Synthetic oligonucleotide
  Target: ATXN1; (+) strand; PAM type: YTN; PAM sequence: CTC
catttggcttatctatctct

SEQ ID NO: 253535 - DNA, 20 bp, Artificial Sequence
  Description of Artificial Sequence: Synthetic oligonucleotide
  Target: ATXN1; (+) strand; PAM type: YTN; PAM sequence: TTT
ggcttatctatctctagcgt

SEQ ID NO: 253536 - DNA, 20 bp, Artificial Sequence
  Description of Artificial Sequence: Synthetic oligonucleotide
  Target: ATXN1; (+) strand; PAM type: YTN; PAM sequence: TTG
gcttatctatctctagcgtc

SEQ ID NO: 253537 - DNA, 20 bp, Artificial Sequence
  Description of Artificial Sequence: Synthetic oligonucleotide
  Target: ATXN1; (+) strand; PAM type: YTN; PAM sequence: CTT
atctatctctagcgtcatat

SEQ ID NO: 253538 - DNA, 20 bp, Artificial Sequence
  Description of Artificial Sequence: Synthetic oligonucleotide
  Target: ATXN1; (+) strand; PAM type: YTN; PAM sequence: TTA
tctatctctagcgtcatatc

SEQ ID NO: 253539 - DNA, 20 bp, Artificial Sequence
  Description of Artificial Sequence: Synthetic oligonucleotide
  Target: ATXN1; (+) strand; PAM type: YTN; PAM sequence: CTA
tctctagcgtcatatctccc

SEQ ID NO: 253540 - DNA, 20 bp, Artificial Sequence
  Description of Artificial Sequence: Synthetic oligonucleotide
  Target: ATXN1; (+) strand; PAM type: YTN; PAM sequence: CTC
tagcgtcatatctccctgat

SEQ ID NO: 253541 - DNA, 20 bp, Artificial Sequence
  Description of Artificial Sequence: Synthetic oligonucleotide
  Target: ATXN1; (+) strand; PAM type: YTN; PAM sequence: CTA
gcgtcatatctccctgatga

SEQ ID NO: 253542 - DNA, 20 bp, Artificial Sequence
  Description of Artificial Sequence: Synthetic oligonucleotide
  Target: ATXN1; (+) strand; PAM type: YTN; PAM sequence: CTC
cctgatgatccgtggtagtg

SEQ ID NO: 253543 - DNA, 20 bp, Artificial Sequence
  Description of Artificial Sequence: Synthetic oligonucleotide
  Target: ATXN1; (+) strand; PAM type: YTN; PAM sequence: CTG
atgatccgtggtagtggcgt

SEQ ID NO: 253544 - DNA, 20 bp, Artificial Sequence
  Description of Artificial Sequence: Synthetic oligonucleotide
  Target: ATXN1; (+) strand; PAM type: YTN; PAM sequence: TTA
atccatttacgaaaaacaag

SEQ ID NO: 253545 - DNA, 20 bp, Artificial Sequence
  Description of Artificial Sequence: Synthetic oligonucleotide
  Target: ATXN1; (+) strand; PAM type: YTN; PAM sequence: TTT
acgaaaaacaagacaacata

SEQ ID NO: 253546 - DNA, 20 bp, Artificial Sequence
  Description of Artificial Sequence: Synthetic oligonucleotide
  Target: ATXN1; (+) strand; PAM type: YTN; PAM sequence: TTA
cgaaaaacaagacaacatag

SEQ ID NO: 253547 - DNA, 20 bp, Artificial Sequence
  Description of Artificial Sequence: Synthetic oligonucleotide
  Target: ATXN1; (+) strand; PAM type: YTN; PAM sequence: TTC
aaggagtcaaataaacacat

SEQ ID NO: 253548 - DNA, 20 bp, Artificial Sequence
  Description of Artificial Sequence: Synthetic oligonucleotide
  Target: ATXN1; (+) strand; PAM type: YTN; PAM sequence: TTC
tagttccaattcctctccac

SEQ ID NO: 253549 - DNA, 20 bp, Artificial Sequence
  Description of Artificial Sequence: Synthetic oligonucleotide
  Target: ATXN1; (+) strand; PAM type: YTN; PAM sequence: CTA
gttccaattcctctccactg

SEQ ID NO: 253550 - DNA, 20 bp, Artificial Sequence
  Description of Artificial Sequence: Synthetic oligonucleotide
  Target: ATXN1; (+) strand; PAM type: YTN; PAM sequence: TTC
caattcctctccactgcagc

SEQ ID NO: 253551 - DNA, 20 bp, Artificial Sequence
  Description of Artificial Sequence: Synthetic oligonucleotide
  Target: ATXN1; (+) strand; PAM type: YTN; PAM sequence: TTC
ctctccactgcagcatctca

SEQ ID NO: 253552 - DNA, 20 bp, Artificial Sequence
  Description of Artificial Sequence: Synthetic oligonucleotide
  Target: ATXN1; (+) strand; PAM type: YTN; PAM sequence: CTC
tccactgcagcatctcagat

SEQ ID NO: 253553 - DNA, 20 bp, Artificial Sequence
  Description of Artificial Sequence: Synthetic oligonucleotide
  Target: ATXN1; (+) strand; PAM type: YTN; PAM sequence: CTC
cactgcagcatctcagatgt

SEQ ID NO: 253554 - DNA, 20 bp, Artificial Sequence
  Description of Artificial Sequence: Synthetic oligonucleotide
  Target: ATXN1; (+) strand; PAM type: YTN; PAM sequence: CTG
cagcatctcagatgtaaact

SEQ ID NO: 253555 - DNA, 20 bp, Artificial Sequence
  Description of Artificial Sequence: Synthetic oligonucleotide
  Target: ATXN1; (+) strand; PAM type: YTN; PAM sequence: CTC
agatgtaaactggcgtcagt

SEQ ID NO: 253556 - DNA, 20 bp, Artificial Sequence
  Description of Artificial Sequence: Synthetic oligonucleotide
  Target: ATXN1; (+) strand; PAM type: YTN; PAM sequence: CTG
gcgtcagtaacaggtcctgt

SEQ ID NO: 253557 - DNA, 20 bp, Artificial Sequence
  Description of Artificial Sequence: Synthetic oligonucleotide
  Target: ATXN1; (+) strand; PAM type: YTN; PAM sequence: CTG
tcatccacctcccaggaaaa

SEQ ID NO: 253558 - DNA, 20 bp, Artificial Sequence
  Description of Artificial Sequence: Synthetic oligonucleotide
  Target: ATXN1; (+) strand; PAM type: YTN; PAM sequence: CTC
ccaggaaaattgtcaaagat

SEQ ID NO: 253559 - DNA, 20 bp, Artificial Sequence
  Description of Artificial Sequence: Synthetic oligonucleotide
  Target: ATXN1; (+) strand; PAM type: YTN; PAM sequence: TTG
tcaaagataatagttatggc

SEQ ID NO: 253560 - DNA, 20 bp, Artificial Sequence
  Description of Artificial Sequence: Synthetic oligonucleotide
  Target: ATXN1; (+) strand; PAM type: YTN; PAM sequence: TTA
tggccaggcgtggtggctca

SEQ ID NO: 253561 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccaccact

SEQ ID NO: 253562 - DNA, 20 bp, Artificial Sequence
  Description of Artificial Sequence: Synthetic oligonucleotide
  Target: ATXN1; (+) strand; PAM type: YTN; PAM sequence: CTG
taatcccaccactttgggag

SEQ ID NO: 253563 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcaggtga

SEQ ID NO: 253564 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcaggtgaa

SEQ ID NO: 253565 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcaggtgaac

SEQ ID NO: 253566 - DNA, 20 bp, Artificial Sequence
  Description of Artificial Sequence: Synthetic oligonucleotide
  Target: ATXN1; (+) strand; PAM type: YTN; PAM sequence: CTG
aggttgggagtttgagatca

SEQ ID NO: 253567 - DNA, 20 bp, Artificial Sequence
  Description of Artificial Sequence: Synthetic oligonucleotide
  Target: ATXN1; (+) strand; PAM type: YTN; PAM sequence: TTG
ggagtttgagatcagcctgg

SEQ ID NO: 253568 - DNA, 20 bp, Artificial Sequence
  Description of Artificial Sequence: Synthetic oligonucleotide
  Target: ATXN1; (+) strand; PAM type: YTN; PAM sequence: TTT
gagatcagcctggacaacat

SEQ ID NO: 253569 - DNA, 20 bp, Artificial Sequence
  Description of Artificial Sequence: Synthetic oligonucleotide
  Target: ATXN1; (+) strand; PAM type: YTN; PAM sequence: TTG
agatcagcctggacaacatg

SEQ ID NO: 253570 - DNA, 20 bp, Artificial Sequence
  Description of Artificial Sequence: Synthetic oligonucleotide
  Target: ATXN1; (+) strand; PAM type: YTN; PAM sequence: CTG
gacaacatggataaacccca

SEQ ID NO: 253571 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatataaaaaatt

SEQ ID NO: 253572 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatataaaaaattag

SEQ ID NO: 253573 - DNA, 20 bp, Artificial Sequence
  Description of Artificial Sequence: Synthetic oligonucleotide
  Target: ATXN1; (+) strand; PAM type: YTN; PAM sequence: CTA
aaaatataaaaaattagctg

SEQ ID NO: 253574 - DNA, 20 bp, Artificial Sequence
  Description of Artificial Sequence: Synthetic oligonucleotide
  Target: ATXN1; (+) strand; PAM type: YTN; PAM sequence: TTA
gctgggcgtaggagcacacg

SEQ ID NO: 253575 - DNA, 20 bp, Artificial Sequence
  Description of Artificial Sequence: Synthetic oligonucleotide
  Target: ATXN1; (+) strand; PAM type: YTN; PAM sequence: CTG
ggcgtaggagcacacgtctg

SEQ ID NO: 253576 - DNA, 20 bp, Artificial Sequence
  Description of Artificial Sequence: Synthetic oligonucleotide
  Target: ATXN1; (+) strand; PAM type: YTN; PAM sequence: CTG
taatcccagctaatcaggag

SEQ ID NO: 253577 - DNA, 20 bp, Artificial Sequence
  Description of Artificial Sequence: Synthetic oligonucleotide
  Target: ATXN1; (+) strand; PAM type: YTN; PAM sequence: CTA
atcaggaggctgaggcagga

SEQ ID NO: 253578 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcacatgaa

SEQ ID NO: 253579 - DNA, 20 bp, Artificial Sequence
  Description of Artificial Sequence: Synthetic oligonucleotide
  Target: ATXN1; (+) strand; PAM type: YTN; PAM sequence: CTG
ggaggcggaggttgcagtga

SEQ ID NO: 253580 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagattgcgtc

SEQ ID NO: 253581 - DNA, 20 bp, Artificial Sequence
  Description of Artificial Sequence: Synthetic oligonucleotide
  Target: ATXN1; (+) strand; PAM type: YTN; PAM sequence: TTG
cgtcactgcactccagcctg

SEQ ID NO: 253582 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggtgacac

SEQ ID NO: 253583 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacacagcaa

SEQ ID NO: 253584 - DNA, 20 bp, Artificial Sequence
  Description of Artificial Sequence: Synthetic oligonucleotide
  Target: ATXN1; (+) strand; PAM type: YTN; PAM sequence: CTG
ggtgacacagcaagactcca

SEQ ID NO: 253585 - DNA, 20 bp, Artificial Sequence
  Description of Artificial Sequence: Synthetic oligonucleotide
  Target: ATXN1; (+) strand; PAM type: YTN; PAM sequence: CTC
catctcaaaaaaaaaaaaaa

SEQ ID NO: 253586 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaaaaa

SEQ ID NO: 253587 - DNA, 20 bp, Artificial Sequence
  Description of Artificial Sequence: Synthetic oligonucleotide
  Target: ATXN1; (+) strand; PAM type: YTN; PAM sequence: TTA
tgaaggtcttctgaaaacaa

SEQ ID NO: 253588 - DNA, 20 bp, Artificial Sequence
  Description of Artificial Sequence: Synthetic oligonucleotide
  Target: ATXN1; (+) strand; PAM type: YTN; PAM sequence: CTT
ctgaaaacaagaaaacacta

SEQ ID NO: 253589 - DNA, 20 bp, Artificial Sequence
  Description of Artificial Sequence: Synthetic oligonucleotide
  Target: ATXN1; (+) strand; PAM type: YTN; PAM sequence: TTC
tgaaaacaagaaaacactat

SEQ ID NO: 253590 - DNA, 20 bp, Artificial Sequence
  Description of Artificial Sequence: Synthetic oligonucleotide
  Target: ATXN1; (+) strand; PAM type: YTN; PAM sequence: CTG
aaaacaagaaaacactattc

SEQ ID NO: 253591 - DNA, 20 bp, Artificial Sequence
  Description of Artificial Sequence: Synthetic oligonucleotide
  Target: ATXN1; (+) strand; PAM type: YTN; PAM sequence: CTA
ttcagatgaaaactattata

SEQ ID NO: 253592 - DNA, 20 bp, Artificial Sequence
  Description of Artificial Sequence: Synthetic oligonucleotide
  Target: ATXN1; (+) strand; PAM type: YTN; PAM sequence: TTC
agatgaaaactattatattt

SEQ ID NO: 253593 - DNA, 20 bp, Artificial Sequence
  Description of Artificial Sequence: Synthetic oligonucleotide
  Target: ATXN1; (+) strand; PAM type: YTN; PAM sequence: CTA
ttatatttatagattactat

SEQ ID NO: 253594 - DNA, 20 bp, Artificial Sequence
  Description of Artificial Sequence: Synthetic oligonucleotide
  Target: ATXN1; (+) strand; PAM type: YTN; PAM sequence: TTA
tatttatagattactatttt

SEQ ID NO: 253595 - DNA, 20 bp, Artificial Sequence
  Description of Artificial Sequence: Synthetic oligonucleotide
  Target: ATXN1; (+) strand; PAM type: YTN; PAM sequence: TTT
atagattactattttttttt

SEQ ID NO: 253596 - DNA, 20 bp, Artificial Sequence
  Description of Artificial Sequence: Synthetic oligonucleotide
  Target: ATXN1; (+) strand; PAM type: YTN; PAM sequence: TTA
tagattactattttttttta

SEQ ID NO: 253597 - DNA, 20 bp, Artificial Sequence
  Description of Artificial Sequence: Synthetic oligonucleotide
  Target: ATXN1; (+) strand; PAM type: YTN; PAM sequence: TTA
ctatttttttttaaaaaaaa

SEQ ID NO: 253598 - DNA, 20 bp, Artificial Sequence
  Description of Artificial Sequence: Synthetic oligonucleotide
  Target: ATXN1; (+) strand; PAM type: YTN; PAM sequence: CTA
tttttttttaaaaaaaagaa

SEQ ID NO: 253599 - DNA, 20 bp, Artificial Sequence
  Description of Artificial Sequence: Synthetic oligonucleotide
  Target: ATXN1; (+) strand; PAM type: YTN; PAM sequence: TTT
ttttttaaaaaaaagaagct

SEQ ID NO: 253600 - DNA, 20 bp, Artificial Sequence
  Description of Artificial Sequence: Synthetic oligonucleotide
  Target: ATXN1; (+) strand; PAM type: YTN; PAM sequence: TTT
tttttaaaaaaaagaagctc

SEQ ID NO: 253601 - DNA, 20 bp, Artificial Sequence
  Description of Artificial Sequence: Synthetic oligonucleotide
  Target: ATXN1; (+) strand; PAM type: YTN; PAM sequence: TTT
ttttaaaaaaaagaagctct

SEQ ID NO: 253602 - DNA, 20 bp, Artificial Sequence
  Description of Artificial Sequence: Synthetic oligonucleotide
  Target: ATXN1; (+) strand; PAM type: YTN; PAM sequence: TTT
tttaaaaaaaagaagctctt

SEQ ID NO: 253603 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaaaagaagctcttc

SEQ ID NO: 253604 - DNA, 20 bp, Artificial Sequence
  Description of Artificial Sequence: Synthetic oligonucleotide
  Target: ATXN1; (+) strand; PAM type: YTN; PAM sequence: TTT
taaaaaaaagaagctcttct

SEQ ID NO: 253605 - DNA, 20 bp, Artificial Sequence
  Description of Artificial Sequence: Synthetic oligonucleotide
  Target: ATXN1; (+) strand; PAM type: YTN; PAM sequence: TTT
aaaaaaaagaagctcttctt

SEQ ID NO: 253606 - DNA, 20 bp, Artificial Sequence
  Description of Artificial Sequence: Synthetic oligonucleotide
  Target: ATXN1; (+) strand; PAM type: YTN; PAM sequence: TTA
aaaaaaagaagctcttcttt

SEQ ID NO: 253607 - DNA, 20 bp, Artificial Sequence
  Description of Artificial Sequence: Synthetic oligonucleotide
  Target: ATXN1; (+) strand; PAM type: YTN; PAM sequence: CTC
ttctttgaattacctataat

SEQ ID NO: 253608 - DNA, 20 bp, Artificial Sequence
  Description of Artificial Sequence: Synthetic oligonucleotide
  Target: ATXN1; (+) strand; PAM type: YTN; PAM sequence: CTT
ctttgaattacctataatgc

SEQ ID NO: 253609 - DNA, 20 bp, Artificial Sequence
  Description of Artificial Sequence: Synthetic oligonucleotide
  Target: ATXN1; (+) strand; PAM type: YTN; PAM sequence: TTC
tttgaattacctataatgca

SEQ ID NO: 253610 - DNA, 20 bp, Artificial Sequence
  Description of Artificial Sequence: Synthetic oligonucleotide
  Target: ATXN1; (+) strand; PAM type: YTN; PAM sequence: CTT
tgaattacctataatgcaac

SEQ ID NO: 253611 - DNA, 20 bp, Artificial Sequence
  Description of Artificial Sequence: Synthetic oligonucleotide
  Target: ATXN1; (+) strand; PAM type: YTN; PAM sequence: TTT
gaattacctataatgcaaca

SEQ ID NO: 253612 - DNA, 20 bp, Artificial Sequence
  Description of Artificial Sequence: Synthetic oligonucleotide
  Target: ATXN1; (+) strand; PAM type: YTN; PAM sequence: TTG
aattacctataatgcaacag

SEQ ID NO: 253613 - DNA, 20 bp, Artificial Sequence
  Description of Artificial Sequence: Synthetic oligonucleotide
  Target: ATXN1; (+) strand; PAM type: YTN; PAM sequence: TTA
cctataatgcaacagcagca

SEQ ID NO: 253614 - DNA, 20 bp, Artificial Sequence
  Description of Artificial Sequence: Synthetic oligonucleotide
  Target: ATXN1; (+) strand; PAM type: YTN; PAM sequence: CTA
taatgcaacagcagcaccat

SEQ ID NO: 253615 - DNA, 20 bp, Artificial Sequence
  Description of Artificial Sequence: Synthetic oligonucleotide
  Target: ATXN1; (+) strand; PAM type: YTN; PAM sequence: TTG
tgcacaattcaatcagaggt

SEQ ID NO: 253616 - DNA, 20 bp, Artificial Sequence
  Description of Artificial Sequence: Synthetic oligonucleotide
  Target: ATXN1; (+) strand; PAM type: YTN; PAM sequence: TTC
aatcagaggttctcaaacat

SEQ ID NO: 253617 - DNA, 20 bp, Artificial Sequence
  Description of Artificial Sequence: Synthetic oligonucleotide
  Target: ATXN1; (+) strand; PAM type: YTN; PAM sequence: TTC
tcaaacatggctgcccatca

SEQ ID NO: 253618 - DNA, 20 bp, Artificial Sequence
  Description of Artificial Sequence: Synthetic oligonucleotide
  Target: ATXN1; (+) strand; PAM type: YTN; PAM sequence: CTC
aaacatggctgcccatcaga

SEQ ID NO: 253619 - DNA, 20 bp, Artificial Sequence
  Description of Artificial Sequence: Synthetic oligonucleotide
  Target: ATXN1; (+) strand; PAM type: YTN; PAM sequence: CTG
cccatcagaatcaccattgt

SEQ ID NO: 253620 - DNA, 20 bp, Artificial Sequence
  Description of Artificial Sequence: Synthetic oligonucleotide
  Target: ATXN1; (+) strand; PAM type: YTN; PAM sequence: TTG
tgccttttaggaaacacaga

SEQ ID NO: 253621 - DNA, 20 bp, Artificial Sequence
  Description of Artificial Sequence: Synthetic oligonucleotide
  Target: ATXN1; (+) strand; PAM type: YTN; PAM sequence: CTT
ttaggaaacacagattctca

SEQ ID NO: 253622 - DNA, 20 bp, Artificial Sequence
  Description of Artificial Sequence: Synthetic oligonucleotide
  Target: ATXN1; (+) strand; PAM type: YTN; PAM sequence: TTT
taggaaacacagattctcag

SEQ ID NO: 253623 - DNA, 20 bp, Artificial Sequence
  Description of Artificial Sequence: Synthetic oligonucleotide
  Target: ATXN1; (+) strand; PAM type: YTN; PAM sequence: TTT
aggaaacacagattctcaga

SEQ ID NO: 253624 - DNA, 20 bp, Artificial Sequence
  Description of Artificial Sequence: Synthetic oligonucleotide
  Target: ATXN1; (+) strand; PAM type: YTN; PAM sequence: TTA
ggaaacacagattctcagac

SEQ ID NO: 253625 - DNA, 20 bp, Artificial Sequence
  Description of Artificial Sequence: Synthetic oligonucleotide
  Target: ATXN1; (+) strand; PAM type: YTN; PAM sequence: TTC
tcagacatttgcagtctcta

SEQ ID NO: 253626 - DNA, 20 bp, Artificial Sequence
  Description of Artificial Sequence: Synthetic oligonucleotide
  Target: ATXN1; (+) strand; PAM type: YTN; PAM sequence: CTC
agacatttgcagtctctaat

SEQ ID NO: 253627 - DNA, 20 bp, Artificial Sequence
  Description of Artificial Sequence: Synthetic oligonucleotide
  Target: ATXN1; (+) strand; PAM type: YTN; PAM sequence: TTT
gcagtctctaatggccctgg

SEQ ID NO: 253628 - DNA, 20 bp, Artificial Sequence
  Description of Artificial Sequence: Synthetic oligonucleotide
  Target: ATXN1; (+) strand; PAM type: YTN; PAM sequence: TTG
cagtctctaatggccctgga

SEQ ID NO: 253629 - DNA, 20 bp, Artificial Sequence
  Description of Artificial Sequence: Synthetic oligonucleotide
  Target: ATXN1; (+) strand; PAM type: YTN; PAM sequence: CTC
taatggccctggattttctg

SEQ ID NO: 253630 - DNA, 20 bp, Artificial Sequence
  Description of Artificial Sequence: Synthetic oligonucleotide
  Target: ATXN1; (+) strand; PAM type: YTN; PAM sequence: CTA
atggccctggattttctggg

SEQ ID NO: 253631 - DNA, 20 bp, Artificial Sequence
  Description of Artificial Sequence: Synthetic oligonucleotide
  Target: ATXN1; (+) strand; PAM type: YTN; PAM sequence: CTG
gattttctgggccagtgcac

SEQ ID NO: 253632 - DNA, 20 bp, Artificial Sequence
  Description of Artificial Sequence: Synthetic oligonucleotide
  Target: ATXN1; (+) strand; PAM type: YTN; PAM sequence: TTT
tctgggccagtgcacaggta

SEQ ID NO: 253633 - DNA, 20 bp, Artificial Sequence
  Description of Artificial Sequence: Synthetic oligonucleotide
  Target: ATXN1; (+) strand; PAM type: YTN; PAM sequence: TTT
ctgggccagtgcacaggtaa

SEQ ID NO: 253634 - DNA, 20 bp, Artificial Sequence
  Description of Artificial Sequence: Synthetic oligonucleotide
  Target: ATXN1; (+) strand; PAM type: YTN; PAM sequence: TTC
tgggccagtgcacaggtaat

SEQ ID NO: 253635 - DNA, 20 bp, Artificial Sequence
  Description of Artificial Sequence: Synthetic oligonucleotide
  Target: ATXN1; (+) strand; PAM type: YTN; PAM sequence: CTG
ggccagtgcacaggtaatgg

SEQ ID NO: 253636 - DNA, 20 bp, Artificial Sequence
  Description of Artificial Sequence: Synthetic oligonucleotide
  Target: ATXN1; (+) strand; PAM type: YTN; PAM sequence: TTT
tttaaaaacatttcccccaa

SEQ ID NO: 253637 - DNA, 20 bp, Artificial Sequence
  Description of Artificial Sequence: Synthetic oligonucleotide
  Target: ATXN1; (+) strand; PAM type: YTN; PAM sequence: TTT
ttaaaaacatttcccccaag

SEQ ID NO: 253638 - DNA, 20 bp, Artificial Sequence
  Description of Artificial Sequence: Synthetic oligonucleotide
  Target: ATXN1; (+) strand; PAM type: YTN; PAM sequence: TTT
taaaaacatttcccccaagg

SEQ ID NO: 253639 - DNA, 20 bp, Artificial Sequence
  Description of Artificial Sequence: Synthetic oligonucleotide
  Target: ATXN1; (+) strand; PAM type: YTN; PAM sequence: TTT
aaaaacatttcccccaaggg

SEQ ID NO: 253640 - DNA, 20 bp, Artificial Sequence
  Description of Artificial Sequence: Synthetic oligonucleotide
  Target: ATXN1; (+) strand; PAM type: YTN; PAM sequence: TTA
aaaacatttcccccaaggga

SEQ ID NO: 253641 - DNA, 20 bp, Artificial Sequence
  Description of Artificial Sequence: Synthetic oligonucleotide
  Target: ATXN1; (+) strand; PAM type: YTN; PAM sequence: TTT
cccccaagggattctgatca

SEQ ID NO: 253642 - DNA, 20 bp, Artificial Sequence
  Description of Artificial Sequence: Synthetic oligonucleotide
  Target: ATXN1; (+) strand; PAM type: YTN; PAM sequence: TTC
ccccaagggattctgatcag

SEQ ID NO: 253643 - DNA, 20 bp, Artificial Sequence
  Description of Artificial Sequence: Synthetic oligonucleotide
  Target: ATXN1; (+) strand; PAM type: YTN; PAM sequence: TTC
tgatcagttaggtttgggat

SEQ ID NO: 253644 - DNA, 20 bp, Artificial Sequence
  Description of Artificial Sequence: Synthetic oligonucleotide
  Target: ATXN1; (+) strand; PAM type: YTN; PAM sequence: CTG
atcagttaggtttgggatcc

SEQ ID NO: 253645 - DNA, 20 bp, Artificial Sequence
  Description of Artificial Sequence: Synthetic oligonucleotide
  Target: ATXN1; (+) strand; PAM type: YTN; PAM sequence: TTA
ggtttgggatccactttcta

SEQ ID NO: 253646 - DNA, 20 bp, Artificial Sequence
  Description of Artificial Sequence: Synthetic oligonucleotide
  Target: ATXN1; (+) strand; PAM type: YTN; PAM sequence: TTT
gggatccactttctaaaaat

SEQ ID NO: 253647 - DNA, 20 bp, Artificial Sequence
  Description of Artificial Sequence: Synthetic oligonucleotide
  Target: ATXN1; (+) strand; PAM type: YTN; PAM sequence: TTG
ggatccactttctaaaaata

SEQ ID NO: 253648 - DNA, 20 bp, Artificial Sequence
  Description of Artificial Sequence: Synthetic oligonucleotide
  Target: ATXN1; (+) strand; PAM type: YTN; PAM sequence: CTT
tctaaaaataacatgtttct

SEQ ID NO: 253649 - DNA, 20 bp, Artificial Sequence
  Description of Artificial Sequence: Synthetic oligonucleotide
  Target: ATXN1; (+) strand; PAM type: YTN; PAM sequence: TTT
ctaaaaataacatgtttctc

SEQ ID NO: 253650 - DNA, 20 bp, Artificial Sequence
  Description of Artificial Sequence: Synthetic oligonucleotide
  Target: ATXN1; (+) strand; PAM type: YTN; PAM sequence: TTC
taaaaataacatgtttctct

SEQ ID NO: 253651 - DNA, 20 bp, Artificial Sequence
  Description of Artificial Sequence: Synthetic oligonucleotide
  Target: ATXN1; (+) strand; PAM type: YTN; PAM sequence: CTA
aaaataacatgtttctctgt

SEQ ID NO: 253652 - DNA, 20 bp, Artificial Sequence
  Description of Artificial Sequence: Synthetic oligonucleotide
  Target: ATXN1; (+) strand; PAM type: YTN; PAM sequence: TTT
ctctgtgacggaggaaattt

SEQ ID NO: 253653 - DNA, 20 bp, Artificial Sequence
  Description of Artificial Sequence: Synthetic oligonucleotide
  Target: ATXN1; (+) strand; PAM type: YTN; PAM sequence: TTC
tctgtgacggaggaaattta

SEQ ID NO: 253654 - DNA, 20 bp, Artificial Sequence
  Description of Artificial Sequence: Synthetic oligonucleotide
  Target: ATXN1; (+) strand; PAM type: YTN; PAM sequence: CTC
tgtgacggaggaaatttaag

SEQ ID NO: 253655 - DNA, 20 bp, Artificial Sequence
  Description of Artificial Sequence: Synthetic oligonucleotide
  Target: ATXN1; (+) strand; PAM type: YTN; PAM sequence: CTG
tgacggaggaaatttaagta

SEQ ID NO: 253656 - DNA, 20 bp, Artificial Sequence
  Description of Artificial Sequence: Synthetic oligonucleotide
  Target: ATXN1; (+) strand; PAM type: YTN; PAM sequence: TTT
aagtataactatgattcatg

SEQ ID NO: 253657 - DNA, 20 bp, Artificial Sequence
  Description of Artificial Sequence: Synthetic oligonucleotide
  Target: ATXN1; (+) strand; PAM type: YTN; PAM sequence: TTA
agtataactatgattcatga

SEQ ID NO: 253658 - DNA, 20 bp, Artificial Sequence
  Description of Artificial Sequence: Synthetic oligonucleotide
  Target: ATXN1; (+) strand; PAM type: YTN; PAM sequence: CTA
tgattcatgaatttgttatc

SEQ ID NO: 253659 - DNA, 20 bp, Artificial Sequence
  Description of Artificial Sequence: Synthetic oligonucleotide
  Target: ATXN1; (+) strand; PAM type: YTN; PAM sequence: TTC
atgaatttgttatctgtttt

SEQ ID NO: 253660 - DNA, 20 bp, Artificial Sequence
  Description of Artificial Sequence: Synthetic oligonucleotide
  Target: ATXN1; (+) strand; PAM type: YTN; PAM sequence: TTT
gttatctgtttttttcttca

SEQ ID NO: 253661 - DNA, 20 bp, Artificial Sequence
  Description of Artificial Sequence: Synthetic oligonucleotide
  Target: ATXN1; (+) strand; PAM type: YTN; PAM sequence: TTG
ttatctgtttttttcttcag

SEQ ID NO: 253662 - DNA, 20 bp, Artificial Sequence
  Description of Artificial Sequence: Synthetic oligonucleotide
  Target: ATXN1; (+) strand; PAM type: YTN; PAM sequence: TTA
tctgtttttttcttcagagg

SEQ ID NO: 253663 - DNA, 20 bp, Artificial Sequence
  Description of Artificial Sequence: Synthetic oligonucleotide
  Target: ATXN1; (+) strand; PAM type: YTN; PAM sequence: CTG
tttttttcttcagaggatat

SEQ ID NO: 253664 - DNA, 20 bp, Artificial Sequence
  Description of Artificial Sequence: Synthetic oligonucleotide
  Target: ATXN1; (+) strand; PAM type: YTN; PAM sequence: TTT
ttttcttcagaggatatcag

SEQ ID NO: 253665 - DNA, 20 bp, Artificial Sequence
  Description of Artificial Sequence: Synthetic oligonucleotide
  Target: ATXN1; (+) strand; PAM type: YTN; PAM sequence: TTT
tttcttcagaggatatcagt

SEQ ID NO: 253666 - DNA, 20 bp, Artificial Sequence
  Description of Artificial Sequence: Synthetic oligonucleotide
  Target: ATXN1; (+) strand; PAM type: YTN; PAM sequence: TTT
ttcttcagaggatatcagtt

SEQ ID NO: 253667 - DNA, 20 bp, Artificial Sequence
  Description of Artificial Sequence: Synthetic oligonucleotide
  Target: ATXN1; (+) strand; PAM type: YTN; PAM sequence: TTT
tcttcagaggatatcagttt

SEQ ID NO: 253668 - DNA, 20 bp, Artificial Sequence
  Description of Artificial Sequence: Synthetic oligonucleotide
  Target: ATXN1; (+) strand; PAM type: YTN; PAM sequence: TTT
cttcagaggatatcagttta

SEQ ID NO: 253669 - DNA, 20 bp, Artificial Sequence
  Description of Artificial Sequence: Synthetic oligonucleotide
  Target: ATXN1; (+) strand; PAM type: YTN; PAM sequence: TTC
ttcagaggatatcagtttaa

SEQ ID NO: 253670 - DNA, 20 bp, Artificial Sequence
  Description of Artificial Sequence: Synthetic oligonucleotide
  Target: ATXN1; (+) strand; PAM type: YTN; PAM sequence: CTT
cagaggatatcagtttaagt

SEQ ID NO: 253671 - DNA, 20 bp, Artificial Sequence
  Description of Artificial Sequence: Synthetic oligonucleotide
  Target: ATXN1; (+) strand; PAM type: YTN; PAM sequence: TTC
agaggatatcagtttaagtg

SEQ ID NO: 253672 - DNA, 20 bp, Artificial Sequence
  Description of Artificial Sequence: Synthetic oligonucleotide
  Target: ATXN1; (+) strand; PAM type: YTN; PAM sequence: TTT
aagtgttggtttttaaactg

SEQ ID NO: 253673 - DNA, 20 bp, Artificial Sequence
  Description of Artificial Sequence: Synthetic oligonucleotide
  Target: ATXN1; (+) strand; PAM type: YTN; PAM sequence: TTA
agtgttggtttttaaactgt

SEQ ID NO: 253674 - DNA, 20 bp, Artificial Sequence
  Description of Artificial Sequence: Synthetic oligonucleotide
  Target: ATXN1; (+) strand; PAM type: YTN; PAM sequence: TTG
gtttttaaactgtaactctg

SEQ ID NO: 253675 - DNA, 20 bp, Artificial Sequence
  Description of Artificial Sequence: Synthetic oligonucleotide
  Target: ATXN1; (+) strand; PAM type: YTN; PAM sequence: TTT
ttaaactgtaactctgaagg

SEQ ID NO: 253676 - DNA, 20 bp, Artificial Sequence
  Description of Artificial Sequence: Synthetic oligonucleotide
  Target: ATXN1; (+) strand; PAM type: YTN; PAM sequence: TTT
taaactgtaactctgaaggc

SEQ ID NO: 253677 - DNA, 20 bp, Artificial Sequence
  Description of Artificial Sequence: Synthetic oligonucleotide
  Target: ATXN1; (+) strand; PAM type: YTN; PAM sequence: TTT
aaactgtaactctgaaggca

SEQ ID NO: 253678 - DNA, 20 bp, Artificial Sequence
  Description of Artificial Sequence: Synthetic oligonucleotide
  Target: ATXN1; (+) strand; PAM type: YTN; PAM sequence: TTA
aactgtaactctgaaggcaa

SEQ ID NO: 253679 - DNA, 20 bp, Artificial Sequence
  Description of Artificial Sequence: Synthetic oligonucleotide
  Target: ATXN1; (+) strand; PAM type: YTN; PAM sequence: CTG
taactctgaaggcaaacaac

SEQ ID NO: 253680 - DNA, 20 bp, Artificial Sequence
  Description of Artificial Sequence: Synthetic oligonucleotide
  Target: ATXN1; (+) strand; PAM type: YTN; PAM sequence: CTC
tgaaggcaaacaactggcaa

SEQ ID NO: 253681 - DNA, 20 bp, Artificial Sequence
  Description of Artificial Sequence: Synthetic oligonucleotide
  Target: ATXN1; (+) strand; PAM type: YTN; PAM sequence: CTG
aaggcaaacaactggcaaga

SEQ ID NO: 253682 - DNA, 20 bp, Artificial Sequence
  Description of Artificial Sequence: Synthetic oligonucleotide
  Target: ATXN1; (+) strand; PAM type: YTN; PAM sequence: CTG
gcaagagagagttttcagga

SEQ ID NO: 253683 - DNA, 20 bp, Artificial Sequence
  Description of Artificial Sequence: Synthetic oligonucleotide
  Target: ATXN1; (+) strand; PAM type: YTN; PAM sequence: TTT
tcaggaagaatgctggctct

SEQ ID NO: 253684 - DNA, 20 bp, Artificial Sequence
  Description of Artificial Sequence: Synthetic oligonucleotide
  Target: ATXN1; (+) strand; PAM type: YTN; PAM sequence: TTT
caggaagaatgctggctctg

SEQ ID NO: 253685 - DNA, 20 bp, Artificial Sequence
  Description of Artificial Sequence: Synthetic oligonucleotide
  Target: ATXN1; (+) strand; PAM type: YTN; PAM sequence: TTC
aggaagaatgctggctctgg

SEQ ID NO: 253686 - DNA, 20 bp, Artificial Sequence
  Description of Artificial Sequence: Synthetic oligonucleotide
  Target: ATXN1; (+) strand; PAM type: YTN; PAM sequence: CTG
gctctggaaggcagcggaag

SEQ ID NO: 253687 - DNA, 20 bp, Artificial Sequence
  Description of Artificial Sequence: Synthetic oligonucleotide
  Target: ATXN1; (+) strand; PAM type: YTN; PAM sequence: CTC
tggaaggcagcggaaggttc

SEQ ID NO: 253688 - DNA, 20 bp, Artificial Sequence
  Description of Artificial Sequence: Synthetic oligonucleotide
  Target: ATXN1; (+) strand; PAM type: YTN; PAM sequence: CTG
gaaggcagcggaaggttctg

SEQ ID NO: 253689 - DNA, 20 bp, Artificial Sequence
  Description of Artificial Sequence: Synthetic oligonucleotide
  Target: ATXN1; (+) strand; PAM type: YTN; PAM sequence: TTC
tggaaaagcaatgtgtccta

SEQ ID NO: 253690 - DNA, 20 bp, Artificial Sequence
  Description of Artificial Sequence: Synthetic oligonucleotide
  Target: ATXN1; (+) strand; PAM type: YTN; PAM sequence: CTG
gaaaagcaatgtgtcctatg

SEQ ID NO: 253691 - DNA, 20 bp, Artificial Sequence
  Description of Artificial Sequence: Synthetic oligonucleotide
  Target: ATXN1; (+) strand; PAM type: YTN; PAM sequence: CTA
tgaactagacttttcacctg

SEQ ID NO: 253692 - DNA, 20 bp, Artificial Sequence
  Description of Artificial Sequence: Synthetic oligonucleotide
  Target: ATXN1; (+) strand; PAM type: YTN; PAM sequence: CTA
gacttttcacctgtaagcat

SEQ ID NO: 253693 - DNA, 20 bp, Artificial Sequence
  Description of Artificial Sequence: Synthetic oligonucleotide
  Target: ATXN1; (+) strand; PAM type: YTN; PAM sequence: CTT
ttcacctgtaagcatggcag

SEQ ID NO: 253694 - DNA, 20 bp, Artificial Sequence
  Description of Artificial Sequence: Synthetic oligonucleotide
  Target: ATXN1; (+) strand; PAM type: YTN; PAM sequence: TTT
tcacctgtaagcatggcagg

SEQ ID NO: 253695 - DNA, 20 bp, Artificial Sequence
  Description of Artificial Sequence: Synthetic oligonucleotide
  Target: ATXN1; (+) strand; PAM type: YTN; PAM sequence: TTT
cacctgtaagcatggcagga

SEQ ID NO: 253696 - DNA, 20 bp, Artificial Sequence
  Description of Artificial Sequence: Synthetic oligonucleotide
  Target: ATXN1; (+) strand; PAM type: YTN; PAM sequence: TTC
acctgtaagcatggcaggaa

SEQ ID NO: 253697 - DNA, 20 bp, Artificial Sequence
  Description of Artificial Sequence: Synthetic oligonucleotide
  Target: ATXN1; (+) strand; PAM type: YTN; PAM sequence: CTG
taagcatggcaggaagaggc

SEQ ID NO: 253698 - DNA, 20 bp, Artificial Sequence
  Description of Artificial Sequence: Synthetic oligonucleotide
  Target: ATXN1; (+) strand; PAM type: YTN; PAM sequence: CTG
tgcaaggtggtggatgacta

SEQ ID NO: 253699 - DNA, 20 bp, Artificial Sequence
  Description of Artificial Sequence: Synthetic oligonucleotide
  Target: ATXN1; (+) strand; PAM type: YTN; PAM sequence: CTA
cagggctttgttgtggactc

SEQ ID NO: 253700 - DNA, 20 bp, Artificial Sequence
  Description of Artificial Sequence: Synthetic oligonucleotide
  Target: ATXN1; (+) strand; PAM type: YTN; PAM sequence: CTT
tgttgtggactccaggcctc

SEQ ID NO: 253701 - DNA, 20 bp, Artificial Sequence
  Description of Artificial Sequence: Synthetic oligonucleotide
  Target: ATXN1; (+) strand; PAM type: YTN; PAM sequence: TTT
gttgtggactccaggcctct

SEQ ID NO: 253702 - DNA, 20 bp, Artificial Sequence
  Description of Artificial Sequence: Synthetic oligonucleotide
  Target: ATXN1; (+) strand; PAM type: YTN; PAM sequence: TTG
ttgtggactccaggcctcta

SEQ ID NO: 253703 - DNA, 20 bp, Artificial Sequence
  Description of Artificial Sequence: Synthetic oligonucleotide
  Target: ATXN1; (+) strand; PAM type: YTN; PAM sequence: TTG
tggactccaggcctctaatc

SEQ ID NO: 253704 - DNA, 20 bp, Artificial Sequence
  Description of Artificial Sequence: Synthetic oligonucleotide
  Target: ATXN1; (+) strand; PAM type: YTN; PAM sequence: CTC
caggcctctaatccctttca

SEQ ID NO: 253705 - DNA, 20 bp, Artificial Sequence
  Description of Artificial Sequence: Synthetic oligonucleotide
  Target: ATXN1; (+) strand; PAM type: YTN; PAM sequence: CTC
taatccctttcagtcttttt

SEQ ID NO: 253706 - DNA, 20 bp, Artificial Sequence
  Description of Artificial Sequence: Synthetic oligonucleotide
  Target: ATXN1; (+) strand; PAM type: YTN; PAM sequence: CTA
atccctttcagtctttttat

SEQ ID NO: 253707 - DNA, 20 bp, Artificial Sequence
  Description of Artificial Sequence: Synthetic oligonucleotide
  Target: ATXN1; (+) strand; PAM type: YTN; PAM sequence: CTT
tcagtctttttatttctctg

SEQ ID NO: 253708 - DNA, 20 bp, Artificial Sequence
  Description of Artificial Sequence: Synthetic oligonucleotide
  Target: ATXN1; (+) strand; PAM type: YTN; PAM sequence: TTT
cagtctttttatttctctgc

SEQ ID NO: 253709 - DNA, 20 bp, Artificial Sequence
  Description of Artificial Sequence: Synthetic oligonucleotide
  Target: ATXN1; (+) strand; PAM type: YTN; PAM sequence: TTC
agtctttttatttctctgcc

SEQ ID NO: 253710 - DNA, 20 bp, Artificial Sequence
  Description of Artificial Sequence: Synthetic oligonucleotide
  Target: ATXN1; (+) strand; PAM type: YTN; PAM sequence: CTT
tttatttctctgccctcaaa

SEQ ID NO: 253711 - DNA, 20 bp, Artificial Sequence
  Description of Artificial Sequence: Synthetic oligonucleotide
  Target: ATXN1; (+) strand; PAM type: YTN; PAM sequence: TTT
ttatttctctgccctcaaag

SEQ ID NO: 253712 - DNA, 20 bp, Artificial Sequence
  Description of Artificial Sequence: Synthetic oligonucleotide
  Target: ATXN1; (+) strand; PAM type: YTN; PAM sequence: TTT
tatttctctgccctcaaagc

SEQ ID NO: 253713 - DNA, 20 bp, Artificial Sequence
  Description of Artificial Sequence: Synthetic oligonucleotide
  Target: ATXN1; (+) strand; PAM type: YTN; PAM sequence: TTT
atttctctgccctcaaagcc

SEQ ID NO: 253714 - DNA, 20 bp, Artificial Sequence
  Description of Artificial Sequence: Synthetic oligonucleotide
  Target: ATXN1; (+) strand; PAM type: YTN; PAM sequence: TTA
tttctctgccctcaaagccc

SEQ ID NO: 253715 - DNA, 20 bp, Artificial Sequence
  Description of Artificial Sequence: Synthetic oligonucleotide
  Target: ATXN1; (+) strand; PAM type: YTN; PAM sequence: TTT
ctctgccctcaaagcccagc

SEQ ID NO: 253716 - DNA, 20 bp, Artificial Sequence
  Description of Artificial Sequence: Synthetic oligonucleotide
  Target: ATXN1; (+) strand; PAM type: YTN; PAM sequence: TTC
tctgccctcaaagcccagca

SEQ ID NO: 253717 - DNA, 20 bp, Artificial Sequence
  Description of Artificial Sequence: Synthetic oligonucleotide
  Target: ATXN1; (+) strand; PAM type: YTN; PAM sequence: CTC
tgccctcaaagcccagcagc

SEQ ID NO: 253718 - DNA, 20 bp, Artificial Sequence
  Description of Artificial Sequence: Synthetic oligonucleotide
  Target: ATXN1; (+) strand; PAM type: YTN; PAM sequence: CTG
ccctcaaagcccagcagcct

SEQ ID NO: 253719 - DNA, 20 bp, Artificial Sequence
  Description of Artificial Sequence: Synthetic oligonucleotide
  Target: ATXN1; (+) strand; PAM type: YTN; PAM sequence: CTC
aaagcccagcagcctggagg

SEQ ID NO: 253720 - DNA, 20 bp, Artificial Sequence
  Description of Artificial Sequence: Synthetic oligonucleotide
  Target: ATXN1; (+) strand; PAM type: YTN; PAM sequence: CTG
gaggggagaaggcagtgccc

SEQ ID NO: 253721 - DNA, 20 bp, Artificial Sequence
  Description of Artificial Sequence: Synthetic oligonucleotide
  Target: ATXN1; (+) strand; PAM type: YTN; PAM sequence: CTT
gactgcagcctgatgtttcc

SEQ ID NO: 253722 - DNA, 20 bp, Artificial Sequence
  Description of Artificial Sequence: Synthetic oligonucleotide
  Target: ATXN1; (+) strand; PAM type: YTN; PAM sequence: TTG
actgcagcctgatgtttcct

SEQ ID NO: 253723 - DNA, 20 bp, Artificial Sequence
  Description of Artificial Sequence: Synthetic oligonucleotide
  Target: ATXN1; (+) strand; PAM type: YTN; PAM sequence: CTG
cagcctgatgtttcctcctg

SEQ ID NO: 253724 - DNA, 20 bp, Artificial Sequence
  Description of Artificial Sequence: Synthetic oligonucleotide
  Target: ATXN1; (+) strand; PAM type: YTN; PAM sequence: CTG
atgtttcctcctggcttctg

SEQ ID NO: 253725 - DNA, 20 bp, Artificial Sequence
  Description of Artificial Sequence: Synthetic oligonucleotide
  Target: ATXN1; (+) strand; PAM type: YTN; PAM sequence: TTT
cctcctggcttctggtggcc

SEQ ID NO: 253726 - DNA, 20 bp, Artificial Sequence
  Description of Artificial Sequence: Synthetic oligonucleotide
  Target: ATXN1; (+) strand; PAM type: YTN; PAM sequence: TTC
ctcctggcttctggtggcct

SEQ ID NO: 253727 - DNA, 20 bp, Artificial Sequence
  Description of Artificial Sequence: Synthetic oligonucleotide
  Target: ATXN1; (+) strand; PAM type: YTN; PAM sequence: CTC
ctggcttctggtggcctacg

SEQ ID NO: 253728 - DNA, 20 bp, Artificial Sequence
  Description of Artificial Sequence: Synthetic oligonucleotide
  Target: ATXN1; (+) strand; PAM type: YTN; PAM sequence: CTG
gcttctggtggcctacggtc

SEQ ID NO: 253729 - DNA, 20 bp, Artificial Sequence
  Description of Artificial Sequence: Synthetic oligonucleotide
  Target: ATXN1; (+) strand; PAM type: YTN; PAM sequence: CTT
ctggtggcctacggtctcct

SEQ ID NO: 253730 - DNA, 20 bp, Artificial Sequence
  Description of Artificial Sequence: Synthetic oligonucleotide
  Target: ATXN1; (+) strand; PAM type: YTN; PAM sequence: TTC
tggtggcctacggtctcctt

SEQ ID NO: 253731 - DNA, 20 bp, Artificial Sequence
  Description of Artificial Sequence: Synthetic oligonucleotide
  Target: ATXN1; (+) strand; PAM type: YTN; PAM sequence: CTG
gtggcctacggtctccttta

SEQ ID NO: 253732 - DNA, 20 bp, Artificial Sequence
  Description of Artificial Sequence: Synthetic oligonucleotide
  Target: ATXN1; (+) strand; PAM type: YTN; PAM sequence: CTA
cggtctcctttactgtaggt

SEQ ID NO: 253733 - DNA, 20 bp, Artificial Sequence
  Description of Artificial Sequence: Synthetic oligonucleotide
  Target: ATXN1; (+) strand; PAM type: YTN; PAM sequence: CTC
ctttactgtaggtttctgga

SEQ ID NO: 253734 - DNA, 20 bp, Artificial Sequence
  Description of Artificial Sequence: Synthetic oligonucleotide
  Target: ATXN1; (+) strand; PAM type: YTN; PAM sequence: CTT
tactgtaggtttctggagca

SEQ ID NO: 253735 - DNA, 20 bp, Artificial Sequence
  Description of Artificial Sequence: Synthetic oligonucleotide
  Target: ATXN1; (+) strand; PAM type: YTN; PAM sequence: TTT
actgtaggtttctggagcaa

SEQ ID NO: 253736 - DNA, 20 bp, Artificial Sequence
  Description of Artificial Sequence: Synthetic oligonucleotide
  Target: ATXN1; (+) strand; PAM type: YTN; PAM sequence: TTA
ctgtaggtttctggagcaaa

SEQ ID NO: 253737 - DNA, 20 bp, Artificial Sequence
  Description of Artificial Sequence: Synthetic oligonucleotide
  Target: ATXN1; (+) strand; PAM type: YTN; PAM sequence: CTG
taggtttctggagcaaaaat

SEQ ID NO: 253738 - DNA, 20 bp, Artificial Sequence
  Description of Artificial Sequence: Synthetic oligonucleotide
  Target: ATXN1; (+) strand; PAM type: YTN; PAM sequence: TTT
ctggagcaaaaatccagcag

SEQ ID NO: 253739 - DNA, 20 bp, Artificial Sequence
  Description of Artificial Sequence: Synthetic oligonucleotide
  Target: ATXN1; (+) strand; PAM type: YTN; PAM sequence: TTC
tggagcaaaaatccagcagt

SEQ ID NO: 253740 - DNA, 20 bp, Artificial Sequence
  Description of Artificial Sequence: Synthetic oligonucleotide
  Target: ATXN1; (+) strand; PAM type: YTN; PAM sequence: CTG
gagcaaaaatccagcagtca

SEQ ID NO: 253741 - DNA, 20 bp, Artificial Sequence
  Description of Artificial Sequence: Synthetic oligonucleotide
  Target: ATXN1; (+) strand; PAM type: YTN; PAM sequence: TTA
ccaggatcagtgacaactat

SEQ ID NO: 253742 - DNA, 20 bp, Artificial Sequence
  Description of Artificial Sequence: Synthetic oligonucleotide
  Target: ATXN1; (+) strand; PAM type: YTN; PAM sequence: CTA
tgcaataattaggggcaggc

SEQ ID NO: 253743 - DNA, 20 bp, Artificial Sequence
  Description of Artificial Sequence: Synthetic oligonucleotide
  Target: ATXN1; (+) strand; PAM type: YTN; PAM sequence: TTA
ggggcaggcaccaggaggca

SEQ ID NO: 253744 - DNA, 20 bp, Artificial Sequence
  Description of Artificial Sequence: Synthetic oligonucleotide
  Target: ATXN1; (+) strand; PAM type: YTN; PAM sequence: CTG
ggtggcagaaactctatgat

SEQ ID NO: 253745 - DNA, 20 bp, Artificial Sequence
  Description of Artificial Sequence: Synthetic oligonucleotide
  Target: ATXN1; (+) strand; PAM type: YTN; PAM sequence: CTC
tatgataccccaaaggaaac

SEQ ID NO: 253746 - DNA, 20 bp, Artificial Sequence
  Description of Artificial Sequence: Synthetic oligonucleotide
  Target: ATXN1; (+) strand; PAM type: YTN; PAM sequence: CTA
tgataccccaaaggaaacat

SEQ ID NO: 253747 - DNA, 20 bp, Artificial Sequence
  Description of Artificial Sequence: Synthetic oligonucleotide
  Target: ATXN1; (+) strand; PAM type: YTN; PAM sequence: CTC
ttctcagaggtggtcaagaa

SEQ ID NO: 253748 - DNA, 20 bp, Artificial Sequence
  Description of Artificial Sequence: Synthetic oligonucleotide
  Target: ATXN1; (+) strand; PAM type: YTN; PAM sequence: CTT
ctcagaggtggtcaagaaca

SEQ ID NO: 253749 - DNA, 20 bp, Artificial Sequence
  Description of Artificial Sequence: Synthetic oligonucleotide
  Target: ATXN1; (+) strand; PAM type: YTN; PAM sequence: TTC
tcagaggtggtcaagaacat

SEQ ID NO: 253750 - DNA, 20 bp, Artificial Sequence
  Description of Artificial Sequence: Synthetic oligonucleotide
  Target: ATXN1; (+) strand; PAM type: YTN; PAM sequence: CTC
agaggtggtcaagaacatgc

SEQ ID NO: 253751 - DNA, 20 bp, Artificial Sequence
  Description of Artificial Sequence: Synthetic oligonucleotide
  Target: ATXN1; (+) strand; PAM type: YTN; PAM sequence: CTT
tgcctgcctggttggcagca

SEQ ID NO: 253752 - DNA, 20 bp, Artificial Sequence
  Description of Artificial Sequence: Synthetic oligonucleotide
  Target: ATXN1; (+) strand; PAM type: YTN; PAM sequence: TTT
gcctgcctggttggcagcag

SEQ ID NO: 253753 - DNA, 20 bp, Artificial Sequence
  Description of Artificial Sequence: Synthetic oligonucleotide
  Target: ATXN1; (+) strand; PAM type: YTN; PAM sequence: TTG
cctgcctggttggcagcaga

SEQ ID NO: 253754 - DNA, 20 bp, Artificial Sequence
  Description of Artificial Sequence: Synthetic oligonucleotide
  Target: ATXN1; (+) strand; PAM type: YTN; PAM sequence: CTG
cctggttggcagcagaaatg

SEQ ID NO: 253755 - DNA, 20 bp, Artificial Sequence
  Description of Artificial Sequence: Synthetic oligonucleotide
  Target: ATXN1; (+) strand; PAM type: YTN; PAM sequence: CTG
gttggcagcagaaatggcac

SEQ ID NO: 253756 - DNA, 20 bp, Artificial Sequence
  Description of Artificial Sequence: Synthetic oligonucleotide
  Target: ATXN1; (+) strand; PAM type: YTN; PAM sequence: TTG
gcagcagaaatggcactagc

SEQ ID NO: 253757 - DNA, 20 bp, Artificial Sequence
  Description of Artificial Sequence: Synthetic oligonucleotide
  Target: ATXN1; (+) strand; PAM type: YTN; PAM sequence: CTA
gccagtgatcactcgtaacc

SEQ ID NO: 253758 - DNA, 20 bp, Artificial Sequence
  Description of Artificial Sequence: Synthetic oligonucleotide
  Target: ATXN1; (+) strand; PAM type: YTN; PAM sequence: CTC
gtaaccttgctgccttcttt

SEQ ID NO: 253759 - DNA, 20 bp, Artificial Sequence
  Description of Artificial Sequence: Synthetic oligonucleotide
  Target: ATXN1; (+) strand; PAM type: YTN; PAM sequence: CTT
gctgccttctttacagatgg

SEQ ID NO: 253760 - DNA, 20 bp, Artificial Sequence
  Description of Artificial Sequence: Synthetic oligonucleotide
  Target: ATXN1; (+) strand; PAM type: YTN; PAM sequence: TTG
ctgccttctttacagatggc

SEQ ID NO: 253761 - DNA, 20 bp, Artificial Sequence
  Description of Artificial Sequence: Synthetic oligonucleotide
  Target: ATXN1; (+) strand; PAM type: YTN; PAM sequence: CTG
ccttctttacagatggctgc

SEQ ID NO: 253762 - DNA, 20 bp, Artificial Sequence
  Description of Artificial Sequence: Synthetic oligonucleotide
  Target: ATXN1; (+) strand; PAM type: YTN; PAM sequence: CTT
ctttacagatggctgctgtc

SEQ ID NO: 253763 - DNA, 20 bp, Artificial Sequence
  Description of Artificial Sequence: Synthetic oligonucleotide
  Target: ATXN1; (+) strand; PAM type: YTN; PAM sequence: TTC
tttacagatggctgctgtca

SEQ ID NO: 253764 - DNA, 20 bp, Artificial Sequence
  Description of Artificial Sequence: Synthetic oligonucleotide
  Target: ATXN1; (+) strand; PAM type: YTN; PAM sequence: CTT
tacagatggctgctgtcagg

SEQ ID NO: 253765 - DNA, 20 bp, Artificial Sequence
  Description of Artificial Sequence: Synthetic oligonucleotide
  Target: ATXN1; (+) strand; PAM type: YTN; PAM sequence: TTT
acagatggctgctgtcaggc

SEQ ID NO: 253766 - DNA, 20 bp, Artificial Sequence
  Description of Artificial Sequence: Synthetic oligonucleotide
  Target: ATXN1; (+) strand; PAM type: YTN; PAM sequence: TTA
cagatggctgctgtcaggct

SEQ ID NO: 253767 - DNA, 20 bp, Artificial Sequence
  Description of Artificial Sequence: Synthetic oligonucleotide
  Target: ATXN1; (+) strand; PAM type: YTN; PAM sequence: CTG
ctgtcaggctgtttaatttg

SEQ ID NO: 253768 - DNA, 20 bp, Artificial Sequence
  Description of Artificial Sequence: Synthetic oligonucleotide
  Target: ATXN1; (+) strand; PAM type: YTN; PAM sequence: CTG
tcaggctgtttaatttggag

SEQ ID NO: 253769 - DNA, 20 bp, Artificial Sequence
  Description of Artificial Sequence: Synthetic oligonucleotide
  Target: ATXN1; (+) strand; PAM type: YTN; PAM sequence: CTG
tttaatttggaggaaattcc

SEQ ID NO: 253770 - DNA, 20 bp, Artificial Sequence
  Description of Artificial Sequence: Synthetic oligonucleotide
  Target: ATXN1; (+) strand; PAM type: YTN; PAM sequence: TTT
aatttggaggaaattccaat

SEQ ID NO: 253771 - DNA, 20 bp, Artificial Sequence
  Description of Artificial Sequence: Synthetic oligonucleotide
  Target: ATXN1; (+) strand; PAM type: YTN; PAM sequence: TTA
atttggaggaaattccaatg

SEQ ID NO: 253772 - DNA, 20 bp, Artificial Sequence
  Description of Artificial Sequence: Synthetic oligonucleotide
  Target: ATXN1; (+) strand; PAM type: YTN; PAM sequence: TTT
ggaggaaattccaatgtcat

SEQ ID NO: 253773 - DNA, 20 bp, Artificial Sequence
  Description of Artificial Sequence: Synthetic oligonucleotide
  Target: ATXN1; (+) strand; PAM type: YTN; PAM sequence: TTG
gaggaaattccaatgtcatc

SEQ ID NO: 253774 - DNA, 20 bp, Artificial Sequence
  Description of Artificial Sequence: Synthetic oligonucleotide
  Target: ATXN1; (+) strand; PAM type: YTN; PAM sequence: TTC
caatgtcatcagcagagaca

SEQ ID NO: 253775 - DNA, 20 bp, Artificial Sequence
  Description of Artificial Sequence: Synthetic oligonucleotide
  Target: ATXN1; (+) strand; PAM type: YTN; PAM sequence: TTG
gggagggctgccaagcacaa

SEQ ID NO: 253776 - DNA, 20 bp, Artificial Sequence
  Description of Artificial Sequence: Synthetic oligonucleotide
  Target: ATXN1; (+) strand; PAM type: YTN; PAM sequence: CTG
ccaagcacaaagacagaact

SEQ ID NO: 253777 - DNA, 20 bp, Artificial Sequence
  Description of Artificial Sequence: Synthetic oligonucleotide
  Target: ATXN1; (+) strand; PAM type: YTN; PAM sequence: CTT
ggcttccccagctgataccc

SEQ ID NO: 253778 - DNA, 20 bp, Artificial Sequence
  Description of Artificial Sequence: Synthetic oligonucleotide
  Target: ATXN1; (+) strand; PAM type: YTN; PAM sequence: TTG
gcttccccagctgataccca

SEQ ID NO: 253779 - DNA, 20 bp, Artificial Sequence
  Description of Artificial Sequence: Synthetic oligonucleotide
  Target: ATXN1; (+) strand; PAM type: YTN; PAM sequence: CTT
ccccagctgatacccatgga

SEQ ID NO: 253780 - DNA, 20 bp, Artificial Sequence
  Description of Artificial Sequence: Synthetic oligonucleotide
  Target: ATXN1; (+) strand; PAM type: YTN; PAM sequence: TTC
cccagctgatacccatggat

SEQ ID NO: 253781 - DNA, 20 bp, Artificial Sequence
  Description of Artificial Sequence: Synthetic oligonucleotide
  Target: ATXN1; (+) strand; PAM type: YTN; PAM sequence: CTG
atacccatggatacagaaac

SEQ ID NO: 253782 - DNA, 20 bp, Artificial Sequence
  Description of Artificial Sequence: Synthetic oligonucleotide
  Target: ATXN1; (+) strand; PAM type: YTN; PAM sequence: CTA
gtcttaacaatcttttagac

SEQ ID NO: 253783 - DNA, 20 bp, Artificial Sequence
  Description of Artificial Sequence: Synthetic oligonucleotide
  Target: ATXN1; (+) strand; PAM type: YTN; PAM sequence: CTT
aacaatcttttagacctgac

SEQ ID NO: 253784 - DNA, 20 bp, Artificial Sequence
  Description of Artificial Sequence: Synthetic oligonucleotide
  Target: ATXN1; (+) strand; PAM type: YTN; PAM sequence: TTA
acaatcttttagacctgacc

SEQ ID NO: 253785 - DNA, 20 bp, Artificial Sequence
  Description of Artificial Sequence: Synthetic oligonucleotide
  Target: ATXN1; (+) strand; PAM type: YTN; PAM sequence: CTT
ttagacctgaccttagtagc

SEQ ID NO: 253786 - DNA, 20 bp, Artificial Sequence
  Description of Artificial Sequence: Synthetic oligonucleotide
  Target: ATXN1; (+) strand; PAM type: YTN; PAM sequence: TTT
tagacctgaccttagtagca

SEQ ID NO: 253787 - DNA, 20 bp, Artificial Sequence
  Description of Artificial Sequence: Synthetic oligonucleotide
  Target: ATXN1; (+) strand; PAM type: YTN; PAM sequence: TTT
agacctgaccttagtagcaa

SEQ ID NO: 253788 - DNA, 20 bp, Artificial Sequence
  Description of Artificial Sequence: Synthetic oligonucleotide
  Target: ATXN1; (+) strand; PAM type: YTN; PAM sequence: TTA
gacctgaccttagtagcaaa

SEQ ID NO: 253789 - DNA, 20 bp, Artificial Sequence
  Description of Artificial Sequence: Synthetic oligonucleotide
  Target: ATXN1; (+) strand; PAM type: YTN; PAM sequence: CTG
accttagtagcaaactggat

SEQ ID NO: 253790 - DNA, 20 bp, Artificial Sequence
  Description of Artificial Sequence: Synthetic oligonucleotide
  Target: ATXN1; (+) strand; PAM type: YTN; PAM sequence: CTT
agtagcaaactggataactg

SEQ ID NO: 253791 - DNA, 20 bp, Artificial Sequence
  Description of Artificial Sequence: Synthetic oligonucleotide
  Target: ATXN1; (+) strand; PAM type: YTN; PAM sequence: TTA
gtagcaaactggataactgc

SEQ ID NO: 253792 - DNA, 20 bp, Artificial Sequence
  Description of Artificial Sequence: Synthetic oligonucleotide
  Target: ATXN1; (+) strand; PAM type: YTN; PAM sequence: CTG
gataactgccagtcataaaa

SEQ ID NO: 253793 - DNA, 20 bp, Artificial Sequence
  Description of Artificial Sequence: Synthetic oligonucleotide
  Target: ATXN1; (+) strand; PAM type: YTN; PAM sequence: CTG
ccagtcataaaagtgtttct

SEQ ID NO: 253794 - DNA, 20 bp, Artificial Sequence
  Description of Artificial Sequence: Synthetic oligonucleotide
  Target: ATXN1; (+) strand; PAM type: YTN; PAM sequence: TTT
ctaaagtggcctgattttct

SEQ ID NO: 253795 - DNA, 20 bp, Artificial Sequence
  Description of Artificial Sequence: Synthetic oligonucleotide
  Target: ATXN1; (+) strand; PAM type: YTN; PAM sequence: TTC
taaagtggcctgattttctc

SEQ ID NO: 253796 - DNA, 20 bp, Artificial Sequence
  Description of Artificial Sequence: Synthetic oligonucleotide
  Target: ATXN1; (+) strand; PAM type: YTN; PAM sequence: CTA
aagtggcctgattttctccc

SEQ ID NO: 253797 - DNA, 20 bp, Artificial Sequence
  Description of Artificial Sequence: Synthetic oligonucleotide
  Target: ATXN1; (+) strand; PAM type: YTN; PAM sequence: CTG
attttctcccctcctgttag

SEQ ID NO: 253798 - DNA, 20 bp, Artificial Sequence
  Description of Artificial Sequence: Synthetic oligonucleotide
  Target: ATXN1; (+) strand; PAM type: YTN; PAM sequence: TTT
tctcccctcctgttaggatc

SEQ ID NO: 253799 - DNA, 20 bp, Artificial Sequence
  Description of Artificial Sequence: Synthetic oligonucleotide
  Target: ATXN1; (+) strand; PAM type: YTN; PAM sequence: TTT
ctcccctcctgttaggatcc

SEQ ID NO: 253800 - DNA, 20 bp, Artificial Sequence
  Description of Artificial Sequence: Synthetic oligonucleotide
  Target: ATXN1; (+) strand; PAM type: YTN; PAM sequence: TTC
tcccctcctgttaggatcct

SEQ ID NO: 253801 - DNA, 20 bp, Artificial Sequence
  Description of Artificial Sequence: Synthetic oligonucleotide
  Target: ATXN1; (+) strand; PAM type: YTN; PAM sequence: CTC
ccctcctgttaggatcctgg

SEQ ID NO: 253802 - DNA, 20 bp, Artificial Sequence
  Description of Artificial Sequence: Synthetic oligonucleotide
  Target: ATXN1; (+) strand; PAM type: YTN; PAM sequence: CTC
ctgttaggatcctggatgct

SEQ ID NO: 253803 - DNA, 20 bp, Artificial Sequence
  Description of Artificial Sequence: Synthetic oligonucleotide
  Target: ATXN1; (+) strand; PAM type: YTN; PAM sequence: CTG
ttaggatcctggatgcttgt

SEQ ID NO: 253804 - DNA, 20 bp, Artificial Sequence
  Description of Artificial Sequence: Synthetic oligonucleotide
  Target: ATXN1; (+) strand; PAM type: YTN; PAM sequence: TTA
ggatcctggatgcttgtaat

SEQ ID NO: 253805 - DNA, 20 bp, Artificial Sequence
  Description of Artificial Sequence: Synthetic oligonucleotide
  Target: ATXN1; (+) strand; PAM type: YTN; PAM sequence: CTG
gatgcttgtaatgctattta

SEQ ID NO: 253806 - DNA, 20 bp, Artificial Sequence
  Description of Artificial Sequence: Synthetic oligonucleotide
  Target: ATXN1; (+) strand; PAM type: YTN; PAM sequence: CTT
gtaatgctatttatcaatgg

SEQ ID NO: 253807 - DNA, 20 bp, Artificial Sequence
  Description of Artificial Sequence: Synthetic oligonucleotide
  Target: ATXN1; (+) strand; PAM type: YTN; PAM sequence: TTG
taatgctatttatcaatggt

SEQ ID NO: 253808 - DNA, 20 bp, Artificial Sequence
  Description of Artificial Sequence: Synthetic oligonucleotide
  Target: ATXN1; (+) strand; PAM type: YTN; PAM sequence: CTA
tttatcaatggttattttgt

SEQ ID NO: 253809 - DNA, 20 bp, Artificial Sequence
  Description of Artificial Sequence: Synthetic oligonucleotide
  Target: ATXN1; (+) strand; PAM type: YTN; PAM sequence: TTT
atcaatggttattttgtgct

SEQ ID NO: 253810 - DNA, 20 bp, Artificial Sequence
  Description of Artificial Sequence: Synthetic oligonucleotide
  Target: ATXN1; (+) strand; PAM type: YTN; PAM sequence: TTA
tcaatggttattttgtgctt

SEQ ID NO: 253811 - DNA, 20 bp, Artificial Sequence
  Description of Artificial Sequence: Synthetic oligonucleotide
  Target: ATXN1; (+) strand; PAM type: YTN; PAM sequence: TTA
ttttgtgcttactgatgtgc

SEQ ID NO: 253812 - DNA, 20 bp, Artificial Sequence
  Description of Artificial Sequence: Synthetic oligonucleotide
  Target: ATXN1; (+) strand; PAM type: YTN; PAM sequence: TTT
tgtgcttactgatgtgcaga

SEQ ID NO: 253813 - DNA, 20 bp, Artificial Sequence
  Description of Artificial Sequence: Synthetic oligonucleotide
  Target: ATXN1; (+) strand; PAM type: YTN; PAM sequence: TTT
gtgcttactgatgtgcagac

SEQ ID NO: 253814 - DNA, 20 bp, Artificial Sequence
  Description of Artificial Sequence: Synthetic oligonucleotide
  Target: ATXN1; (+) strand; PAM type: YTN; PAM sequence: TTG
tgcttactgatgtgcagaca

SEQ ID NO: 253815 - DNA, 20 bp, Artificial Sequence
  Description of Artificial Sequence: Synthetic oligonucleotide
  Target: ATXN1; (+) strand; PAM type: YTN; PAM sequence: CTT
actgatgtgcagacattttt

SEQ ID NO: 253816 - DNA, 20 bp, Artificial Sequence
  Description of Artificial Sequence: Synthetic oligonucleotide
  Target: ATXN1; (+) strand; PAM type: YTN; PAM sequence: TTA
ctgatgtgcagacatttttt

SEQ ID NO: 253817 - DNA, 20 bp, Artificial Sequence
  Description of Artificial Sequence: Synthetic oligonucleotide
  Target: ATXN1; (+) strand; PAM type: YTN; PAM sequence: CTG
atgtgcagacattttttcca

SEQ ID NO: 253818 - DNA, 20 bp, Artificial Sequence
  Description of Artificial Sequence: Synthetic oligonucleotide
  Target: ATXN1; (+) strand; PAM type: YTN; PAM sequence: TTT
tttccaacccattctttttt

SEQ ID NO: 253819 - DNA, 20 bp, Artificial Sequence
  Description of Artificial Sequence: Synthetic oligonucleotide
  Target: ATXN1; (+) strand; PAM type: YTN; PAM sequence: TTT
ttccaacccattcttttttt

SEQ ID NO: 253820 - DNA, 20 bp, Artificial Sequence
  Description of Artificial Sequence: Synthetic oligonucleotide
  Target: ATXN1; (+) strand; PAM type: YTN; PAM sequence: TTT
tccaacccattctttttttt

SEQ ID NO: 253821 - DNA, 20 bp, Artificial Sequence
  Description of Artificial Sequence: Synthetic oligonucleotide
  Target: ATXN1; (+) strand; PAM type: YTN; PAM sequence: TTT
ccaacccattcttttttttt

SEQ ID NO: 253822 - DNA, 20 bp, Artificial Sequence
  Description of Artificial Sequence: Synthetic oligonucleotide
  Target: ATXN1; (+) strand; PAM type: YTN; PAM sequence: TTC
caacccattctttttttttt

SEQ ID NO: 253823 - DNA, 20 bp, Artificial Sequence
  Description of Artificial Sequence: Synthetic oligonucleotide
  Target: ATXN1; (+) strand; PAM type: YTN; PAM sequence: TTC
ttttttttttttgagatgga

SEQ ID NO: 253824 - DNA, 20 bp, Artificial Sequence
  Description of Artificial Sequence: Synthetic oligonucleotide
  Target: ATXN1; (+) strand; PAM type: YTN; PAM sequence: CTT
ttttttttttgagatggagt

SEQ ID NO: 253825 - DNA, 20 bp, Artificial Sequence
  Description of Artificial Sequence: Synthetic oligonucleotide
  Target: ATXN1; (+) strand; PAM type: YTN; PAM sequence: TTT
tttttttttgagatggagtt

SEQ ID NO: 253826 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagatggagttt

SEQ ID NO: 253827 - DNA, 20 bp, Artificial Sequence
  Description of Artificial Sequence: Synthetic oligonucleotide
  Target: ATXN1; (+) strand; PAM type: YTN; PAM sequence: TTT
tttttttgagatggagtttt

SEQ ID NO: 253828 - DNA, 20 bp, Artificial Sequence
  Description of Artificial Sequence: Synthetic oligonucleotide
  Target: ATXN1; (+) strand; PAM type: YTN; PAM sequence: TTT
ttttttgagatggagttttg

SEQ ID NO: 253829 - DNA, 20 bp, Artificial Sequence
  Description of Artificial Sequence: Synthetic oligonucleotide
  Target: ATXN1; (+) strand; PAM type: YTN; PAM sequence: TTT
tttttgagatggagttttgc

SEQ ID NO: 253830 - DNA, 20 bp, Artificial Sequence
  Description of Artificial Sequence: Synthetic oligonucleotide
  Target: ATXN1; (+) strand; PAM type: YTN; PAM sequence: TTT
ttttgagatggagttttgct

SEQ ID NO: 253831 - DNA, 20 bp, Artificial Sequence
  Description of Artificial Sequence: Synthetic oligonucleotide
  Target: ATXN1; (+) strand; PAM type: YTN; PAM sequence: TTT
tttgagatggagttttgctc

SEQ ID NO: 253832 - DNA, 20 bp, Artificial Sequence
  Description of Artificial Sequence: Synthetic oligonucleotide
  Target: ATXN1; (+) strand; PAM type: YTN; PAM sequence: TTT
ttgagatggagttttgctct

SEQ ID NO: 253833 - DNA, 20 bp, Artificial Sequence
  Description of Artificial Sequence: Synthetic oligonucleotide
  Target: ATXN1; (+) strand; PAM type: YTN; PAM sequence: TTT
tgagatggagttttgctcta

SEQ ID NO: 253834 - DNA, 20 bp, Artificial Sequence
  Description of Artificial Sequence: Synthetic oligonucleotide
  Target: ATXN1; (+) strand; PAM type: YTN; PAM sequence: TTT
gagatggagttttgctctat

SEQ ID NO: 253835 - DNA, 20 bp, Artificial Sequence
  Description of Artificial Sequence: Synthetic oligonucleotide
  Target: ATXN1; (+) strand; PAM type: YTN; PAM sequence: TTG
agatggagttttgctctata

SEQ ID NO: 253836 - DNA, 20 bp, Artificial Sequence
  Description of Artificial Sequence: Synthetic oligonucleotide
  Target: ATXN1; (+) strand; PAM type: YTN; PAM sequence: TTT
tgctctatagcccaggttgg

SEQ ID NO: 253837 - DNA, 20 bp, Artificial Sequence
  Description of Artificial Sequence: Synthetic oligonucleotide
  Target: ATXN1; (+) strand; PAM type: YTN; PAM sequence: TTT
gctctatagcccaggttgga

SEQ ID NO: 253838 - DNA, 20 bp, Artificial Sequence
  Description of Artificial Sequence: Synthetic oligonucleotide
  Target: ATXN1; (+) strand; PAM type: YTN; PAM sequence: TTG
ctctatagcccaggttggag

SEQ ID NO: 253839 - DNA, 20 bp, Artificial Sequence
  Description of Artificial Sequence: Synthetic oligonucleotide
  Target: ATXN1; (+) strand; PAM type: YTN; PAM sequence: CTC
tatagcccaggttggagtga

SEQ ID NO: 253840 - DNA, 20 bp, Artificial Sequence
  Description of Artificial Sequence: Synthetic oligonucleotide
  Target: ATXN1; (+) strand; PAM type: YTN; PAM sequence: CTA
tagcccaggttggagtgaag

SEQ ID NO: 253841 - DNA, 20 bp, Artificial Sequence
  Description of Artificial Sequence: Synthetic oligonucleotide
  Target: ATXN1; (+) strand; PAM type: YTN; PAM sequence: TTG
gagtgaagcggtgtaatctt

SEQ ID NO: 253842 - DNA, 20 bp, Artificial Sequence
  Description of Artificial Sequence: Synthetic oligonucleotide
  Target: ATXN1; (+) strand; PAM type: YTN; PAM sequence: CTT
ggctccctgcaacctccgcc

SEQ ID NO: 253843 - DNA, 20 bp, Artificial Sequence
  Description of Artificial Sequence: Synthetic oligonucleotide
  Target: ATXN1; (+) strand; PAM type: YTN; PAM sequence: TTG
gctccctgcaacctccgcct

SEQ ID NO: 253844 - DNA, 20 bp, Artificial Sequence
  Description of Artificial Sequence: Synthetic oligonucleotide
  Target: ATXN1; (+) strand; PAM type: YTN; PAM sequence: CTC
cctgcaacctccgccttcta

SEQ ID NO: 253845 - DNA, 20 bp, Artificial Sequence
  Description of Artificial Sequence: Synthetic oligonucleotide
  Target: ATXN1; (+) strand; PAM type: YTN; PAM sequence: CTG
caacctccgccttctaggtt

SEQ ID NO: 253846 - DNA, 20 bp, Artificial Sequence
  Description of Artificial Sequence: Synthetic oligonucleotide
  Target: ATXN1; (+) strand; PAM type: YTN; PAM sequence: CTC
cgccttctaggttcaagcga

SEQ ID NO: 253847 - DNA, 20 bp, Artificial Sequence
  Description of Artificial Sequence: Synthetic oligonucleotide
  Target: ATXN1; (+) strand; PAM type: YTN; PAM sequence: CTT
ctaggttcaagcgattctcc

SEQ ID NO: 253848 - DNA, 20 bp, Artificial Sequence
  Description of Artificial Sequence: Synthetic oligonucleotide
  Target: ATXN1; (+) strand; PAM type: YTN; PAM sequence: TTC
taggttcaagcgattctcct

SEQ ID NO: 253849 - DNA, 20 bp, Artificial Sequence
  Description of Artificial Sequence: Synthetic oligonucleotide
  Target: ATXN1; (+) strand; PAM type: YTN; PAM sequence: CTA
ggttcaagcgattctcctgc

SEQ ID NO: 253850 - DNA, 20 bp, Artificial Sequence
  Description of Artificial Sequence: Synthetic oligonucleotide
  Target: ATXN1; (+) strand; PAM type: YTN; PAM sequence: TTC
aagcgattctcctgcctcag

SEQ ID NO: 253851 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcctgag

SEQ ID NO: 253852 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcctgagta

SEQ ID NO: 253853 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcctgagtagct

SEQ ID NO: 253854 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagtagctggga

SEQ ID NO: 253855 - DNA, 20 bp, Artificial Sequence
  Description of Artificial Sequence: Synthetic oligonucleotide
  Target: ATXN1; (+) strand; PAM type: YTN; PAM sequence: CTC
ctgagtagctgggattacag

SEQ ID NO: 253856 - DNA, 20 bp, Artificial Sequence
  Description of Artificial Sequence: Synthetic oligonucleotide
  Target: ATXN1; (+) strand; PAM type: YTN; PAM sequence: CTG
agtagctgggattacaggcg

SEQ ID NO: 253857 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgcccgccac

SEQ ID NO: 253858 - DNA, 20 bp, Artificial Sequence
  Description of Artificial Sequence: Synthetic oligonucleotide
  Target: ATXN1; (+) strand; PAM type: YTN; PAM sequence: TTA
caggcgcccgccaccacacc

SEQ ID NO: 253859 - DNA, 20 bp, Artificial Sequence
  Description of Artificial Sequence: Synthetic oligonucleotide
  Target: ATXN1; (+) strand; PAM type: YTN; PAM sequence: CTG
gctaatttttgtatttttag

SEQ ID NO: 253860 - DNA, 20 bp, Artificial Sequence
  Description of Artificial Sequence: Synthetic oligonucleotide
  Target: ATXN1; (+) strand; PAM type: YTN; PAM sequence: CTA
atttttgtatttttagtaga

SEQ ID NO: 253861 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagaca

SEQ ID NO: 253862 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagacag

SEQ ID NO: 253863 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagacagg

SEQ ID NO: 253864 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagacaggg

SEQ ID NO: 253865 - DNA, 20 bp, Artificial Sequence
  Description of Artificial Sequence: Synthetic oligonucleotide
  Target: ATXN1; (+) strand; PAM type: YTN; PAM sequence: TTT
ttagtagagacagggtttca

SEQ ID NO: 253866 - DNA, 20 bp, Artificial Sequence
  Description of Artificial Sequence: Synthetic oligonucleotide
  Target: ATXN1; (+) strand; PAM type: YTN; PAM sequence: TTT
tagtagagacagggtttcat

SEQ ID NO: 253867 - DNA, 20 bp, Artificial Sequence
  Description of Artificial Sequence: Synthetic oligonucleotide
  Target: ATXN1; (+) strand; PAM type: YTN; PAM sequence: TTT
agtagagacagggtttcatc

SEQ ID NO: 253868 - DNA, 20 bp, Artificial Sequence
  Description of Artificial Sequence: Synthetic oligonucleotide
  Target: ATXN1; (+) strand; PAM type: YTN; PAM sequence: TTA
gtagagacagggtttcatca

SEQ ID NO: 253869 - DNA, 20 bp, Artificial Sequence
  Description of Artificial Sequence: Synthetic oligonucleotide
  Target: ATXN1; (+) strand; PAM type: YTN; PAM sequence: TTT
catcatgttaggcaggctgg

SEQ ID NO: 253870 - DNA, 20 bp, Artificial Sequence
  Description of Artificial Sequence: Synthetic oligonucleotide
  Target: ATXN1; (+) strand; PAM type: YTN; PAM sequence: TTC
atcatgttaggcaggctggt

SEQ ID NO: 253871 - DNA, 20 bp, Artificial Sequence
  Description of Artificial Sequence: Synthetic oligonucleotide
  Target: ATXN1; (+) strand; PAM type: YTN; PAM sequence: TTA
ggcaggctggtctcgaactc

SEQ ID NO: 253872 - DNA, 20 bp, Artificial Sequence
  Description of Artificial Sequence: Synthetic oligonucleotide
  Target: ATXN1; (+) strand; PAM type: YTN; PAM sequence: CTG
gtctcgaactcctgacctca

SEQ ID NO: 253873 - DNA, 20 bp, Artificial Sequence
  Description of Artificial Sequence: Synthetic oligonucleotide
  Target: ATXN1; (+) strand; PAM type: YTN; PAM sequence: CTC
gaactcctgacctcaggtga

SEQ ID NO: 253874 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggtgatccacc

SEQ ID NO: 253875 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatccacccgc

SEQ ID NO: 253876 - DNA, 20 bp, Artificial Sequence
  Description of Artificial Sequence: Synthetic oligonucleotide
  Target: ATXN1; (+) strand; PAM type: YTN; PAM sequence: CTC
aggtgatccacccgctttgg

SEQ ID NO: 253877 - DNA, 20 bp, Artificial Sequence
  Description of Artificial Sequence: Synthetic oligonucleotide
  Target: ATXN1; (+) strand; PAM type: YTN; PAM sequence: CTT
tggcctcccaaagtgctagg

SEQ ID NO: 253878 - DNA, 20 bp, Artificial Sequence
  Description of Artificial Sequence: Synthetic oligonucleotide
  Target: ATXN1; (+) strand; PAM type: YTN; PAM sequence: TTT
ggcctcccaaagtgctagga

SEQ ID NO: 253879 - DNA, 20 bp, Artificial Sequence
  Description of Artificial Sequence: Synthetic oligonucleotide
  Target: ATXN1; (+) strand; PAM type: YTN; PAM sequence: TTG
gcctcccaaagtgctaggac

SEQ ID NO: 253880 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctaggactagag

SEQ ID NO: 253881 - DNA, 20 bp, Artificial Sequence
  Description of Artificial Sequence: Synthetic oligonucleotide
  Target: ATXN1; (+) strand; PAM type: YTN; PAM sequence: CTA
ggactagaggcatgagccat

SEQ ID NO: 253882 - DNA, 20 bp, Artificial Sequence
  Description of Artificial Sequence: Synthetic oligonucleotide
  Target: ATXN1; (+) strand; PAM type: YTN; PAM sequence: CTA
gaggcatgagccatcgcaca

SEQ ID NO: 253883 - DNA, 20 bp, Artificial Sequence
  Description of Artificial Sequence: Synthetic oligonucleotide
  Target: ATXN1; (+) strand; PAM type: YTN; PAM sequence: CTC
aaccattctttatctctaaa

SEQ ID NO: 253884 - DNA, 20 bp, Artificial Sequence
  Description of Artificial Sequence: Synthetic oligonucleotide
  Target: ATXN1; (+) strand; PAM type: YTN; PAM sequence: TTC
tttatctctaaactcacaag

SEQ ID NO: 253885 - DNA, 20 bp, Artificial Sequence
  Description of Artificial Sequence: Synthetic oligonucleotide
  Target: ATXN1; (+) strand; PAM type: YTN; PAM sequence: CTT
tatctctaaactcacaagac

SEQ ID NO: 253886 - DNA, 20 bp, Artificial Sequence
  Description of Artificial Sequence: Synthetic oligonucleotide
  Target: ATXN1; (+) strand; PAM type: YTN; PAM sequence: TTT
atctctaaactcacaagaca

SEQ ID NO: 253887 - DNA, 20 bp, Artificial Sequence
  Description of Artificial Sequence: Synthetic oligonucleotide
  Target: ATXN1; (+) strand; PAM type: YTN; PAM sequence: TTA
tctctaaactcacaagacag

SEQ ID NO: 253888 - DNA, 20 bp, Artificial Sequence
  Description of Artificial Sequence: Synthetic oligonucleotide
  Target: ATXN1; (+) strand; PAM type: YTN; PAM sequence: CTC
taaactcacaagacagtggt

SEQ ID NO: 253889 - DNA, 20 bp, Artificial Sequence
  Description of Artificial Sequence: Synthetic oligonucleotide
  Target: ATXN1; (+) strand; PAM type: YTN; PAM sequence: CTA
aactcacaagacagtggttc

SEQ ID NO: 253890 - DNA, 20 bp, Artificial Sequence
  Description of Artificial Sequence: Synthetic oligonucleotide
  Target: ATXN1; (+) strand; PAM type: YTN; PAM sequence: CTC
acaagacagtggttctcaaa

SEQ ID NO: 253891 - DNA, 20 bp, Artificial Sequence
  Description of Artificial Sequence: Synthetic oligonucleotide
  Target: ATXN1; (+) strand; PAM type: YTN; PAM sequence: TTC
tcaaagtgagtcacccaggg

SEQ ID NO: 253892 - DNA, 20 bp, Artificial Sequence
  Description of Artificial Sequence: Synthetic oligonucleotide
  Target: ATXN1; (+) strand; PAM type: YTN; PAM sequence: CTC
aaagtgagtcacccagggaa

SEQ ID NO: 253893 - DNA, 20 bp, Artificial Sequence
  Description of Artificial Sequence: Synthetic oligonucleotide
  Target: ATXN1; (+) strand; PAM type: YTN; PAM sequence: CTG
taaacttgttacaaatgcaa

SEQ ID NO: 253894 - DNA, 20 bp, Artificial Sequence
  Description of Artificial Sequence: Synthetic oligonucleotide
  Target: ATXN1; (+) strand; PAM type: YTN; PAM sequence: CTT
gttacaaatgcaaattcttg

SEQ ID NO: 253895 - DNA, 20 bp, Artificial Sequence
  Description of Artificial Sequence: Synthetic oligonucleotide
  Target: ATXN1; (+) strand; PAM type: YTN; PAM sequence: TTG
ttacaaatgcaaattcttgg

SEQ ID NO: 253896 - DNA, 20 bp, Artificial Sequence
  Description of Artificial Sequence: Synthetic oligonucleotide
  Target: ATXN1; (+) strand; PAM type: YTN; PAM sequence: TTA
caaatgcaaattcttgggct

SEQ ID NO: 253897 - DNA, 20 bp, Artificial Sequence
  Description of Artificial Sequence: Synthetic oligonucleotide
  Target: ATXN1; (+) strand; PAM type: YTN; PAM sequence: TTC
ttgggctttccagcaatctg

SEQ ID NO: 253898 - DNA, 20 bp, Artificial Sequence
  Description of Artificial Sequence: Synthetic oligonucleotide
  Target: ATXN1; (+) strand; PAM type: YTN; PAM sequence: CTT
gggctttccagcaatctgtg

SEQ ID NO: 253899 - DNA, 20 bp, Artificial Sequence
  Description of Artificial Sequence: Synthetic oligonucleotide
  Target: ATXN1; (+) strand; PAM type: YTN; PAM sequence: TTG
ggctttccagcaatctgtgt

SEQ ID NO: 253900 - DNA, 20 bp, Artificial Sequence
  Description of Artificial Sequence: Synthetic oligonucleotide
  Target: ATXN1; (+) strand; PAM type: YTN; PAM sequence: CTT
tccagcaatctgtgtttgaa

SEQ ID NO: 253901 - DNA, 20 bp, Artificial Sequence
  Description of Artificial Sequence: Synthetic oligonucleotide
  Target: ATXN1; (+) strand; PAM type: YTN; PAM sequence: TTT
ccagcaatctgtgtttgaac

SEQ ID NO: 253902 - DNA, 20 bp, Artificial Sequence
  Description of Artificial Sequence: Synthetic oligonucleotide
  Target: ATXN1; (+) strand; PAM type: YTN; PAM sequence: TTC
cagcaatctgtgtttgaaca

SEQ ID NO: 253903 - DNA, 20 bp, Artificial Sequence
  Description of Artificial Sequence: Synthetic oligonucleotide
  Target: ATXN1; (+) strand; PAM type: YTN; PAM sequence: CTG
tgtttgaacaagtcctccag

SEQ ID NO: 253904 - DNA, 20 bp, Artificial Sequence
  Description of Artificial Sequence: Synthetic oligonucleotide
  Target: ATXN1; (+) strand; PAM type: YTN; PAM sequence: TTT
gaacaagtcctccaggcaat

SEQ ID NO: 253905 - DNA, 20 bp, Artificial Sequence
  Description of Artificial Sequence: Synthetic oligonucleotide
  Target: ATXN1; (+) strand; PAM type: YTN; PAM sequence: TTG
aacaagtcctccaggcaatg

SEQ ID NO: 253906 - DNA, 20 bp, Artificial Sequence
  Description of Artificial Sequence: Synthetic oligonucleotide
  Target: ATXN1; (+) strand; PAM type: YTN; PAM sequence: CTC
caggcaatgcccatgcactt

SEQ ID NO: 253907 - DNA, 20 bp, Artificial Sequence
  Description of Artificial Sequence: Synthetic oligonucleotide
  Target: ATXN1; (+) strand; PAM type: YTN; PAM sequence: CTT
gaaatttgacagtaactctc

SEQ ID NO: 253908 - DNA, 20 bp, Artificial Sequence
  Description of Artificial Sequence: Synthetic oligonucleotide
  Target: ATXN1; (+) strand; PAM type: YTN; PAM sequence: TTG
aaatttgacagtaactctca

SEQ ID NO: 253909 - DNA, 20 bp, Artificial Sequence
  Description of Artificial Sequence: Synthetic oligonucleotide
  Target: ATXN1; (+) strand; PAM type: YTN; PAM sequence: TTT
gacagtaactctcataagag

SEQ ID NO: 253910 - DNA, 20 bp, Artificial Sequence
  Description of Artificial Sequence: Synthetic oligonucleotide
  Target: ATXN1; (+) strand; PAM type: YTN; PAM sequence: TTG
acagtaactctcataagagg

SEQ ID NO: 253911 - DNA, 20 bp, Artificial Sequence
  Description of Artificial Sequence: Synthetic oligonucleotide
  Target: ATXN1; (+) strand; PAM type: YTN; PAM sequence: CTC
tcataagaggtcacatggct

SEQ ID NO: 253912 - DNA, 20 bp, Artificial Sequence
  Description of Artificial Sequence: Synthetic oligonucleotide
  Target: ATXN1; (+) strand; PAM type: YTN; PAM sequence: CTC
ataagaggtcacatggctcc

SEQ ID NO: 253913 - DNA, 20 bp, Artificial Sequence
  Description of Artificial Sequence: Synthetic oligonucleotide
  Target: ATXN1; (+) strand; PAM type: YTN; PAM sequence: CTC
cccttaatgtaaacacacca

SEQ ID NO: 253914 - DNA, 20 bp, Artificial Sequence
  Description of Artificial Sequence: Synthetic oligonucleotide
  Target: ATXN1; (+) strand; PAM type: YTN; PAM sequence: CTT
aatgtaaacacaccaaaatg

SEQ ID NO: 253915 - DNA, 20 bp, Artificial Sequence
  Description of Artificial Sequence: Synthetic oligonucleotide
  Target: ATXN1; (+) strand; PAM type: YTN; PAM sequence: TTA
atgtaaacacaccaaaatga

SEQ ID NO: 253916 - DNA, 20 bp, Artificial Sequence
  Description of Artificial Sequence: Synthetic oligonucleotide
  Target: ATXN1; (+) strand; PAM type: YTN; PAM sequence: TTT
tcttttaagaagtttcaaga

SEQ ID NO: 253917 - DNA, 20 bp, Artificial Sequence
  Description of Artificial Sequence: Synthetic oligonucleotide
  Target: ATXN1; (+) strand; PAM type: YTN; PAM sequence: TTT
cttttaagaagtttcaagac

SEQ ID NO: 253918 - DNA, 20 bp, Artificial Sequence
  Description of Artificial Sequence: Synthetic oligonucleotide
  Target: ATXN1; (+) strand; PAM type: YTN; PAM sequence: TTC
ttttaagaagtttcaagacc

SEQ ID NO: 253919 - DNA, 20 bp, Artificial Sequence
  Description of Artificial Sequence: Synthetic oligonucleotide
  Target: ATXN1; (+) strand; PAM type: YTN; PAM sequence: CTT
ttaagaagtttcaagacctt

SEQ ID NO: 253920 - DNA, 20 bp, Artificial Sequence
  Description of Artificial Sequence: Synthetic oligonucleotide
  Target: ATXN1; (+) strand; PAM type: YTN; PAM sequence: TTT
taagaagtttcaagaccttc

SEQ ID NO: 253921 - DNA, 20 bp, Artificial Sequence
  Description of Artificial Sequence: Synthetic oligonucleotide
  Target: ATXN1; (+) strand; PAM type: YTN; PAM sequence: TTT
aagaagtttcaagaccttca

SEQ ID NO: 253922 - DNA, 20 bp, Artificial Sequence
  Description of Artificial Sequence: Synthetic oligonucleotide
  Target: ATXN1; (+) strand; PAM type: YTN; PAM sequence: TTA
agaagtttcaagaccttcag

SEQ ID NO: 253923 - DNA, 20 bp, Artificial Sequence
  Description of Artificial Sequence: Synthetic oligonucleotide
  Target: ATXN1; (+) strand; PAM type: YTN; PAM sequence: TTT
caagaccttcagacatttta

SEQ ID NO: 253924 - DNA, 20 bp, Artificial Sequence
  Description of Artificial Sequence: Synthetic oligonucleotide
  Target: ATXN1; (+) strand; PAM type: YTN; PAM sequence: TTC
aagaccttcagacattttat

SEQ ID NO: 253925 - DNA, 20 bp, Artificial Sequence
  Description of Artificial Sequence: Synthetic oligonucleotide
  Target: ATXN1; (+) strand; PAM type: YTN; PAM sequence: CTT
cagacattttattcgagtaa

SEQ ID NO: 253926 - DNA, 20 bp, Artificial Sequence
  Description of Artificial Sequence: Synthetic oligonucleotide
  Target: ATXN1; (+) strand; PAM type: YTN; PAM sequence: TTC
agacattttattcgagtaaa

SEQ ID NO: 253927 - DNA, 20 bp, Artificial Sequence
  Description of Artificial Sequence: Synthetic oligonucleotide
  Target: ATXN1; (+) strand; PAM type: YTN; PAM sequence: TTT
tattcgagtaaattcataag

SEQ ID NO: 253928 - DNA, 20 bp, Artificial Sequence
  Description of Artificial Sequence: Synthetic oligonucleotide
  Target: ATXN1; (+) strand; PAM type: YTN; PAM sequence: TTT
attcgagtaaattcataagc

SEQ ID NO: 253929 - DNA, 20 bp, Artificial Sequence
  Description of Artificial Sequence: Synthetic oligonucleotide
  Target: ATXN1; (+) strand; PAM type: YTN; PAM sequence: TTA
ttcgagtaaattcataagca

SEQ ID NO: 253930 - DNA, 20 bp, Artificial Sequence
  Description of Artificial Sequence: Synthetic oligonucleotide
  Target: ATXN1; (+) strand; PAM type: YTN; PAM sequence: TTC
gagtaaattcataagcaaaa

SEQ ID NO: 253931 - DNA, 20 bp, Artificial Sequence
  Description of Artificial Sequence: Synthetic oligonucleotide
  Target: ATXN1; (+) strand; PAM type: YTN; PAM sequence: TTC
ataagcaaaacacaagcaca

SEQ ID NO: 253932 - DNA, 20 bp, Artificial Sequence
  Description of Artificial Sequence: Synthetic oligonucleotide
  Target: ATXN1; (+) strand; PAM type: YTN; PAM sequence: TTG
acttttttgcttaataaata

SEQ ID NO: 253933 - DNA, 20 bp, Artificial Sequence
  Description of Artificial Sequence: Synthetic oligonucleotide
  Target: ATXN1; (+) strand; PAM type: YTN; PAM sequence: CTT
ttttgcttaataaatatgat

SEQ ID NO: 253934 - DNA, 20 bp, Artificial Sequence
  Description of Artificial Sequence: Synthetic oligonucleotide
  Target: ATXN1; (+) strand; PAM type: YTN; PAM sequence: TTT
tttgcttaataaatatgatt

SEQ ID NO: 253935 - DNA, 20 bp, Artificial Sequence
  Description of Artificial Sequence: Synthetic oligonucleotide
  Target: ATXN1; (+) strand; PAM type: YTN; PAM sequence: TTT
ttgcttaataaatatgattt

SEQ ID NO: 253936 - DNA, 20 bp, Artificial Sequence
  Description of Artificial Sequence: Synthetic oligonucleotide
  Target: ATXN1; (+) strand; PAM type: YTN; PAM sequence: TTT
tgcttaataaatatgatttt

SEQ ID NO: 253937 - DNA, 20 bp, Artificial Sequence
  Description of Artificial Sequence: Synthetic oligonucleotide
  Target: ATXN1; (+) strand; PAM type: YTN; PAM sequence: TTT
gcttaataaatatgattttc

SEQ ID NO: 253938 - DNA, 20 bp, Artificial Sequence
  Description of Artificial Sequence: Synthetic oligonucleotide
  Target: ATXN1; (+) strand; PAM type: YTN; PAM sequence: TTG
cttaataaatatgattttct

SEQ ID NO: 253939 - DNA, 20 bp, Artificial Sequence
  Description of Artificial Sequence: Synthetic oligonucleotide
  Target: ATXN1; (+) strand; PAM type: YTN; PAM sequence: CTT
aataaatatgattttctcag

SEQ ID NO: 253940 - DNA, 20 bp, Artificial Sequence
  Description of Artificial Sequence: Synthetic oligonucleotide
  Target: ATXN1; (+) strand; PAM type: YTN; PAM sequence: TTA
ataaatatgattttctcaga

SEQ ID NO: 253941 - DNA, 20 bp, Artificial Sequence
  Description of Artificial Sequence: Synthetic oligonucleotide
  Target: ATXN1; (+) strand; PAM type: YTN; PAM sequence: TTT
tctcagacccactaacagat

SEQ ID NO: 253942 - DNA, 20 bp, Artificial Sequence
  Description of Artificial Sequence: Synthetic oligonucleotide
  Target: ATXN1; (+) strand; PAM type: YTN; PAM sequence: TTT
ctcagacccactaacagatc

SEQ ID NO: 253943 - DNA, 20 bp, Artificial Sequence
  Description of Artificial Sequence: Synthetic oligonucleotide
  Target: ATXN1; (+) strand; PAM type: YTN; PAM sequence: TTC
tcagacccactaacagatca

SEQ ID NO: 253944 - DNA, 20 bp, Artificial Sequence
  Description of Artificial Sequence: Synthetic oligonucleotide
  Target: ATXN1; (+) strand; PAM type: YTN; PAM sequence: CTC
agacccactaacagatcaca

SEQ ID NO: 253945 - DNA, 20 bp, Artificial Sequence
  Description of Artificial Sequence: Synthetic oligonucleotide
  Target: ATXN1; (+) strand; PAM type: YTN; PAM sequence: CTA
acagatcacatgtttcaccc

SEQ ID NO: 253946 - DNA, 20 bp, Artificial Sequence
  Description of Artificial Sequence: Synthetic oligonucleotide
  Target: ATXN1; (+) strand; PAM type: YTN; PAM sequence: TTT
cacccacacaaaatagtgta

SEQ ID NO: 253947 - DNA, 20 bp, Artificial Sequence
  Description of Artificial Sequence: Synthetic oligonucleotide
  Target: ATXN1; (+) strand; PAM type: YTN; PAM sequence: TTC
acccacacaaaatagtgtat

SEQ ID NO: 253948 - DNA, 20 bp, Artificial Sequence
  Description of Artificial Sequence: Synthetic oligonucleotide
  Target: ATXN1; (+) strand; PAM type: YTN; PAM sequence: CTT
acgaatgatcacagagaaga

SEQ ID NO: 253949 - DNA, 20 bp, Artificial Sequence
  Description of Artificial Sequence: Synthetic oligonucleotide
  Target: ATXN1; (+) strand; PAM type: YTN; PAM sequence: TTA
cgaatgatcacagagaagaa

SEQ ID NO: 253950 - DNA, 20 bp, Artificial Sequence
  Description of Artificial Sequence: Synthetic oligonucleotide
  Target: ATXN1; (+) strand; PAM type: YTN; PAM sequence: CTT
tttaaatttttaatttattt

SEQ ID NO: 253951 - DNA, 20 bp, Artificial Sequence
  Description of Artificial Sequence: Synthetic oligonucleotide
  Target: ATXN1; (+) strand; PAM type: YTN; PAM sequence: TTT
ttaaatttttaatttatttt

SEQ ID NO: 253952 - DNA, 20 bp, Artificial Sequence
  Description of Artificial Sequence: Synthetic oligonucleotide
  Target: ATXN1; (+) strand; PAM type: YTN; PAM sequence: TTT
taaatttttaatttattttt

SEQ ID NO: 253953 - DNA, 20 bp, Artificial Sequence
  Description of Artificial Sequence: Synthetic oligonucleotide
  Target: ATXN1; (+) strand; PAM type: YTN; PAM sequence: TTT
aaatttttaatttattttta

SEQ ID NO: 253954 - DNA, 20 bp, Artificial Sequence
  Description of Artificial Sequence: Synthetic oligonucleotide
  Target: ATXN1; (+) strand; PAM type: YTN; PAM sequence: TTA
aatttttaatttatttttat

SEQ ID NO: 253955 - DNA, 20 bp, Artificial Sequence
  Description of Artificial Sequence: Synthetic oligonucleotide
  Target: ATXN1; (+) strand; PAM type: YTN; PAM sequence: TTT
ttaatttatttttattttat

SEQ ID NO: 253956 - DNA, 20 bp, Artificial Sequence
  Description of Artificial Sequence: Synthetic oligonucleotide
  Target: ATXN1; (+) strand; PAM type: YTN; PAM sequence: TTT
taatttatttttattttatt

SEQ ID NO: 253957 - DNA, 20 bp, Artificial Sequence
  Description of Artificial Sequence: Synthetic oligonucleotide
  Target: ATXN1; (+) strand; PAM type: YTN; PAM sequence: TTT
aatttatttttattttattg

SEQ ID NO: 253958 - DNA, 20 bp, Artificial Sequence
  Description of Artificial Sequence: Synthetic oligonucleotide
  Target: ATXN1; (+) strand; PAM type: YTN; PAM sequence: TTA
atttatttttattttattgt

SEQ ID NO: 253959 - DNA, 20 bp, Artificial Sequence
  Description of Artificial Sequence: Synthetic oligonucleotide
  Target: ATXN1; (+) strand; PAM type: YTN; PAM sequence: TTT
atttttattttattgtatat

SEQ ID NO: 253960 - DNA, 20 bp, Artificial Sequence
  Description of Artificial Sequence: Synthetic oligonucleotide
  Target: ATXN1; (+) strand; PAM type: YTN; PAM sequence: TTA
tttttattttattgtatata

SEQ ID NO: 253961 - DNA, 20 bp, Artificial Sequence
  Description of Artificial Sequence: Synthetic oligonucleotide
  Target: ATXN1; (+) strand; PAM type: YTN; PAM sequence: TTT
ttattttattgtatatattt

SEQ ID NO: 253962 - DNA, 20 bp, Artificial Sequence
  Description of Artificial Sequence: Synthetic oligonucleotide
  Target: ATXN1; (+) strand; PAM type: YTN; PAM sequence: TTT
tattttattgtatatattta

SEQ ID NO: 253963 - DNA, 20 bp, Artificial Sequence
  Description of Artificial Sequence: Synthetic oligonucleotide
  Target: ATXN1; (+) strand; PAM type: YTN; PAM sequence: TTT
attttattgtatatatttat

SEQ ID NO: 253964 - DNA, 20 bp, Artificial Sequence
  Description of Artificial Sequence: Synthetic oligonucleotide
  Target: ATXN1; (+) strand; PAM type: YTN; PAM sequence: TTA
ttttattgtatatatttatt

SEQ ID NO: 253965 - DNA, 20 bp, Artificial Sequence
  Description of Artificial Sequence: Synthetic oligonucleotide
  Target: ATXN1; (+) strand; PAM type: YTN; PAM sequence: TTT
tattgtatatatttattttt

SEQ ID NO: 253966 - DNA, 20 bp, Artificial Sequence
  Description of Artificial Sequence: Synthetic oligonucleotide
  Target: ATXN1; (+) strand; PAM type: YTN; PAM sequence: TTT
attgtatatatttatttttt

SEQ ID NO: 253967 - DNA, 20 bp, Artificial Sequence
  Description of Artificial Sequence: Synthetic oligonucleotide
  Target: ATXN1; (+) strand; PAM type: YTN; PAM sequence: TTA
ttgtatatatttattttttt

SEQ ID NO: 253968 - DNA, 20 bp, Artificial Sequence
  Description of Artificial Sequence: Synthetic oligonucleotide
  Target: ATXN1; (+) strand; PAM type: YTN; PAM sequence: TTG
tatatatttattttttttag

SEQ ID NO: 253969 - DNA, 20 bp, Artificial Sequence
  Description of Artificial Sequence: Synthetic oligonucleotide
  Target: ATXN1; (+) strand; PAM type: YTN; PAM sequence: TTT
attttttttagagacagggt

SEQ ID NO: 253970 - DNA, 20 bp, Artificial Sequence
  Description of Artificial Sequence: Synthetic oligonucleotide
  Target: ATXN1; (+) strand; PAM type: YTN; PAM sequence: TTA
ttttttttagagacagggtc

SEQ ID NO: 253971 - DNA, 20 bp, Artificial Sequence
  Description of Artificial Sequence: Synthetic oligonucleotide
  Target: ATXN1; (+) strand; PAM type: YTN; PAM sequence: TTT
tttttagagacagggtcttt

SEQ ID NO: 253972 - DNA, 20 bp, Artificial Sequence
  Description of Artificial Sequence: Synthetic oligonucleotide
  Target: ATXN1; (+) strand; PAM type: YTN; PAM sequence: TTT
ttttagagacagggtctttc

SEQ ID NO: 253973 - DNA, 20 bp, Artificial Sequence
  Description of Artificial Sequence: Synthetic oligonucleotide
  Target: ATXN1; (+) strand; PAM type: YTN; PAM sequence: TTT
tttagagacagggtctttct

SEQ ID NO: 253974 - DNA, 20 bp, Artificial Sequence
  Description of Artificial Sequence: Synthetic oligonucleotide
  Target: ATXN1; (+) strand; PAM type: YTN; PAM sequence: TTT
ttagagacagggtctttctg

SEQ ID NO: 253975 - DNA, 20 bp, Artificial Sequence
  Description of Artificial Sequence: Synthetic oligonucleotide
  Target: ATXN1; (+) strand; PAM type: YTN; PAM sequence: TTT
tagagacagggtctttctgg

SEQ ID NO: 253976 - DNA, 20 bp, Artificial Sequence
  Description of Artificial Sequence: Synthetic oligonucleotide
  Target: ATXN1; (+) strand; PAM type: YTN; PAM sequence: TTT
agagacagggtctttctggg

SEQ ID NO: 253977 - DNA, 20 bp, Artificial Sequence
  Description of Artificial Sequence: Synthetic oligonucleotide
  Target: ATXN1; (+) strand; PAM type: YTN; PAM sequence: TTA
gagacagggtctttctgggt

SEQ ID NO: 253978 - DNA, 20 bp, Artificial Sequence
  Description of Artificial Sequence: Synthetic oligonucleotide
  Target: ATXN1; (+) strand; PAM type: YTN; PAM sequence: CTT
tctgggttacatccatagct

SEQ ID NO: 253979 - DNA, 20 bp, Artificial Sequence
  Description of Artificial Sequence: Synthetic oligonucleotide
  Target: ATXN1; (+) strand; PAM type: YTN; PAM sequence: TTT
ctgggttacatccatagctc

SEQ ID NO: 253980 - DNA, 20 bp, Artificial Sequence
  Description of Artificial Sequence: Synthetic oligonucleotide
  Target: ATXN1; (+) strand; PAM type: YTN; PAM sequence: TTC
tgggttacatccatagctca

SEQ ID NO: 253981 - DNA, 20 bp, Artificial Sequence
  Description of Artificial Sequence: Synthetic oligonucleotide
  Target: ATXN1; (+) strand; PAM type: YTN; PAM sequence: CTG
ggttacatccatagctcact

SEQ ID NO: 253982 - DNA, 20 bp, Artificial Sequence
  Description of Artificial Sequence: Synthetic oligonucleotide
  Target: ATXN1; (+) strand; PAM type: YTN; PAM sequence: TTA
catccatagctcactgcagc

SEQ ID NO: 253983 - DNA, 20 bp, Artificial Sequence
  Description of Artificial Sequence: Synthetic oligonucleotide
  Target: ATXN1; (+) strand; PAM type: YTN; PAM sequence: CTC
actgcagcctcaaactcctg

SEQ ID NO: 253984 - DNA, 20 bp, Artificial Sequence
  Description of Artificial Sequence: Synthetic oligonucleotide
  Target: ATXN1; (+) strand; PAM type: YTN; PAM sequence: CTG
cagcctcaaactcctgggct

SEQ ID NO: 253985 - DNA, 20 bp, Artificial Sequence
  Description of Artificial Sequence: Synthetic oligonucleotide
  Target: ATXN1; (+) strand; PAM type: YTN; PAM sequence: CTC
aaactcctgggctcaagcaa

SEQ ID NO: 253986 - DNA, 20 bp, Artificial Sequence
  Description of Artificial Sequence: Synthetic oligonucleotide
  Target: ATXN1; (+) strand; PAM type: YTN; PAM sequence: CTC
ctgggctcaagcaatcctcc

SEQ ID NO: 253987 - DNA, 20 bp, Artificial Sequence
  Description of Artificial Sequence: Synthetic oligonucleotide
  Target: ATXN1; (+) strand; PAM type: YTN; PAM sequence: CTG
ggctcaagcaatcctcccac

SEQ ID NO: 253988 - DNA, 20 bp, Artificial Sequence
  Description of Artificial Sequence: Synthetic oligonucleotide
  Target: ATXN1; (+) strand; PAM type: YTN; PAM sequence: CTC
aagcaatcctcccacatcag

SEQ ID NO: 253989 - DNA, 20 bp, Artificial Sequence
  Description of Artificial Sequence: Synthetic oligonucleotide
  Target: ATXN1; (+) strand; PAM type: YTN; PAM sequence: CTC
ccacatcagcctcctgagta

SEQ ID NO: 253990 - DNA, 20 bp, Artificial Sequence
  Description of Artificial Sequence: Synthetic oligonucleotide
  Target: ATXN1; (+) strand; PAM type: YTN; PAM sequence: CTC
ctgagtagctaagactacag

SEQ ID NO: 253991 - DNA, 20 bp, Artificial Sequence
  Description of Artificial Sequence: Synthetic oligonucleotide
  Target: ATXN1; (+) strand; PAM type: YTN; PAM sequence: CTG
agtagctaagactacagaga

SEQ ID NO: 253992 - DNA, 20 bp, Artificial Sequence
  Description of Artificial Sequence: Synthetic oligonucleotide
  Target: ATXN1; (+) strand; PAM type: YTN; PAM sequence: CTA
agactacagagatgtacaac

SEQ ID NO: 253993 - DNA, 20 bp, Artificial Sequence
  Description of Artificial Sequence: Synthetic oligonucleotide
  Target: ATXN1; (+) strand; PAM type: YTN; PAM sequence: CTA
cagagatgtacaaccatacc

SEQ ID NO: 253994 - DNA, 20 bp, Artificial Sequence
  Description of Artificial Sequence: Synthetic oligonucleotide
  Target: ATXN1; (+) strand; PAM type: YTN; PAM sequence: CTA
atttttaaatttttttgtag

SEQ ID NO: 253995 - DNA, 20 bp, Artificial Sequence
  Description of Artificial Sequence: Synthetic oligonucleotide
  Target: ATXN1; (+) strand; PAM type: YTN; PAM sequence: TTT
ttaaatttttttgtagagag

SEQ ID NO: 253996 - DNA, 20 bp, Artificial Sequence
  Description of Artificial Sequence: Synthetic oligonucleotide
  Target: ATXN1; (+) strand; PAM type: YTN; PAM sequence: TTT
taaatttttttgtagagagg

SEQ ID NO: 253997 - DNA, 20 bp, Artificial Sequence
  Description of Artificial Sequence: Synthetic oligonucleotide
  Target: ATXN1; (+) strand; PAM type: YTN; PAM sequence: TTT
aaatttttttgtagagagga

SEQ ID NO: 253998 - DNA, 20 bp, Artificial Sequence
  Description of Artificial Sequence: Synthetic oligonucleotide
  Target: ATXN1; (+) strand; PAM type: YTN; PAM sequence: TTA
aatttttttgtagagaggag

SEQ ID NO: 253999 - DNA, 20 bp, Artificial Sequence
  Description of Artificial Sequence: Synthetic oligonucleotide
  Target: ATXN1; (+) strand; PAM type: YTN; PAM sequence: TTT
ttttgtagagaggagttttg

SEQ ID NO: 254000 - DNA, 20 bp, Artificial Sequence
  Description of Artificial Sequence: Synthetic oligonucleotide
  Target: ATXN1; (+) strand; PAM type: YTN; PAM sequence: TTT
tttgtagagaggagttttgc

SEQ ID NO: 254001 - DNA, 20 bp, Artificial Sequence
  Description of Artificial Sequence: Synthetic oligonucleotide
  Target: ATXN1; (+) strand; PAM type: YTN; PAM sequence: TTT
ttgtagagaggagttttgct

SEQ ID NO: 254002 - DNA, 20 bp, Artificial Sequence
  Description of Artificial Sequence: Synthetic oligonucleotide
  Target: ATXN1; (+) strand; PAM type: YTN; PAM sequence: TTT
tgtagagaggagttttgctt

SEQ ID NO: 254003 - DNA, 20 bp, Artificial Sequence
  Description of Artificial Sequence: Synthetic oligonucleotide
  Target: ATXN1; (+) strand; PAM type: YTN; PAM sequence: TTT
gtagagaggagttttgcttt

SEQ ID NO: 254004 - DNA, 20 bp, Artificial Sequence
  Description of Artificial Sequence: Synthetic oligonucleotide
  Target: ATXN1; (+) strand; PAM type: YTN; PAM sequence: TTG
tagagaggagttttgctttt

SEQ ID NO: 254005 - DNA, 20 bp, Artificial Sequence
  Description of Artificial Sequence: Synthetic oligonucleotide
  Target: ATXN1; (+) strand; PAM type: YTN; PAM sequence: TTT
tgcttttttgcccaggccgg

SEQ ID NO: 254006 - DNA, 20 bp, Artificial Sequence
  Description of Artificial Sequence: Synthetic oligonucleotide
  Target: ATXN1; (+) strand; PAM type: YTN; PAM sequence: TTT
gcttttttgcccaggccggt

SEQ ID NO: 254007 - DNA, 20 bp, Artificial Sequence
  Description of Artificial Sequence: Synthetic oligonucleotide
  Target: ATXN1; (+) strand; PAM type: YTN; PAM sequence: TTG
cttttttgcccaggccggtc

SEQ ID NO: 254008 - DNA, 20 bp, Artificial Sequence
  Description of Artificial Sequence: Synthetic oligonucleotide
  Target: ATXN1; (+) strand; PAM type: YTN; PAM sequence: CTT
ttttgcccaggccggtcttg

SEQ ID NO: 254009 - DNA, 20 bp, Artificial Sequence
  Description of Artificial Sequence: Synthetic oligonucleotide
  Target: ATXN1; (+) strand; PAM type: YTN; PAM sequence: TTT
tttgcccaggccggtcttga

SEQ ID NO: 254010 - DNA, 20 bp, Artificial Sequence
  Description of Artificial Sequence: Synthetic oligonucleotide
  Target: ATXN1; (+) strand; PAM type: YTN; PAM sequence: TTT
ttgcccaggccggtcttgaa

SEQ ID NO: 254011 - DNA, 20 bp, Artificial Sequence
  Description of Artificial Sequence: Synthetic oligonucleotide
  Target: ATXN1; (+) strand; PAM type: YTN; PAM sequence: TTT
tgcccaggccggtcttgaat

SEQ ID NO: 254012 - DNA, 20 bp, Artificial Sequence
  Description of Artificial Sequence: Synthetic oligonucleotide
  Target: ATXN1; (+) strand; PAM type: YTN; PAM sequence: TTT
gcccaggccggtcttgaatt

SEQ ID NO: 254013 - DNA, 20 bp, Artificial Sequence
  Description of Artificial Sequence: Synthetic oligonucleotide
  Target: ATXN1; (+) strand; PAM type: YTN; PAM sequence: TTG
cccaggccggtcttgaattc

SEQ ID NO: 254014 - DNA, 20 bp, Artificial Sequence
  Description of Artificial Sequence: Synthetic oligonucleotide
  Target: ATXN1; (+) strand; PAM type: YTN; PAM sequence: CTT
gaattcctgacctcaagtga

SEQ ID NO: 254015 - DNA, 20 bp, Artificial Sequence
  Description of Artificial Sequence: Synthetic oligonucleotide
  Target: ATXN1; (+) strand; PAM type: YTN; PAM sequence: TTG
aattcctgacctcaagtgat

SEQ ID NO: 254016 - DNA, 20 bp, Artificial Sequence
  Description of Artificial Sequence: Synthetic oligonucleotide
  Target: ATXN1; (+) strand; PAM type: YTN; PAM sequence: TTC
ctgacctcaagtgatcttcc

SEQ ID NO: 254017 - DNA, 20 bp, Artificial Sequence
  Description of Artificial Sequence: Synthetic oligonucleotide
  Target: ATXN1; (+) strand; PAM type: YTN; PAM sequence: CTG
acctcaagtgatcttcctac

SEQ ID NO: 254018 - DNA, 20 bp, Artificial Sequence
  Description of Artificial Sequence: Synthetic oligonucleotide
  Target: ATXN1; (+) strand; PAM type: YTN; PAM sequence: CTC
aagtgatcttcctaccttgg

SEQ ID NO: 254019 - DNA, 20 bp, Artificial Sequence
  Description of Artificial Sequence: Synthetic oligonucleotide
  Target: ATXN1; (+) strand; PAM type: YTN; PAM sequence: CTT
cctaccttggccttccaaag

SEQ ID NO: 254020 - DNA, 20 bp, Artificial Sequence
  Description of Artificial Sequence: Synthetic oligonucleotide
  Target: ATXN1; (+) strand; PAM type: YTN; PAM sequence: TTC
ctaccttggccttccaaagt

SEQ ID NO: 254021 - DNA, 20 bp, Artificial Sequence
  Description of Artificial Sequence: Synthetic oligonucleotide
  Target: ATXN1; (+) strand; PAM type: YTN; PAM sequence: CTA
ccttggccttccaaagtgtt

SEQ ID NO: 254022 - DNA, 20 bp, Artificial Sequence
  Description of Artificial Sequence: Synthetic oligonucleotide
  Target: ATXN1; (+) strand; PAM type: YTN; PAM sequence: CTT
ggccttccaaagtgttggaa

SEQ ID NO: 254023 - DNA, 20 bp, Artificial Sequence
  Description of Artificial Sequence: Synthetic oligonucleotide
  Target: ATXN1; (+) strand; PAM type: YTN; PAM sequence: TTG
gccttccaaagtgttggaat

SEQ ID NO: 254024 - DNA, 20 bp, Artificial Sequence
  Description of Artificial Sequence: Synthetic oligonucleotide
  Target: ATXN1; (+) strand; PAM type: YTN; PAM sequence: CTT
ccaaagtgttggaattgtag

SEQ ID NO: 254025 - DNA, 20 bp, Artificial Sequence
  Description of Artificial Sequence: Synthetic oligonucleotide
  Target: ATXN1; (+) strand; PAM type: YTN; PAM sequence: TTC
caaagtgttggaattgtagg

SEQ ID NO: 254026 - DNA, 20 bp, Artificial Sequence
  Description of Artificial Sequence: Synthetic oligonucleotide
  Target: ATXN1; (+) strand; PAM type: YTN; PAM sequence: TTG
gaattgtaggtgtgaaccat

SEQ ID NO: 254027 - DNA, 20 bp, Artificial Sequence
  Description of Artificial Sequence: Synthetic oligonucleotide
  Target: ATXN1; (+) strand; PAM type: YTN; PAM sequence: TTG
taggtgtgaaccatcatgat

SEQ ID NO: 254028 - DNA, 20 bp, Artificial Sequence
  Description of Artificial Sequence: Synthetic oligonucleotide
  Target: ATXN1; (+) strand; PAM type: YTN; PAM sequence: TTC
atagtgagttgtttagttta

SEQ ID NO: 254029 - DNA, 20 bp, Artificial Sequence
  Description of Artificial Sequence: Synthetic oligonucleotide
  Target: ATXN1; (+) strand; PAM type: YTN; PAM sequence: TTG
tttagtttaaaatatgtgac

SEQ ID NO: 254030 - DNA, 20 bp, Artificial Sequence
  Description of Artificial Sequence: Synthetic oligonucleotide
  Target: ATXN1; (+) strand; PAM type: YTN; PAM sequence: TTT
agtttaaaatatgtgactct

SEQ ID NO: 254031 - DNA, 20 bp, Artificial Sequence
  Description of Artificial Sequence: Synthetic oligonucleotide
  Target: ATXN1; (+) strand; PAM type: YTN; PAM sequence: TTA
gtttaaaatatgtgactcta

SEQ ID NO: 254032 - DNA, 20 bp, Artificial Sequence
  Description of Artificial Sequence: Synthetic oligonucleotide
  Target: ATXN1; (+) strand; PAM type: YTN; PAM sequence: TTT
aaaatatgtgactctatctc

SEQ ID NO: 254033 - DNA, 20 bp, Artificial Sequence
  Description of Artificial Sequence: Synthetic oligonucleotide
  Target: ATXN1; (+) strand; PAM type: YTN; PAM sequence: TTA
aaatatgtgactctatctct

SEQ ID NO: 254034 - DNA, 20 bp, Artificial Sequence
  Description of Artificial Sequence: Synthetic oligonucleotide
  Target: ATXN1; (+) strand; PAM type: YTN; PAM sequence: CTC
tatctctacattatttgcct

SEQ ID NO: 254035 - DNA, 20 bp, Artificial Sequence
  Description of Artificial Sequence: Synthetic oligonucleotide
  Target: ATXN1; (+) strand; PAM type: YTN; PAM sequence: CTA
tctctacattatttgcctac

SEQ ID NO: 254036 - DNA, 20 bp, Artificial Sequence
  Description of Artificial Sequence: Synthetic oligonucleotide
  Target: ATXN1; (+) strand; PAM type: YTN; PAM sequence: CTC
tacattatttgcctacaaat

SEQ ID NO: 254037 - DNA, 20 bp, Artificial Sequence
  Description of Artificial Sequence: Synthetic oligonucleotide
  Target: ATXN1; (+) strand; PAM type: YTN; PAM sequence: CTA
cattatttgcctacaaatat

SEQ ID NO: 254038 - DNA, 20 bp, Artificial Sequence
  Description of Artificial Sequence: Synthetic oligonucleotide
  Target: ATXN1; (+) strand; PAM type: YTN; PAM sequence: TTA
tttgcctacaaatatgtcta

SEQ ID NO: 254039 - DNA, 20 bp, Artificial Sequence
  Description of Artificial Sequence: Synthetic oligonucleotide
  Target: ATXN1; (+) strand; PAM type: YTN; PAM sequence: TTT
gcctacaaatatgtctacca

SEQ ID NO: 254040 - DNA, 20 bp, Artificial Sequence
  Description of Artificial Sequence: Synthetic oligonucleotide
  Target: ATXN1; (+) strand; PAM type: YTN; PAM sequence: TTG
cctacaaatatgtctaccaa

SEQ ID NO: 254041 - DNA, 20 bp, Artificial Sequence
  Description of Artificial Sequence: Synthetic oligonucleotide
  Target: ATXN1; (+) strand; PAM type: YTN; PAM sequence: CTA
caaatatgtctaccaaattc

SEQ ID NO: 254042 - DNA, 20 bp, Artificial Sequence
  Description of Artificial Sequence: Synthetic oligonucleotide
  Target: ATXN1; (+) strand; PAM type: YTN; PAM sequence: CTA
ccaaattcatgacatatgac

SEQ ID NO: 254043 - DNA, 20 bp, Artificial Sequence
  Description of Artificial Sequence: Synthetic oligonucleotide
  Target: ATXN1; (+) strand; PAM type: YTN; PAM sequence: TTC
atgacatatgaccagtgtgt

SEQ ID NO: 254044 - DNA, 20 bp, Artificial Sequence
  Description of Artificial Sequence: Synthetic oligonucleotide
  Target: ATXN1; (+) strand; PAM type: YTN; PAM sequence: CTG
aatacataccagtgtttatg

SEQ ID NO: 254045 - DNA, 20 bp, Artificial Sequence
  Description of Artificial Sequence: Synthetic oligonucleotide
  Target: ATXN1; (+) strand; PAM type: YTN; PAM sequence: TTT
atggcactgacgttttaagt

SEQ ID NO: 254046 - DNA, 20 bp, Artificial Sequence
  Description of Artificial Sequence: Synthetic oligonucleotide
  Target: ATXN1; (+) strand; PAM type: YTN; PAM sequence: TTA
tggcactgacgttttaagtc

SEQ ID NO: 254047 - DNA, 20 bp, Artificial Sequence
  Description of Artificial Sequence: Synthetic oligonucleotide
  Target: ATXN1; (+) strand; PAM type: YTN; PAM sequence: CTG
acgttttaagtcctgttcgg

SEQ ID NO: 254048 - DNA, 20 bp, Artificial Sequence
  Description of Artificial Sequence: Synthetic oligonucleotide
  Target: ATXN1; (+) strand; PAM type: YTN; PAM sequence: TTT
taagtcctgttcggaaacac

SEQ ID NO: 254049 - DNA, 20 bp, Artificial Sequence
  Description of Artificial Sequence: Synthetic oligonucleotide
  Target: ATXN1; (+) strand; PAM type: YTN; PAM sequence: TTT
aagtcctgttcggaaacaca

SEQ ID NO: 254050 - DNA, 20 bp, Artificial Sequence
  Description of Artificial Sequence: Synthetic oligonucleotide
  Target: ATXN1; (+) strand; PAM type: YTN; PAM sequence: TTA
agtcctgttcggaaacacaa

SEQ ID NO: 254051 - DNA, 20 bp, Artificial Sequence
  Description of Artificial Sequence: Synthetic oligonucleotide
  Target: ATXN1; (+) strand; PAM type: YTN; PAM sequence: CTG
ttcggaaacacaaaatgcac

SEQ ID NO: 254052 - DNA, 20 bp, Artificial Sequence
  Description of Artificial Sequence: Synthetic oligonucleotide
  Target: ATXN1; (+) strand; PAM type: YTN; PAM sequence: TTC
ggaaacacaaaatgcactac

SEQ ID NO: 254053 - DNA, 20 bp, Artificial Sequence
  Description of Artificial Sequence: Synthetic oligonucleotide
  Target: ATXN1; (+) strand; PAM type: YTN; PAM sequence: CTA
cttagcttccatatgtgact

SEQ ID NO: 254054 - DNA, 20 bp, Artificial Sequence
  Description of Artificial Sequence: Synthetic oligonucleotide
  Target: ATXN1; (+) strand; PAM type: YTN; PAM sequence: CTT
agcttccatatgtgactaat

SEQ ID NO: 254055 - DNA, 20 bp, Artificial Sequence
  Description of Artificial Sequence: Synthetic oligonucleotide
  Target: ATXN1; (+) strand; PAM type: YTN; PAM sequence: TTA
gcttccatatgtgactaatt

SEQ ID NO: 254056 - DNA, 20 bp, Artificial Sequence
  Description of Artificial Sequence: Synthetic oligonucleotide
  Target: ATXN1; (+) strand; PAM type: YTN; PAM sequence: CTT
ccatatgtgactaattttaa

SEQ ID NO: 254057 - DNA, 20 bp, Artificial Sequence
  Description of Artificial Sequence: Synthetic oligonucleotide
  Target: ATXN1; (+) strand; PAM type: YTN; PAM sequence: TTC
catatgtgactaattttaaa

SEQ ID NO: 254058 - DNA, 20 bp, Artificial Sequence
  Description of Artificial Sequence: Synthetic oligonucleotide
  Target: ATXN1; (+) strand; PAM type: YTN; PAM sequence: CTA
attttaaaatatgcttttta

SEQ ID NO: 254059 - DNA, 20 bp, Artificial Sequence
  Description of Artificial Sequence: Synthetic oligonucleotide
  Target: ATXN1; (+) strand; PAM type: YTN; PAM sequence: TTT
taaaatatgctttttaggcc

SEQ ID NO: 254060 - DNA, 20 bp, Artificial Sequence
  Description of Artificial Sequence: Synthetic oligonucleotide
  Target: ATXN1; (+) strand; PAM type: YTN; PAM sequence: TTT
aaaatatgctttttaggcca

SEQ ID NO: 254061 - DNA, 20 bp, Artificial Sequence
  Description of Artificial Sequence: Synthetic oligonucleotide
  Target: ATXN1; (+) strand; PAM type: YTN; PAM sequence: TTA
aaatatgctttttaggccag

SEQ ID NO: 254062 - DNA, 20 bp, Artificial Sequence
  Description of Artificial Sequence: Synthetic oligonucleotide
  Target: ATXN1; (+) strand; PAM type: YTN; PAM sequence: CTT
tttaggccagacgcagtggc

SEQ ID NO: 254063 - DNA, 20 bp, Artificial Sequence
  Description of Artificial Sequence: Synthetic oligonucleotide
  Target: ATXN1; (+) strand; PAM type: YTN; PAM sequence: TTT
ttaggccagacgcagtggct

SEQ ID NO: 254064 - DNA, 20 bp, Artificial Sequence
  Description of Artificial Sequence: Synthetic oligonucleotide
  Target: ATXN1; (+) strand; PAM type: YTN; PAM sequence: TTT
taggccagacgcagtggctc

SEQ ID NO: 254065 - DNA, 20 bp, Artificial Sequence
  Description of Artificial Sequence: Synthetic oligonucleotide
  Target: ATXN1; (+) strand; PAM type: YTN; PAM sequence: TTT
aggccagacgcagtggctca

SEQ ID NO: 254066 - DNA, 20 bp, Artificial Sequence
  Description of Artificial Sequence: Synthetic oligonucleotide
  Target: ATXN1; (+) strand; PAM type: YTN; PAM sequence: TTA
ggccagacgcagtggctcac

SEQ ID NO: 254067 - DNA, 20 bp, Artificial Sequence
  Description of Artificial Sequence: Synthetic oligonucleotide
  Target: ATXN1; (+) strand; PAM type: YTN; PAM sequence: CTC
acacctgtaatcccagcact

SEQ ID NO: 254068 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 254069 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggtgggagg

SEQ ID NO: 254070 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggtgggagga

SEQ ID NO: 254071 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggtgggaggat

SEQ ID NO: 254072 - DNA, 20 bp, Artificial Sequence
  Description of Artificial Sequence: Synthetic oligonucleotide
  Target: ATXN1; (+) strand; PAM type: YTN; PAM sequence: TTC
aagaccagtctggccaacac

SEQ ID NO: 254073 - DNA, 20 bp, Artificial Sequence
  Description of Artificial Sequence: Synthetic oligonucleotide
  Target: ATXN1; (+) strand; PAM type: YTN; PAM sequence: CTG
gccaacacagtgaaatcttg

SEQ ID NO: 254074 - DNA, 20 bp, Artificial Sequence
  Description of Artificial Sequence: Synthetic oligonucleotide
  Target: ATXN1; (+) strand; PAM type: YTN; PAM sequence: CTT
gtctgtattacaataaagtg

SEQ ID NO: 254075 - DNA, 20 bp, Artificial Sequence
  Description of Artificial Sequence: Synthetic oligonucleotide
  Target: ATXN1; (+) strand; PAM type: YTN; PAM sequence: TTG
tctgtattacaataaagtgt

SEQ ID NO: 254076 - DNA, 20 bp, Artificial Sequence
  Description of Artificial Sequence: Synthetic oligonucleotide
  Target: ATXN1; (+) strand; PAM type: YTN; PAM sequence: CTG
tattacaataaagtgtaata

SEQ ID NO: 254077 - DNA, 20 bp, Artificial Sequence
  Description of Artificial Sequence: Synthetic oligonucleotide
  Target: ATXN1; (+) strand; PAM type: YTN; PAM sequence: TTA
caataaagtgtaataccttt

SEQ ID NO: 254078 - DNA, 20 bp, Artificial Sequence
  Description of Artificial Sequence: Synthetic oligonucleotide
  Target: ATXN1; (+) strand; PAM type: YTN; PAM sequence: CTT
ttcaacatgggattctaaca

SEQ ID NO: 254079 - DNA, 20 bp, Artificial Sequence
  Description of Artificial Sequence: Synthetic oligonucleotide
  Target: ATXN1; (+) strand; PAM type: YTN; PAM sequence: TTT
tcaacatgggattctaacat

SEQ ID NO: 254080 - DNA, 20 bp, Artificial Sequence
  Description of Artificial Sequence: Synthetic oligonucleotide
  Target: ATXN1; (+) strand; PAM type: YTN; PAM sequence: TTT
caacatgggattctaacatg

SEQ ID NO: 254081 - DNA, 20 bp, Artificial Sequence
  Description of Artificial Sequence: Synthetic oligonucleotide
  Target: ATXN1; (+) strand; PAM type: YTN; PAM sequence: TTC
aacatgggattctaacatgg

SEQ ID NO: 254082 - DNA, 20 bp, Artificial Sequence
  Description of Artificial Sequence: Synthetic oligonucleotide
  Target: ATXN1; (+) strand; PAM type: YTN; PAM sequence: TTC
taacatggaatcaccttttt

SEQ ID NO: 254083 - DNA, 20 bp, Artificial Sequence
  Description of Artificial Sequence: Synthetic oligonucleotide
  Target: ATXN1; (+) strand; PAM type: YTN; PAM sequence: CTA
acatggaatcaccttttttt

SEQ ID NO: 254084 - DNA, 20 bp, Artificial Sequence
  Description of Artificial Sequence: Synthetic oligonucleotide
  Target: ATXN1; (+) strand; PAM type: YTN; PAM sequence: CTT
tttttttttttttttgtaat

SEQ ID NO: 254085 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgtaatt

SEQ ID NO: 254086 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgtaattc

SEQ ID NO: 254087 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgtaattcg

SEQ ID NO: 254088 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgtaattcgt

SEQ ID NO: 254089 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgtaattcgtg

SEQ ID NO: 254090 - DNA, 20 bp, Artificial Sequence
  Description of Artificial Sequence: Synthetic oligonucleotide
  Target: ATXN1; (+) strand; PAM type: YTN; PAM sequence: TTT
tttttttttgtaattcgtgc

SEQ ID NO: 254091 - DNA, 20 bp, Artificial Sequence
  Description of Artificial Sequence: Synthetic oligonucleotide
  Target: ATXN1; (+) strand; PAM type: YTN; PAM sequence: TTT
ttttttttgtaattcgtgcc

SEQ ID NO: 254092 - DNA, 20 bp, Artificial Sequence
  Description of Artificial Sequence: Synthetic oligonucleotide
  Target: ATXN1; (+) strand; PAM type: YTN; PAM sequence: TTT
tttttttgtaattcgtgcct

SEQ ID NO: 254093 - DNA, 20 bp, Artificial Sequence
  Description of Artificial Sequence: Synthetic oligonucleotide
  Target: ATXN1; (+) strand; PAM type: YTN; PAM sequence: TTT
ttttttgtaattcgtgcctc

SEQ ID NO: 254094 - DNA, 20 bp, Artificial Sequence
  Description of Artificial Sequence: Synthetic oligonucleotide
  Target: ATXN1; (+) strand; PAM type: YTN; PAM sequence: TTT
tttttgtaattcgtgcctcc

SEQ ID NO: 254095 - DNA, 20 bp, Artificial Sequence
  Description of Artificial Sequence: Synthetic oligonucleotide
  Target: ATXN1; (+) strand; PAM type: YTN; PAM sequence: TTT
ttttgtaattcgtgcctccc

SEQ ID NO: 254096 - DNA, 20 bp, Artificial Sequence
  Description of Artificial Sequence: Synthetic oligonucleotide
  Target: ATXN1; (+) strand; PAM type: YTN; PAM sequence: TTT
tttgtaattcgtgcctccct

SEQ ID NO: 254097 - DNA, 20 bp, Artificial Sequence
  Description of Artificial Sequence: Synthetic oligonucleotide
  Target: ATXN1; (+) strand; PAM type: YTN; PAM sequence: TTT
ttgtaattcgtgcctccctc

SEQ ID NO: 254098 - DNA, 20 bp, Artificial Sequence
  Description of Artificial Sequence: Synthetic oligonucleotide
  Target: ATXN1; (+) strand; PAM type: YTN; PAM sequence: TTT
tgtaattcgtgcctccctcc

SEQ ID NO: 254099 - DNA, 20 bp, Artificial Sequence
  Description of Artificial Sequence: Synthetic oligonucleotide
  Target: ATXN1; (+) strand; PAM type: YTN; PAM sequence: TTT
gtaattcgtgcctccctccc

SEQ ID NO: 254100 - DNA, 20 bp, Artificial Sequence
  Description of Artificial Sequence: Synthetic oligonucleotide
  Target: ATXN1; (+) strand; PAM type: YTN; PAM sequence: TTG
taattcgtgcctccctcccc

SEQ ID NO: 254101 - DNA, 20 bp, Artificial Sequence
  Description of Artificial Sequence: Synthetic oligonucleotide
  Target: ATXN1; (+) strand; PAM type: YTN; PAM sequence: TTC
gtgcctccctcccctagttt

SEQ ID NO: 254102 - DNA, 20 bp, Artificial Sequence
  Description of Artificial Sequence: Synthetic oligonucleotide
  Target: ATXN1; (+) strand; PAM type: YTN; PAM sequence: CTC
cctcccctagttttaaccta

SEQ ID NO: 254103 - DNA, 20 bp, Artificial Sequence
  Description of Artificial Sequence: Synthetic oligonucleotide
  Target: ATXN1; (+) strand; PAM type: YTN; PAM sequence: CTC
ccctagttttaacctatgct

SEQ ID NO: 254104 - DNA, 20 bp, Artificial Sequence
  Description of Artificial Sequence: Synthetic oligonucleotide
  Target: ATXN1; (+) strand; PAM type: YTN; PAM sequence: CTA
gttttaacctatgcttggtc

SEQ ID NO: 254105 - DNA, 20 bp, Artificial Sequence
  Description of Artificial Sequence: Synthetic oligonucleotide
  Target: ATXN1; (+) strand; PAM type: YTN; PAM sequence: TTT
taacctatgcttggtccaaa

SEQ ID NO: 254106 - DNA, 20 bp, Artificial Sequence
  Description of Artificial Sequence: Synthetic oligonucleotide
  Target: ATXN1; (+) strand; PAM type: YTN; PAM sequence: TTT
aacctatgcttggtccaaat

SEQ ID NO: 254107 - DNA, 20 bp, Artificial Sequence
  Description of Artificial Sequence: Synthetic oligonucleotide
  Target: ATXN1; (+) strand; PAM type: YTN; PAM sequence: TTA
acctatgcttggtccaaata

SEQ ID NO: 254108 - DNA, 20 bp, Artificial Sequence
  Description of Artificial Sequence: Synthetic oligonucleotide
  Target: ATXN1; (+) strand; PAM type: YTN; PAM sequence: CTA
tgcttggtccaaatatcatg

SEQ ID NO: 254109 - DNA, 20 bp, Artificial Sequence
  Description of Artificial Sequence: Synthetic oligonucleotide
  Target: ATXN1; (+) strand; PAM type: YTN; PAM sequence: CTT
ggtccaaatatcatgggtct

SEQ ID NO: 254110 - DNA, 20 bp, Artificial Sequence
  Description of Artificial Sequence: Synthetic oligonucleotide
  Target: ATXN1; (+) strand; PAM type: YTN; PAM sequence: TTG
gtccaaatatcatgggtcta

SEQ ID NO: 254111 - DNA, 20 bp, Artificial Sequence
  Description of Artificial Sequence: Synthetic oligonucleotide
  Target: ATXN1; (+) strand; PAM type: YTN; PAM sequence: CTA
tgtttctgtggtctaagaca

SEQ ID NO: 254112 - DNA, 20 bp, Artificial Sequence
  Description of Artificial Sequence: Synthetic oligonucleotide
  Target: ATXN1; (+) strand; PAM type: YTN; PAM sequence: TTT
ctgtggtctaagacacttct

SEQ ID NO: 254113 - DNA, 20 bp, Artificial Sequence
  Description of Artificial Sequence: Synthetic oligonucleotide
  Target: ATXN1; (+) strand; PAM type: YTN; PAM sequence: TTC
tgtggtctaagacacttctt

SEQ ID NO: 254114 - DNA, 20 bp, Artificial Sequence
  Description of Artificial Sequence: Synthetic oligonucleotide
  Target: ATXN1; (+) strand; PAM type: YTN; PAM sequence: CTG
tggtctaagacacttcttta

SEQ ID NO: 254115 - DNA, 20 bp, Artificial Sequence
  Description of Artificial Sequence: Synthetic oligonucleotide
  Target: ATXN1; (+) strand; PAM type: YTN; PAM sequence: CTA
agacacttctttaagataag

SEQ ID NO: 254116 - DNA, 20 bp, Artificial Sequence
  Description of Artificial Sequence: Synthetic oligonucleotide
  Target: ATXN1; (+) strand; PAM type: YTN; PAM sequence: CTT
ctttaagataagcccgatgc

SEQ ID NO: 254117 - DNA, 20 bp, Artificial Sequence
  Description of Artificial Sequence: Synthetic oligonucleotide
  Target: ATXN1; (+) strand; PAM type: YTN; PAM sequence: TTC
tttaagataagcccgatgcc

SEQ ID NO: 254118 - DNA, 20 bp, Artificial Sequence
  Description of Artificial Sequence: Synthetic oligonucleotide
  Target: ATXN1; (+) strand; PAM type: YTN; PAM sequence: CTT
taagataagcccgatgccta

SEQ ID NO: 254119 - DNA, 20 bp, Artificial Sequence
  Description of Artificial Sequence: Synthetic oligonucleotide
  Target: ATXN1; (+) strand; PAM type: YTN; PAM sequence: TTT
aagataagcccgatgcctaa

SEQ ID NO: 254120 - DNA, 20 bp, Artificial Sequence
  Description of Artificial Sequence: Synthetic oligonucleotide
  Target: ATXN1; (+) strand; PAM type: YTN; PAM sequence: TTA
agataagcccgatgcctaac

SEQ ID NO: 254121 - DNA, 20 bp, Artificial Sequence
  Description of Artificial Sequence: Synthetic oligonucleotide
  Target: ATXN1; (+) strand; PAM type: YTN; PAM sequence: CTA
acacacatctaggagtaagt

SEQ ID NO: 254122 - DNA, 20 bp, Artificial Sequence
  Description of Artificial Sequence: Synthetic oligonucleotide
  Target: ATXN1; (+) strand; PAM type: YTN; PAM sequence: CTA
ggagtaagttaacaattctg

SEQ ID NO: 254123 - DNA, 20 bp, Artificial Sequence
  Description of Artificial Sequence: Synthetic oligonucleotide
  Target: ATXN1; (+) strand; PAM type: YTN; PAM sequence: TTA
acaattctgaaatactggtt

SEQ ID NO: 254124 - DNA, 20 bp, Artificial Sequence
  Description of Artificial Sequence: Synthetic oligonucleotide
  Target: ATXN1; (+) strand; PAM type: YTN; PAM sequence: TTC
tgaaatactggtttctttgg

SEQ ID NO: 254125 - DNA, 20 bp, Artificial Sequence
  Description of Artificial Sequence: Synthetic oligonucleotide
  Target: ATXN1; (+) strand; PAM type: YTN; PAM sequence: CTG
aaatactggtttctttggct

SEQ ID NO: 254126 - DNA, 20 bp, Artificial Sequence
  Description of Artificial Sequence: Synthetic oligonucleotide
  Target: ATXN1; (+) strand; PAM type: YTN; PAM sequence: CTG
gtttctttggcttttagacc

SEQ ID NO: 254127 - DNA, 20 bp, Artificial Sequence
  Description of Artificial Sequence: Synthetic oligonucleotide
  Target: ATXN1; (+) strand; PAM type: YTN; PAM sequence: TTT
ctttggcttttagacctgtt

SEQ ID NO: 254128 - DNA, 20 bp, Artificial Sequence
  Description of Artificial Sequence: Synthetic oligonucleotide
  Target: ATXN1; (+) strand; PAM type: YTN; PAM sequence: TTC
tttggcttttagacctgttg

SEQ ID NO: 254129 - DNA, 20 bp, Artificial Sequence
  Description of Artificial Sequence: Synthetic oligonucleotide
  Target: ATXN1; (+) strand; PAM type: YTN; PAM sequence: CTT
tggcttttagacctgttgat

SEQ ID NO: 254130 - DNA, 20 bp, Artificial Sequence
  Description of Artificial Sequence: Synthetic oligonucleotide
  Target: ATXN1; (+) strand; PAM type: YTN; PAM sequence: TTT
ggcttttagacctgttgatt

SEQ ID NO: 254131 - DNA, 20 bp, Artificial Sequence
  Description of Artificial Sequence: Synthetic oligonucleotide
  Target: ATXN1; (+) strand; PAM type: YTN; PAM sequence: TTG
gcttttagacctgttgattg

SEQ ID NO: 254132 - DNA, 20 bp, Artificial Sequence
  Description of Artificial Sequence: Synthetic oligonucleotide
  Target: ATXN1; (+) strand; PAM type: YTN; PAM sequence: CTT
ttagacctgttgattgtttt

SEQ ID NO: 254133 - DNA, 20 bp, Artificial Sequence
  Description of Artificial Sequence: Synthetic oligonucleotide
  Target: ATXN1; (+) strand; PAM type: YTN; PAM sequence: TTT
tagacctgttgattgttttg

SEQ ID NO: 254134 - DNA, 20 bp, Artificial Sequence
  Description of Artificial Sequence: Synthetic oligonucleotide
  Target: ATXN1; (+) strand; PAM type: YTN; PAM sequence: TTT
agacctgttgattgttttgg

SEQ ID NO: 254135 - DNA, 20 bp, Artificial Sequence
  Description of Artificial Sequence: Synthetic oligonucleotide
  Target: ATXN1; (+) strand; PAM type: YTN; PAM sequence: TTA
gacctgttgattgttttggt

SEQ ID NO: 254136 - DNA, 20 bp, Artificial Sequence
  Description of Artificial Sequence: Synthetic oligonucleotide
  Target: ATXN1; (+) strand; PAM type: YTN; PAM sequence: CTG
ttgattgttttggttataaa

SEQ ID NO: 254137 - DNA, 20 bp, Artificial Sequence
  Description of Artificial Sequence: Synthetic oligonucleotide
  Target: ATXN1; (+) strand; PAM type: YTN; PAM sequence: TTG
attgttttggttataaaggt

SEQ ID NO: 254138 - DNA, 20 bp, Artificial Sequence
  Description of Artificial Sequence: Synthetic oligonucleotide
  Target: ATXN1; (+) strand; PAM type: YTN; PAM sequence: TTG
ttttggttataaaggtctgc

SEQ ID NO: 254139 - DNA, 20 bp, Artificial Sequence
  Description of Artificial Sequence: Synthetic oligonucleotide
  Target: ATXN1; (+) strand; PAM type: YTN; PAM sequence: TTT
tggttataaaggtctgcctt

SEQ ID NO: 254140 - DNA, 20 bp, Artificial Sequence
  Description of Artificial Sequence: Synthetic oligonucleotide
  Target: ATXN1; (+) strand; PAM type: YTN; PAM sequence: TTT
ggttataaaggtctgccttt

SEQ ID NO: 254141 - DNA, 20 bp, Artificial Sequence
  Description of Artificial Sequence: Synthetic oligonucleotide
  Target: ATXN1; (+) strand; PAM type: YTN; PAM sequence: TTG
gttataaaggtctgccttta

SEQ ID NO: 254142 - DNA, 20 bp, Artificial Sequence
  Description of Artificial Sequence: Synthetic oligonucleotide
  Target: ATXN1; (+) strand; PAM type: YTN; PAM sequence: TTA
taaaggtctgcctttaacat

SEQ ID NO: 254143 - DNA, 20 bp, Artificial Sequence
  Description of Artificial Sequence: Synthetic oligonucleotide
  Target: ATXN1; (+) strand; PAM type: YTN; PAM sequence: CTG
cctttaacatttttccttct

SEQ ID NO: 254144 - DNA, 20 bp, Artificial Sequence
  Description of Artificial Sequence: Synthetic oligonucleotide
  Target: ATXN1; (+) strand; PAM type: YTN; PAM sequence: CTT
taacatttttccttctgtgt

SEQ ID NO: 254145 - DNA, 20 bp, Artificial Sequence
  Description of Artificial Sequence: Synthetic oligonucleotide
  Target: ATXN1; (+) strand; PAM type: YTN; PAM sequence: TTT
aacatttttccttctgtgtt

SEQ ID NO: 254146 - DNA, 20 bp, Artificial Sequence
  Description of Artificial Sequence: Synthetic oligonucleotide
  Target: ATXN1; (+) strand; PAM type: YTN; PAM sequence: TTA
acatttttccttctgtgttc

SEQ ID NO: 254147 - DNA, 20 bp, Artificial Sequence
  Description of Artificial Sequence: Synthetic oligonucleotide
  Target: ATXN1; (+) strand; PAM type: YTN; PAM sequence: TTT
ttccttctgtgttcctaact

SEQ ID NO: 254148 - DNA, 20 bp, Artificial Sequence
  Description of Artificial Sequence: Synthetic oligonucleotide
  Target: ATXN1; (+) strand; PAM type: YTN; PAM sequence: TTT
tccttctgtgttcctaacta

SEQ ID NO: 254149 - DNA, 20 bp, Artificial Sequence
  Description of Artificial Sequence: Synthetic oligonucleotide
  Target: ATXN1; (+) strand; PAM type: YTN; PAM sequence: TTT
ccttctgtgttcctaactag

SEQ ID NO: 254150 - DNA, 20 bp, Artificial Sequence
  Description of Artificial Sequence: Synthetic oligonucleotide
  Target: ATXN1; (+) strand; PAM type: YTN; PAM sequence: TTC
cttctgtgttcctaactagg

SEQ ID NO: 254151 - DNA, 20 bp, Artificial Sequence
  Description of Artificial Sequence: Synthetic oligonucleotide
  Target: ATXN1; (+) strand; PAM type: YTN; PAM sequence: CTT
ctgtgttcctaactaggcct

SEQ ID NO: 254152 - DNA, 20 bp, Artificial Sequence
  Description of Artificial Sequence: Synthetic oligonucleotide
  Target: ATXN1; (+) strand; PAM type: YTN; PAM sequence: TTC
tgtgttcctaactaggcctc

SEQ ID NO: 254153 - DNA, 20 bp, Artificial Sequence
  Description of Artificial Sequence: Synthetic oligonucleotide
  Target: ATXN1; (+) strand; PAM type: YTN; PAM sequence: CTG
tgttcctaactaggcctctg

SEQ ID NO: 254154 - DNA, 20 bp, Artificial Sequence
  Description of Artificial Sequence: Synthetic oligonucleotide
  Target: ATXN1; (+) strand; PAM type: YTN; PAM sequence: TTC
ctaactaggcctctgagtct

SEQ ID NO: 254155 - DNA, 20 bp, Artificial Sequence
  Description of Artificial Sequence: Synthetic oligonucleotide
  Target: ATXN1; (+) strand; PAM type: YTN; PAM sequence: CTA
actaggcctctgagtctcca

SEQ ID NO: 254156 - DNA, 20 bp, Artificial Sequence
  Description of Artificial Sequence: Synthetic oligonucleotide
  Target: ATXN1; (+) strand; PAM type: YTN; PAM sequence: CTA
ggcctctgagtctccactgt

SEQ ID NO: 254157 - DNA, 20 bp, Artificial Sequence
  Description of Artificial Sequence: Synthetic oligonucleotide
  Target: ATXN1; (+) strand; PAM type: YTN; PAM sequence: CTC
tgagtctccactgtcaaaat

SEQ ID NO: 254158 - DNA, 20 bp, Artificial Sequence
  Description of Artificial Sequence: Synthetic oligonucleotide
  Target: ATXN1; (+) strand; PAM type: YTN; PAM sequence: CTG
agtctccactgtcaaaatgt

SEQ ID NO: 254159 - DNA, 20 bp, Artificial Sequence
  Description of Artificial Sequence: Synthetic oligonucleotide
  Target: ATXN1; (+) strand; PAM type: YTN; PAM sequence: CTC
cactgtcaaaatgtggctga

SEQ ID NO: 254160 - DNA, 20 bp, Artificial Sequence
  Description of Artificial Sequence: Synthetic oligonucleotide
  Target: ATXN1; (+) strand; PAM type: YTN; PAM sequence: CTG
tcaaaatgtggctgatcaga

SEQ ID NO: 254161 - DNA, 20 bp, Artificial Sequence
  Description of Artificial Sequence: Synthetic oligonucleotide
  Target: ATXN1; (+) strand; PAM type: YTN; PAM sequence: CTG
atcagactttaggcaaccct

SEQ ID NO: 254162 - DNA, 20 bp, Artificial Sequence
  Description of Artificial Sequence: Synthetic oligonucleotide
  Target: ATXN1; (+) strand; PAM type: YTN; PAM sequence: CTT
taggcaaccctcacctcaac

SEQ ID NO: 254163 - DNA, 20 bp, Artificial Sequence
  Description of Artificial Sequence: Synthetic oligonucleotide
  Target: ATXN1; (+) strand; PAM type: YTN; PAM sequence: TTT
aggcaaccctcacctcaacc

SEQ ID NO: 254164 - DNA, 20 bp, Artificial Sequence
  Description of Artificial Sequence: Synthetic oligonucleotide
  Target: ATXN1; (+) strand; PAM type: YTN; PAM sequence: TTA
ggcaaccctcacctcaacct

SEQ ID NO: 254165 - DNA, 20 bp, Artificial Sequence
  Description of Artificial Sequence: Synthetic oligonucleotide
  Target: ATXN1; (+) strand; PAM type: YTN; PAM sequence: CTC
acctcaacctgtgattatgg

SEQ ID NO: 254166 - DNA, 20 bp, Artificial Sequence
  Description of Artificial Sequence: Synthetic oligonucleotide
  Target: ATXN1; (+) strand; PAM type: YTN; PAM sequence: CTC
aacctgtgattatggaagga

SEQ ID NO: 254167 - DNA, 20 bp, Artificial Sequence
  Description of Artificial Sequence: Synthetic oligonucleotide
  Target: ATXN1; (+) strand; PAM type: YTN; PAM sequence: CTG
tgattatggaaggaagtaca

SEQ ID NO: 254168 - DNA, 20 bp, Artificial Sequence
  Description of Artificial Sequence: Synthetic oligonucleotide
  Target: ATXN1; (+) strand; PAM type: YTN; PAM sequence: TTA
tggaaggaagtacaggacat

SEQ ID NO: 254169 - DNA, 20 bp, Artificial Sequence
  Description of Artificial Sequence: Synthetic oligonucleotide
  Target: ATXN1; (+) strand; PAM type: YTN; PAM sequence: CTT
aacactccttcccggtcacg

SEQ ID NO: 254170 - DNA, 20 bp, Artificial Sequence
  Description of Artificial Sequence: Synthetic oligonucleotide
  Target: ATXN1; (+) strand; PAM type: YTN; PAM sequence: TTA
acactccttcccggtcacgt

SEQ ID NO: 254171 - DNA, 20 bp, Artificial Sequence
  Description of Artificial Sequence: Synthetic oligonucleotide
  Target: ATXN1; (+) strand; PAM type: YTN; PAM sequence: CTC
cttcccggtcacgtgcatca

SEQ ID NO: 254172 - DNA, 20 bp, Artificial Sequence
  Description of Artificial Sequence: Synthetic oligonucleotide
  Target: ATXN1; (+) strand; PAM type: YTN; PAM sequence: CTT
cccggtcacgtgcatcatga

SEQ ID NO: 254173 - DNA, 20 bp, Artificial Sequence
  Description of Artificial Sequence: Synthetic oligonucleotide
  Target: ATXN1; (+) strand; PAM type: YTN; PAM sequence: TTC
ccggtcacgtgcatcatgaa

SEQ ID NO: 254174 - DNA, 20 bp, Artificial Sequence
  Description of Artificial Sequence: Synthetic oligonucleotide
  Target: ATXN1; (+) strand; PAM type: YTN; PAM sequence: CTA
aaatttcaatcttttgttct

SEQ ID NO: 254175 - DNA, 20 bp, Artificial Sequence
  Description of Artificial Sequence: Synthetic oligonucleotide
  Target: ATXN1; (+) strand; PAM type: YTN; PAM sequence: TTT
caatcttttgttctccaccg

SEQ ID NO: 254176 - DNA, 20 bp, Artificial Sequence
  Description of Artificial Sequence: Synthetic oligonucleotide
  Target: ATXN1; (+) strand; PAM type: YTN; PAM sequence: TTC
aatcttttgttctccaccgg

SEQ ID NO: 254177 - DNA, 20 bp, Artificial Sequence
  Description of Artificial Sequence: Synthetic oligonucleotide
  Target: ATXN1; (+) strand; PAM type: YTN; PAM sequence: CTT
ttgttctccaccggccattt

SEQ ID NO: 254178 - DNA, 20 bp, Artificial Sequence
  Description of Artificial Sequence: Synthetic oligonucleotide
  Target: ATXN1; (+) strand; PAM type: YTN; PAM sequence: TTT
tgttctccaccggccatttt

SEQ ID NO: 254179 - DNA, 20 bp, Artificial Sequence
  Description of Artificial Sequence: Synthetic oligonucleotide
  Target: ATXN1; (+) strand; PAM type: YTN; PAM sequence: TTT
gttctccaccggccattttt

SEQ ID NO: 254180 - DNA, 20 bp, Artificial Sequence
  Description of Artificial Sequence: Synthetic oligonucleotide
  Target: ATXN1; (+) strand; PAM type: YTN; PAM sequence: TTG
ttctccaccggccatttttt

SEQ ID NO: 254181 - DNA, 20 bp, Artificial Sequence
  Description of Artificial Sequence: Synthetic oligonucleotide
  Target: ATXN1; (+) strand; PAM type: YTN; PAM sequence: TTC
tccaccggccattttttccc

SEQ ID NO: 254182 - DNA, 20 bp, Artificial Sequence
  Description of Artificial Sequence: Synthetic oligonucleotide
  Target: ATXN1; (+) strand; PAM type: YTN; PAM sequence: CTC
caccggccattttttcccga

SEQ ID NO: 254183 - DNA, 20 bp, Artificial Sequence
  Description of Artificial Sequence: Synthetic oligonucleotide
  Target: ATXN1; (+) strand; PAM type: YTN; PAM sequence: TTT
tttcccgaacccttaaggat

SEQ ID NO: 254184 - DNA, 20 bp, Artificial Sequence
  Description of Artificial Sequence: Synthetic oligonucleotide
  Target: ATXN1; (+) strand; PAM type: YTN; PAM sequence: TTT
ttcccgaacccttaaggata

SEQ ID NO: 254185 - DNA, 20 bp, Artificial Sequence
  Description of Artificial Sequence: Synthetic oligonucleotide
  Target: ATXN1; (+) strand; PAM type: YTN; PAM sequence: TTT
tcccgaacccttaaggatag

SEQ ID NO: 254186 - DNA, 20 bp, Artificial Sequence
  Description of Artificial Sequence: Synthetic oligonucleotide
  Target: ATXN1; (+) strand; PAM type: YTN; PAM sequence: TTT
cccgaacccttaaggataga

SEQ ID NO: 254187 - DNA, 20 bp, Artificial Sequence
  Description of Artificial Sequence: Synthetic oligonucleotide
  Target: ATXN1; (+) strand; PAM type: YTN; PAM sequence: TTC
ccgaacccttaaggatagat

SEQ ID NO: 254188 - DNA, 20 bp, Artificial Sequence
  Description of Artificial Sequence: Synthetic oligonucleotide
  Target: ATXN1; (+) strand; PAM type: YTN; PAM sequence: CTT
aaggatagatagccagaaaa

SEQ ID NO: 254189 - DNA, 20 bp, Artificial Sequence
  Description of Artificial Sequence: Synthetic oligonucleotide
  Target: ATXN1; (+) strand; PAM type: YTN; PAM sequence: TTA
aggatagatagccagaaaaa

SEQ ID NO: 254190 - DNA, 20 bp, Artificial Sequence
  Description of Artificial Sequence: Synthetic oligonucleotide
  Target: ATXN1; (+) strand; PAM type: YTN; PAM sequence: CTC
ttcttgggaatattttctag

SEQ ID NO: 254191 - DNA, 20 bp, Artificial Sequence
  Description of Artificial Sequence: Synthetic oligonucleotide
  Target: ATXN1; (+) strand; PAM type: YTN; PAM sequence: CTT
cttgggaatattttctagaa

SEQ ID NO: 254192 - DNA, 20 bp, Artificial Sequence
  Description of Artificial Sequence: Synthetic oligonucleotide
  Target: ATXN1; (+) strand; PAM type: YTN; PAM sequence: TTC
ttgggaatattttctagaat

SEQ ID NO: 254193 - DNA, 20 bp, Artificial Sequence
  Description of Artificial Sequence: Synthetic oligonucleotide
  Target: ATXN1; (+) strand; PAM type: YTN; PAM sequence: CTT
gggaatattttctagaatgt

SEQ ID NO: 254194 - DNA, 20 bp, Artificial Sequence
  Description of Artificial Sequence: Synthetic oligonucleotide
  Target: ATXN1; (+) strand; PAM type: YTN; PAM sequence: TTG
ggaatattttctagaatgtt

SEQ ID NO: 254195 - DNA, 20 bp, Artificial Sequence
  Description of Artificial Sequence: Synthetic oligonucleotide
  Target: ATXN1; (+) strand; PAM type: YTN; PAM sequence: TTT
tctagaatgttttcatttta

SEQ ID NO: 254196 - DNA, 20 bp, Artificial Sequence
  Description of Artificial Sequence: Synthetic oligonucleotide
  Target: ATXN1; (+) strand; PAM type: YTN; PAM sequence: TTT
ctagaatgttttcattttaa

SEQ ID NO: 254197 - DNA, 20 bp, Artificial Sequence
  Description of Artificial Sequence: Synthetic oligonucleotide
  Target: ATXN1; (+) strand; PAM type: YTN; PAM sequence: TTC
tagaatgttttcattttaaa

SEQ ID NO: 254198 - DNA, 20 bp, Artificial Sequence
  Description of Artificial Sequence: Synthetic oligonucleotide
  Target: ATXN1; (+) strand; PAM type: YTN; PAM sequence: CTA
gaatgttttcattttaaaat

SEQ ID NO: 254199 - DNA, 20 bp, Artificial Sequence
  Description of Artificial Sequence: Synthetic oligonucleotide
  Target: ATXN1; (+) strand; PAM type: YTN; PAM sequence: TTT
tcattttaaaatttaatttc

SEQ ID NO: 254200 - DNA, 20 bp, Artificial Sequence
  Description of Artificial Sequence: Synthetic oligonucleotide
  Target: ATXN1; (+) strand; PAM type: YTN; PAM sequence: TTT
cattttaaaatttaatttca

SEQ ID NO: 254201 - DNA, 20 bp, Artificial Sequence
  Description of Artificial Sequence: Synthetic oligonucleotide
  Target: ATXN1; (+) strand; PAM type: YTN; PAM sequence: TTC
attttaaaatttaatttcat

SEQ ID NO: 254202 - DNA, 20 bp, Artificial Sequence
  Description of Artificial Sequence: Synthetic oligonucleotide
  Target: ATXN1; (+) strand; PAM type: YTN; PAM sequence: TTT
taaaatttaatttcatttta

SEQ ID NO: 254203 - DNA, 20 bp, Artificial Sequence
  Description of Artificial Sequence: Synthetic oligonucleotide
  Target: ATXN1; (+) strand; PAM type: YTN; PAM sequence: TTT
aaaatttaatttcattttat

SEQ ID NO: 254204 - DNA, 20 bp, Artificial Sequence
  Description of Artificial Sequence: Synthetic oligonucleotide
  Target: ATXN1; (+) strand; PAM type: YTN; PAM sequence: TTA
aaatttaatttcattttatt

SEQ ID NO: 254205 - DNA, 20 bp, Artificial Sequence
  Description of Artificial Sequence: Synthetic oligonucleotide
  Target: ATXN1; (+) strand; PAM type: YTN; PAM sequence: TTT
aatttcattttattccattg

SEQ ID NO: 254206 - DNA, 20 bp, Artificial Sequence
  Description of Artificial Sequence: Synthetic oligonucleotide
  Target: ATXN1; (+) strand; PAM type: YTN; PAM sequence: TTA
atttcattttattccattgt

SEQ ID NO: 254207 - DNA, 20 bp, Artificial Sequence
  Description of Artificial Sequence: Synthetic oligonucleotide
  Target: ATXN1; (+) strand; PAM type: YTN; PAM sequence: TTT
cattttattccattgttaat

SEQ ID NO: 254208 - DNA, 20 bp, Artificial Sequence
  Description of Artificial Sequence: Synthetic oligonucleotide
  Target: ATXN1; (+) strand; PAM type: YTN; PAM sequence: TTC
attttattccattgttaatt

SEQ ID NO: 254209 - DNA, 20 bp, Artificial Sequence
  Description of Artificial Sequence: Synthetic oligonucleotide
  Target: ATXN1; (+) strand; PAM type: YTN; PAM sequence: TTT
tattccattgttaattgaca

SEQ ID NO: 254210 - DNA, 20 bp, Artificial Sequence
  Description of Artificial Sequence: Synthetic oligonucleotide
  Target: ATXN1; (+) strand; PAM type: YTN; PAM sequence: TTT
attccattgttaattgacat

SEQ ID NO: 254211 - DNA, 20 bp, Artificial Sequence
  Description of Artificial Sequence: Synthetic oligonucleotide
  Target: ATXN1; (+) strand; PAM type: YTN; PAM sequence: TTA
ttccattgttaattgacatc

SEQ ID NO: 254212 - DNA, 20 bp, Artificial Sequence
  Description of Artificial Sequence: Synthetic oligonucleotide
  Target: ATXN1; (+) strand; PAM type: YTN; PAM sequence: TTC
cattgttaattgacatctga

SEQ ID NO: 254213 - DNA, 20 bp, Artificial Sequence
  Description of Artificial Sequence: Synthetic oligonucleotide
  Target: ATXN1; (+) strand; PAM type: YTN; PAM sequence: TTG
ttaattgacatctgataatt

SEQ ID NO: 254214 - DNA, 20 bp, Artificial Sequence
  Description of Artificial Sequence: Synthetic oligonucleotide
  Target: ATXN1; (+) strand; PAM type: YTN; PAM sequence: TTA
attgacatctgataatttct

SEQ ID NO: 254215 - DNA, 20 bp, Artificial Sequence
  Description of Artificial Sequence: Synthetic oligonucleotide
  Target: ATXN1; (+) strand; PAM type: YTN; PAM sequence: TTG
acatctgataatttcttata

SEQ ID NO: 254216 - DNA, 20 bp, Artificial Sequence
  Description of Artificial Sequence: Synthetic oligonucleotide
  Target: ATXN1; (+) strand; PAM type: YTN; PAM sequence: CTG
ataatttcttatatttatgg

SEQ ID NO: 254217 - DNA, 20 bp, Artificial Sequence
  Description of Artificial Sequence: Synthetic oligonucleotide
  Target: ATXN1; (+) strand; PAM type: YTN; PAM sequence: TTT
cttatatttatgggctagag

SEQ ID NO: 254218 - DNA, 20 bp, Artificial Sequence
  Description of Artificial Sequence: Synthetic oligonucleotide
  Target: ATXN1; (+) strand; PAM type: YTN; PAM sequence: TTC
ttatatttatgggctagagt

SEQ ID NO: 254219 - DNA, 20 bp, Artificial Sequence
  Description of Artificial Sequence: Synthetic oligonucleotide
  Target: ATXN1; (+) strand; PAM type: YTN; PAM sequence: CTT
atatttatgggctagagtat

SEQ ID NO: 254220 - DNA, 20 bp, Artificial Sequence
  Description of Artificial Sequence: Synthetic oligonucleotide
  Target: ATXN1; (+) strand; PAM type: YTN; PAM sequence: TTA
tatttatgggctagagtatg

SEQ ID NO: 254221 - DNA, 20 bp, Artificial Sequence
  Description of Artificial Sequence: Synthetic oligonucleotide
  Target: ATXN1; (+) strand; PAM type: YTN; PAM sequence: TTT
atgggctagagtatgatgtt

SEQ ID NO: 254222 - DNA, 20 bp, Artificial Sequence
  Description of Artificial Sequence: Synthetic oligonucleotide
  Target: ATXN1; (+) strand; PAM type: YTN; PAM sequence: TTA
tgggctagagtatgatgttt

SEQ ID NO: 254223 - DNA, 20 bp, Artificial Sequence
  Description of Artificial Sequence: Synthetic oligonucleotide
  Target: ATXN1; (+) strand; PAM type: YTN; PAM sequence: CTA
gagtatgatgtttcaataca

SEQ ID NO: 254224 - DNA, 20 bp, Artificial Sequence
  Description of Artificial Sequence: Synthetic oligonucleotide
  Target: ATXN1; (+) strand; PAM type: YTN; PAM sequence: TTT
caatacatgtatatattgtg

SEQ ID NO: 254225 - DNA, 20 bp, Artificial Sequence
  Description of Artificial Sequence: Synthetic oligonucleotide
  Target: ATXN1; (+) strand; PAM type: YTN; PAM sequence: TTC
aatacatgtatatattgtgt

SEQ ID NO: 254226 - DNA, 20 bp, Artificial Sequence
  Description of Artificial Sequence: Synthetic oligonucleotide
  Target: ATXN1; (+) strand; PAM type: YTN; PAM sequence: TTG
tgtaatgatcaattcacggt

SEQ ID NO: 254227 - DNA, 20 bp, Artificial Sequence
  Description of Artificial Sequence: Synthetic oligonucleotide
  Target: ATXN1; (+) strand; PAM type: YTN; PAM sequence: TTC
acggtaattagcatattttt

SEQ ID NO: 254228 - DNA, 20 bp, Artificial Sequence
  Description of Artificial Sequence: Synthetic oligonucleotide
  Target: ATXN1; (+) strand; PAM type: YTN; PAM sequence: TTA
gcatatttttcacttcaaac

SEQ ID NO: 254229 - DNA, 20 bp, Artificial Sequence
  Description of Artificial Sequence: Synthetic oligonucleotide
  Target: ATXN1; (+) strand; PAM type: YTN; PAM sequence: TTT
ttcacttcaaacctttatca

SEQ ID NO: 254230 - DNA, 20 bp, Artificial Sequence
  Description of Artificial Sequence: Synthetic oligonucleotide
  Target: ATXN1; (+) strand; PAM type: YTN; PAM sequence: TTT
tcacttcaaacctttatcag

SEQ ID NO: 254231 - DNA, 20 bp, Artificial Sequence
  Description of Artificial Sequence: Synthetic oligonucleotide
  Target: ATXN1; (+) strand; PAM type: YTN; PAM sequence: TTT
cacttcaaacctttatcagt

SEQ ID NO: 254232 - DNA, 20 bp, Artificial Sequence
  Description of Artificial Sequence: Synthetic oligonucleotide
  Target: ATXN1; (+) strand; PAM type: YTN; PAM sequence: TTC
acttcaaacctttatcagtt

SEQ ID NO: 254233 - DNA, 20 bp, Artificial Sequence
  Description of Artificial Sequence: Synthetic oligonucleotide
  Target: ATXN1; (+) strand; PAM type: YTN; PAM sequence: CTT
caaacctttatcagttcttt

SEQ ID NO: 254234 - DNA, 20 bp, Artificial Sequence
  Description of Artificial Sequence: Synthetic oligonucleotide
  Target: ATXN1; (+) strand; PAM type: YTN; PAM sequence: TTC
aaacctttatcagttctttg

SEQ ID NO: 254235 - DNA, 20 bp, Artificial Sequence
  Description of Artificial Sequence: Synthetic oligonucleotide
  Target: ATXN1; (+) strand; PAM type: YTN; PAM sequence: CTT
tatcagttctttgttatgag

SEQ ID NO: 254236 - DNA, 20 bp, Artificial Sequence
  Description of Artificial Sequence: Synthetic oligonucleotide
  Target: ATXN1; (+) strand; PAM type: YTN; PAM sequence: TTT
atcagttctttgttatgaga

SEQ ID NO: 254237 - DNA, 20 bp, Artificial Sequence
  Description of Artificial Sequence: Synthetic oligonucleotide
  Target: ATXN1; (+) strand; PAM type: YTN; PAM sequence: TTA
tcagttctttgttatgagaa

SEQ ID NO: 254238 - DNA, 20 bp, Artificial Sequence
  Description of Artificial Sequence: Synthetic oligonucleotide
  Target: ATXN1; (+) strand; PAM type: YTN; PAM sequence: TTC
tttgttatgagaacattcaa

SEQ ID NO: 254239 - DNA, 20 bp, Artificial Sequence
  Description of Artificial Sequence: Synthetic oligonucleotide
  Target: ATXN1; (+) strand; PAM type: YTN; PAM sequence: CTT
tgttatgagaacattcaaat

SEQ ID NO: 254240 - DNA, 20 bp, Artificial Sequence
  Description of Artificial Sequence: Synthetic oligonucleotide
  Target: ATXN1; (+) strand; PAM type: YTN; PAM sequence: TTT
gttatgagaacattcaaatt

SEQ ID NO: 254241 - DNA, 20 bp, Artificial Sequence
  Description of Artificial Sequence: Synthetic oligonucleotide
  Target: ATXN1; (+) strand; PAM type: YTN; PAM sequence: TTG
ttatgagaacattcaaattc

SEQ ID NO: 254242 - DNA, 20 bp, Artificial Sequence
  Description of Artificial Sequence: Synthetic oligonucleotide
  Target: ATXN1; (+) strand; PAM type: YTN; PAM sequence: TTA
tgagaacattcaaattcctc

SEQ ID NO: 254243 - DNA, 20 bp, Artificial Sequence
  Description of Artificial Sequence: Synthetic oligonucleotide
  Target: ATXN1; (+) strand; PAM type: YTN; PAM sequence: TTC
aaattcctcttgtctagttt

SEQ ID NO: 254244 - DNA, 20 bp, Artificial Sequence
  Description of Artificial Sequence: Synthetic oligonucleotide
  Target: ATXN1; (+) strand; PAM type: YTN; PAM sequence: TTC
ctcttgtctagttttctgca

SEQ ID NO: 254245 - DNA, 20 bp, Artificial Sequence
  Description of Artificial Sequence: Synthetic oligonucleotide
  Target: ATXN1; (+) strand; PAM type: YTN; PAM sequence: CTC
ttgtctagttttctgcagtc

SEQ ID NO: 254246 - DNA, 20 bp, Artificial Sequence
  Description of Artificial Sequence: Synthetic oligonucleotide
  Target: ATXN1; (+) strand; PAM type: YTN; PAM sequence: CTT
gtctagttttctgcagtctt

SEQ ID NO: 254247 - DNA, 20 bp, Artificial Sequence
  Description of Artificial Sequence: Synthetic oligonucleotide
  Target: ATXN1; (+) strand; PAM type: YTN; PAM sequence: TTG
tctagttttctgcagtcttc

SEQ ID NO: 254248 - DNA, 20 bp, Artificial Sequence
  Description of Artificial Sequence: Synthetic oligonucleotide
  Target: ATXN1; (+) strand; PAM type: YTN; PAM sequence: CTA
gttttctgcagtcttctctt

SEQ ID NO: 254249 - DNA, 20 bp, Artificial Sequence
  Description of Artificial Sequence: Synthetic oligonucleotide
  Target: ATXN1; (+) strand; PAM type: YTN; PAM sequence: TTT
tctgcagtcttctcttaagg

SEQ ID NO: 254250 - DNA, 20 bp, Artificial Sequence
  Description of Artificial Sequence: Synthetic oligonucleotide
  Target: ATXN1; (+) strand; PAM type: YTN; PAM sequence: TTT
ctgcagtcttctcttaagga

SEQ ID NO: 254251 - DNA, 20 bp, Artificial Sequence
  Description of Artificial Sequence: Synthetic oligonucleotide
  Target: ATXN1; (+) strand; PAM type: YTN; PAM sequence: TTC
tgcagtcttctcttaaggac

SEQ ID NO: 254252 - DNA, 20 bp, Artificial Sequence
  Description of Artificial Sequence: Synthetic oligonucleotide
  Target: ATXN1; (+) strand; PAM type: YTN; PAM sequence: CTG
cagtcttctcttaaggacca

SEQ ID NO: 254253 - DNA, 20 bp, Artificial Sequence
  Description of Artificial Sequence: Synthetic oligonucleotide
  Target: ATXN1; (+) strand; PAM type: YTN; PAM sequence: CTT
ctcttaaggaccaaagaaga

SEQ ID NO: 254254 - DNA, 20 bp, Artificial Sequence
  Description of Artificial Sequence: Synthetic oligonucleotide
  Target: ATXN1; (+) strand; PAM type: YTN; PAM sequence: TTC
tcttaaggaccaaagaagaa

SEQ ID NO: 254255 - DNA, 20 bp, Artificial Sequence
  Description of Artificial Sequence: Synthetic oligonucleotide
  Target: ATXN1; (+) strand; PAM type: YTN; PAM sequence: CTC
ttaaggaccaaagaagaaaa

SEQ ID NO: 254256 - DNA, 20 bp, Artificial Sequence
  Description of Artificial Sequence: Synthetic oligonucleotide
  Target: ATXN1; (+) strand; PAM type: YTN; PAM sequence: CTT
aaggaccaaagaagaaaata

SEQ ID NO: 254257 - DNA, 20 bp, Artificial Sequence
  Description of Artificial Sequence: Synthetic oligonucleotide
  Target: ATXN1; (+) strand; PAM type: YTN; PAM sequence: TTA
aggaccaaagaagaaaataa

SEQ ID NO: 254258 - DNA, 20 bp, Artificial Sequence
  Description of Artificial Sequence: Synthetic oligonucleotide
  Target: ATXN1; (+) strand; PAM type: YTN; PAM sequence: CTA
taaaattcagctctgtttaa

SEQ ID NO: 254259 - DNA, 20 bp, Artificial Sequence
  Description of Artificial Sequence: Synthetic oligonucleotide
  Target: ATXN1; (+) strand; PAM type: YTN; PAM sequence: TTC
agctctgtttaagtcctatc

SEQ ID NO: 254260 - DNA, 20 bp, Artificial Sequence
  Description of Artificial Sequence: Synthetic oligonucleotide
  Target: ATXN1; (+) strand; PAM type: YTN; PAM sequence: CTC
tgtttaagtcctatctttta

SEQ ID NO: 254261 - DNA, 20 bp, Artificial Sequence
  Description of Artificial Sequence: Synthetic oligonucleotide
  Target: ATXN1; (+) strand; PAM type: YTN; PAM sequence: CTG
tttaagtcctatcttttaag

SEQ ID NO: 254262 - DNA, 20 bp, Artificial Sequence
  Description of Artificial Sequence: Synthetic oligonucleotide
  Target: ATXN1; (+) strand; PAM type: YTN; PAM sequence: TTT
aagtcctatcttttaagtaa

SEQ ID NO: 254263 - DNA, 20 bp, Artificial Sequence
  Description of Artificial Sequence: Synthetic oligonucleotide
  Target: ATXN1; (+) strand; PAM type: YTN; PAM sequence: TTA
agtcctatcttttaagtaac

SEQ ID NO: 254264 - DNA, 20 bp, Artificial Sequence
  Description of Artificial Sequence: Synthetic oligonucleotide
  Target: ATXN1; (+) strand; PAM type: YTN; PAM sequence: CTA
tcttttaagtaactaaaaag

SEQ ID NO: 254265 - DNA, 20 bp, Artificial Sequence
  Description of Artificial Sequence: Synthetic oligonucleotide
  Target: ATXN1; (+) strand; PAM type: YTN; PAM sequence: CTT
ttaagtaactaaaaagttga

SEQ ID NO: 254266 - DNA, 20 bp, Artificial Sequence
  Description of Artificial Sequence: Synthetic oligonucleotide
  Target: ATXN1; (+) strand; PAM type: YTN; PAM sequence: TTT
taagtaactaaaaagttgaa

SEQ ID NO: 254267 - DNA, 20 bp, Artificial Sequence
  Description of Artificial Sequence: Synthetic oligonucleotide
  Target: ATXN1; (+) strand; PAM type: YTN; PAM sequence: TTT
aagtaactaaaaagttgaat

SEQ ID NO: 254268 - DNA, 20 bp, Artificial Sequence
  Description of Artificial Sequence: Synthetic oligonucleotide
  Target: ATXN1; (+) strand; PAM type: YTN; PAM sequence: TTA
agtaactaaaaagttgaata

SEQ ID NO: 254269 - DNA, 20 bp, Artificial Sequence
  Description of Artificial Sequence: Synthetic oligonucleotide
  Target: ATXN1; (+) strand; PAM type: YTN; PAM sequence: CTA
aaaagttgaatactagctcc

SEQ ID NO: 254270 - DNA, 20 bp, Artificial Sequence
  Description of Artificial Sequence: Synthetic oligonucleotide
  Target: ATXN1; (+) strand; PAM type: YTN; PAM sequence: TTG
aatactagctccaataacta

SEQ ID NO: 254271 - DNA, 20 bp, Artificial Sequence
  Description of Artificial Sequence: Synthetic oligonucleotide
  Target: ATXN1; (+) strand; PAM type: YTN; PAM sequence: CTA
gctccaataactagatccat

SEQ ID NO: 254272 - DNA, 20 bp, Artificial Sequence
  Description of Artificial Sequence: Synthetic oligonucleotide
  Target: ATXN1; (+) strand; PAM type: YTN; PAM sequence: CTC
caataactagatccataaac

SEQ ID NO: 254273 - DNA, 20 bp, Artificial Sequence
  Description of Artificial Sequence: Synthetic oligonucleotide
  Target: ATXN1; (+) strand; PAM type: YTN; PAM sequence: CTA
gatccataaaccatttttca

SEQ ID NO: 254274 - DNA, 20 bp, Artificial Sequence
  Description of Artificial Sequence: Synthetic oligonucleotide
  Target: ATXN1; (+) strand; PAM type: YTN; PAM sequence: TTT
ttcaatactaattttcttag

SEQ ID NO: 254275 - DNA, 20 bp, Artificial Sequence
  Description of Artificial Sequence: Synthetic oligonucleotide
  Target: ATXN1; (+) strand; PAM type: YTN; PAM sequence: TTT
tcaatactaattttcttagc

SEQ ID NO: 254276 - DNA, 20 bp, Artificial Sequence
  Description of Artificial Sequence: Synthetic oligonucleotide
  Target: ATXN1; (+) strand; PAM type: YTN; PAM sequence: TTT
caatactaattttcttagcc

SEQ ID NO: 254277 - DNA, 20 bp, Artificial Sequence
  Description of Artificial Sequence: Synthetic oligonucleotide
  Target: ATXN1; (+) strand; PAM type: YTN; PAM sequence: TTC
aatactaattttcttagcca

SEQ ID NO: 254278 - DNA, 20 bp, Artificial Sequence
  Description of Artificial Sequence: Synthetic oligonucleotide
  Target: ATXN1; (+) strand; PAM type: YTN; PAM sequence: CTA
attttcttagccaaagagat

SEQ ID NO: 254279 - DNA, 20 bp, Artificial Sequence
  Description of Artificial Sequence: Synthetic oligonucleotide
  Target: ATXN1; (+) strand; PAM type: YTN; PAM sequence: TTT
tcttagccaaagagatatgc

SEQ ID NO: 254280 - DNA, 20 bp, Artificial Sequence
  Description of Artificial Sequence: Synthetic oligonucleotide
  Target: ATXN1; (+) strand; PAM type: YTN; PAM sequence: TTT
cttagccaaagagatatgca

SEQ ID NO: 254281 - DNA, 20 bp, Artificial Sequence
  Description of Artificial Sequence: Synthetic oligonucleotide
  Target: ATXN1; (+) strand; PAM type: YTN; PAM sequence: TTC
ttagccaaagagatatgcag

SEQ ID NO: 254282 - DNA, 20 bp, Artificial Sequence
  Description of Artificial Sequence: Synthetic oligonucleotide
  Target: ATXN1; (+) strand; PAM type: YTN; PAM sequence: CTT
agccaaagagatatgcagta

SEQ ID NO: 254283 - DNA, 20 bp, Artificial Sequence
  Description of Artificial Sequence: Synthetic oligonucleotide
  Target: ATXN1; (+) strand; PAM type: YTN; PAM sequence: TTA
gccaaagagatatgcagtag

SEQ ID NO: 254284 - DNA, 20 bp, Artificial Sequence
  Description of Artificial Sequence: Synthetic oligonucleotide
  Target: ATXN1; (+) strand; PAM type: YTN; PAM sequence: TTT
atgactgcattttccacgct

SEQ ID NO: 254285 - DNA, 20 bp, Artificial Sequence
  Description of Artificial Sequence: Synthetic oligonucleotide
  Target: ATXN1; (+) strand; PAM type: YTN; PAM sequence: TTA
tgactgcattttccacgctg

SEQ ID NO: 254286 - DNA, 20 bp, Artificial Sequence
  Description of Artificial Sequence: Synthetic oligonucleotide
  Target: ATXN1; (+) strand; PAM type: YTN; PAM sequence: CTG
cattttccacgctggctttc

SEQ ID NO: 254287 - DNA, 20 bp, Artificial Sequence
  Description of Artificial Sequence: Synthetic oligonucleotide
  Target: ATXN1; (+) strand; PAM type: YTN; PAM sequence: TTT
tccacgctggctttccagga

SEQ ID NO: 254288 - DNA, 20 bp, Artificial Sequence
  Description of Artificial Sequence: Synthetic oligonucleotide
  Target: ATXN1; (+) strand; PAM type: YTN; PAM sequence: TTT
ccacgctggctttccaggat

SEQ ID NO: 254289 - DNA, 20 bp, Artificial Sequence
  Description of Artificial Sequence: Synthetic oligonucleotide
  Target: ATXN1; (+) strand; PAM type: YTN; PAM sequence: TTC
cacgctggctttccaggatg

SEQ ID NO: 254290 - DNA, 20 bp, Artificial Sequence
  Description of Artificial Sequence: Synthetic oligonucleotide
  Target: ATXN1; (+) strand; PAM type: YTN; PAM sequence: CTG
gctttccaggatggtcctga

SEQ ID NO: 254291 - DNA, 20 bp, Artificial Sequence
  Description of Artificial Sequence: Synthetic oligonucleotide
  Target: ATXN1; (+) strand; PAM type: YTN; PAM sequence: CTT
tccaggatggtcctgaactt

SEQ ID NO: 254292 - DNA, 20 bp, Artificial Sequence
  Description of Artificial Sequence: Synthetic oligonucleotide
  Target: ATXN1; (+) strand; PAM type: YTN; PAM sequence: TTT
ccaggatggtcctgaacttg

SEQ ID NO: 254293 - DNA, 20 bp, Artificial Sequence
  Description of Artificial Sequence: Synthetic oligonucleotide
  Target: ATXN1; (+) strand; PAM type: YTN; PAM sequence: TTC
caggatggtcctgaacttgc

SEQ ID NO: 254294 - DNA, 20 bp, Artificial Sequence
  Description of Artificial Sequence: Synthetic oligonucleotide
  Target: ATXN1; (+) strand; PAM type: YTN; PAM sequence: CTG
aacttgctaattcatggtat

SEQ ID NO: 254295 - DNA, 20 bp, Artificial Sequence
  Description of Artificial Sequence: Synthetic oligonucleotide
  Target: ATXN1; (+) strand; PAM type: YTN; PAM sequence: CTT
gctaattcatggtataactt

SEQ ID NO: 254296 - DNA, 20 bp, Artificial Sequence
  Description of Artificial Sequence: Synthetic oligonucleotide
  Target: ATXN1; (+) strand; PAM type: YTN; PAM sequence: TTG
ctaattcatggtataacttt

SEQ ID NO: 254297 - DNA, 20 bp, Artificial Sequence
  Description of Artificial Sequence: Synthetic oligonucleotide
  Target: ATXN1; (+) strand; PAM type: YTN; PAM sequence: CTA
attcatggtataactttgta

SEQ ID NO: 254298 - DNA, 20 bp, Artificial Sequence
  Description of Artificial Sequence: Synthetic oligonucleotide
  Target: ATXN1; (+) strand; PAM type: YTN; PAM sequence: TTC
atggtataactttgtactgt

SEQ ID NO: 254299 - DNA, 20 bp, Artificial Sequence
  Description of Artificial Sequence: Synthetic oligonucleotide
  Target: ATXN1; (+) strand; PAM type: YTN; PAM sequence: CTT
tgtactgtaacacagccaag

SEQ ID NO: 254300 - DNA, 20 bp, Artificial Sequence
  Description of Artificial Sequence: Synthetic oligonucleotide
  Target: ATXN1; (+) strand; PAM type: YTN; PAM sequence: TTT
gtactgtaacacagccaagg

SEQ ID NO: 254301 - DNA, 20 bp, Artificial Sequence
  Description of Artificial Sequence: Synthetic oligonucleotide
  Target: ATXN1; (+) strand; PAM type: YTN; PAM sequence: TTG
tactgtaacacagccaagga

SEQ ID NO: 254302 - DNA, 20 bp, Artificial Sequence
  Description of Artificial Sequence: Synthetic oligonucleotide
  Target: ATXN1; (+) strand; PAM type: YTN; PAM sequence: CTG
taacacagccaaggagaaac

SEQ ID NO: 254303 - DNA, 20 bp, Artificial Sequence
  Description of Artificial Sequence: Synthetic oligonucleotide
  Target: ATXN1; (+) strand; PAM type: YTN; PAM sequence: TTG
gagccaggtctgtgagagct

SEQ ID NO: 254304 - DNA, 20 bp, Artificial Sequence
  Description of Artificial Sequence: Synthetic oligonucleotide
  Target: ATXN1; (+) strand; PAM type: YTN; PAM sequence: CTG
tgagagctaacagttaagct

SEQ ID NO: 254305 - DNA, 20 bp, Artificial Sequence
  Description of Artificial Sequence: Synthetic oligonucleotide
  Target: ATXN1; (+) strand; PAM type: YTN; PAM sequence: CTA
acagttaagcttgacagcca

SEQ ID NO: 254306 - DNA, 20 bp, Artificial Sequence
  Description of Artificial Sequence: Synthetic oligonucleotide
  Target: ATXN1; (+) strand; PAM type: YTN; PAM sequence: TTA
agcttgacagccaagcgttc

SEQ ID NO: 254307 - DNA, 20 bp, Artificial Sequence
  Description of Artificial Sequence: Synthetic oligonucleotide
  Target: ATXN1; (+) strand; PAM type: YTN; PAM sequence: CTT
gacagccaagcgttcaacat

SEQ ID NO: 254308 - DNA, 20 bp, Artificial Sequence
  Description of Artificial Sequence: Synthetic oligonucleotide
  Target: ATXN1; (+) strand; PAM type: YTN; PAM sequence: TTG
acagccaagcgttcaacata

SEQ ID NO: 254309 - DNA, 20 bp, Artificial Sequence
  Description of Artificial Sequence: Synthetic oligonucleotide
  Target: ATXN1; (+) strand; PAM type: YTN; PAM sequence: TTC
aacatagccaatgttaaaaa

SEQ ID NO: 254310 - DNA, 20 bp, Artificial Sequence
  Description of Artificial Sequence: Synthetic oligonucleotide
  Target: ATXN1; (+) strand; PAM type: YTN; PAM sequence: TTA
aaaattaacttatataaact

SEQ ID NO: 254311 - DNA, 20 bp, Artificial Sequence
  Description of Artificial Sequence: Synthetic oligonucleotide
  Target: ATXN1; (+) strand; PAM type: YTN; PAM sequence: TTA
acttatataaacttatggtt

SEQ ID NO: 254312 - DNA, 20 bp, Artificial Sequence
  Description of Artificial Sequence: Synthetic oligonucleotide
  Target: ATXN1; (+) strand; PAM type: YTN; PAM sequence: CTT
atataaacttatggtttaat

SEQ ID NO: 254313 - DNA, 20 bp, Artificial Sequence
  Description of Artificial Sequence: Synthetic oligonucleotide
  Target: ATXN1; (+) strand; PAM type: YTN; PAM sequence: TTA
tataaacttatggtttaata

SEQ ID NO: 254314 - DNA, 20 bp, Artificial Sequence
  Description of Artificial Sequence: Synthetic oligonucleotide
  Target: ATXN1; (+) strand; PAM type: YTN; PAM sequence: CTT
atggtttaataaattatatt

SEQ ID NO: 254315 - DNA, 20 bp, Artificial Sequence
  Description of Artificial Sequence: Synthetic oligonucleotide
  Target: ATXN1; (+) strand; PAM type: YTN; PAM sequence: TTA
tggtttaataaattatatta

SEQ ID NO: 254316 - DNA, 20 bp, Artificial Sequence
  Description of Artificial Sequence: Synthetic oligonucleotide
  Target: ATXN1; (+) strand; PAM type: YTN; PAM sequence: TTT
aataaattatattaaaaact

SEQ ID NO: 254317 - DNA, 20 bp, Artificial Sequence
  Description of Artificial Sequence: Synthetic oligonucleotide
  Target: ATXN1; (+) strand; PAM type: YTN; PAM sequence: TTA
ataaattatattaaaaactc

SEQ ID NO: 254318 - DNA, 20 bp, Artificial Sequence
  Description of Artificial Sequence: Synthetic oligonucleotide
  Target: ATXN1; (+) strand; PAM type: YTN; PAM sequence: TTA
tattaaaaactcctgaggcg

SEQ ID NO: 254319 - DNA, 20 bp, Artificial Sequence
  Description of Artificial Sequence: Synthetic oligonucleotide
  Target: ATXN1; (+) strand; PAM type: YTN; PAM sequence: TTA
aaaactcctgaggcgaggcg

SEQ ID NO: 254320 - DNA, 20 bp, Artificial Sequence
  Description of Artificial Sequence: Synthetic oligonucleotide
  Target: ATXN1; (+) strand; PAM type: YTN; PAM sequence: CTC
ctgaggcgaggcggatcacc

SEQ ID NO: 254321 - DNA, 20 bp, Artificial Sequence
  Description of Artificial Sequence: Synthetic oligonucleotide
  Target: ATXN1; (+) strand; PAM type: YTN; PAM sequence: CTG
aggcgaggcggatcacccga

SEQ ID NO: 254322 - DNA, 20 bp, Artificial Sequence
  Description of Artificial Sequence: Synthetic oligonucleotide
  Target: ATXN1; (+) strand; PAM type: YTN; PAM sequence: TTC
gagaccagtcggaccaacat

SEQ ID NO: 254323 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaattag

SEQ ID NO: 254324 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaattagct

SEQ ID NO: 254325 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaattagctggg

SEQ ID NO: 254326 - DNA, 20 bp, Artificial Sequence
  Description of Artificial Sequence: Synthetic oligonucleotide
  Target: ATXN1; (+) strand; PAM type: YTN; PAM sequence: TTA
gctgggcatggtggctcatg

SEQ ID NO: 254327 - DNA, 20 bp, Artificial Sequence
  Description of Artificial Sequence: Synthetic oligonucleotide
  Target: ATXN1; (+) strand; PAM type: YTN; PAM sequence: CTG
ggcatggtggctcatgcctg

SEQ ID NO: 254328 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcacactact

SEQ ID NO: 254329 - DNA, 20 bp, Artificial Sequence
  Description of Artificial Sequence: Synthetic oligonucleotide
  Target: ATXN1; (+) strand; PAM type: YTN; PAM sequence: CTG
taatcacactactcaggagg

SEQ ID NO: 254330 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctgaggcagga

SEQ ID NO: 254331 - DNA, 20 bp, Artificial Sequence
  Description of Artificial Sequence: Synthetic oligonucleotide
  Target: ATXN1; (+) strand; PAM type: YTN; PAM sequence: CTC
aggaggctgaggcaggagaa

SEQ ID NO: 254332 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcacttgaa

SEQ ID NO: 254333 - DNA, 20 bp, Artificial Sequence
  Description of Artificial Sequence: Synthetic oligonucleotide
  Target: ATXN1; (+) strand; PAM type: YTN; PAM sequence: CTT
gaacccgggaggtggaggtt

SEQ ID NO: 254334 - DNA, 20 bp, Artificial Sequence
  Description of Artificial Sequence: Synthetic oligonucleotide
  Target: ATXN1; (+) strand; PAM type: YTN; PAM sequence: TTG
aacccgggaggtggaggttg

SEQ ID NO: 254335 - DNA, 20 bp, Artificial Sequence
  Description of Artificial Sequence: Synthetic oligonucleotide
  Target: ATXN1; (+) strand; PAM type: YTN; PAM sequence: TTG
cggtgagccaagattgcgcc

SEQ ID NO: 254336 - DNA, 20 bp, Artificial Sequence
  Description of Artificial Sequence: Synthetic oligonucleotide
  Target: ATXN1; (+) strand; PAM type: YTN; PAM sequence: TTG
cgccattgcattccagcctg

SEQ ID NO: 254337 - DNA, 20 bp, Artificial Sequence
  Description of Artificial Sequence: Synthetic oligonucleotide
  Target: ATXN1; (+) strand; PAM type: YTN; PAM sequence: TTG
cattccagcctggccaacaa

SEQ ID NO: 254338 - DNA, 20 bp, Artificial Sequence
  Description of Artificial Sequence: Synthetic oligonucleotide
  Target: ATXN1; (+) strand; PAM type: YTN; PAM sequence: TTC
cagcctggccaacaagagcg

SEQ ID NO: 254339 - DNA, 20 bp, Artificial Sequence
  Description of Artificial Sequence: Synthetic oligonucleotide
  Target: ATXN1; (+) strand; PAM type: YTN; PAM sequence: CTG
gccaacaagagcgaaactcc

SEQ ID NO: 254340 - DNA, 20 bp, Artificial Sequence
  Description of Artificial Sequence: Synthetic oligonucleotide
  Target: ATXN1; (+) strand; PAM type: YTN; PAM sequence: CTC
cgtctcaaaaaaaaaaaaaa

SEQ ID NO: 254341 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaaaaa

SEQ ID NO: 254342 - DNA, 20 bp, Artificial Sequence
  Description of Artificial Sequence: Synthetic oligonucleotide
  Target: ATXN1; (+) strand; PAM type: YTN; PAM sequence: CTC
atcatcatccctcattttac

SEQ ID NO: 254343 - DNA, 20 bp, Artificial Sequence
  Description of Artificial Sequence: Synthetic oligonucleotide
  Target: ATXN1; (+) strand; PAM type: YTN; PAM sequence: CTC
attttactctattttactat

SEQ ID NO: 254344 - DNA, 20 bp, Artificial Sequence
  Description of Artificial Sequence: Synthetic oligonucleotide
  Target: ATXN1; (+) strand; PAM type: YTN; PAM sequence: TTT
tactctattttactattatc

SEQ ID NO: 254345 - DNA, 20 bp, Artificial Sequence
  Description of Artificial Sequence: Synthetic oligonucleotide
  Target: ATXN1; (+) strand; PAM type: YTN; PAM sequence: TTT
actctattttactattatct

SEQ ID NO: 254346 - DNA, 20 bp, Artificial Sequence
  Description of Artificial Sequence: Synthetic oligonucleotide
  Target: ATXN1; (+) strand; PAM type: YTN; PAM sequence: TTA
ctctattttactattatctg

SEQ ID NO: 254347 - DNA, 20 bp, Artificial Sequence
  Description of Artificial Sequence: Synthetic oligonucleotide
  Target: ATXN1; (+) strand; PAM type: YTN; PAM sequence: CTC
tattttactattatctgtat

SEQ ID NO: 254348 - DNA, 20 bp, Artificial Sequence
  Description of Artificial Sequence: Synthetic oligonucleotide
  Target: ATXN1; (+) strand; PAM type: YTN; PAM sequence: CTA
ttttactattatctgtatga

SEQ ID NO: 254349 - DNA, 20 bp, Artificial Sequence
  Description of Artificial Sequence: Synthetic oligonucleotide
  Target: ATXN1; (+) strand; PAM type: YTN; PAM sequence: TTT
tactattatctgtatgactg

SEQ ID NO: 254350 - DNA, 20 bp, Artificial Sequence
  Description of Artificial Sequence: Synthetic oligonucleotide
  Target: ATXN1; (+) strand; PAM type: YTN; PAM sequence: TTT
actattatctgtatgactga

SEQ ID NO: 254351 - DNA, 20 bp, Artificial Sequence
  Description of Artificial Sequence: Synthetic oligonucleotide
  Target: ATXN1; (+) strand; PAM type: YTN; PAM sequence: TTA
ctattatctgtatgactgag

SEQ ID NO: 254352 - DNA, 20 bp, Artificial Sequence
  Description of Artificial Sequence: Synthetic oligonucleotide
  Target: ATXN1; (+) strand; PAM type: YTN; PAM sequence: CTA
ttatctgtatgactgaggtt

SEQ ID NO: 254353 - DNA, 20 bp, Artificial Sequence
  Description of Artificial Sequence: Synthetic oligonucleotide
  Target: ATXN1; (+) strand; PAM type: YTN; PAM sequence: TTA
tctgtatgactgaggttaat

SEQ ID NO: 254354 - DNA, 20 bp, Artificial Sequence
  Description of Artificial Sequence: Synthetic oligonucleotide
  Target: ATXN1; (+) strand; PAM type: YTN; PAM sequence: CTG
tatgactgaggttaattaca

SEQ ID NO: 254355 - DNA, 20 bp, Artificial Sequence
  Description of Artificial Sequence: Synthetic oligonucleotide
  Target: ATXN1; (+) strand; PAM type: YTN; PAM sequence: CTG
aggttaattacatctacttg

SEQ ID NO: 254356 - DNA, 20 bp, Artificial Sequence
  Description of Artificial Sequence: Synthetic oligonucleotide
  Target: ATXN1; (+) strand; PAM type: YTN; PAM sequence: TTA
attacatctacttgtatagt

SEQ ID NO: 254357 - DNA, 20 bp, Artificial Sequence
  Description of Artificial Sequence: Synthetic oligonucleotide
  Target: ATXN1; (+) strand; PAM type: YTN; PAM sequence: TTA
catctacttgtatagtggat

SEQ ID NO: 254358 - DNA, 20 bp, Artificial Sequence
  Description of Artificial Sequence: Synthetic oligonucleotide
  Target: ATXN1; (+) strand; PAM type: YTN; PAM sequence: CTA
cttgtatagtggatataaag

SEQ ID NO: 254359 - DNA, 20 bp, Artificial Sequence
  Description of Artificial Sequence: Synthetic oligonucleotide
  Target: ATXN1; (+) strand; PAM type: YTN; PAM sequence: CTT
gtatagtggatataaagtca

SEQ ID NO: 254360 - DNA, 20 bp, Artificial Sequence
  Description of Artificial Sequence: Synthetic oligonucleotide
  Target: ATXN1; (+) strand; PAM type: YTN; PAM sequence: TTG
tatagtggatataaagtcat

SEQ ID NO: 254361 - DNA, 20 bp, Artificial Sequence
  Description of Artificial Sequence: Synthetic oligonucleotide
  Target: ATXN1; (+) strand; PAM type: YTN; PAM sequence: TTT
gggtcagccgcggattgcat

SEQ ID NO: 254362 - DNA, 20 bp, Artificial Sequence
  Description of Artificial Sequence: Synthetic oligonucleotide
  Target: ATXN1; (+) strand; PAM type: YTN; PAM sequence: TTG
ggtcagccgcggattgcata

SEQ ID NO: 254363 - DNA, 20 bp, Artificial Sequence
  Description of Artificial Sequence: Synthetic oligonucleotide
  Target: ATXN1; (+) strand; PAM type: YTN; PAM sequence: TTG
catatgtgacagcggtcaca

SEQ ID NO: 254364 - DNA, 20 bp, Artificial Sequence
  Description of Artificial Sequence: Synthetic oligonucleotide
  Target: ATXN1; (+) strand; PAM type: YTN; PAM sequence: TTA
taatggagctgaaaattttc

SEQ ID NO: 254365 - DNA, 20 bp, Artificial Sequence
  Description of Artificial Sequence: Synthetic oligonucleotide
  Target: ATXN1; (+) strand; PAM type: YTN; PAM sequence: CTG
aaaattttctactgcctact

SEQ ID NO: 254366 - DNA, 20 bp, Artificial Sequence
  Description of Artificial Sequence: Synthetic oligonucleotide
  Target: ATXN1; (+) strand; PAM type: YTN; PAM sequence: TTT
tctactgcctactgatgctg

SEQ ID NO: 254367 - DNA, 20 bp, Artificial Sequence
  Description of Artificial Sequence: Synthetic oligonucleotide
  Target: ATXN1; (+) strand; PAM type: YTN; PAM sequence: TTT
ctactgcctactgatgctgt

SEQ ID NO: 254368 - DNA, 20 bp, Artificial Sequence
  Description of Artificial Sequence: Synthetic oligonucleotide
  Target: ATXN1; (+) strand; PAM type: YTN; PAM sequence: TTC
tactgcctactgatgctgta

SEQ ID NO: 254369 - DNA, 20 bp, Artificial Sequence
  Description of Artificial Sequence: Synthetic oligonucleotide
  Target: ATXN1; (+) strand; PAM type: YTN; PAM sequence: CTA
ctgcctactgatgctgtagc

SEQ ID NO: 254370 - DNA, 20 bp, Artificial Sequence
  Description of Artificial Sequence: Synthetic oligonucleotide
  Target: ATXN1; (+) strand; PAM type: YTN; PAM sequence: CTG
cctactgatgctgtagctgt

SEQ ID NO: 254371 - DNA, 20 bp, Artificial Sequence
  Description of Artificial Sequence: Synthetic oligonucleotide
  Target: ATXN1; (+) strand; PAM type: YTN; PAM sequence: CTA
ctgatgctgtagctgtccaa

SEQ ID NO: 254372 - DNA, 20 bp, Artificial Sequence
  Description of Artificial Sequence: Synthetic oligonucleotide
  Target: ATXN1; (+) strand; PAM type: YTN; PAM sequence: CTG
atgctgtagctgtccaatgt

SEQ ID NO: 254373 - DNA, 20 bp, Artificial Sequence
  Description of Artificial Sequence: Synthetic oligonucleotide
  Target: ATXN1; (+) strand; PAM type: YTN; PAM sequence: CTG
tagctgtccaatgtaatagt

SEQ ID NO: 254374 - DNA, 20 bp, Artificial Sequence
  Description of Artificial Sequence: Synthetic oligonucleotide
  Target: ATXN1; (+) strand; PAM type: YTN; PAM sequence: CTG
tccaatgtaatagtgtaata

SEQ ID NO: 254375 - DNA, 20 bp, Artificial Sequence
  Description of Artificial Sequence: Synthetic oligonucleotide
  Target: ATXN1; (+) strand; PAM type: YTN; PAM sequence: TTA
ctcatatgtttgtggtgatg

SEQ ID NO: 254376 - DNA, 20 bp, Artificial Sequence
  Description of Artificial Sequence: Synthetic oligonucleotide
  Target: ATXN1; (+) strand; PAM type: YTN; PAM sequence: CTC
atatgtttgtggtgatgctg

SEQ ID NO: 254377 - DNA, 20 bp, Artificial Sequence
  Description of Artificial Sequence: Synthetic oligonucleotide
  Target: ATXN1; (+) strand; PAM type: YTN; PAM sequence: TTT
gtggtgatgctggtatatat

SEQ ID NO: 254378 - DNA, 20 bp, Artificial Sequence
  Description of Artificial Sequence: Synthetic oligonucleotide
  Target: ATXN1; (+) strand; PAM type: YTN; PAM sequence: TTG
tggtgatgctggtatatata

SEQ ID NO: 254379 - DNA, 20 bp, Artificial Sequence
  Description of Artificial Sequence: Synthetic oligonucleotide
  Target: ATXN1; (+) strand; PAM type: YTN; PAM sequence: CTG
gtatatataaacgtcctgca

SEQ ID NO: 254380 - DNA, 20 bp, Artificial Sequence
  Description of Artificial Sequence: Synthetic oligonucleotide
  Target: ATXN1; (+) strand; PAM type: YTN; PAM sequence: CTG
cagtgccagtcctataaaag

SEQ ID NO: 254381 - DNA, 20 bp, Artificial Sequence
  Description of Artificial Sequence: Synthetic oligonucleotide
  Target: ATXN1; (+) strand; PAM type: YTN; PAM sequence: CTA
taaaagtatagcacatgcaa

SEQ ID NO: 254382 - DNA, 20 bp, Artificial Sequence
  Description of Artificial Sequence: Synthetic oligonucleotide
  Target: ATXN1; (+) strand; PAM type: YTN; PAM sequence: TTA
cgcacagtacataatagttg

SEQ ID NO: 254383 - DNA, 20 bp, Artificial Sequence
  Description of Artificial Sequence: Synthetic oligonucleotide
  Target: ATXN1; (+) strand; PAM type: YTN; PAM sequence: TTG
atagtgaaaataaatgacta

SEQ ID NO: 254384 - DNA, 20 bp, Artificial Sequence
  Description of Artificial Sequence: Synthetic oligonucleotide
  Target: ATXN1; (+) strand; PAM type: YTN; PAM sequence: CTA
tgttactggtttgtgtattt

SEQ ID NO: 254385 - DNA, 20 bp, Artificial Sequence
  Description of Artificial Sequence: Synthetic oligonucleotide
  Target: ATXN1; (+) strand; PAM type: YTN; PAM sequence: TTA
ctggtttgtgtatttacgat

SEQ ID NO: 254386 - DNA, 20 bp, Artificial Sequence
  Description of Artificial Sequence: Synthetic oligonucleotide
  Target: ATXN1; (+) strand; PAM type: YTN; PAM sequence: CTG
gtttgtgtatttacgatact

SEQ ID NO: 254387 - DNA, 20 bp, Artificial Sequence
  Description of Artificial Sequence: Synthetic oligonucleotide
  Target: ATXN1; (+) strand; PAM type: YTN; PAM sequence: TTT
gtgtatttacgatactatac

SEQ ID NO: 254388 - DNA, 20 bp, Artificial Sequence
  Description of Artificial Sequence: Synthetic oligonucleotide
  Target: ATXN1; (+) strand; PAM type: YTN; PAM sequence: TTG
tgtatttacgatactatact

SEQ ID NO: 254389 - DNA, 20 bp, Artificial Sequence
  Description of Artificial Sequence: Synthetic oligonucleotide
  Target: ATXN1; (+) strand; PAM type: YTN; PAM sequence: TTT
acgatactatactttttatt

SEQ ID NO: 254390 - DNA, 20 bp, Artificial Sequence
  Description of Artificial Sequence: Synthetic oligonucleotide
  Target: ATXN1; (+) strand; PAM type: YTN; PAM sequence: TTA
cgatactatactttttattg

SEQ ID NO: 254391 - DNA, 20 bp, Artificial Sequence
  Description of Artificial Sequence: Synthetic oligonucleotide
  Target: ATXN1; (+) strand; PAM type: YTN; PAM sequence: CTA
tactttttattgttatttga

SEQ ID NO: 254392 - DNA, 20 bp, Artificial Sequence
  Description of Artificial Sequence: Synthetic oligonucleotide
  Target: ATXN1; (+) strand; PAM type: YTN; PAM sequence: CTT
tttattgttatttgagagtg

SEQ ID NO: 254393 - DNA, 20 bp, Artificial Sequence
  Description of Artificial Sequence: Synthetic oligonucleotide
  Target: ATXN1; (+) strand; PAM type: YTN; PAM sequence: TTT
ttattgttatttgagagtgg

SEQ ID NO: 254394 - DNA, 20 bp, Artificial Sequence
  Description of Artificial Sequence: Synthetic oligonucleotide
  Target: ATXN1; (+) strand; PAM type: YTN; PAM sequence: TTT
tattgttatttgagagtgga

SEQ ID NO: 254395 - DNA, 20 bp, Artificial Sequence
  Description of Artificial Sequence: Synthetic oligonucleotide
  Target: ATXN1; (+) strand; PAM type: YTN; PAM sequence: TTT
attgttatttgagagtggac

SEQ ID NO: 254396 - DNA, 20 bp, Artificial Sequence
  Description of Artificial Sequence: Synthetic oligonucleotide
  Target: ATXN1; (+) strand; PAM type: YTN; PAM sequence: TTA
ttgttatttgagagtggact

SEQ ID NO: 254397 - DNA, 20 bp, Artificial Sequence
  Description of Artificial Sequence: Synthetic oligonucleotide
  Target: ATXN1; (+) strand; PAM type: YTN; PAM sequence: TTG
ttatttgagagtggactctt

SEQ ID NO: 254398 - DNA, 20 bp, Artificial Sequence
  Description of Artificial Sequence: Synthetic oligonucleotide
  Target: ATXN1; (+) strand; PAM type: YTN; PAM sequence: TTA
tttgagagtggactctttct

SEQ ID NO: 254399 - DNA, 20 bp, Artificial Sequence
  Description of Artificial Sequence: Synthetic oligonucleotide
  Target: ATXN1; (+) strand; PAM type: YTN; PAM sequence: TTT
gagagtggactctttctacc

SEQ ID NO: 254400 - DNA, 20 bp, Artificial Sequence
  Description of Artificial Sequence: Synthetic oligonucleotide
  Target: ATXN1; (+) strand; PAM type: YTN; PAM sequence: TTG
agagtggactctttctacct

SEQ ID NO: 254401 - DNA, 20 bp, Artificial Sequence
  Description of Artificial Sequence: Synthetic oligonucleotide
  Target: ATXN1; (+) strand; PAM type: YTN; PAM sequence: CTC
tttctacctataagaaatta

SEQ ID NO: 254402 - DNA, 20 bp, Artificial Sequence
  Description of Artificial Sequence: Synthetic oligonucleotide
  Target: ATXN1; (+) strand; PAM type: YTN; PAM sequence: CTT
tctacctataagaaattaac

SEQ ID NO: 254403 - DNA, 20 bp, Artificial Sequence
  Description of Artificial Sequence: Synthetic oligonucleotide
  Target: ATXN1; (+) strand; PAM type: YTN; PAM sequence: TTT
ctacctataagaaattaact

SEQ ID NO: 254404 - DNA, 20 bp, Artificial Sequence
  Description of Artificial Sequence: Synthetic oligonucleotide
  Target: ATXN1; (+) strand; PAM type: YTN; PAM sequence: TTC
tacctataagaaattaactg

SEQ ID NO: 254405 - DNA, 20 bp, Artificial Sequence
  Description of Artificial Sequence: Synthetic oligonucleotide
  Target: ATXN1; (+) strand; PAM type: YTN; PAM sequence: CTA
cctataagaaattaactgta

SEQ ID NO: 254406 - DNA, 20 bp, Artificial Sequence
  Description of Artificial Sequence: Synthetic oligonucleotide
  Target: ATXN1; (+) strand; PAM type: YTN; PAM sequence: CTA
taagaaattaactgtaggcc

SEQ ID NO: 254407 - DNA, 20 bp, Artificial Sequence
  Description of Artificial Sequence: Synthetic oligonucleotide
  Target: ATXN1; (+) strand; PAM type: YTN; PAM sequence: TTA
actgtaggccgggcgcagtg

SEQ ID NO: 254408 - DNA, 20 bp, Artificial Sequence
  Description of Artificial Sequence: Synthetic oligonucleotide
  Target: ATXN1; (+) strand; PAM type: YTN; PAM sequence: CTG
taggccgggcgcagtggctc

SEQ ID NO: 254409 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcccagcact

SEQ ID NO: 254410 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 254411 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggtgggcag

SEQ ID NO: 254412 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggtgggcaga

SEQ ID NO: 254413 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggtgggcagat

SEQ ID NO: 254414 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgaaacccat

SEQ ID NO: 254415 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 254416 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 254417 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagctgg

SEQ ID NO: 254418 - DNA, 20 bp, Artificial Sequence
  Description of Artificial Sequence: Synthetic oligonucleotide
  Target: ATXN1; (+) strand; PAM type: YTN; PAM sequence: TTA
gctgggcatagtggcacgtg

SEQ ID NO: 254419 - DNA, 20 bp, Artificial Sequence
  Description of Artificial Sequence: Synthetic oligonucleotide
  Target: ATXN1; (+) strand; PAM type: YTN; PAM sequence: CTG
ggcatagtggcacgtgcctg

SEQ ID NO: 254420 - DNA, 20 bp, Artificial Sequence
  Description of Artificial Sequence: Synthetic oligonucleotide
  Target: ATXN1; (+) strand; PAM type: YTN; PAM sequence: CTG
taatctcagctcttcgggtg

SEQ ID NO: 254421 - DNA, 20 bp, Artificial Sequence
  Description of Artificial Sequence: Synthetic oligonucleotide
  Target: ATXN1; (+) strand; PAM type: YTN; PAM sequence: CTC
agctcttcgggtggctgagg

SEQ ID NO: 254422 - DNA, 20 bp, Artificial Sequence
  Description of Artificial Sequence: Synthetic oligonucleotide
  Target: ATXN1; (+) strand; PAM type: YTN; PAM sequence: CTC
ttcgggtggctgaggcagaa

SEQ ID NO: 254423 - DNA, 20 bp, Artificial Sequence
  Description of Artificial Sequence: Synthetic oligonucleotide
  Target: ATXN1; (+) strand; PAM type: YTN; PAM sequence: CTT
cgggtggctgaggcagaaga

SEQ ID NO: 254424 - DNA, 20 bp, Artificial Sequence
  Description of Artificial Sequence: Synthetic oligonucleotide
  Target: ATXN1; (+) strand; PAM type: YTN; PAM sequence: TTC
gggtggctgaggcagaagaa

SEQ ID NO: 254425 - DNA, 20 bp, Artificial Sequence
  Description of Artificial Sequence: Synthetic oligonucleotide
  Target: ATXN1; (+) strand; PAM type: YTN; PAM sequence: CTG
aggcagaagaatcacttgaa

SEQ ID NO: 254426 - DNA, 20 bp, Artificial Sequence
  Description of Artificial Sequence: Synthetic oligonucleotide
  Target: ATXN1; (+) strand; PAM type: YTN; PAM sequence: CTT
gaaccagggagtcggaggtt

SEQ ID NO: 254427 - DNA, 20 bp, Artificial Sequence
  Description of Artificial Sequence: Synthetic oligonucleotide
  Target: ATXN1; (+) strand; PAM type: YTN; PAM sequence: TTG
aaccagggagtcggaggttg

SEQ ID NO: 254428 - DNA, 20 bp, Artificial Sequence
  Description of Artificial Sequence: Synthetic oligonucleotide
  Target: ATXN1; (+) strand; PAM type: YTN; PAM sequence: TTG
cagtgagctgagattgtgcc

SEQ ID NO: 254429 - DNA, 20 bp, Artificial Sequence
  Description of Artificial Sequence: Synthetic oligonucleotide
  Target: ATXN1; (+) strand; PAM type: YTN; PAM sequence: CTG
agattgtgccactgcactcc

SEQ ID NO: 254430 - DNA, 20 bp, Artificial Sequence
  Description of Artificial Sequence: Synthetic oligonucleotide
  Target: ATXN1; (+) strand; PAM type: YTN; PAM sequence: TTG
tgccactgcactccagcctg

SEQ ID NO: 254431 - DNA, 20 bp, Artificial Sequence
  Description of Artificial Sequence: Synthetic oligonucleotide
  Target: ATXN1; (+) strand; PAM type: YTN; PAM sequence: CTG
cactccagcctggtgacaga

SEQ ID NO: 254432 - DNA, 20 bp, Artificial Sequence
  Description of Artificial Sequence: Synthetic oligonucleotide
  Target: ATXN1; (+) strand; PAM type: YTN; PAM sequence: CTC
cagcctggtgacagagcgag

SEQ ID NO: 254433 - DNA, 20 bp, Artificial Sequence
  Description of Artificial Sequence: Synthetic oligonucleotide
  Target: ATXN1; (+) strand; PAM type: YTN; PAM sequence: CTG
gtgacagagcgagactccgt

SEQ ID NO: 254434 - DNA, 20 bp, Artificial Sequence
  Description of Artificial Sequence: Synthetic oligonucleotide
  Target: ATXN1; (+) strand; PAM type: YTN; PAM sequence: CTC
cgtctcaaaaaaaaaaaaaa

SEQ ID NO: 254435 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaaaaa

SEQ ID NO: 254436 - DNA, 20 bp, Artificial Sequence
  Description of Artificial Sequence: Synthetic oligonucleotide
  Target: ATXN1; (+) strand; PAM type: YTN; PAM sequence: TTA
actgtaaacagcctcaggca

SEQ ID NO: 254437 - DNA, 20 bp, Artificial Sequence
  Description of Artificial Sequence: Synthetic oligonucleotide
  Target: ATXN1; (+) strand; PAM type: YTN; PAM sequence: CTG
taaacagcctcaggcaggtc

SEQ ID NO: 254438 - DNA, 20 bp, Artificial Sequence
  Description of Artificial Sequence: Synthetic oligonucleotide
  Target: ATXN1; (+) strand; PAM type: YTN; PAM sequence: CTC
aggcaggtccctctggaggt

SEQ ID NO: 254439 - DNA, 20 bp, Artificial Sequence
  Description of Artificial Sequence: Synthetic oligonucleotide
  Target: ATXN1; (+) strand; PAM type: YTN; PAM sequence: CTC
tggaggtgttcaagaagaag

SEQ ID NO: 254440 - DNA, 20 bp, Artificial Sequence
  Description of Artificial Sequence: Synthetic oligonucleotide
  Target: ATXN1; (+) strand; PAM type: YTN; PAM sequence: CTG
gaggtgttcaagaagaaggc

SEQ ID NO: 254441 - DNA, 20 bp, Artificial Sequence
  Description of Artificial Sequence: Synthetic oligonucleotide
  Target: ATXN1; (+) strand; PAM type: YTN; PAM sequence: TTC
aagaagaaggcattgttatc

SEQ ID NO: 254442 - DNA, 20 bp, Artificial Sequence
  Description of Artificial Sequence: Synthetic oligonucleotide
  Target: ATXN1; (+) strand; PAM type: YTN; PAM sequence: TTG
ttatcatcgcagatgatggc

SEQ ID NO: 254443 - DNA, 20 bp, Artificial Sequence
  Description of Artificial Sequence: Synthetic oligonucleotide
  Target: ATXN1; (+) strand; PAM type: YTN; PAM sequence: TTA
tcatcgcagatgatggctcc

SEQ ID NO: 254444 - DNA, 20 bp, Artificial Sequence
  Description of Artificial Sequence: Synthetic oligonucleotide
  Target: ATXN1; (+) strand; PAM type: YTN; PAM sequence: CTC
cattcatggtattgcctctg

SEQ ID NO: 254445 - DNA, 20 bp, Artificial Sequence
  Description of Artificial Sequence: Synthetic oligonucleotide
  Target: ATXN1; (+) strand; PAM type: YTN; PAM sequence: TTC
atggtattgcctctgaagac

SEQ ID NO: 254446 - DNA, 20 bp, Artificial Sequence
  Description of Artificial Sequence: Synthetic oligonucleotide
  Target: ATXN1; (+) strand; PAM type: YTN; PAM sequence: TTG
cctctgaagaccttacagat

SEQ ID NO: 254447 - DNA, 20 bp, Artificial Sequence
  Description of Artificial Sequence: Synthetic oligonucleotide
  Target: ATXN1; (+) strand; PAM type: YTN; PAM sequence: CTC
tgaagaccttacagatggaa

SEQ ID NO: 254448 - DNA, 20 bp, Artificial Sequence
  Description of Artificial Sequence: Synthetic oligonucleotide
  Target: ATXN1; (+) strand; PAM type: YTN; PAM sequence: CTG
aagaccttacagatggaaaa

SEQ ID NO: 254449 - DNA, 20 bp, Artificial Sequence
  Description of Artificial Sequence: Synthetic oligonucleotide
  Target: ATXN1; (+) strand; PAM type: YTN; PAM sequence: CTT
acagatggaaaagataagga

SEQ ID NO: 254450 - DNA, 20 bp, Artificial Sequence
  Description of Artificial Sequence: Synthetic oligonucleotide
  Target: ATXN1; (+) strand; PAM type: YTN; PAM sequence: TTA
cagatggaaaagataaggag

SEQ ID NO: 254451 - DNA, 20 bp, Artificial Sequence
  Description of Artificial Sequence: Synthetic oligonucleotide
  Target: ATXN1; (+) strand; PAM type: YTN; PAM sequence: CTG
accatcatgaccctgtgtgg

SEQ ID NO: 254452 - DNA, 20 bp, Artificial Sequence
  Description of Artificial Sequence: Synthetic oligonucleotide
  Target: ATXN1; (+) strand; PAM type: YTN; PAM sequence: CTG
tgtggggctaggctaatgta

SEQ ID NO: 254453 - DNA, 20 bp, Artificial Sequence
  Description of Artificial Sequence: Synthetic oligonucleotide
  Target: ATXN1; (+) strand; PAM type: YTN; PAM sequence: CTA
ggctaatgtatgtgtttgtg

SEQ ID NO: 254454 - DNA, 20 bp, Artificial Sequence
  Description of Artificial Sequence: Synthetic oligonucleotide
  Target: ATXN1; (+) strand; PAM type: YTN; PAM sequence: CTA
atgtatgtgtttgtgtctta

SEQ ID NO: 254455 - DNA, 20 bp, Artificial Sequence
  Description of Artificial Sequence: Synthetic oligonucleotide
  Target: ATXN1; (+) strand; PAM type: YTN; PAM sequence: TTT
gtgtcttagtttttaacaga

SEQ ID NO: 254456 - DNA, 20 bp, Artificial Sequence
  Description of Artificial Sequence: Synthetic oligonucleotide
  Target: ATXN1; (+) strand; PAM type: YTN; PAM sequence: TTG
tgtcttagtttttaacagaa

SEQ ID NO: 254457 - DNA, 20 bp, Artificial Sequence
  Description of Artificial Sequence: Synthetic oligonucleotide
  Target: ATXN1; (+) strand; PAM type: YTN; PAM sequence: CTT
agtttttaacagaaaactta

SEQ ID NO: 254458 - DNA, 20 bp, Artificial Sequence
  Description of Artificial Sequence: Synthetic oligonucleotide
  Target: ATXN1; (+) strand; PAM type: YTN; PAM sequence: TTA
gtttttaacagaaaacttaa

SEQ ID NO: 254459 - DNA, 20 bp, Artificial Sequence
  Description of Artificial Sequence: Synthetic oligonucleotide
  Target: ATXN1; (+) strand; PAM type: YTN; PAM sequence: TTT
ttaacagaaaacttaaaaaa

SEQ ID NO: 254460 - DNA, 20 bp, Artificial Sequence
  Description of Artificial Sequence: Synthetic oligonucleotide
  Target: ATXN1; (+) strand; PAM type: YTN; PAM sequence: TTT
taacagaaaacttaaaaaaa

SEQ ID NO: 254461 - DNA, 20 bp, Artificial Sequence
  Description of Artificial Sequence: Synthetic oligonucleotide
  Target: ATXN1; (+) strand; PAM type: YTN; PAM sequence: TTT
aacagaaaacttaaaaaaaa

SEQ ID NO: 254462 - DNA, 20 bp, Artificial Sequence
  Description of Artificial Sequence: Synthetic oligonucleotide
  Target: ATXN1; (+) strand; PAM type: YTN; PAM sequence: TTA
acagaaaacttaaaaaaaaa

SEQ ID NO: 254463 - DNA, 20 bp, Artificial Sequence
  Description of Artificial Sequence: Synthetic oligonucleotide
  Target: ATXN1; (+) strand; PAM type: YTN; PAM sequence: CTT
aaaaaaaaaaaacttttttt

SEQ ID NO: 254464 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaaaacttttttta

SEQ ID NO: 254465 - DNA, 20 bp, Artificial Sequence
  Description of Artificial Sequence: Synthetic oligonucleotide
  Target: ATXN1; (+) strand; PAM type: YTN; PAM sequence: CTT
tttttaataagaaaaagctt

SEQ ID NO: 254466 - DNA, 20 bp, Artificial Sequence
  Description of Artificial Sequence: Synthetic oligonucleotide
  Target: ATXN1; (+) strand; PAM type: YTN; PAM sequence: TTT
ttttaataagaaaaagctta

SEQ ID NO: 254467 - DNA, 20 bp, Artificial Sequence
  Description of Artificial Sequence: Synthetic oligonucleotide
  Target: ATXN1; (+) strand; PAM type: YTN; PAM sequence: TTT
tttaataagaaaaagcttat

SEQ ID NO: 254468 - DNA, 20 bp, Artificial Sequence
  Description of Artificial Sequence: Synthetic oligonucleotide
  Target: ATXN1; (+) strand; PAM type: YTN; PAM sequence: TTT
ttaataagaaaaagcttata

SEQ ID NO: 254469 - DNA, 20 bp, Artificial Sequence
  Description of Artificial Sequence: Synthetic oligonucleotide
  Target: ATXN1; (+) strand; PAM type: YTN; PAM sequence: TTT
taataagaaaaagcttataa

SEQ ID NO: 254470 - DNA, 20 bp, Artificial Sequence
  Description of Artificial Sequence: Synthetic oligonucleotide
  Target: ATXN1; (+) strand; PAM type: YTN; PAM sequence: TTT
aataagaaaaagcttataaa

SEQ ID NO: 254471 - DNA, 20 bp, Artificial Sequence
  Description of Artificial Sequence: Synthetic oligonucleotide
  Target: ATXN1; (+) strand; PAM type: YTN; PAM sequence: TTA
ataagaaaaagcttataaac

SEQ ID NO: 254472 - DNA, 20 bp, Artificial Sequence
  Description of Artificial Sequence: Synthetic oligonucleotide
  Target: ATXN1; (+) strand; PAM type: YTN; PAM sequence: CTT
ataaactggatgtggtggtg

SEQ ID NO: 254473 - DNA, 20 bp, Artificial Sequence
  Description of Artificial Sequence: Synthetic oligonucleotide
  Target: ATXN1; (+) strand; PAM type: YTN; PAM sequence: TTA
taaactggatgtggtggtgt

SEQ ID NO: 254474 - DNA, 20 bp, Artificial Sequence
  Description of Artificial Sequence: Synthetic oligonucleotide
  Target: ATXN1; (+) strand; PAM type: YTN; PAM sequence: CTG
gatgtggtggtgtacacctg

SEQ ID NO: 254475 - DNA, 20 bp, Artificial Sequence
  Description of Artificial Sequence: Synthetic oligonucleotide
  Target: ATXN1; (+) strand; PAM type: YTN; PAM sequence: CTG
taatcccagcattttgggag

SEQ ID NO: 254476 - DNA, 20 bp, Artificial Sequence
  Description of Artificial Sequence: Synthetic oligonucleotide
  Target: ATXN1; (+) strand; PAM type: YTN; PAM sequence: TTT
tgggaggctgaggcaggagg

SEQ ID NO: 254477 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggcaggagga

SEQ ID NO: 254478 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggaggat

SEQ ID NO: 254479 - DNA, 20 bp, Artificial Sequence
  Description of Artificial Sequence: Synthetic oligonucleotide
  Target: ATXN1; (+) strand; PAM type: YTN; PAM sequence: CTG
aggcaggaggatggcttgag

SEQ ID NO: 254480 - DNA, 20 bp, Artificial Sequence
  Description of Artificial Sequence: Synthetic oligonucleotide
  Target: ATXN1; (+) strand; PAM type: YTN; PAM sequence: CTT
gagcccgggtgcgcgaaacc

SEQ ID NO: 254481 - DNA, 20 bp, Artificial Sequence
  Description of Artificial Sequence: Synthetic oligonucleotide
  Target: ATXN1; (+) strand; PAM type: YTN; PAM sequence: TTG
agcccgggtgcgcgaaacca

SEQ ID NO: 254482 - DNA, 20 bp, Artificial Sequence
  Description of Artificial Sequence: Synthetic oligonucleotide
  Target: ATXN1; (+) strand; PAM type: YTN; PAM sequence: CTG
ggcaacatagtgagacttag

SEQ ID NO: 254483 - DNA, 20 bp, Artificial Sequence
  Description of Artificial Sequence: Synthetic oligonucleotide
  Target: ATXN1; (+) strand; PAM type: YTN; PAM sequence: CTT
agtttctacaaaaacaagct

SEQ ID NO: 254484 - DNA, 20 bp, Artificial Sequence
  Description of Artificial Sequence: Synthetic oligonucleotide
  Target: ATXN1; (+) strand; PAM type: YTN; PAM sequence: TTA
gtttctacaaaaacaagctt

SEQ ID NO: 254485 - DNA, 20 bp, Artificial Sequence
  Description of Artificial Sequence: Synthetic oligonucleotide
  Target: ATXN1; (+) strand; PAM type: YTN; PAM sequence: TTT
ctacaaaaacaagcttatag

SEQ ID NO: 254486 - DNA, 20 bp, Artificial Sequence
  Description of Artificial Sequence: Synthetic oligonucleotide
  Target: ATXN1; (+) strand; PAM type: YTN; PAM sequence: TTC
tacaaaaacaagcttataga

SEQ ID NO: 254487 - DNA, 20 bp, Artificial Sequence
  Description of Artificial Sequence: Synthetic oligonucleotide
  Target: ATXN1; (+) strand; PAM type: YTN; PAM sequence: CTA
caaaaacaagcttatagaat

SEQ ID NO: 254488 - DNA, 20 bp, Artificial Sequence
  Description of Artificial Sequence: Synthetic oligonucleotide
  Target: ATXN1; (+) strand; PAM type: YTN; PAM sequence: CTT
atagaataaagatataaaga

SEQ ID NO: 254489 - DNA, 20 bp, Artificial Sequence
  Description of Artificial Sequence: Synthetic oligonucleotide
  Target: ATXN1; (+) strand; PAM type: YTN; PAM sequence: TTA
tagaataaagatataaagaa

SEQ ID NO: 254490 - DNA, 20 bp, Artificial Sequence
  Description of Artificial Sequence: Synthetic oligonucleotide
  Target: ATXN1; (+) strand; PAM type: YTN; PAM sequence: TTC
ttgtacagctgtaaaatgtg

SEQ ID NO: 254491 - DNA, 20 bp, Artificial Sequence
  Description of Artificial Sequence: Synthetic oligonucleotide
  Target: ATXN1; (+) strand; PAM type: YTN; PAM sequence: CTT
gtacagctgtaaaatgtgtt

SEQ ID NO: 254492 - DNA, 20 bp, Artificial Sequence
  Description of Artificial Sequence: Synthetic oligonucleotide
  Target: ATXN1; (+) strand; PAM type: YTN; PAM sequence: TTG
tacagctgtaaaatgtgttt

SEQ ID NO: 254493 - DNA, 20 bp, Artificial Sequence
  Description of Artificial Sequence: Synthetic oligonucleotide
  Target: ATXN1; (+) strand; PAM type: YTN; PAM sequence: CTG
taaaatgtgtttgtatttta

SEQ ID NO: 254494 - DNA, 20 bp, Artificial Sequence
  Description of Artificial Sequence: Synthetic oligonucleotide
  Target: ATXN1; (+) strand; PAM type: YTN; PAM sequence: TTT
gtattttaaactgagtgcta

SEQ ID NO: 254495 - DNA, 20 bp, Artificial Sequence
  Description of Artificial Sequence: Synthetic oligonucleotide
  Target: ATXN1; (+) strand; PAM type: YTN; PAM sequence: TTG
tattttaaactgagtgctat

SEQ ID NO: 254496 - DNA, 20 bp, Artificial Sequence
  Description of Artificial Sequence: Synthetic oligonucleotide
  Target: ATXN1; (+) strand; PAM type: YTN; PAM sequence: TTT
taaactgagtgctattatga

SEQ ID NO: 254497 - DNA, 20 bp, Artificial Sequence
  Description of Artificial Sequence: Synthetic oligonucleotide
  Target: ATXN1; (+) strand; PAM type: YTN; PAM sequence: TTT
aaactgagtgctattatgaa

SEQ ID NO: 254498 - DNA, 20 bp, Artificial Sequence
  Description of Artificial Sequence: Synthetic oligonucleotide
  Target: ATXN1; (+) strand; PAM type: YTN; PAM sequence: TTA
aactgagtgctattatgaaa

SEQ ID NO: 254499 - DNA, 20 bp, Artificial Sequence
  Description of Artificial Sequence: Synthetic oligonucleotide
  Target: ATXN1; (+) strand; PAM type: YTN; PAM sequence: CTG
agtgctattatgaaagttat

SEQ ID NO: 254500 - DNA, 20 bp, Artificial Sequence
  Description of Artificial Sequence: Synthetic oligonucleotide
  Target: ATXN1; (+) strand; PAM type: YTN; PAM sequence: CTA
ttatgaaagttatcaaaaag

SEQ ID NO: 254501 - DNA, 20 bp, Artificial Sequence
  Description of Artificial Sequence: Synthetic oligonucleotide
  Target: ATXN1; (+) strand; PAM type: YTN; PAM sequence: TTA
tgaaagttatcaaaaagttt

SEQ ID NO: 254502 - DNA, 20 bp, Artificial Sequence
  Description of Artificial Sequence: Synthetic oligonucleotide
  Target: ATXN1; (+) strand; PAM type: YTN; PAM sequence: TTA
tcaaaaagtttttaaaaatt

SEQ ID NO: 254503 - DNA, 20 bp, Artificial Sequence
  Description of Artificial Sequence: Synthetic oligonucleotide
  Target: ATXN1; (+) strand; PAM type: YTN; PAM sequence: TTT
ttaaaaattaaaaagtttat

SEQ ID NO: 254504 - DNA, 20 bp, Artificial Sequence
  Description of Artificial Sequence: Synthetic oligonucleotide
  Target: ATXN1; (+) strand; PAM type: YTN; PAM sequence: TTT
taaaaattaaaaagtttata

SEQ ID NO: 254505 - DNA, 20 bp, Artificial Sequence
  Description of Artificial Sequence: Synthetic oligonucleotide
  Target: ATXN1; (+) strand; PAM type: YTN; PAM sequence: TTT
aaaaattaaaaagtttataa

SEQ ID NO: 254506 - DNA, 20 bp, Artificial Sequence
  Description of Artificial Sequence: Synthetic oligonucleotide
  Target: ATXN1; (+) strand; PAM type: YTN; PAM sequence: TTA
aaaattaaaaagtttataaa

SEQ ID NO: 254507 - DNA, 20 bp, Artificial Sequence
  Description of Artificial Sequence: Synthetic oligonucleotide
  Target: ATXN1; (+) strand; PAM type: YTN; PAM sequence: TTA
aaaagtttataaagtaaaaa

SEQ ID NO: 254508 - DNA, 20 bp, Artificial Sequence
  Description of Artificial Sequence: Synthetic oligonucleotide
  Target: ATXN1; (+) strand; PAM type: YTN; PAM sequence: TTT
ataaagtaaaaaagtaagct

SEQ ID NO: 254509 - DNA, 20 bp, Artificial Sequence
  Description of Artificial Sequence: Synthetic oligonucleotide
  Target: ATXN1; (+) strand; PAM type: YTN; PAM sequence: TTA
taaagtaaaaaagtaagctg

SEQ ID NO: 254510 - DNA, 20 bp, Artificial Sequence
  Description of Artificial Sequence: Synthetic oligonucleotide
  Target: ATXN1; (+) strand; PAM type: YTN; PAM sequence: CTG
agcgtggttaatttattatc

SEQ ID NO: 254511 - DNA, 20 bp, Artificial Sequence
  Description of Artificial Sequence: Synthetic oligonucleotide
  Target: ATXN1; (+) strand; PAM type: YTN; PAM sequence: TTA
atttattatcaaagaaagaa

SEQ ID NO: 254512 - DNA, 20 bp, Artificial Sequence
  Description of Artificial Sequence: Synthetic oligonucleotide
  Target: ATXN1; (+) strand; PAM type: YTN; PAM sequence: TTT
attatcaaagaaagaacaat

SEQ ID NO: 254513 - DNA, 20 bp, Artificial Sequence
  Description of Artificial Sequence: Synthetic oligonucleotide
  Target: ATXN1; (+) strand; PAM type: YTN; PAM sequence: TTA
ttatcaaagaaagaacaatt

SEQ ID NO: 254514 - DNA, 20 bp, Artificial Sequence
  Description of Artificial Sequence: Synthetic oligonucleotide
  Target: ATXN1; (+) strand; PAM type: YTN; PAM sequence: TTA
tcaaagaaagaacaatttaa

SEQ ID NO: 254515 - DNA, 20 bp, Artificial Sequence
  Description of Artificial Sequence: Synthetic oligonucleotide
  Target: ATXN1; (+) strand; PAM type: YTN; PAM sequence: TTT
aaaaaacaaacttagtgtag

SEQ ID NO: 254516 - DNA, 20 bp, Artificial Sequence
  Description of Artificial Sequence: Synthetic oligonucleotide
  Target: ATXN1; (+) strand; PAM type: YTN; PAM sequence: TTA
aaaaacaaacttagtgtagc

SEQ ID NO: 254517 - DNA, 20 bp, Artificial Sequence
  Description of Artificial Sequence: Synthetic oligonucleotide
  Target: ATXN1; (+) strand; PAM type: YTN; PAM sequence: CTT
agtgtagcctaagtgtacag

SEQ ID NO: 254518 - DNA, 20 bp, Artificial Sequence
  Description of Artificial Sequence: Synthetic oligonucleotide
  Target: ATXN1; (+) strand; PAM type: YTN; PAM sequence: TTA
gtgtagcctaagtgtacagt

SEQ ID NO: 254519 - DNA, 20 bp, Artificial Sequence
  Description of Artificial Sequence: Synthetic oligonucleotide
  Target: ATXN1; (+) strand; PAM type: YTN; PAM sequence: CTA
agtgtacagtccttataaag

SEQ ID NO: 254520 - DNA, 20 bp, Artificial Sequence
  Description of Artificial Sequence: Synthetic oligonucleotide
  Target: ATXN1; (+) strand; PAM type: YTN; PAM sequence: CTT
ataaagtctacagtggggta

SEQ ID NO: 254521 - DNA, 20 bp, Artificial Sequence
  Description of Artificial Sequence: Synthetic oligonucleotide
  Target: ATXN1; (+) strand; PAM type: YTN; PAM sequence: TTA
taaagtctacagtggggtac

SEQ ID NO: 254522 - DNA, 20 bp, Artificial Sequence
  Description of Artificial Sequence: Synthetic oligonucleotide
  Target: ATXN1; (+) strand; PAM type: YTN; PAM sequence: CTA
cagtggggtacagtgataca

SEQ ID NO: 254523 - DNA, 20 bp, Artificial Sequence
  Description of Artificial Sequence: Synthetic oligonucleotide
  Target: ATXN1; (+) strand; PAM type: YTN; PAM sequence: CTA
ggccttcacattcactcacc

SEQ ID NO: 254524 - DNA, 20 bp, Artificial Sequence
  Description of Artificial Sequence: Synthetic oligonucleotide
  Target: ATXN1; (+) strand; PAM type: YTN; PAM sequence: CTT
cacattcactcaccacccac

SEQ ID NO: 254525 - DNA, 20 bp, Artificial Sequence
  Description of Artificial Sequence: Synthetic oligonucleotide
  Target: ATXN1; (+) strand; PAM type: YTN; PAM sequence: TTC
acattcactcaccacccact

SEQ ID NO: 254526 - DNA, 20 bp, Artificial Sequence
  Description of Artificial Sequence: Synthetic oligonucleotide
  Target: ATXN1; (+) strand; PAM type: YTN; PAM sequence: TTC
actcaccacccactcactga

SEQ ID NO: 254527 - DNA, 20 bp, Artificial Sequence
  Description of Artificial Sequence: Synthetic oligonucleotide
  Target: ATXN1; (+) strand; PAM type: YTN; PAM sequence: CTC
accacccactcactgactca

SEQ ID NO: 254528 - DNA, 20 bp, Artificial Sequence
  Description of Artificial Sequence: Synthetic oligonucleotide
  Target: ATXN1; (+) strand; PAM type: YTN; PAM sequence: CTC
actgactcacccagagcaac

SEQ ID NO: 254529 - DNA, 20 bp, Artificial Sequence
  Description of Artificial Sequence: Synthetic oligonucleotide
  Target: ATXN1; (+) strand; PAM type: YTN; PAM sequence: CTG
actcacccagagcaacttcc

SEQ ID NO: 254530 - DNA, 20 bp, Artificial Sequence
  Description of Artificial Sequence: Synthetic oligonucleotide
  Target: ATXN1; (+) strand; PAM type: YTN; PAM sequence: CTC
acccagagcaacttccagtc

SEQ ID NO: 254531 - DNA, 20 bp, Artificial Sequence
  Description of Artificial Sequence: Synthetic oligonucleotide
  Target: ATXN1; (+) strand; PAM type: YTN; PAM sequence: CTT
ccagtcctgcaagctccatt

SEQ ID NO: 254532 - DNA, 20 bp, Artificial Sequence
  Description of Artificial Sequence: Synthetic oligonucleotide
  Target: ATXN1; (+) strand; PAM type: YTN; PAM sequence: TTC
cagtcctgcaagctccattc

SEQ ID NO: 254533 - DNA, 20 bp, Artificial Sequence
  Description of Artificial Sequence: Synthetic oligonucleotide
  Target: ATXN1; (+) strand; PAM type: YTN; PAM sequence: CTG
caagctccattcatggtaag

SEQ ID NO: 254534 - DNA, 20 bp, Artificial Sequence
  Description of Artificial Sequence: Synthetic oligonucleotide
  Target: ATXN1; (+) strand; PAM type: YTN; PAM sequence: CTC
cattcatggtaagtgcccta

SEQ ID NO: 254535 - DNA, 20 bp, Artificial Sequence
  Description of Artificial Sequence: Synthetic oligonucleotide
  Target: ATXN1; (+) strand; PAM type: YTN; PAM sequence: TTC
atggtaagtgccctatatag

SEQ ID NO: 254536 - DNA, 20 bp, Artificial Sequence
  Description of Artificial Sequence: Synthetic oligonucleotide
  Target: ATXN1; (+) strand; PAM type: YTN; PAM sequence: CTA
tataggtgtgcccttttaaa

SEQ ID NO: 254537 - DNA, 20 bp, Artificial Sequence
  Description of Artificial Sequence: Synthetic oligonucleotide
  Target: ATXN1; (+) strand; PAM type: YTN; PAM sequence: CTT
ttaaaatcttttctacttca

SEQ ID NO: 254538 - DNA, 20 bp, Artificial Sequence
  Description of Artificial Sequence: Synthetic oligonucleotide
  Target: ATXN1; (+) strand; PAM type: YTN; PAM sequence: TTT
taaaatcttttctacttcat

SEQ ID NO: 254539 - DNA, 20 bp, Artificial Sequence
  Description of Artificial Sequence: Synthetic oligonucleotide
  Target: ATXN1; (+) strand; PAM type: YTN; PAM sequence: TTT
aaaatcttttctacttcatt

SEQ ID NO: 254540 - DNA, 20 bp, Artificial Sequence
  Description of Artificial Sequence: Synthetic oligonucleotide
  Target: ATXN1; (+) strand; PAM type: YTN; PAM sequence: TTA
aaatcttttctacttcattt

SEQ ID NO: 254541 - DNA, 20 bp, Artificial Sequence
  Description of Artificial Sequence: Synthetic oligonucleotide
  Target: ATXN1; (+) strand; PAM type: YTN; PAM sequence: CTT
ttctacttcatttttactgt

SEQ ID NO: 254542 - DNA, 20 bp, Artificial Sequence
  Description of Artificial Sequence: Synthetic oligonucleotide
  Target: ATXN1; (+) strand; PAM type: YTN; PAM sequence: TTT
tctacttcatttttactgta

SEQ ID NO: 254543 - DNA, 20 bp, Artificial Sequence
  Description of Artificial Sequence: Synthetic oligonucleotide
  Target: ATXN1; (+) strand; PAM type: YTN; PAM sequence: TTT
ctacttcatttttactgtac

SEQ ID NO: 254544 - DNA, 20 bp, Artificial Sequence
  Description of Artificial Sequence: Synthetic oligonucleotide
  Target: ATXN1; (+) strand; PAM type: YTN; PAM sequence: TTC
tacttcatttttactgtacc

SEQ ID NO: 254545 - DNA, 20 bp, Artificial Sequence
  Description of Artificial Sequence: Synthetic oligonucleotide
  Target: ATXN1; (+) strand; PAM type: YTN; PAM sequence: CTA
cttcatttttactgtaccta

SEQ ID NO: 254546 - DNA, 20 bp, Artificial Sequence
  Description of Artificial Sequence: Synthetic oligonucleotide
  Target: ATXN1; (+) strand; PAM type: YTN; PAM sequence: CTT
catttttactgtacctattc

SEQ ID NO: 254547 - DNA, 20 bp, Artificial Sequence
  Description of Artificial Sequence: Synthetic oligonucleotide
  Target: ATXN1; (+) strand; PAM type: YTN; PAM sequence: TTC
atttttactgtacctattct

SEQ ID NO: 254548 - DNA, 20 bp, Artificial Sequence
  Description of Artificial Sequence: Synthetic oligonucleotide
  Target: ATXN1; (+) strand; PAM type: YTN; PAM sequence: TTT
ttactgtacctattctatgt

SEQ ID NO: 254549 - DNA, 20 bp, Artificial Sequence
  Description of Artificial Sequence: Synthetic oligonucleotide
  Target: ATXN1; (+) strand; PAM type: YTN; PAM sequence: TTT
tactgtacctattctatgtc

SEQ ID NO: 254550 - DNA, 20 bp, Artificial Sequence
  Description of Artificial Sequence: Synthetic oligonucleotide
  Target: ATXN1; (+) strand; PAM type: YTN; PAM sequence: TTT
actgtacctattctatgtct

SEQ ID NO: 254551 - DNA, 20 bp, Artificial Sequence
  Description of Artificial Sequence: Synthetic oligonucleotide
  Target: ATXN1; (+) strand; PAM type: YTN; PAM sequence: TTA
ctgtacctattctatgtcta

SEQ ID NO: 254552 - DNA, 20 bp, Artificial Sequence
  Description of Artificial Sequence: Synthetic oligonucleotide
  Target: ATXN1; (+) strand; PAM type: YTN; PAM sequence: CTG
tacctattctatgtctagat

SEQ ID NO: 254553 - DNA, 20 bp, Artificial Sequence
  Description of Artificial Sequence: Synthetic oligonucleotide
  Target: ATXN1; (+) strand; PAM type: YTN; PAM sequence: CTA
ttctatgtctagatgcacaa

SEQ ID NO: 254554 - DNA, 20 bp, Artificial Sequence
  Description of Artificial Sequence: Synthetic oligonucleotide
  Target: ATXN1; (+) strand; PAM type: YTN; PAM sequence: TTC
tatgtctagatgcacaaaaa

SEQ ID NO: 254555 - DNA, 20 bp, Artificial Sequence
  Description of Artificial Sequence: Synthetic oligonucleotide
  Target: ATXN1; (+) strand; PAM type: YTN; PAM sequence: CTA
tgtctagatgcacaaaaact

SEQ ID NO: 254556 - DNA, 20 bp, Artificial Sequence
  Description of Artificial Sequence: Synthetic oligonucleotide
  Target: ATXN1; (+) strand; PAM type: YTN; PAM sequence: CTA
gatgcacaaaaactatgttt

SEQ ID NO: 254557 - DNA, 20 bp, Artificial Sequence
  Description of Artificial Sequence: Synthetic oligonucleotide
  Target: ATXN1; (+) strand; PAM type: YTN; PAM sequence: CTA
tgtttaggaacattgtgtta

SEQ ID NO: 254558 - DNA, 20 bp, Artificial Sequence
  Description of Artificial Sequence: Synthetic oligonucleotide
  Target: ATXN1; (+) strand; PAM type: YTN; PAM sequence: TTT
aggaacattgtgttacaagt

SEQ ID NO: 254559 - DNA, 20 bp, Artificial Sequence
  Description of Artificial Sequence: Synthetic oligonucleotide
  Target: ATXN1; (+) strand; PAM type: YTN; PAM sequence: TTA
ggaacattgtgttacaagtg

SEQ ID NO: 254560 - DNA, 20 bp, Artificial Sequence
  Description of Artificial Sequence: Synthetic oligonucleotide
  Target: ATXN1; (+) strand; PAM type: YTN; PAM sequence: TTG
tgttacaagtgcctacagta

SEQ ID NO: 254561 - DNA, 20 bp, Artificial Sequence
  Description of Artificial Sequence: Synthetic oligonucleotide
  Target: ATXN1; (+) strand; PAM type: YTN; PAM sequence: TTA
caagtgcctacagtattcag

SEQ ID NO: 254562 - DNA, 20 bp, Artificial Sequence
  Description of Artificial Sequence: Synthetic oligonucleotide
  Target: ATXN1; (+) strand; PAM type: YTN; PAM sequence: CTA
cagtattcagtacagtaagg

SEQ ID NO: 254563 - DNA, 20 bp, Artificial Sequence
  Description of Artificial Sequence: Synthetic oligonucleotide
  Target: ATXN1; (+) strand; PAM type: YTN; PAM sequence: TTC
agtacagtaaggtgctgagt

SEQ ID NO: 254564 - DNA, 20 bp, Artificial Sequence
  Description of Artificial Sequence: Synthetic oligonucleotide
  Target: ATXN1; (+) strand; PAM type: YTN; PAM sequence: CTG
agtgctgtaggcaatcgtaa

SEQ ID NO: 254565 - DNA, 20 bp, Artificial Sequence
  Description of Artificial Sequence: Synthetic oligonucleotide
  Target: ATXN1; (+) strand; PAM type: YTN; PAM sequence: CTG
taggcaatcgtaaccctatg

SEQ ID NO: 254566 - DNA, 20 bp, Artificial Sequence
  Description of Artificial Sequence: Synthetic oligonucleotide
  Target: ATXN1; (+) strand; PAM type: YTN; PAM sequence: CTA
tgtccaagtttgtatcctag

SEQ ID NO: 254567 - DNA, 20 bp, Artificial Sequence
  Description of Artificial Sequence: Synthetic oligonucleotide
  Target: ATXN1; (+) strand; PAM type: YTN; PAM sequence: TTT
gtatcctaggagcaacaggc

SEQ ID NO: 254568 - DNA, 20 bp, Artificial Sequence
  Description of Artificial Sequence: Synthetic oligonucleotide
  Target: ATXN1; (+) strand; PAM type: YTN; PAM sequence: TTG
tatcctaggagcaacaggct

SEQ ID NO: 254569 - DNA, 20 bp, Artificial Sequence
  Description of Artificial Sequence: Synthetic oligonucleotide
  Target: ATXN1; (+) strand; PAM type: YTN; PAM sequence: CTA
ggagcaacaggctgcattat

SEQ ID NO: 254570 - DNA, 20 bp, Artificial Sequence
  Description of Artificial Sequence: Synthetic oligonucleotide
  Target: ATXN1; (+) strand; PAM type: YTN; PAM sequence: CTG
cattatatagcttagatgtg

SEQ ID NO: 254571 - DNA, 20 bp, Artificial Sequence
  Description of Artificial Sequence: Synthetic oligonucleotide
  Target: ATXN1; (+) strand; PAM type: YTN; PAM sequence: TTA
tatagcttagatgtgtagca

SEQ ID NO: 254572 - DNA, 20 bp, Artificial Sequence
  Description of Artificial Sequence: Synthetic oligonucleotide
  Target: ATXN1; (+) strand; PAM type: YTN; PAM sequence: CTT
agatgtgtagcaggctgtac

SEQ ID NO: 254573 - DNA, 20 bp, Artificial Sequence
  Description of Artificial Sequence: Synthetic oligonucleotide
  Target: ATXN1; (+) strand; PAM type: YTN; PAM sequence: TTA
gatgtgtagcaggctgtacc

SEQ ID NO: 254574 - DNA, 20 bp, Artificial Sequence
  Description of Artificial Sequence: Synthetic oligonucleotide
  Target: ATXN1; (+) strand; PAM type: YTN; PAM sequence: CTG
taccatctaggcttgggtga

SEQ ID NO: 254575 - DNA, 20 bp, Artificial Sequence
  Description of Artificial Sequence: Synthetic oligonucleotide
  Target: ATXN1; (+) strand; PAM type: YTN; PAM sequence: CTA
ggcttgggtgaacacacttt

SEQ ID NO: 254576 - DNA, 20 bp, Artificial Sequence
  Description of Artificial Sequence: Synthetic oligonucleotide
  Target: ATXN1; (+) strand; PAM type: YTN; PAM sequence: CTT
gggtgaacacactttatgat

SEQ ID NO: 254577 - DNA, 20 bp, Artificial Sequence
  Description of Artificial Sequence: Synthetic oligonucleotide
  Target: ATXN1; (+) strand; PAM type: YTN; PAM sequence: TTG
ggtgaacacactttatgata

SEQ ID NO: 254578 - DNA, 20 bp, Artificial Sequence
  Description of Artificial Sequence: Synthetic oligonucleotide
  Target: ATXN1; (+) strand; PAM type: YTN; PAM sequence: CTT
tatgatatttgcagaaggac

SEQ ID NO: 254579 - DNA, 20 bp, Artificial Sequence
  Description of Artificial Sequence: Synthetic oligonucleotide
  Target: ATXN1; (+) strand; PAM type: YTN; PAM sequence: TTT
atgatatttgcagaaggacg

SEQ ID NO: 254580 - DNA, 20 bp, Artificial Sequence
  Description of Artificial Sequence: Synthetic oligonucleotide
  Target: ATXN1; (+) strand; PAM type: YTN; PAM sequence: TTA
tgatatttgcagaaggacga

SEQ ID NO: 254581 - DNA, 20 bp, Artificial Sequence
  Description of Artificial Sequence: Synthetic oligonucleotide
  Target: ATXN1; (+) strand; PAM type: YTN; PAM sequence: TTT
gcagaaggacgatgtaagga

SEQ ID NO: 254582 - DNA, 20 bp, Artificial Sequence
  Description of Artificial Sequence: Synthetic oligonucleotide
  Target: ATXN1; (+) strand; PAM type: YTN; PAM sequence: TTG
cagaaggacgatgtaaggat

SEQ ID NO: 254583 - DNA, 20 bp, Artificial Sequence
  Description of Artificial Sequence: Synthetic oligonucleotide
  Target: ATXN1; (+) strand; PAM type: YTN; PAM sequence: TTT
ctcagaatgcattcccatta

SEQ ID NO: 254584 - DNA, 20 bp, Artificial Sequence
  Description of Artificial Sequence: Synthetic oligonucleotide
  Target: ATXN1; (+) strand; PAM type: YTN; PAM sequence: TTC
tcagaatgcattcccattat

SEQ ID NO: 254585 - DNA, 20 bp, Artificial Sequence
  Description of Artificial Sequence: Synthetic oligonucleotide
  Target: ATXN1; (+) strand; PAM type: YTN; PAM sequence: CTC
agaatgcattcccattatta

SEQ ID NO: 254586 - DNA, 20 bp, Artificial Sequence
  Description of Artificial Sequence: Synthetic oligonucleotide
  Target: ATXN1; (+) strand; PAM type: YTN; PAM sequence: TTC
ccattattaagtgatgcacg

SEQ ID NO: 254587 - DNA, 20 bp, Artificial Sequence
  Description of Artificial Sequence: Synthetic oligonucleotide
  Target: ATXN1; (+) strand; PAM type: YTN; PAM sequence: TTA
ttaagtgatgcacgactgtc

SEQ ID NO: 254588 - DNA, 20 bp, Artificial Sequence
  Description of Artificial Sequence: Synthetic oligonucleotide
  Target: ATXN1; (+) strand; PAM type: YTN; PAM sequence: TTA
agtgatgcacgactgtccta

SEQ ID NO: 254589 - DNA, 20 bp, Artificial Sequence
  Description of Artificial Sequence: Synthetic oligonucleotide
  Target: ATXN1; (+) strand; PAM type: YTN; PAM sequence: CTG
tcctatatggtggtgtgcta

SEQ ID NO: 254590 - DNA, 20 bp, Artificial Sequence
  Description of Artificial Sequence: Synthetic oligonucleotide
  Target: ATXN1; (+) strand; PAM type: YTN; PAM sequence: CTA
tatggtggtgtgctactgtg

SEQ ID NO: 254591 - DNA, 20 bp, Artificial Sequence
  Description of Artificial Sequence: Synthetic oligonucleotide
  Target: ATXN1; (+) strand; PAM type: YTN; PAM sequence: CTA
ctgtgcatctctttacaatc

SEQ ID NO: 254592 - DNA, 20 bp, Artificial Sequence
  Description of Artificial Sequence: Synthetic oligonucleotide
  Target: ATXN1; (+) strand; PAM type: YTN; PAM sequence: CTG
tgcatctctttacaatctca

SEQ ID NO: 254593 - DNA, 20 bp, Artificial Sequence
  Description of Artificial Sequence: Synthetic oligonucleotide
  Target: ATXN1; (+) strand; PAM type: YTN; PAM sequence: CTC
tttacaatctcatggttggt

SEQ ID NO: 254594 - DNA, 20 bp, Artificial Sequence
  Description of Artificial Sequence: Synthetic oligonucleotide
  Target: ATXN1; (+) strand; PAM type: YTN; PAM sequence: CTT
tacaatctcatggttggtaa

SEQ ID NO: 254595 - DNA, 20 bp, Artificial Sequence
  Description of Artificial Sequence: Synthetic oligonucleotide
  Target: ATXN1; (+) strand; PAM type: YTN; PAM sequence: TTT
acaatctcatggttggtaat

SEQ ID NO: 254596 - DNA, 20 bp, Artificial Sequence
  Description of Artificial Sequence: Synthetic oligonucleotide
  Target: ATXN1; (+) strand; PAM type: YTN; PAM sequence: TTA
caatctcatggttggtaatg

SEQ ID NO: 254597 - DNA, 20 bp, Artificial Sequence
  Description of Artificial Sequence: Synthetic oligonucleotide
  Target: ATXN1; (+) strand; PAM type: YTN; PAM sequence: CTC
atggttggtaatgtcacatt

SEQ ID NO: 254598 - DNA, 20 bp, Artificial Sequence
  Description of Artificial Sequence: Synthetic oligonucleotide
  Target: ATXN1; (+) strand; PAM type: YTN; PAM sequence: TTG
gtaatgtcacattggtagtt

SEQ ID NO: 254599 - DNA, 20 bp, Artificial Sequence
  Description of Artificial Sequence: Synthetic oligonucleotide
  Target: ATXN1; (+) strand; PAM type: YTN; PAM sequence: TTG
gtagtttgaaattagtcaca

SEQ ID NO: 254600 - DNA, 20 bp, Artificial Sequence
  Description of Artificial Sequence: Synthetic oligonucleotide
  Target: ATXN1; (+) strand; PAM type: YTN; PAM sequence: TTT
gaaattagtcacagtgagag

SEQ ID NO: 254601 - DNA, 20 bp, Artificial Sequence
  Description of Artificial Sequence: Synthetic oligonucleotide
  Target: ATXN1; (+) strand; PAM type: YTN; PAM sequence: TTG
aaattagtcacagtgagagt

SEQ ID NO: 254602 - DNA, 20 bp, Artificial Sequence
  Description of Artificial Sequence: Synthetic oligonucleotide
  Target: ATXN1; (+) strand; PAM type: YTN; PAM sequence: TTA
gtcacagtgagagtatttat

SEQ ID NO: 254603 - DNA, 20 bp, Artificial Sequence
  Description of Artificial Sequence: Synthetic oligonucleotide
  Target: ATXN1; (+) strand; PAM type: YTN; PAM sequence: TTT
atattacagaaatcagtaaa

SEQ ID NO: 254604 - DNA, 20 bp, Artificial Sequence
  Description of Artificial Sequence: Synthetic oligonucleotide
  Target: ATXN1; (+) strand; PAM type: YTN; PAM sequence: TTA
tattacagaaatcagtaaat

SEQ ID NO: 254605 - DNA, 20 bp, Artificial Sequence
  Description of Artificial Sequence: Synthetic oligonucleotide
  Target: ATXN1; (+) strand; PAM type: YTN; PAM sequence: TTA
cagaaatcagtaaatgctac

SEQ ID NO: 254606 - DNA, 20 bp, Artificial Sequence
  Description of Artificial Sequence: Synthetic oligonucleotide
  Target: ATXN1; (+) strand; PAM type: YTN; PAM sequence: CTA
caaatcaaacgtcctgttat

SEQ ID NO: 254607 - DNA, 20 bp, Artificial Sequence
  Description of Artificial Sequence: Synthetic oligonucleotide
  Target: ATXN1; (+) strand; PAM type: YTN; PAM sequence: CTG
ttattcccgagccagtagct

SEQ ID NO: 254608 - DNA, 20 bp, Artificial Sequence
  Description of Artificial Sequence: Synthetic oligonucleotide
  Target: ATXN1; (+) strand; PAM type: YTN; PAM sequence: TTA
ttcccgagccagtagctaaa

SEQ ID NO: 254609 - DNA, 20 bp, Artificial Sequence
  Description of Artificial Sequence: Synthetic oligonucleotide
  Target: ATXN1; (+) strand; PAM type: YTN; PAM sequence: TTC
ccgagccagtagctaaactt

SEQ ID NO: 254610 - DNA, 20 bp, Artificial Sequence
  Description of Artificial Sequence: Synthetic oligonucleotide
  Target: ATXN1; (+) strand; PAM type: YTN; PAM sequence: CTA
aactttttgttttgtttttt

SEQ ID NO: 254611 - DNA, 20 bp, Artificial Sequence
  Description of Artificial Sequence: Synthetic oligonucleotide
  Target: ATXN1; (+) strand; PAM type: YTN; PAM sequence: CTT
tttgttttgttttttgtttt

SEQ ID NO: 254612 - DNA, 20 bp, Artificial Sequence
  Description of Artificial Sequence: Synthetic oligonucleotide
  Target: ATXN1; (+) strand; PAM type: YTN; PAM sequence: TTT
ttgttttgttttttgttttt

SEQ ID NO: 254613 - DNA, 20 bp, Artificial Sequence
  Description of Artificial Sequence: Synthetic oligonucleotide
  Target: ATXN1; (+) strand; PAM type: YTN; PAM sequence: TTT
tgttttgttttttgtttttt

SEQ ID NO: 254614 - DNA, 20 bp, Artificial Sequence
  Description of Artificial Sequence: Synthetic oligonucleotide
  Target: ATXN1; (+) strand; PAM type: YTN; PAM sequence: TTT
gttttgttttttgttttttt

SEQ ID NO: 254615 - DNA, 20 bp, Artificial Sequence
  Description of Artificial Sequence: Synthetic oligonucleotide
  Target: ATXN1; (+) strand; PAM type: YTN; PAM sequence: TTG
ttttgttttttgtttttttg

SEQ ID NO: 254616 - DNA, 20 bp, Artificial Sequence
  Description of Artificial Sequence: Synthetic oligonucleotide
  Target: ATXN1; (+) strand; PAM type: YTN; PAM sequence: TTT
tgttttttgtttttttgttt

SEQ ID NO: 254617 - DNA, 20 bp, Artificial Sequence
  Description of Artificial Sequence: Synthetic oligonucleotide
  Target: ATXN1; (+) strand; PAM type: YTN; PAM sequence: TTT
gttttttgtttttttgtttt

SEQ ID NO: 254618 - DNA, 20 bp, Artificial Sequence
  Description of Artificial Sequence: Synthetic oligonucleotide
  Target: ATXN1; (+) strand; PAM type: YTN; PAM sequence: TTG
ttttttgtttttttgttttt

SEQ ID NO: 254619 - DNA, 20 bp, Artificial Sequence
  Description of Artificial Sequence: Synthetic oligonucleotide
  Target: ATXN1; (+) strand; PAM type: YTN; PAM sequence: TTT
tttgtttttttgttttttgt

SEQ ID NO: 254620 - DNA, 20 bp, Artificial Sequence
  Description of Artificial Sequence: Synthetic oligonucleotide
  Target: ATXN1; (+) strand; PAM type: YTN; PAM sequence: TTT
ttgtttttttgttttttgtt

SEQ ID NO: 254621 - DNA, 20 bp, Artificial Sequence
  Description of Artificial Sequence: Synthetic oligonucleotide
  Target: ATXN1; (+) strand; PAM type: YTN; PAM sequence: TTT
tgtttttttgttttttgttt

SEQ ID NO: 254622 - DNA, 20 bp, Artificial Sequence
  Description of Artificial Sequence: Synthetic oligonucleotide
  Target: ATXN1; (+) strand; PAM type: YTN; PAM sequence: TTT
gtttttttgttttttgtttt

SEQ ID NO: 254623 - DNA, 20 bp, Artificial Sequence
  Description of Artificial Sequence: Synthetic oligonucleotide
  Target: ATXN1; (+) strand; PAM type: YTN; PAM sequence: TTG
tttttttgttttttgttttt

SEQ ID NO: 254624 - DNA, 20 bp, Artificial Sequence
  Description of Artificial Sequence: Synthetic oligonucleotide
  Target: ATXN1; (+) strand; PAM type: YTN; PAM sequence: TTT
ttttgttttttgtttttttg

SEQ ID NO: 254625 - DNA, 20 bp, Artificial Sequence
  Description of Artificial Sequence: Synthetic oligonucleotide
  Target: ATXN1; (+) strand; PAM type: YTN; PAM sequence: TTT
tttgttttttgtttttttga

SEQ ID NO: 254626 - DNA, 20 bp, Artificial Sequence
  Description of Artificial Sequence: Synthetic oligonucleotide
  Target: ATXN1; (+) strand; PAM type: YTN; PAM sequence: TTT
ttgttttttgtttttttgag

SEQ ID NO: 254627 - DNA, 20 bp, Artificial Sequence
  Description of Artificial Sequence: Synthetic oligonucleotide
  Target: ATXN1; (+) strand; PAM type: YTN; PAM sequence: TTT
tgttttttgtttttttgaga

SEQ ID NO: 254628 - DNA, 20 bp, Artificial Sequence
  Description of Artificial Sequence: Synthetic oligonucleotide
  Target: ATXN1; (+) strand; PAM type: YTN; PAM sequence: TTT
gttttttgtttttttgagat

SEQ ID NO: 254629 - DNA, 20 bp, Artificial Sequence
  Description of Artificial Sequence: Synthetic oligonucleotide
  Target: ATXN1; (+) strand; PAM type: YTN; PAM sequence: TTG
ttttttgtttttttgagatg

SEQ ID NO: 254630 - DNA, 20 bp, Artificial Sequence
  Description of Artificial Sequence: Synthetic oligonucleotide
  Target: ATXN1; (+) strand; PAM type: YTN; PAM sequence: TTT
tttgtttttttgagatgaag

SEQ ID NO: 254631 - DNA, 20 bp, Artificial Sequence
  Description of Artificial Sequence: Synthetic oligonucleotide
  Target: ATXN1; (+) strand; PAM type: YTN; PAM sequence: TTT
ttgtttttttgagatgaagt

SEQ ID NO: 254632 - DNA, 20 bp, Artificial Sequence
  Description of Artificial Sequence: Synthetic oligonucleotide
  Target: ATXN1; (+) strand; PAM type: YTN; PAM sequence: TTT
tgtttttttgagatgaagtc

SEQ ID NO: 254633 - DNA, 20 bp, Artificial Sequence
  Description of Artificial Sequence: Synthetic oligonucleotide
  Target: ATXN1; (+) strand; PAM type: YTN; PAM sequence: TTT
gtttttttgagatgaagtct

SEQ ID NO: 254634 - DNA, 20 bp, Artificial Sequence
  Description of Artificial Sequence: Synthetic oligonucleotide
  Target: ATXN1; (+) strand; PAM type: YTN; PAM sequence: TTG
tttttttgagatgaagtctc

SEQ ID NO: 254635 - DNA, 20 bp, Artificial Sequence
  Description of Artificial Sequence: Synthetic oligonucleotide
  Target: ATXN1; (+) strand; PAM type: YTN; PAM sequence: TTT
ttttgagatgaagtctcgtt

SEQ ID NO: 254636 - DNA, 20 bp, Artificial Sequence
  Description of Artificial Sequence: Synthetic oligonucleotide
  Target: ATXN1; (+) strand; PAM type: YTN; PAM sequence: TTT
tttgagatgaagtctcgttc

SEQ ID NO: 254637 - DNA, 20 bp, Artificial Sequence
  Description of Artificial Sequence: Synthetic oligonucleotide
  Target: ATXN1; (+) strand; PAM type: YTN; PAM sequence: TTT
ttgagatgaagtctcgttct

SEQ ID NO: 254638 - DNA, 20 bp, Artificial Sequence
  Description of Artificial Sequence: Synthetic oligonucleotide
  Target: ATXN1; (+) strand; PAM type: YTN; PAM sequence: TTT
tgagatgaagtctcgttctg

SEQ ID NO: 254639 - DNA, 20 bp, Artificial Sequence
  Description of Artificial Sequence: Synthetic oligonucleotide
  Target: ATXN1; (+) strand; PAM type: YTN; PAM sequence: TTT
gagatgaagtctcgttctgt

SEQ ID NO: 254640 - DNA, 20 bp, Artificial Sequence
  Description of Artificial Sequence: Synthetic oligonucleotide
  Target: ATXN1; (+) strand; PAM type: YTN; PAM sequence: TTG
agatgaagtctcgttctgtc

SEQ ID NO: 254641 - DNA, 20 bp, Artificial Sequence
  Description of Artificial Sequence: Synthetic oligonucleotide
  Target: ATXN1; (+) strand; PAM type: YTN; PAM sequence: CTC
gttctgtcatccaggctgga

SEQ ID NO: 254642 - DNA, 20 bp, Artificial Sequence
  Description of Artificial Sequence: Synthetic oligonucleotide
  Target: ATXN1; (+) strand; PAM type: YTN; PAM sequence: TTC
tgtcatccaggctggagtgc

SEQ ID NO: 254643 - DNA, 20 bp, Artificial Sequence
  Description of Artificial Sequence: Synthetic oligonucleotide
  Target: ATXN1; (+) strand; PAM type: YTN; PAM sequence: CTG
tcatccaggctggagtgcaa

SEQ ID NO: 254644 - DNA, 20 bp, Artificial Sequence
  Description of Artificial Sequence: Synthetic oligonucleotide
  Target: ATXN1; (+) strand; PAM type: YTN; PAM sequence: CTG
gagtgcaatggcacgatctt

SEQ ID NO: 254645 - DNA, 20 bp, Artificial Sequence
  Description of Artificial Sequence: Synthetic oligonucleotide
  Target: ATXN1; (+) strand; PAM type: YTN; PAM sequence: CTT
ggctcactgcaacctccacc

SEQ ID NO: 254646 - DNA, 20 bp, Artificial Sequence
  Description of Artificial Sequence: Synthetic oligonucleotide
  Target: ATXN1; (+) strand; PAM type: YTN; PAM sequence: TTG
gctcactgcaacctccacct

SEQ ID NO: 254647 - DNA, 20 bp, Artificial Sequence
  Description of Artificial Sequence: Synthetic oligonucleotide
  Target: ATXN1; (+) strand; PAM type: YTN; PAM sequence: CTC
actgcaacctccacctccaa

SEQ ID NO: 254648 - DNA, 20 bp, Artificial Sequence
  Description of Artificial Sequence: Synthetic oligonucleotide
  Target: ATXN1; (+) strand; PAM type: YTN; PAM sequence: CTG
caacctccacctccaagtga

SEQ ID NO: 254649 - DNA, 20 bp, Artificial Sequence
  Description of Artificial Sequence: Synthetic oligonucleotide
  Target: ATXN1; (+) strand; PAM type: YTN; PAM sequence: CTC
cacctccaagtgattctcct

SEQ ID NO: 254650 - DNA, 20 bp, Artificial Sequence
  Description of Artificial Sequence: Synthetic oligonucleotide
  Target: ATXN1; (+) strand; PAM type: YTN; PAM sequence: CTC
caagtgattctcctgcttca

SEQ ID NO: 254651 - DNA, 20 bp, Artificial Sequence
  Description of Artificial Sequence: Synthetic oligonucleotide
  Target: ATXN1; (+) strand; PAM type: YTN; PAM sequence: TTC
tcctgcttcagcctcccgag

SEQ ID NO: 254652 - DNA, 20 bp, Artificial Sequence
  Description of Artificial Sequence: Synthetic oligonucleotide
  Target: ATXN1; (+) strand; PAM type: YTN; PAM sequence: CTC
ctgcttcagcctcccgagta

SEQ ID NO: 254653 - DNA, 20 bp, Artificial Sequence
  Description of Artificial Sequence: Synthetic oligonucleotide
  Target: ATXN1; (+) strand; PAM type: YTN; PAM sequence: CTG
cttcagcctcccgagtagct

SEQ ID NO: 254654 - DNA, 20 bp, Artificial Sequence
  Description of Artificial Sequence: Synthetic oligonucleotide
  Target: ATXN1; (+) strand; PAM type: YTN; PAM sequence: CTT
cagcctcccgagtagctgga

SEQ ID NO: 254655 - DNA, 20 bp, Artificial Sequence
  Description of Artificial Sequence: Synthetic oligonucleotide
  Target: ATXN1; (+) strand; PAM type: YTN; PAM sequence: TTC
agcctcccgagtagctggaa

SEQ ID NO: 254656 - DNA, 20 bp, Artificial Sequence
  Description of Artificial Sequence: Synthetic oligonucleotide
  Target: ATXN1; (+) strand; PAM type: YTN; PAM sequence: CTC
ccgagtagctggaattacag

SEQ ID NO: 254657 - DNA, 20 bp, Artificial Sequence
  Description of Artificial Sequence: Synthetic oligonucleotide
  Target: ATXN1; (+) strand; PAM type: YTN; PAM sequence: CTG
gaattacaggtgcccaccac

SEQ ID NO: 254658 - DNA, 20 bp, Artificial Sequence
  Description of Artificial Sequence: Synthetic oligonucleotide
  Target: ATXN1; (+) strand; PAM type: YTN; PAM sequence: TTA
caggtgcccaccaccatgcc

SEQ ID NO: 254659 - DNA, 20 bp, Artificial Sequence
  Description of Artificial Sequence: Synthetic oligonucleotide
  Target: ATXN1; (+) strand; PAM type: YTN; PAM sequence: CTA
gtatttatatttttagtaga

SEQ ID NO: 254660 - DNA, 20 bp, Artificial Sequence
  Description of Artificial Sequence: Synthetic oligonucleotide
  Target: ATXN1; (+) strand; PAM type: YTN; PAM sequence: TTT
atatttttagtagagatggg

SEQ ID NO: 254661 - DNA, 20 bp, Artificial Sequence
  Description of Artificial Sequence: Synthetic oligonucleotide
  Target: ATXN1; (+) strand; PAM type: YTN; PAM sequence: TTA
tatttttagtagagatgggg

SEQ ID NO: 254662 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatggggtttca

SEQ ID NO: 254663 - DNA, 20 bp, Artificial Sequence
  Description of Artificial Sequence: Synthetic oligonucleotide
  Target: ATXN1; (+) strand; PAM type: YTN; PAM sequence: TTT
tagtagagatggggtttcac

SEQ ID NO: 254664 - DNA, 20 bp, Artificial Sequence
  Description of Artificial Sequence: Synthetic oligonucleotide
  Target: ATXN1; (+) strand; PAM type: YTN; PAM sequence: TTT
agtagagatggggtttcact

SEQ ID NO: 254665 - DNA, 20 bp, Artificial Sequence
  Description of Artificial Sequence: Synthetic oligonucleotide
  Target: ATXN1; (+) strand; PAM type: YTN; PAM sequence: TTA
gtagagatggggtttcacta

SEQ ID NO: 254666 - DNA, 20 bp, Artificial Sequence
  Description of Artificial Sequence: Synthetic oligonucleotide
  Target: ATXN1; (+) strand; PAM type: YTN; PAM sequence: TTT
cactatgttggccaggctgg

SEQ ID NO: 254667 - DNA, 20 bp, Artificial Sequence
  Description of Artificial Sequence: Synthetic oligonucleotide
  Target: ATXN1; (+) strand; PAM type: YTN; PAM sequence: TTC
actatgttggccaggctggt

SEQ ID NO: 254668 - DNA, 20 bp, Artificial Sequence
  Description of Artificial Sequence: Synthetic oligonucleotide
  Target: ATXN1; (+) strand; PAM type: YTN; PAM sequence: CTA
tgttggccaggctggtctca

SEQ ID NO: 254669 - DNA, 20 bp, Artificial Sequence
  Description of Artificial Sequence: Synthetic oligonucleotide
  Target: ATXN1; (+) strand; PAM type: YTN; PAM sequence: TTG
gccaggctggtctcaaactc

SEQ ID NO: 254670 - DNA, 20 bp, Artificial Sequence
  Description of Artificial Sequence: Synthetic oligonucleotide
  Target: ATXN1; (+) strand; PAM type: YTN; PAM sequence: CTG
gtctcaaactcctgacctca

SEQ ID NO: 254671 - DNA, 20 bp, Artificial Sequence
  Description of Artificial Sequence: Synthetic oligonucleotide
  Target: ATXN1; (+) strand; PAM type: YTN; PAM sequence: CTC
aaactcctgacctcaggtga

SEQ ID NO: 254672 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggtgatctgcc

SEQ ID NO: 254673 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatctgcctgc

SEQ ID NO: 254674 - DNA, 20 bp, Artificial Sequence
  Description of Artificial Sequence: Synthetic oligonucleotide
  Target: ATXN1; (+) strand; PAM type: YTN; PAM sequence: CTC
aggtgatctgcctgcctcag

SEQ ID NO: 254675 - DNA, 20 bp, Artificial Sequence
  Description of Artificial Sequence: Synthetic oligonucleotide
  Target: ATXN1; (+) strand; PAM type: YTN; PAM sequence: CTG
cctgcctcagcctctcaaag

SEQ ID NO: 254676 - DNA, 20 bp, Artificial Sequence
  Description of Artificial Sequence: Synthetic oligonucleotide
  Target: ATXN1; (+) strand; PAM type: YTN; PAM sequence: CTG
cctcagcctctcaaagtgcc

SEQ ID NO: 254677 - DNA, 20 bp, Artificial Sequence
  Description of Artificial Sequence: Synthetic oligonucleotide
  Target: ATXN1; (+) strand; PAM type: YTN; PAM sequence: CTC
agcctctcaaagtgccactg

SEQ ID NO: 254678 - DNA, 20 bp, Artificial Sequence
  Description of Artificial Sequence: Synthetic oligonucleotide
  Target: ATXN1; (+) strand; PAM type: YTN; PAM sequence: CTC
tcaaagtgccactgtgcccg

SEQ ID NO: 254679 - DNA, 20 bp, Artificial Sequence
  Description of Artificial Sequence: Synthetic oligonucleotide
  Target: ATXN1; (+) strand; PAM type: YTN; PAM sequence: CTC
aaagtgccactgtgcccggc

SEQ ID NO: 254680 - DNA, 20 bp, Artificial Sequence
  Description of Artificial Sequence: Synthetic oligonucleotide
  Target: ATXN1; (+) strand; PAM type: YTN; PAM sequence: CTG
tgcccggccgccagtagtag

SEQ ID NO: 254681 - DNA, 20 bp, Artificial Sequence
  Description of Artificial Sequence: Synthetic oligonucleotide
  Target: ATXN1; (+) strand; PAM type: YTN; PAM sequence: CTA
aacttttatcagcacactgc

SEQ ID NO: 254682 - DNA, 20 bp, Artificial Sequence
  Description of Artificial Sequence: Synthetic oligonucleotide
  Target: ATXN1; (+) strand; PAM type: YTN; PAM sequence: CTT
ttatcagcacactgctggta

SEQ ID NO: 254683 - DNA, 20 bp, Artificial Sequence
  Description of Artificial Sequence: Synthetic oligonucleotide
  Target: ATXN1; (+) strand; PAM type: YTN; PAM sequence: TTT
tatcagcacactgctggtat

SEQ ID NO: 254684 - DNA, 20 bp, Artificial Sequence
  Description of Artificial Sequence: Synthetic oligonucleotide
  Target: ATXN1; (+) strand; PAM type: YTN; PAM sequence: TTT
atcagcacactgctggtatc

SEQ ID NO: 254685 - DNA, 20 bp, Artificial Sequence
  Description of Artificial Sequence: Synthetic oligonucleotide
  Target: ATXN1; (+) strand; PAM type: YTN; PAM sequence: TTA
tcagcacactgctggtatcc

SEQ ID NO: 254686 - DNA, 20 bp, Artificial Sequence
  Description of Artificial Sequence: Synthetic oligonucleotide
  Target: ATXN1; (+) strand; PAM type: YTN; PAM sequence: CTG
ctggtatccattccaacttt

SEQ ID NO: 254687 - DNA, 20 bp, Artificial Sequence
  Description of Artificial Sequence: Synthetic oligonucleotide
  Target: ATXN1; (+) strand; PAM type: YTN; PAM sequence: CTG
gtatccattccaactttttc

SEQ ID NO: 254688 - DNA, 20 bp, Artificial Sequence
  Description of Artificial Sequence: Synthetic oligonucleotide
  Target: ATXN1; (+) strand; PAM type: YTN; PAM sequence: TTC
caactttttcttaagtgaaa

SEQ ID NO: 254689 - DNA, 20 bp, Artificial Sequence
  Description of Artificial Sequence: Synthetic oligonucleotide
  Target: ATXN1; (+) strand; PAM type: YTN; PAM sequence: CTT
tttcttaagtgaaatagaac

SEQ ID NO: 254690 - DNA, 20 bp, Artificial Sequence
  Description of Artificial Sequence: Synthetic oligonucleotide
  Target: ATXN1; (+) strand; PAM type: YTN; PAM sequence: TTT
ttcttaagtgaaatagaact

SEQ ID NO: 254691 - DNA, 20 bp, Artificial Sequence
  Description of Artificial Sequence: Synthetic oligonucleotide
  Target: ATXN1; (+) strand; PAM type: YTN; PAM sequence: TTT
tcttaagtgaaatagaacta

SEQ ID NO: 254692 - DNA, 20 bp, Artificial Sequence
  Description of Artificial Sequence: Synthetic oligonucleotide
  Target: ATXN1; (+) strand; PAM type: YTN; PAM sequence: TTT
cttaagtgaaatagaactag

SEQ ID NO: 254693 - DNA, 20 bp, Artificial Sequence
  Description of Artificial Sequence: Synthetic oligonucleotide
  Target: ATXN1; (+) strand; PAM type: YTN; PAM sequence: TTC
ttaagtgaaatagaactagg

SEQ ID NO: 254694 - DNA, 20 bp, Artificial Sequence
  Description of Artificial Sequence: Synthetic oligonucleotide
  Target: ATXN1; (+) strand; PAM type: YTN; PAM sequence: CTT
aagtgaaatagaactagggg

SEQ ID NO: 254695 - DNA, 20 bp, Artificial Sequence
  Description of Artificial Sequence: Synthetic oligonucleotide
  Target: ATXN1; (+) strand; PAM type: YTN; PAM sequence: TTA
agtgaaatagaactagggga

SEQ ID NO: 254696 - DNA, 20 bp, Artificial Sequence
  Description of Artificial Sequence: Synthetic oligonucleotide
  Target: ATXN1; (+) strand; PAM type: YTN; PAM sequence: CTA
ggggagaacagtaggaatag

SEQ ID NO: 254697 - DNA, 20 bp, Artificial Sequence
  Description of Artificial Sequence: Synthetic oligonucleotide
  Target: ATXN1; (+) strand; PAM type: YTN; PAM sequence: CTT
tccatgattacatgtgcagg

SEQ ID NO: 254698 - DNA, 20 bp, Artificial Sequence
  Description of Artificial Sequence: Synthetic oligonucleotide
  Target: ATXN1; (+) strand; PAM type: YTN; PAM sequence: TTT
ccatgattacatgtgcaggt

SEQ ID NO: 254699 - DNA, 20 bp, Artificial Sequence
  Description of Artificial Sequence: Synthetic oligonucleotide
  Target: ATXN1; (+) strand; PAM type: YTN; PAM sequence: TTC
catgattacatgtgcaggta

SEQ ID NO: 254700 - DNA, 20 bp, Artificial Sequence
  Description of Artificial Sequence: Synthetic oligonucleotide
  Target: ATXN1; (+) strand; PAM type: YTN; PAM sequence: TTA
catgtgcaggtacataccac

SEQ ID NO: 254701 - DNA, 20 bp, Artificial Sequence
  Description of Artificial Sequence: Synthetic oligonucleotide
  Target: ATXN1; (+) strand; PAM type: YTN; PAM sequence: TTG
ctgtccagagtttccaacta

SEQ ID NO: 254702 - DNA, 20 bp, Artificial Sequence
  Description of Artificial Sequence: Synthetic oligonucleotide
  Target: ATXN1; (+) strand; PAM type: YTN; PAM sequence: CTG
tccagagtttccaactaatc

SEQ ID NO: 254703 - DNA, 20 bp, Artificial Sequence
  Description of Artificial Sequence: Synthetic oligonucleotide
  Target: ATXN1; (+) strand; PAM type: YTN; PAM sequence: TTT
ccaactaatctattgctgat

SEQ ID NO: 254704 - DNA, 20 bp, Artificial Sequence
  Description of Artificial Sequence: Synthetic oligonucleotide
  Target: ATXN1; (+) strand; PAM type: YTN; PAM sequence: TTC
caactaatctattgctgatt

SEQ ID NO: 254705 - DNA, 20 bp, Artificial Sequence
  Description of Artificial Sequence: Synthetic oligonucleotide
  Target: ATXN1; (+) strand; PAM type: YTN; PAM sequence: CTA
atctattgctgatttactcc

SEQ ID NO: 254706 - DNA, 20 bp, Artificial Sequence
  Description of Artificial Sequence: Synthetic oligonucleotide
  Target: ATXN1; (+) strand; PAM type: YTN; PAM sequence: CTA
ttgctgatttactccctctg

SEQ ID NO: 254707 - DNA, 20 bp, Artificial Sequence
  Description of Artificial Sequence: Synthetic oligonucleotide
  Target: ATXN1; (+) strand; PAM type: YTN; PAM sequence: TTG
ctgatttactccctctgttt

SEQ ID NO: 254708 - DNA, 20 bp, Artificial Sequence
  Description of Artificial Sequence: Synthetic oligonucleotide
  Target: ATXN1; (+) strand; PAM type: YTN; PAM sequence: CTG
atttactccctctgtttatc

SEQ ID NO: 254709 - DNA, 20 bp, Artificial Sequence
  Description of Artificial Sequence: Synthetic oligonucleotide
  Target: ATXN1; (+) strand; PAM type: YTN; PAM sequence: TTT
actccctctgtttatctgct

SEQ ID NO: 254710 - DNA, 20 bp, Artificial Sequence
  Description of Artificial Sequence: Synthetic oligonucleotide
  Target: ATXN1; (+) strand; PAM type: YTN; PAM sequence: TTA
ctccctctgtttatctgcta

SEQ ID NO: 254711 - DNA, 20 bp, Artificial Sequence
  Description of Artificial Sequence: Synthetic oligonucleotide
  Target: ATXN1; (+) strand; PAM type: YTN; PAM sequence: CTC
cctctgtttatctgctactg

SEQ ID NO: 254712 - DNA, 20 bp, Artificial Sequence
  Description of Artificial Sequence: Synthetic oligonucleotide
  Target: ATXN1; (+) strand; PAM type: YTN; PAM sequence: CTC
tgtttatctgctactgaaat

SEQ ID NO: 254713 - DNA, 20 bp, Artificial Sequence
  Description of Artificial Sequence: Synthetic oligonucleotide
  Target: ATXN1; (+) strand; PAM type: YTN; PAM sequence: CTG
tttatctgctactgaaatca

SEQ ID NO: 254714 - DNA, 20 bp, Artificial Sequence
  Description of Artificial Sequence: Synthetic oligonucleotide
  Target: ATXN1; (+) strand; PAM type: YTN; PAM sequence: TTT
atctgctactgaaatcagtc

SEQ ID NO: 254715 - DNA, 20 bp, Artificial Sequence
  Description of Artificial Sequence: Synthetic oligonucleotide
  Target: ATXN1; (+) strand; PAM type: YTN; PAM sequence: TTA
tctgctactgaaatcagtct

SEQ ID NO: 254716 - DNA, 20 bp, Artificial Sequence
  Description of Artificial Sequence: Synthetic oligonucleotide
  Target: ATXN1; (+) strand; PAM type: YTN; PAM sequence: CTG
ctactgaaatcagtctgact

SEQ ID NO: 254717 - DNA, 20 bp, Artificial Sequence
  Description of Artificial Sequence: Synthetic oligonucleotide
  Target: ATXN1; (+) strand; PAM type: YTN; PAM sequence: CTA
ctgaaatcagtctgactcag

SEQ ID NO: 254718 - DNA, 20 bp, Artificial Sequence
  Description of Artificial Sequence: Synthetic oligonucleotide
  Target: ATXN1; (+) strand; PAM type: YTN; PAM sequence: CTG
aaatcagtctgactcagaaa

SEQ ID NO: 254719 - DNA, 20 bp, Artificial Sequence
  Description of Artificial Sequence: Synthetic oligonucleotide
  Target: ATXN1; (+) strand; PAM type: YTN; PAM sequence: CTG
actcagaaatgtaattgtat

SEQ ID NO: 254720 - DNA, 20 bp, Artificial Sequence
  Description of Artificial Sequence: Synthetic oligonucleotide
  Target: ATXN1; (+) strand; PAM type: YTN; PAM sequence: CTC
agaaatgtaattgtatgtgt

SEQ ID NO: 254721 - DNA, 20 bp, Artificial Sequence
  Description of Artificial Sequence: Synthetic oligonucleotide
  Target: ATXN1; (+) strand; PAM type: YTN; PAM sequence: TTG
tatgtgtgttggcaagaact

SEQ ID NO: 254722 - DNA, 20 bp, Artificial Sequence
  Description of Artificial Sequence: Synthetic oligonucleotide
  Target: ATXN1; (+) strand; PAM type: YTN; PAM sequence: TTG
gcaagaactcacacaagaat

SEQ ID NO: 254723 - DNA, 20 bp, Artificial Sequence
  Description of Artificial Sequence: Synthetic oligonucleotide
  Target: ATXN1; (+) strand; PAM type: YTN; PAM sequence: CTC
acacaagaatactatcttca

SEQ ID NO: 254724 - DNA, 20 bp, Artificial Sequence
  Description of Artificial Sequence: Synthetic oligonucleotide
  Target: ATXN1; (+) strand; PAM type: YTN; PAM sequence: CTA
tcttcaagaacaaaaacgcc

SEQ ID NO: 254725 - DNA, 20 bp, Artificial Sequence
  Description of Artificial Sequence: Synthetic oligonucleotide
  Target: ATXN1; (+) strand; PAM type: YTN; PAM sequence: CTT
caagaacaaaaacgccactg

SEQ ID NO: 254726 - DNA, 20 bp, Artificial Sequence
  Description of Artificial Sequence: Synthetic oligonucleotide
  Target: ATXN1; (+) strand; PAM type: YTN; PAM sequence: TTC
aagaacaaaaacgccactgg

SEQ ID NO: 254727 - DNA, 20 bp, Artificial Sequence
  Description of Artificial Sequence: Synthetic oligonucleotide
  Target: ATXN1; (+) strand; PAM type: YTN; PAM sequence: CTG
gatatttgtatcatccttca

SEQ ID NO: 254728 - DNA, 20 bp, Artificial Sequence
  Description of Artificial Sequence: Synthetic oligonucleotide
  Target: ATXN1; (+) strand; PAM type: YTN; PAM sequence: TTT
gtatcatccttcaccacggc

SEQ ID NO: 254729 - DNA, 20 bp, Artificial Sequence
  Description of Artificial Sequence: Synthetic oligonucleotide
  Target: ATXN1; (+) strand; PAM type: YTN; PAM sequence: TTG
tatcatccttcaccacggcc

SEQ ID NO: 254730 - DNA, 20 bp, Artificial Sequence
  Description of Artificial Sequence: Synthetic oligonucleotide
  Target: ATXN1; (+) strand; PAM type: YTN; PAM sequence: CTT
caccacggccacagaatttg

SEQ ID NO: 254731 - DNA, 20 bp, Artificial Sequence
  Description of Artificial Sequence: Synthetic oligonucleotide
  Target: ATXN1; (+) strand; PAM type: YTN; PAM sequence: TTC
accacggccacagaatttga

SEQ ID NO: 254732 - DNA, 20 bp, Artificial Sequence
  Description of Artificial Sequence: Synthetic oligonucleotide
  Target: ATXN1; (+) strand; PAM type: YTN; PAM sequence: TTT
gacggattacctcattaact

SEQ ID NO: 254733 - DNA, 20 bp, Artificial Sequence
  Description of Artificial Sequence: Synthetic oligonucleotide
  Target: ATXN1; (+) strand; PAM type: YTN; PAM sequence: TTG
acggattacctcattaactc

SEQ ID NO: 254734 - DNA, 20 bp, Artificial Sequence
  Description of Artificial Sequence: Synthetic oligonucleotide
  Target: ATXN1; (+) strand; PAM type: YTN; PAM sequence: TTA
cctcattaactcctcgcaac

SEQ ID NO: 254735 - DNA, 20 bp, Artificial Sequence
  Description of Artificial Sequence: Synthetic oligonucleotide
  Target: ATXN1; (+) strand; PAM type: YTN; PAM sequence: CTC
attaactcctcgcaaccatt

SEQ ID NO: 254736 - DNA, 20 bp, Artificial Sequence
  Description of Artificial Sequence: Synthetic oligonucleotide
  Target: ATXN1; (+) strand; PAM type: YTN; PAM sequence: TTA
actcctcgcaaccattgcta

SEQ ID NO: 254737 - DNA, 20 bp, Artificial Sequence
  Description of Artificial Sequence: Synthetic oligonucleotide
  Target: ATXN1; (+) strand; PAM type: YTN; PAM sequence: CTC
ctcgcaaccattgctatgtt

SEQ ID NO: 254738 - DNA, 20 bp, Artificial Sequence
  Description of Artificial Sequence: Synthetic oligonucleotide
  Target: ATXN1; (+) strand; PAM type: YTN; PAM sequence: CTC
gcaaccattgctatgttgag

SEQ ID NO: 254739 - DNA, 20 bp, Artificial Sequence
  Description of Artificial Sequence: Synthetic oligonucleotide
  Target: ATXN1; (+) strand; PAM type: YTN; PAM sequence: TTG
ctatgttgagtttcattgtc

SEQ ID NO: 254740 - DNA, 20 bp, Artificial Sequence
  Description of Artificial Sequence: Synthetic oligonucleotide
  Target: ATXN1; (+) strand; PAM type: YTN; PAM sequence: CTA
tgttgagtttcattgtccct

SEQ ID NO: 254741 - DNA, 20 bp, Artificial Sequence
  Description of Artificial Sequence: Synthetic oligonucleotide
  Target: ATXN1; (+) strand; PAM type: YTN; PAM sequence: TTG
agtttcattgtccctgtttg

SEQ ID NO: 254742 - DNA, 20 bp, Artificial Sequence
  Description of Artificial Sequence: Synthetic oligonucleotide
  Target: ATXN1; (+) strand; PAM type: YTN; PAM sequence: TTT
cattgtccctgtttgacagg

SEQ ID NO: 254743 - DNA, 20 bp, Artificial Sequence
  Description of Artificial Sequence: Synthetic oligonucleotide
  Target: ATXN1; (+) strand; PAM type: YTN; PAM sequence: TTC
attgtccctgtttgacaggt

SEQ ID NO: 254744 - DNA, 20 bp, Artificial Sequence
  Description of Artificial Sequence: Synthetic oligonucleotide
  Target: ATXN1; (+) strand; PAM type: YTN; PAM sequence: TTG
tccctgtttgacaggtgaga

SEQ ID NO: 254745 - DNA, 20 bp, Artificial Sequence
  Description of Artificial Sequence: Synthetic oligonucleotide
  Target: ATXN1; (+) strand; PAM type: YTN; PAM sequence: CTG
tttgacaggtgagattaggt

SEQ ID NO: 254746 - DNA, 20 bp, Artificial Sequence
  Description of Artificial Sequence: Synthetic oligonucleotide
  Target: ATXN1; (+) strand; PAM type: YTN; PAM sequence: TTT
gacaggtgagattaggtgat

SEQ ID NO: 254747 - DNA, 20 bp, Artificial Sequence
  Description of Artificial Sequence: Synthetic oligonucleotide
  Target: ATXN1; (+) strand; PAM type: YTN; PAM sequence: TTG
acaggtgagattaggtgatc

SEQ ID NO: 254748 - DNA, 20 bp, Artificial Sequence
  Description of Artificial Sequence: Synthetic oligonucleotide
  Target: ATXN1; (+) strand; PAM type: YTN; PAM sequence: TTA
ggtgatctgtccaaggccac

SEQ ID NO: 254749 - DNA, 20 bp, Artificial Sequence
  Description of Artificial Sequence: Synthetic oligonucleotide
  Target: ATXN1; (+) strand; PAM type: YTN; PAM sequence: CTG
tccaaggccacatatctagt

SEQ ID NO: 254750 - DNA, 20 bp, Artificial Sequence
  Description of Artificial Sequence: Synthetic oligonucleotide
  Target: ATXN1; (+) strand; PAM type: YTN; PAM sequence: CTA
gtaagttgcatagacaggac

SEQ ID NO: 254751 - DNA, 20 bp, Artificial Sequence
  Description of Artificial Sequence: Synthetic oligonucleotide
  Target: ATXN1; (+) strand; PAM type: YTN; PAM sequence: TTG
catagacaggactcaaatcc

SEQ ID NO: 254752 - DNA, 20 bp, Artificial Sequence
  Description of Artificial Sequence: Synthetic oligonucleotide
  Target: ATXN1; (+) strand; PAM type: YTN; PAM sequence: CTC
aaatccagaaatccaaatct

SEQ ID NO: 254753 - DNA, 20 bp, Artificial Sequence
  Description of Artificial Sequence: Synthetic oligonucleotide
  Target: ATXN1; (+) strand; PAM type: YTN; PAM sequence: CTT
gtattctttagactttacca

SEQ ID NO: 254754 - DNA, 20 bp, Artificial Sequence
  Description of Artificial Sequence: Synthetic oligonucleotide
  Target: ATXN1; (+) strand; PAM type: YTN; PAM sequence: TTG
tattctttagactttaccac

SEQ ID NO: 254755 - DNA, 20 bp, Artificial Sequence
  Description of Artificial Sequence: Synthetic oligonucleotide
  Target: ATXN1; (+) strand; PAM type: YTN; PAM sequence: TTC
tttagactttaccacaggtt

SEQ ID NO: 254756 - DNA, 20 bp, Artificial Sequence
  Description of Artificial Sequence: Synthetic oligonucleotide
  Target: ATXN1; (+) strand; PAM type: YTN; PAM sequence: CTT
tagactttaccacaggttat

SEQ ID NO: 254757 - DNA, 20 bp, Artificial Sequence
  Description of Artificial Sequence: Synthetic oligonucleotide
  Target: ATXN1; (+) strand; PAM type: YTN; PAM sequence: TTT
agactttaccacaggttatt

SEQ ID NO: 254758 - DNA, 20 bp, Artificial Sequence
  Description of Artificial Sequence: Synthetic oligonucleotide
  Target: ATXN1; (+) strand; PAM type: YTN; PAM sequence: TTA
gactttaccacaggttattg

SEQ ID NO: 254759 - DNA, 20 bp, Artificial Sequence
  Description of Artificial Sequence: Synthetic oligonucleotide
  Target: ATXN1; (+) strand; PAM type: YTN; PAM sequence: CTT
taccacaggttattgctttt

SEQ ID NO: 254760 - DNA, 20 bp, Artificial Sequence
  Description of Artificial Sequence: Synthetic oligonucleotide
  Target: ATXN1; (+) strand; PAM type: YTN; PAM sequence: TTT
accacaggttattgctttta

SEQ ID NO: 254761 - DNA, 20 bp, Artificial Sequence
  Description of Artificial Sequence: Synthetic oligonucleotide
  Target: ATXN1; (+) strand; PAM type: YTN; PAM sequence: TTA
ccacaggttattgcttttat

SEQ ID NO: 254762 - DNA, 20 bp, Artificial Sequence
  Description of Artificial Sequence: Synthetic oligonucleotide
  Target: ATXN1; (+) strand; PAM type: YTN; PAM sequence: TTA
ttgcttttatgccaatctgt

SEQ ID NO: 254763 - DNA, 20 bp, Artificial Sequence
  Description of Artificial Sequence: Synthetic oligonucleotide
  Target: ATXN1; (+) strand; PAM type: YTN; PAM sequence: TTG
cttttatgccaatctgtcat

SEQ ID NO: 254764 - DNA, 20 bp, Artificial Sequence
  Description of Artificial Sequence: Synthetic oligonucleotide
  Target: ATXN1; (+) strand; PAM type: YTN; PAM sequence: CTT
ttatgccaatctgtcatgaa

SEQ ID NO: 254765 - DNA, 20 bp, Artificial Sequence
  Description of Artificial Sequence: Synthetic oligonucleotide
  Target: ATXN1; (+) strand; PAM type: YTN; PAM sequence: TTT
tatgccaatctgtcatgaaa

SEQ ID NO: 254766 - DNA, 20 bp, Artificial Sequence
  Description of Artificial Sequence: Synthetic oligonucleotide
  Target: ATXN1; (+) strand; PAM type: YTN; PAM sequence: TTT
atgccaatctgtcatgaaaa

SEQ ID NO: 254767 - DNA, 20 bp, Artificial Sequence
  Description of Artificial Sequence: Synthetic oligonucleotide
  Target: ATXN1; (+) strand; PAM type: YTN; PAM sequence: TTA
tgccaatctgtcatgaaaat

SEQ ID NO: 254768 - DNA, 20 bp, Artificial Sequence
  Description of Artificial Sequence: Synthetic oligonucleotide
  Target: ATXN1; (+) strand; PAM type: YTN; PAM sequence: CTG
tcatgaaaatgggacttttt

SEQ ID NO: 254769 - DNA, 20 bp, Artificial Sequence
  Description of Artificial Sequence: Synthetic oligonucleotide
  Target: ATXN1; (+) strand; PAM type: YTN; PAM sequence: CTT
ttttttcaaaaggtcaacat

SEQ ID NO: 254770 - DNA, 20 bp, Artificial Sequence
  Description of Artificial Sequence: Synthetic oligonucleotide
  Target: ATXN1; (+) strand; PAM type: YTN; PAM sequence: TTT
tttttcaaaaggtcaacatc

SEQ ID NO: 254771 - DNA, 20 bp, Artificial Sequence
  Description of Artificial Sequence: Synthetic oligonucleotide
  Target: ATXN1; (+) strand; PAM type: YTN; PAM sequence: TTT
ttttcaaaaggtcaacatct

SEQ ID NO: 254772 - DNA, 20 bp, Artificial Sequence
  Description of Artificial Sequence: Synthetic oligonucleotide
  Target: ATXN1; (+) strand; PAM type: YTN; PAM sequence: TTT
tttcaaaaggtcaacatctg

SEQ ID NO: 254773 - DNA, 20 bp, Artificial Sequence
  Description of Artificial Sequence: Synthetic oligonucleotide
  Target: ATXN1; (+) strand; PAM type: YTN; PAM sequence: TTT
ttcaaaaggtcaacatctgg

SEQ ID NO: 254774 - DNA, 20 bp, Artificial Sequence
  Description of Artificial Sequence: Synthetic oligonucleotide
  Target: ATXN1; (+) strand; PAM type: YTN; PAM sequence: TTT
tcaaaaggtcaacatctggg

SEQ ID NO: 254775 - DNA, 20 bp, Artificial Sequence
  Description of Artificial Sequence: Synthetic oligonucleotide
  Target: ATXN1; (+) strand; PAM type: YTN; PAM sequence: TTT
caaaaggtcaacatctgggc

SEQ ID NO: 254776 - DNA, 20 bp, Artificial Sequence
  Description of Artificial Sequence: Synthetic oligonucleotide
  Target: ATXN1; (+) strand; PAM type: YTN; PAM sequence: TTC
aaaaggtcaacatctgggct

SEQ ID NO: 254777 - DNA, 20 bp, Artificial Sequence
  Description of Artificial Sequence: Synthetic oligonucleotide
  Target: ATXN1; (+) strand; PAM type: YTN; PAM sequence: CTG
ggctcacttctctccttcct

SEQ ID NO: 254778 - DNA, 20 bp, Artificial Sequence
  Description of Artificial Sequence: Synthetic oligonucleotide
  Target: ATXN1; (+) strand; PAM type: YTN; PAM sequence: CTC
acttctctccttcctttagt

SEQ ID NO: 254779 - DNA, 20 bp, Artificial Sequence
  Description of Artificial Sequence: Synthetic oligonucleotide
  Target: ATXN1; (+) strand; PAM type: YTN; PAM sequence: CTT
ctctccttcctttagttagc

SEQ ID NO: 254780 - DNA, 20 bp, Artificial Sequence
  Description of Artificial Sequence: Synthetic oligonucleotide
  Target: ATXN1; (+) strand; PAM type: YTN; PAM sequence: TTC
tctccttcctttagttagca

SEQ ID NO: 254781 - DNA, 20 bp, Artificial Sequence
  Description of Artificial Sequence: Synthetic oligonucleotide
  Target: ATXN1; (+) strand; PAM type: YTN; PAM sequence: CTC
tccttcctttagttagcaac

SEQ ID NO: 254782 - DNA, 20 bp, Artificial Sequence
  Description of Artificial Sequence: Synthetic oligonucleotide
  Target: ATXN1; (+) strand; PAM type: YTN; PAM sequence: CTC
cttcctttagttagcaacgc

SEQ ID NO: 254783 - DNA, 20 bp, Artificial Sequence
  Description of Artificial Sequence: Synthetic oligonucleotide
  Target: ATXN1; (+) strand; PAM type: YTN; PAM sequence: CTT
cctttagttagcaacgcagc

SEQ ID NO: 254784 - DNA, 20 bp, Artificial Sequence
  Description of Artificial Sequence: Synthetic oligonucleotide
  Target: ATXN1; (+) strand; PAM type: YTN; PAM sequence: TTC
ctttagttagcaacgcagcc

SEQ ID NO: 254785 - DNA, 20 bp, Artificial Sequence
  Description of Artificial Sequence: Synthetic oligonucleotide
  Target: ATXN1; (+) strand; PAM type: YTN; PAM sequence: CTT
tagttagcaacgcagccaac

SEQ ID NO: 254786 - DNA, 20 bp, Artificial Sequence
  Description of Artificial Sequence: Synthetic oligonucleotide
  Target: ATXN1; (+) strand; PAM type: YTN; PAM sequence: TTT
agttagcaacgcagccaact

SEQ ID NO: 254787 - DNA, 20 bp, Artificial Sequence
  Description of Artificial Sequence: Synthetic oligonucleotide
  Target: ATXN1; (+) strand; PAM type: YTN; PAM sequence: TTA
gttagcaacgcagccaactt

SEQ ID NO: 254788 - DNA, 20 bp, Artificial Sequence
  Description of Artificial Sequence: Synthetic oligonucleotide
  Target: ATXN1; (+) strand; PAM type: YTN; PAM sequence: TTA
gcaacgcagccaactttgag

SEQ ID NO: 254789 - DNA, 20 bp, Artificial Sequence
  Description of Artificial Sequence: Synthetic oligonucleotide
  Target: ATXN1; (+) strand; PAM type: YTN; PAM sequence: CTT
tgaggcacccacatctacgt

SEQ ID NO: 254790 - DNA, 20 bp, Artificial Sequence
  Description of Artificial Sequence: Synthetic oligonucleotide
  Target: ATXN1; (+) strand; PAM type: YTN; PAM sequence: TTT
gaggcacccacatctacgtt

SEQ ID NO: 254791 - DNA, 20 bp, Artificial Sequence
  Description of Artificial Sequence: Synthetic oligonucleotide
  Target: ATXN1; (+) strand; PAM type: YTN; PAM sequence: TTG
aggcacccacatctacgttt

SEQ ID NO: 254792 - DNA, 20 bp, Artificial Sequence
  Description of Artificial Sequence: Synthetic oligonucleotide
  Target: ATXN1; (+) strand; PAM type: YTN; PAM sequence: CTA
cgtttacaaatacgaactcc

SEQ ID NO: 254793 - DNA, 20 bp, Artificial Sequence
  Description of Artificial Sequence: Synthetic oligonucleotide
  Target: ATXN1; (+) strand; PAM type: YTN; PAM sequence: TTT
acaaatacgaactccaccat

SEQ ID NO: 254794 - DNA, 20 bp, Artificial Sequence
  Description of Artificial Sequence: Synthetic oligonucleotide
  Target: ATXN1; (+) strand; PAM type: YTN; PAM sequence: TTA
caaatacgaactccaccatc

SEQ ID NO: 254795 - DNA, 20 bp, Artificial Sequence
  Description of Artificial Sequence: Synthetic oligonucleotide
  Target: ATXN1; (+) strand; PAM type: YTN; PAM sequence: CTC
caccatctaagctcccttcc

SEQ ID NO: 254796 - DNA, 20 bp, Artificial Sequence
  Description of Artificial Sequence: Synthetic oligonucleotide
  Target: ATXN1; (+) strand; PAM type: YTN; PAM sequence: CTA
agctcccttcctgcccaaag

SEQ ID NO: 254797 - DNA, 20 bp, Artificial Sequence
  Description of Artificial Sequence: Synthetic oligonucleotide
  Target: ATXN1; (+) strand; PAM type: YTN; PAM sequence: CTC
ccttcctgcccaaaggcaga

SEQ ID NO: 254798 - DNA, 20 bp, Artificial Sequence
  Description of Artificial Sequence: Synthetic oligonucleotide
  Target: ATXN1; (+) strand; PAM type: YTN; PAM sequence: CTT
cctgcccaaaggcagaaatt

SEQ ID NO: 254799 - DNA, 20 bp, Artificial Sequence
  Description of Artificial Sequence: Synthetic oligonucleotide
  Target: ATXN1; (+) strand; PAM type: YTN; PAM sequence: TTC
ctgcccaaaggcagaaatta

SEQ ID NO: 254800 - DNA, 20 bp, Artificial Sequence
  Description of Artificial Sequence: Synthetic oligonucleotide
  Target: ATXN1; (+) strand; PAM type: YTN; PAM sequence: CTG
cccaaaggcagaaattacat

SEQ ID NO: 254801 - DNA, 20 bp, Artificial Sequence
  Description of Artificial Sequence: Synthetic oligonucleotide
  Target: ATXN1; (+) strand; PAM type: YTN; PAM sequence: TTA
catccccactgctgcaacgt

SEQ ID NO: 254802 - DNA, 20 bp, Artificial Sequence
  Description of Artificial Sequence: Synthetic oligonucleotide
  Target: ATXN1; (+) strand; PAM type: YTN; PAM sequence: CTG
ctgcaacgtcttagataaat

SEQ ID NO: 254803 - DNA, 20 bp, Artificial Sequence
  Description of Artificial Sequence: Synthetic oligonucleotide
  Target: ATXN1; (+) strand; PAM type: YTN; PAM sequence: CTG
caacgtcttagataaatcaa

SEQ ID NO: 254804 - DNA, 20 bp, Artificial Sequence
  Description of Artificial Sequence: Synthetic oligonucleotide
  Target: ATXN1; (+) strand; PAM type: YTN; PAM sequence: CTT
agataaatcaaatgcaaaca

SEQ ID NO: 254805 - DNA, 20 bp, Artificial Sequence
  Description of Artificial Sequence: Synthetic oligonucleotide
  Target: ATXN1; (+) strand; PAM type: YTN; PAM sequence: TTA
gataaatcaaatgcaaacac

SEQ ID NO: 254806 - DNA, 20 bp, Artificial Sequence
  Description of Artificial Sequence: Synthetic oligonucleotide
  Target: ATXN1; (+) strand; PAM type: YTN; PAM sequence: CTT
ccacctgaattcctaaagat

SEQ ID NO: 254807 - DNA, 20 bp, Artificial Sequence
  Description of Artificial Sequence: Synthetic oligonucleotide
  Target: ATXN1; (+) strand; PAM type: YTN; PAM sequence: TTC
cacctgaattcctaaagatg

SEQ ID NO: 254808 - DNA, 20 bp, Artificial Sequence
  Description of Artificial Sequence: Synthetic oligonucleotide
  Target: ATXN1; (+) strand; PAM type: YTN; PAM sequence: CTG
aattcctaaagatgtcctag

SEQ ID NO: 254809 - DNA, 20 bp, Artificial Sequence
  Description of Artificial Sequence: Synthetic oligonucleotide
  Target: ATXN1; (+) strand; PAM type: YTN; PAM sequence: TTC
ctaaagatgtcctaggcagg

SEQ ID NO: 254810 - DNA, 20 bp, Artificial Sequence
  Description of Artificial Sequence: Synthetic oligonucleotide
  Target: ATXN1; (+) strand; PAM type: YTN; PAM sequence: CTA
aagatgtcctaggcaggtgg

SEQ ID NO: 254811 - DNA, 20 bp, Artificial Sequence
  Description of Artificial Sequence: Synthetic oligonucleotide
  Target: ATXN1; (+) strand; PAM type: YTN; PAM sequence: CTA
ggcaggtgggcatcattagg

SEQ ID NO: 254812 - DNA, 20 bp, Artificial Sequence
  Description of Artificial Sequence: Synthetic oligonucleotide
  Target: ATXN1; (+) strand; PAM type: YTN; PAM sequence: TTA
ggaagtgttttatactttgt

SEQ ID NO: 254813 - DNA, 20 bp, Artificial Sequence
  Description of Artificial Sequence: Synthetic oligonucleotide
  Target: ATXN1; (+) strand; PAM type: YTN; PAM sequence: TTT
tatactttgtgtctaagtta

SEQ ID NO: 254814 - DNA, 20 bp, Artificial Sequence
  Description of Artificial Sequence: Synthetic oligonucleotide
  Target: ATXN1; (+) strand; PAM type: YTN; PAM sequence: TTT
atactttgtgtctaagttat

SEQ ID NO: 254815 - DNA, 20 bp, Artificial Sequence
  Description of Artificial Sequence: Synthetic oligonucleotide
  Target: ATXN1; (+) strand; PAM type: YTN; PAM sequence: TTA
tactttgtgtctaagttatt

SEQ ID NO: 254816 - DNA, 20 bp, Artificial Sequence
  Description of Artificial Sequence: Synthetic oligonucleotide
  Target: ATXN1; (+) strand; PAM type: YTN; PAM sequence: CTT
tgtgtctaagttattcaaac

SEQ ID NO: 254817 - DNA, 20 bp, Artificial Sequence
  Description of Artificial Sequence: Synthetic oligonucleotide
  Target: ATXN1; (+) strand; PAM type: YTN; PAM sequence: TTT
gtgtctaagttattcaaacc

SEQ ID NO: 254818 - DNA, 20 bp, Artificial Sequence
  Description of Artificial Sequence: Synthetic oligonucleotide
  Target: ATXN1; (+) strand; PAM type: YTN; PAM sequence: TTG
tgtctaagttattcaaaccc

SEQ ID NO: 254819 - DNA, 20 bp, Artificial Sequence
  Description of Artificial Sequence: Synthetic oligonucleotide
  Target: ATXN1; (+) strand; PAM type: YTN; PAM sequence: CTA
agttattcaaacccaaagag

SEQ ID NO: 254820 - DNA, 20 bp, Artificial Sequence
  Description of Artificial Sequence: Synthetic oligonucleotide
  Target: ATXN1; (+) strand; PAM type: YTN; PAM sequence: TTA
ttcaaacccaaagagaagcc

SEQ ID NO: 254821 - DNA, 20 bp, Artificial Sequence
  Description of Artificial Sequence: Synthetic oligonucleotide
  Target: ATXN1; (+) strand; PAM type: YTN; PAM sequence: TTC
aaacccaaagagaagcctaa

SEQ ID NO: 254822 - DNA, 20 bp, Artificial Sequence
  Description of Artificial Sequence: Synthetic oligonucleotide
  Target: ATXN1; (+) strand; PAM type: YTN; PAM sequence: CTA
aggcatctaatttaaattca

SEQ ID NO: 254823 - DNA, 20 bp, Artificial Sequence
  Description of Artificial Sequence: Synthetic oligonucleotide
  Target: ATXN1; (+) strand; PAM type: YTN; PAM sequence: CTA
atttaaattcaaatagaagt

SEQ ID NO: 254824 - DNA, 20 bp, Artificial Sequence
  Description of Artificial Sequence: Synthetic oligonucleotide
  Target: ATXN1; (+) strand; PAM type: YTN; PAM sequence: TTT
aaattcaaatagaagtaatc

SEQ ID NO: 254825 - DNA, 20 bp, Artificial Sequence
  Description of Artificial Sequence: Synthetic oligonucleotide
  Target: ATXN1; (+) strand; PAM type: YTN; PAM sequence: TTA
aattcaaatagaagtaatcg

SEQ ID NO: 254826 - DNA, 20 bp, Artificial Sequence
  Description of Artificial Sequence: Synthetic oligonucleotide
  Target: ATXN1; (+) strand; PAM type: YTN; PAM sequence: TTC
aaatagaagtaatcgtgaat

SEQ ID NO: 254827 - DNA, 20 bp, Artificial Sequence
  Description of Artificial Sequence: Synthetic oligonucleotide
  Target: ATXN1; (+) strand; PAM type: YTN; PAM sequence: TTC
ttgcacttaatggtgaaaat

SEQ ID NO: 254828 - DNA, 20 bp, Artificial Sequence
  Description of Artificial Sequence: Synthetic oligonucleotide
  Target: ATXN1; (+) strand; PAM type: YTN; PAM sequence: CTT
gcacttaatggtgaaaataa

SEQ ID NO: 254829 - DNA, 20 bp, Artificial Sequence
  Description of Artificial Sequence: Synthetic oligonucleotide
  Target: ATXN1; (+) strand; PAM type: YTN; PAM sequence: TTG
cacttaatggtgaaaataat

SEQ ID NO: 254830 - DNA, 20 bp, Artificial Sequence
  Description of Artificial Sequence: Synthetic oligonucleotide
  Target: ATXN1; (+) strand; PAM type: YTN; PAM sequence: CTT
aatggtgaaaataatatata

SEQ ID NO: 254831 - DNA, 20 bp, Artificial Sequence
  Description of Artificial Sequence: Synthetic oligonucleotide
  Target: ATXN1; (+) strand; PAM type: YTN; PAM sequence: TTA
atggtgaaaataatatatat

SEQ ID NO: 254832 - DNA, 20 bp, Artificial Sequence
  Description of Artificial Sequence: Synthetic oligonucleotide
  Target: ATXN1; (+) strand; PAM type: YTN; PAM sequence: TTT
attttacacacacacacatt

SEQ ID NO: 254833 - DNA, 20 bp, Artificial Sequence
  Description of Artificial Sequence: Synthetic oligonucleotide
  Target: ATXN1; (+) strand; PAM type: YTN; PAM sequence: TTA
ttttacacacacacacattt

SEQ ID NO: 254834 - DNA, 20 bp, Artificial Sequence
  Description of Artificial Sequence: Synthetic oligonucleotide
  Target: ATXN1; (+) strand; PAM type: YTN; PAM sequence: TTT
tacacacacacacatttcat

SEQ ID NO: 254835 - DNA, 20 bp, Artificial Sequence
  Description of Artificial Sequence: Synthetic oligonucleotide
  Target: ATXN1; (+) strand; PAM type: YTN; PAM sequence: TTT
acacacacacacatttcatg

SEQ ID NO: 254836 - DNA, 20 bp, Artificial Sequence
  Description of Artificial Sequence: Synthetic oligonucleotide
  Target: ATXN1; (+) strand; PAM type: YTN; PAM sequence: TTA
cacacacacacatttcatga

SEQ ID NO: 254837 - DNA, 20 bp, Artificial Sequence
  Description of Artificial Sequence: Synthetic oligonucleotide
  Target: ATXN1; (+) strand; PAM type: YTN; PAM sequence: TTT
catgagggggaaaacaaact

SEQ ID NO: 254838 - DNA, 20 bp, Artificial Sequence
  Description of Artificial Sequence: Synthetic oligonucleotide
  Target: ATXN1; (+) strand; PAM type: YTN; PAM sequence: TTC
atgagggggaaaacaaacta

SEQ ID NO: 254839 - DNA, 20 bp, Artificial Sequence
  Description of Artificial Sequence: Synthetic oligonucleotide
  Target: ATXN1; (+) strand; PAM type: YTN; PAM sequence: CTA
tatacatacacatatacacg

SEQ ID NO: 254840 - DNA, 20 bp, Artificial Sequence
  Description of Artificial Sequence: Synthetic oligonucleotide
  Target: ATXN1; (+) strand; PAM type: YTN; PAM sequence: CTC
tctatatacacatacatatg

SEQ ID NO: 254841 - DNA, 20 bp, Artificial Sequence
  Description of Artificial Sequence: Synthetic oligonucleotide
  Target: ATXN1; (+) strand; PAM type: YTN; PAM sequence: CTC
tatatacacatacatatgca

SEQ ID NO: 254842 - DNA, 20 bp, Artificial Sequence
  Description of Artificial Sequence: Synthetic oligonucleotide
  Target: ATXN1; (+) strand; PAM type: YTN; PAM sequence: CTA
tatacacatacatatgcaca

SEQ ID NO: 254843 - DNA, 20 bp, Artificial Sequence
  Description of Artificial Sequence: Synthetic oligonucleotide
  Target: ATXN1; (+) strand; PAM type: YTN; PAM sequence: TTT
tgtgagtgtgtatgtgtgtg

SEQ ID NO: 254844 - DNA, 20 bp, Artificial Sequence
  Description of Artificial Sequence: Synthetic oligonucleotide
  Target: ATXN1; (+) strand; PAM type: YTN; PAM sequence: TTT
gtgagtgtgtatgtgtgtgt

SEQ ID NO: 254845 - DNA, 20 bp, Artificial Sequence
  Description of Artificial Sequence: Synthetic oligonucleotide
  Target: ATXN1; (+) strand; PAM type: YTN; PAM sequence: TTG
tgagtgtgtatgtgtgtgtc

SEQ ID NO: 254846 - DNA, 20 bp, Artificial Sequence
  Description of Artificial Sequence: Synthetic oligonucleotide
  Target: ATXN1; (+) strand; PAM type: YTN; PAM sequence: CTA
gtttgtttttcgcctcctcc

SEQ ID NO: 254847 - DNA, 20 bp, Artificial Sequence
  Description of Artificial Sequence: Synthetic oligonucleotide
  Target: ATXN1; (+) strand; PAM type: YTN; PAM sequence: TTT
gtttttcgcctcctccagga

SEQ ID NO: 254848 - DNA, 20 bp, Artificial Sequence
  Description of Artificial Sequence: Synthetic oligonucleotide
  Target: ATXN1; (+) strand; PAM type: YTN; PAM sequence: TTG
tttttcgcctcctccaggag

SEQ ID NO: 254849 - DNA, 20 bp, Artificial Sequence
  Description of Artificial Sequence: Synthetic oligonucleotide
  Target: ATXN1; (+) strand; PAM type: YTN; PAM sequence: TTT
ttcgcctcctccaggagtta

SEQ ID NO: 254850 - DNA, 20 bp, Artificial Sequence
  Description of Artificial Sequence: Synthetic oligonucleotide
  Target: ATXN1; (+) strand; PAM type: YTN; PAM sequence: TTT
tcgcctcctccaggagttat

SEQ ID NO: 254851 - DNA, 20 bp, Artificial Sequence
  Description of Artificial Sequence: Synthetic oligonucleotide
  Target: ATXN1; (+) strand; PAM type: YTN; PAM sequence: TTT
cgcctcctccaggagttata

SEQ ID NO: 254852 - DNA, 20 bp, Artificial Sequence
  Description of Artificial Sequence: Synthetic oligonucleotide
  Target: ATXN1; (+) strand; PAM type: YTN; PAM sequence: TTC
gcctcctccaggagttatac

SEQ ID NO: 254853 - DNA, 20 bp, Artificial Sequence
  Description of Artificial Sequence: Synthetic oligonucleotide
  Target: ATXN1; (+) strand; PAM type: YTN; PAM sequence: CTC
ctccaggagttatacagcaa

SEQ ID NO: 254854 - DNA, 20 bp, Artificial Sequence
  Description of Artificial Sequence: Synthetic oligonucleotide
  Target: ATXN1; (+) strand; PAM type: YTN; PAM sequence: CTC
caggagttatacagcaaaaa

SEQ ID NO: 254855 - DNA, 20 bp, Artificial Sequence
  Description of Artificial Sequence: Synthetic oligonucleotide
  Target: ATXN1; (+) strand; PAM type: YTN; PAM sequence: TTA
tacagcaaaaaagaagaaaa

SEQ ID NO: 254856 - DNA, 20 bp, Artificial Sequence
  Description of Artificial Sequence: Synthetic oligonucleotide
  Target: ATXN1; (+) strand; PAM type: YTN; PAM sequence: CTG
ccttttatcagatatgtaca

SEQ ID NO: 254857 - DNA, 20 bp, Artificial Sequence
  Description of Artificial Sequence: Synthetic oligonucleotide
  Target: ATXN1; (+) strand; PAM type: YTN; PAM sequence: CTT
ttatcagatatgtacacatt

SEQ ID NO: 254858 - DNA, 20 bp, Artificial Sequence
  Description of Artificial Sequence: Synthetic oligonucleotide
  Target: ATXN1; (+) strand; PAM type: YTN; PAM sequence: TTT
tatcagatatgtacacattt

SEQ ID NO: 254859 - DNA, 20 bp, Artificial Sequence
  Description of Artificial Sequence: Synthetic oligonucleotide
  Target: ATXN1; (+) strand; PAM type: YTN; PAM sequence: TTT
atcagatatgtacacatttt

SEQ ID NO: 254860 - DNA, 20 bp, Artificial Sequence
  Description of Artificial Sequence: Synthetic oligonucleotide
  Target: ATXN1; (+) strand; PAM type: YTN; PAM sequence: TTA
tcagatatgtacacatttta

SEQ ID NO: 254861 - DNA, 20 bp, Artificial Sequence
  Description of Artificial Sequence: Synthetic oligonucleotide
  Target: ATXN1; (+) strand; PAM type: YTN; PAM sequence: TTT
tatccttgcaatatgtctaa

SEQ ID NO: 254862 - DNA, 20 bp, Artificial Sequence
  Description of Artificial Sequence: Synthetic oligonucleotide
  Target: ATXN1; (+) strand; PAM type: YTN; PAM sequence: TTT
atccttgcaatatgtctaaa

SEQ ID NO: 254863 - DNA, 20 bp, Artificial Sequence
  Description of Artificial Sequence: Synthetic oligonucleotide
  Target: ATXN1; (+) strand; PAM type: YTN; PAM sequence: TTA
tccttgcaatatgtctaaaa

SEQ ID NO: 254864 - DNA, 20 bp, Artificial Sequence
  Description of Artificial Sequence: Synthetic oligonucleotide
  Target: ATXN1; (+) strand; PAM type: YTN; PAM sequence: CTT
gcaatatgtctaaaatgatt

SEQ ID NO: 254865 - DNA, 20 bp, Artificial Sequence
  Description of Artificial Sequence: Synthetic oligonucleotide
  Target: ATXN1; (+) strand; PAM type: YTN; PAM sequence: TTG
caatatgtctaaaatgattt

SEQ ID NO: 254866 - DNA, 20 bp, Artificial Sequence
  Description of Artificial Sequence: Synthetic oligonucleotide
  Target: ATXN1; (+) strand; PAM type: YTN; PAM sequence: CTA
aaatgattttatgactaaat

SEQ ID NO: 254867 - DNA, 20 bp, Artificial Sequence
  Description of Artificial Sequence: Synthetic oligonucleotide
  Target: ATXN1; (+) strand; PAM type: YTN; PAM sequence: TTT
tatgactaaatcctgggaaa

SEQ ID NO: 254868 - DNA, 20 bp, Artificial Sequence
  Description of Artificial Sequence: Synthetic oligonucleotide
  Target: ATXN1; (+) strand; PAM type: YTN; PAM sequence: TTT
atgactaaatcctgggaaaa

SEQ ID NO: 254869 - DNA, 20 bp, Artificial Sequence
  Description of Artificial Sequence: Synthetic oligonucleotide
  Target: ATXN1; (+) strand; PAM type: YTN; PAM sequence: TTA
tgactaaatcctgggaaaaa

SEQ ID NO: 254870 - DNA, 20 bp, Artificial Sequence
  Description of Artificial Sequence: Synthetic oligonucleotide
  Target: ATXN1; (+) strand; PAM type: YTN; PAM sequence: CTA
aatcctgggaaaaatgtgaa

SEQ ID NO: 254871 - DNA, 20 bp, Artificial Sequence
  Description of Artificial Sequence: Synthetic oligonucleotide
  Target: ATXN1; (+) strand; PAM type: YTN; PAM sequence: CTG
ggaaaaatgtgaagaatgct

SEQ ID NO: 254872 - DNA, 20 bp, Artificial Sequence
  Description of Artificial Sequence: Synthetic oligonucleotide
  Target: ATXN1; (+) strand; PAM type: YTN; PAM sequence: CTT
ggctagatggcaagcttttc

SEQ ID NO: 254873 - DNA, 20 bp, Artificial Sequence
  Description of Artificial Sequence: Synthetic oligonucleotide
  Target: ATXN1; (+) strand; PAM type: YTN; PAM sequence: TTG
gctagatggcaagcttttcc

SEQ ID NO: 254874 - DNA, 20 bp, Artificial Sequence
  Description of Artificial Sequence: Synthetic oligonucleotide
  Target: ATXN1; (+) strand; PAM type: YTN; PAM sequence: CTA
gatggcaagcttttccagta

SEQ ID NO: 254875 - DNA, 20 bp, Artificial Sequence
  Description of Artificial Sequence: Synthetic oligonucleotide
  Target: ATXN1; (+) strand; PAM type: YTN; PAM sequence: CTT
ttccagtaaaaacacaacac

SEQ ID NO: 254876 - DNA, 20 bp, Artificial Sequence
  Description of Artificial Sequence: Synthetic oligonucleotide
  Target: ATXN1; (+) strand; PAM type: YTN; PAM sequence: TTT
tccagtaaaaacacaacact

SEQ ID NO: 254877 - DNA, 20 bp, Artificial Sequence
  Description of Artificial Sequence: Synthetic oligonucleotide
  Target: ATXN1; (+) strand; PAM type: YTN; PAM sequence: TTT
ccagtaaaaacacaacactg

SEQ ID NO: 254878 - DNA, 20 bp, Artificial Sequence
  Description of Artificial Sequence: Synthetic oligonucleotide
  Target: ATXN1; (+) strand; PAM type: YTN; PAM sequence: TTC
cagtaaaaacacaacactgc

SEQ ID NO: 254879 - DNA, 20 bp, Artificial Sequence
  Description of Artificial Sequence: Synthetic oligonucleotide
  Target: ATXN1; (+) strand; PAM type: YTN; PAM sequence: CTG
cttatgaattgtagcacttg

SEQ ID NO: 254880 - DNA, 20 bp, Artificial Sequence
  Description of Artificial Sequence: Synthetic oligonucleotide
  Target: ATXN1; (+) strand; PAM type: YTN; PAM sequence: CTT
atgaattgtagcacttggag

SEQ ID NO: 254881 - DNA, 20 bp, Artificial Sequence
  Description of Artificial Sequence: Synthetic oligonucleotide
  Target: ATXN1; (+) strand; PAM type: YTN; PAM sequence: TTA
tgaattgtagcacttggaga

SEQ ID NO: 254882 - DNA, 20 bp, Artificial Sequence
  Description of Artificial Sequence: Synthetic oligonucleotide
  Target: ATXN1; (+) strand; PAM type: YTN; PAM sequence: TTG
tagcacttggagaagacttt

SEQ ID NO: 254883 - DNA, 20 bp, Artificial Sequence
  Description of Artificial Sequence: Synthetic oligonucleotide
  Target: ATXN1; (+) strand; PAM type: YTN; PAM sequence: CTT
ggagaagacttttcaacatg

SEQ ID NO: 254884 - DNA, 20 bp, Artificial Sequence
  Description of Artificial Sequence: Synthetic oligonucleotide
  Target: ATXN1; (+) strand; PAM type: YTN; PAM sequence: TTG
gagaagacttttcaacatga

SEQ ID NO: 254885 - DNA, 20 bp, Artificial Sequence
  Description of Artificial Sequence: Synthetic oligonucleotide
  Target: ATXN1; (+) strand; PAM type: YTN; PAM sequence: CTT
ttcaacatgatgtacatttt

SEQ ID NO: 254886 - DNA, 20 bp, Artificial Sequence
  Description of Artificial Sequence: Synthetic oligonucleotide
  Target: ATXN1; (+) strand; PAM type: YTN; PAM sequence: TTT
tcaacatgatgtacattttt

SEQ ID NO: 254887 - DNA, 20 bp, Artificial Sequence
  Description of Artificial Sequence: Synthetic oligonucleotide
  Target: ATXN1; (+) strand; PAM type: YTN; PAM sequence: TTT
caacatgatgtacatttttg

SEQ ID NO: 254888 - DNA, 20 bp, Artificial Sequence
  Description of Artificial Sequence: Synthetic oligonucleotide
  Target: ATXN1; (+) strand; PAM type: YTN; PAM sequence: TTC
aacatgatgtacatttttgc

SEQ ID NO: 254889 - DNA, 20 bp, Artificial Sequence
  Description of Artificial Sequence: Synthetic oligonucleotide
  Target: ATXN1; (+) strand; PAM type: YTN; PAM sequence: TTT
ttgctctagcttgagactaa

SEQ ID NO: 254890 - DNA, 20 bp, Artificial Sequence
  Description of Artificial Sequence: Synthetic oligonucleotide
  Target: ATXN1; (+) strand; PAM type: YTN; PAM sequence: TTT
tgctctagcttgagactaaa

SEQ ID NO: 254891 - DNA, 20 bp, Artificial Sequence
  Description of Artificial Sequence: Synthetic oligonucleotide
  Target: ATXN1; (+) strand; PAM type: YTN; PAM sequence: TTT
gctctagcttgagactaaat

SEQ ID NO: 254892 - DNA, 20 bp, Artificial Sequence
  Description of Artificial Sequence: Synthetic oligonucleotide
  Target: ATXN1; (+) strand; PAM type: YTN; PAM sequence: TTG
ctctagcttgagactaaatc

SEQ ID NO: 254893 - DNA, 20 bp, Artificial Sequence
  Description of Artificial Sequence: Synthetic oligonucleotide
  Target: ATXN1; (+) strand; PAM type: YTN; PAM sequence: CTC
tagcttgagactaaatcctg

SEQ ID NO: 254894 - DNA, 20 bp, Artificial Sequence
  Description of Artificial Sequence: Synthetic oligonucleotide
  Target: ATXN1; (+) strand; PAM type: YTN; PAM sequence: CTA
gcttgagactaaatcctgtt

SEQ ID NO: 254895 - DNA, 20 bp, Artificial Sequence
  Description of Artificial Sequence: Synthetic oligonucleotide
  Target: ATXN1; (+) strand; PAM type: YTN; PAM sequence: CTT
gagactaaatcctgtttgga

SEQ ID NO: 254896 - DNA, 20 bp, Artificial Sequence
  Description of Artificial Sequence: Synthetic oligonucleotide
  Target: ATXN1; (+) strand; PAM type: YTN; PAM sequence: TTG
agactaaatcctgtttggag

SEQ ID NO: 254897 - DNA, 20 bp, Artificial Sequence
  Description of Artificial Sequence: Synthetic oligonucleotide
  Target: ATXN1; (+) strand; PAM type: YTN; PAM sequence: CTA
aatcctgtttggaggtaggt

SEQ ID NO: 254898 - DNA, 20 bp, Artificial Sequence
  Description of Artificial Sequence: Synthetic oligonucleotide
  Target: ATXN1; (+) strand; PAM type: YTN; PAM sequence: CTG
tttggaggtaggttttcttt

SEQ ID NO: 254899 - DNA, 20 bp, Artificial Sequence
  Description of Artificial Sequence: Synthetic oligonucleotide
  Target: ATXN1; (+) strand; PAM type: YTN; PAM sequence: TTT
ggaggtaggttttctttggc

SEQ ID NO: 254900 - DNA, 20 bp, Artificial Sequence
  Description of Artificial Sequence: Synthetic oligonucleotide
  Target: ATXN1; (+) strand; PAM type: YTN; PAM sequence: TTG
gaggtaggttttctttggct

SEQ ID NO: 254901 - DNA, 20 bp, Artificial Sequence
  Description of Artificial Sequence: Synthetic oligonucleotide
  Target: ATXN1; (+) strand; PAM type: YTN; PAM sequence: TTT
tctttggctttcagaaaaag

SEQ ID NO: 254902 - DNA, 20 bp, Artificial Sequence
  Description of Artificial Sequence: Synthetic oligonucleotide
  Target: ATXN1; (+) strand; PAM type: YTN; PAM sequence: TTT
ctttggctttcagaaaaagt

SEQ ID NO: 254903 - DNA, 20 bp, Artificial Sequence
  Description of Artificial Sequence: Synthetic oligonucleotide
  Target: ATXN1; (+) strand; PAM type: YTN; PAM sequence: TTC
tttggctttcagaaaaagtt

SEQ ID NO: 254904 - DNA, 20 bp, Artificial Sequence
  Description of Artificial Sequence: Synthetic oligonucleotide
  Target: ATXN1; (+) strand; PAM type: YTN; PAM sequence: CTT
tggctttcagaaaaagttga

SEQ ID NO: 254905 - DNA, 20 bp, Artificial Sequence
  Description of Artificial Sequence: Synthetic oligonucleotide
  Target: ATXN1; (+) strand; PAM type: YTN; PAM sequence: TTT
ggctttcagaaaaagttgaa

SEQ ID NO: 254906 - DNA, 20 bp, Artificial Sequence
  Description of Artificial Sequence: Synthetic oligonucleotide
  Target: ATXN1; (+) strand; PAM type: YTN; PAM sequence: TTG
gctttcagaaaaagttgaac

SEQ ID NO: 254907 - DNA, 20 bp, Artificial Sequence
  Description of Artificial Sequence: Synthetic oligonucleotide
  Target: ATXN1; (+) strand; PAM type: YTN; PAM sequence: CTT
tcagaaaaagttgaaccgat

SEQ ID NO: 254908 - DNA, 20 bp, Artificial Sequence
  Description of Artificial Sequence: Synthetic oligonucleotide
  Target: ATXN1; (+) strand; PAM type: YTN; PAM sequence: TTT
cagaaaaagttgaaccgatt

SEQ ID NO: 254909 - DNA, 20 bp, Artificial Sequence
  Description of Artificial Sequence: Synthetic oligonucleotide
  Target: ATXN1; (+) strand; PAM type: YTN; PAM sequence: TTC
agaaaaagttgaaccgattg

SEQ ID NO: 254910 - DNA, 20 bp, Artificial Sequence
  Description of Artificial Sequence: Synthetic oligonucleotide
  Target: ATXN1; (+) strand; PAM type: YTN; PAM sequence: TTG
aaccgattgtacaacatggg

SEQ ID NO: 254911 - DNA, 20 bp, Artificial Sequence
  Description of Artificial Sequence: Synthetic oligonucleotide
  Target: ATXN1; (+) strand; PAM type: YTN; PAM sequence: TTG
tacaacatgggtctttgggc

SEQ ID NO: 254912 - DNA, 20 bp, Artificial Sequence
  Description of Artificial Sequence: Synthetic oligonucleotide
  Target: ATXN1; (+) strand; PAM type: YTN; PAM sequence: CTT
tgggccctccaacgtggact

SEQ ID NO: 254913 - DNA, 20 bp, Artificial Sequence
  Description of Artificial Sequence: Synthetic oligonucleotide
  Target: ATXN1; (+) strand; PAM type: YTN; PAM sequence: TTT
gggccctccaacgtggactc

SEQ ID NO: 254914 - DNA, 20 bp, Artificial Sequence
  Description of Artificial Sequence: Synthetic oligonucleotide
  Target: ATXN1; (+) strand; PAM type: YTN; PAM sequence: TTG
ggccctccaacgtggactca

SEQ ID NO: 254915 - DNA, 20 bp, Artificial Sequence
  Description of Artificial Sequence: Synthetic oligonucleotide
  Target: ATXN1; (+) strand; PAM type: YTN; PAM sequence: CTC
caacgtggactcaccatgag

SEQ ID NO: 254916 - DNA, 20 bp, Artificial Sequence
  Description of Artificial Sequence: Synthetic oligonucleotide
  Target: ATXN1; (+) strand; PAM type: YTN; PAM sequence: CTC
accatgagaggacgatcgtg

SEQ ID NO: 254917 - DNA, 20 bp, Artificial Sequence
  Description of Artificial Sequence: Synthetic oligonucleotide
  Target: ATXN1; (+) strand; PAM type: YTN; PAM sequence: CTA
ttccattaaacatgcctccg

SEQ ID NO: 254918 - DNA, 20 bp, Artificial Sequence
  Description of Artificial Sequence: Synthetic oligonucleotide
  Target: ATXN1; (+) strand; PAM type: YTN; PAM sequence: TTC
cattaaacatgcctccgtct

SEQ ID NO: 254919 - DNA, 20 bp, Artificial Sequence
  Description of Artificial Sequence: Synthetic oligonucleotide
  Target: ATXN1; (+) strand; PAM type: YTN; PAM sequence: TTA
aacatgcctccgtctcacga

SEQ ID NO: 254920 - DNA, 20 bp, Artificial Sequence
  Description of Artificial Sequence: Synthetic oligonucleotide
  Target: ATXN1; (+) strand; PAM type: YTN; PAM sequence: CTC
cgtctcacgactccagccag

SEQ ID NO: 254921 - DNA, 20 bp, Artificial Sequence
  Description of Artificial Sequence: Synthetic oligonucleotide
  Target: ATXN1; (+) strand; PAM type: YTN; PAM sequence: CTC
acgactccagccagggttaa

SEQ ID NO: 254922 - DNA, 20 bp, Artificial Sequence
  Description of Artificial Sequence: Synthetic oligonucleotide
  Target: ATXN1; (+) strand; PAM type: YTN; PAM sequence: CTC
cagccagggttaaaaccttc

SEQ ID NO: 254923 - DNA, 20 bp, Artificial Sequence
  Description of Artificial Sequence: Synthetic oligonucleotide
  Target: ATXN1; (+) strand; PAM type: YTN; PAM sequence: TTA
aaaccttcagatgttttctc

SEQ ID NO: 254924 - DNA, 20 bp, Artificial Sequence
  Description of Artificial Sequence: Synthetic oligonucleotide
  Target: ATXN1; (+) strand; PAM type: YTN; PAM sequence: CTT
cagatgttttctcaacacat

SEQ ID NO: 254925 - DNA, 20 bp, Artificial Sequence
  Description of Artificial Sequence: Synthetic oligonucleotide
  Target: ATXN1; (+) strand; PAM type: YTN; PAM sequence: TTC
agatgttttctcaacacatt

SEQ ID NO: 254926 - DNA, 20 bp, Artificial Sequence
  Description of Artificial Sequence: Synthetic oligonucleotide
  Target: ATXN1; (+) strand; PAM type: YTN; PAM sequence: TTT
tctcaacacattaagcagaa

SEQ ID NO: 254927 - DNA, 20 bp, Artificial Sequence
  Description of Artificial Sequence: Synthetic oligonucleotide
  Target: ATXN1; (+) strand; PAM type: YTN; PAM sequence: TTT
ctcaacacattaagcagaac

SEQ ID NO: 254928 - DNA, 20 bp, Artificial Sequence
  Description of Artificial Sequence: Synthetic oligonucleotide
  Target: ATXN1; (+) strand; PAM type: YTN; PAM sequence: TTC
tcaacacattaagcagaact

SEQ ID NO: 254929 - DNA, 20 bp, Artificial Sequence
  Description of Artificial Sequence: Synthetic oligonucleotide
  Target: ATXN1; (+) strand; PAM type: YTN; PAM sequence: CTC
aacacattaagcagaactaa

SEQ ID NO: 254930 - DNA, 20 bp, Artificial Sequence
  Description of Artificial Sequence: Synthetic oligonucleotide
  Target: ATXN1; (+) strand; PAM type: YTN; PAM sequence: TTA
agcagaactaaccatcacaa

SEQ ID NO: 254931 - DNA, 20 bp, Artificial Sequence
  Description of Artificial Sequence: Synthetic oligonucleotide
  Target: ATXN1; (+) strand; PAM type: YTN; PAM sequence: CTA
accatcacaaaggcaaaaac

SEQ ID NO: 254932 - DNA, 20 bp, Artificial Sequence
  Description of Artificial Sequence: Synthetic oligonucleotide
  Target: ATXN1; (+) strand; PAM type: YTN; PAM sequence: CTA
aacccatctgtccccttgtc

SEQ ID NO: 254933 - DNA, 20 bp, Artificial Sequence
  Description of Artificial Sequence: Synthetic oligonucleotide
  Target: ATXN1; (+) strand; PAM type: YTN; PAM sequence: CTG
tccccttgtcaggatttttg

SEQ ID NO: 254934 - DNA, 20 bp, Artificial Sequence
  Description of Artificial Sequence: Synthetic oligonucleotide
  Target: ATXN1; (+) strand; PAM type: YTN; PAM sequence: CTT
gtcaggatttttgagattgt

SEQ ID NO: 254935 - DNA, 20 bp, Artificial Sequence
  Description of Artificial Sequence: Synthetic oligonucleotide
  Target: ATXN1; (+) strand; PAM type: YTN; PAM sequence: TTG
tcaggatttttgagattgtc

SEQ ID NO: 254936 - DNA, 20 bp, Artificial Sequence
  Description of Artificial Sequence: Synthetic oligonucleotide
  Target: ATXN1; (+) strand; PAM type: YTN; PAM sequence: TTT
ttgagattgtcaatggactg

SEQ ID NO: 254937 - DNA, 20 bp, Artificial Sequence
  Description of Artificial Sequence: Synthetic oligonucleotide
  Target: ATXN1; (+) strand; PAM type: YTN; PAM sequence: TTT
tgagattgtcaatggactga

SEQ ID NO: 254938 - DNA, 20 bp, Artificial Sequence
  Description of Artificial Sequence: Synthetic oligonucleotide
  Target: ATXN1; (+) strand; PAM type: YTN; PAM sequence: TTT
gagattgtcaatggactgac

SEQ ID NO: 254939 - DNA, 20 bp, Artificial Sequence
  Description of Artificial Sequence: Synthetic oligonucleotide
  Target: ATXN1; (+) strand; PAM type: YTN; PAM sequence: TTG
agattgtcaatggactgacc

SEQ ID NO: 254940 - DNA, 20 bp, Artificial Sequence
  Description of Artificial Sequence: Synthetic oligonucleotide
  Target: ATXN1; (+) strand; PAM type: YTN; PAM sequence: TTG
tcaatggactgaccttgtgg

SEQ ID NO: 254941 - DNA, 20 bp, Artificial Sequence
  Description of Artificial Sequence: Synthetic oligonucleotide
  Target: ATXN1; (+) strand; PAM type: YTN; PAM sequence: CTG
accttgtggctggaaaacat

SEQ ID NO: 254942 - DNA, 20 bp, Artificial Sequence
  Description of Artificial Sequence: Synthetic oligonucleotide
  Target: ATXN1; (+) strand; PAM type: YTN; PAM sequence: CTT
gtggctggaaaacattttgg

SEQ ID NO: 254943 - DNA, 20 bp, Artificial Sequence
  Description of Artificial Sequence: Synthetic oligonucleotide
  Target: ATXN1; (+) strand; PAM type: YTN; PAM sequence: TTG
tggctggaaaacattttgga

SEQ ID NO: 254944 - DNA, 20 bp, Artificial Sequence
  Description of Artificial Sequence: Synthetic oligonucleotide
  Target: ATXN1; (+) strand; PAM type: YTN; PAM sequence: CTG
gaaaacattttggaggccgt

SEQ ID NO: 254945 - DNA, 20 bp, Artificial Sequence
  Description of Artificial Sequence: Synthetic oligonucleotide
  Target: ATXN1; (+) strand; PAM type: YTN; PAM sequence: TTT
tggaggccgtgtaacaaaag

SEQ ID NO: 254946 - DNA, 20 bp, Artificial Sequence
  Description of Artificial Sequence: Synthetic oligonucleotide
  Target: ATXN1; (+) strand; PAM type: YTN; PAM sequence: TTT
ggaggccgtgtaacaaaagt

SEQ ID NO: 254947 - DNA, 20 bp, Artificial Sequence
  Description of Artificial Sequence: Synthetic oligonucleotide
  Target: ATXN1; (+) strand; PAM type: YTN; PAM sequence: TTG
gaggccgtgtaacaaaagtt

SEQ ID NO: 254948 - DNA, 20 bp, Artificial Sequence
  Description of Artificial Sequence: Synthetic oligonucleotide
  Target: ATXN1; (+) strand; PAM type: YTN; PAM sequence: TTA
aatgtggcagtgaatgcaca

SEQ ID NO: 254949 - DNA, 20 bp, Artificial Sequence
  Description of Artificial Sequence: Synthetic oligonucleotide
  Target: ATXN1; (+) strand; PAM type: YTN; PAM sequence: TTC
ttagaggtcactagtgaatt

SEQ ID NO: 254950 - DNA, 20 bp, Artificial Sequence
  Description of Artificial Sequence: Synthetic oligonucleotide
  Target: ATXN1; (+) strand; PAM type: YTN; PAM sequence: CTT
agaggtcactagtgaattac

SEQ ID NO: 254951 - DNA, 20 bp, Artificial Sequence
  Description of Artificial Sequence: Synthetic oligonucleotide
  Target: ATXN1; (+) strand; PAM type: YTN; PAM sequence: TTA
gaggtcactagtgaattact

SEQ ID NO: 254952 - DNA, 20 bp, Artificial Sequence
  Description of Artificial Sequence: Synthetic oligonucleotide
  Target: ATXN1; (+) strand; PAM type: YTN; PAM sequence: CTA
gtgaattactaacaccatta

SEQ ID NO: 254953 - DNA, 20 bp, Artificial Sequence
  Description of Artificial Sequence: Synthetic oligonucleotide
  Target: ATXN1; (+) strand; PAM type: YTN; PAM sequence: TTA
ctaacaccattaccctggca

SEQ ID NO: 254954 - DNA, 20 bp, Artificial Sequence
  Description of Artificial Sequence: Synthetic oligonucleotide
  Target: ATXN1; (+) strand; PAM type: YTN; PAM sequence: CTA
acaccattaccctggcaaga

SEQ ID NO: 254955 - DNA, 20 bp, Artificial Sequence
  Description of Artificial Sequence: Synthetic oligonucleotide
  Target: ATXN1; (+) strand; PAM type: YTN; PAM sequence: TTA
ccctggcaagagatgatgga

SEQ ID NO: 254956 - DNA, 20 bp, Artificial Sequence
  Description of Artificial Sequence: Synthetic oligonucleotide
  Target: ATXN1; (+) strand; PAM type: YTN; PAM sequence: CTG
gcaagagatgatggagtttc

SEQ ID NO: 254957 - DNA, 20 bp, Artificial Sequence
  Description of Artificial Sequence: Synthetic oligonucleotide
  Target: ATXN1; (+) strand; PAM type: YTN; PAM sequence: TTT
ccattttatctcagaggttt

SEQ ID NO: 254958 - DNA, 20 bp, Artificial Sequence
  Description of Artificial Sequence: Synthetic oligonucleotide
  Target: ATXN1; (+) strand; PAM type: YTN; PAM sequence: TTC
cattttatctcagaggtttg

SEQ ID NO: 254959 - DNA, 20 bp, Artificial Sequence
  Description of Artificial Sequence: Synthetic oligonucleotide
  Target: ATXN1; (+) strand; PAM type: YTN; PAM sequence: TTT
tatctcagaggtttggtggg

SEQ ID NO: 254960 - DNA, 20 bp, Artificial Sequence
  Description of Artificial Sequence: Synthetic oligonucleotide
  Target: ATXN1; (+) strand; PAM type: YTN; PAM sequence: TTT
atctcagaggtttggtgggt

SEQ ID NO: 254961 - DNA, 20 bp, Artificial Sequence
  Description of Artificial Sequence: Synthetic oligonucleotide
  Target: ATXN1; (+) strand; PAM type: YTN; PAM sequence: TTA
tctcagaggtttggtgggtg

SEQ ID NO: 254962 - DNA, 20 bp, Artificial Sequence
  Description of Artificial Sequence: Synthetic oligonucleotide
  Target: ATXN1; (+) strand; PAM type: YTN; PAM sequence: CTC
agaggtttggtgggtgtatg

SEQ ID NO: 254963 - DNA, 20 bp, Artificial Sequence
  Description of Artificial Sequence: Synthetic oligonucleotide
  Target: ATXN1; (+) strand; PAM type: YTN; PAM sequence: TTT
ggtgggtgtatggtgatgac

SEQ ID NO: 254964 - DNA, 20 bp, Artificial Sequence
  Description of Artificial Sequence: Synthetic oligonucleotide
  Target: ATXN1; (+) strand; PAM type: YTN; PAM sequence: TTG
gtgggtgtatggtgatgact

SEQ ID NO: 254965 - DNA, 20 bp, Artificial Sequence
  Description of Artificial Sequence: Synthetic oligonucleotide
  Target: ATXN1; (+) strand; PAM type: YTN; PAM sequence: CTT
aaaatgacgttaggctacgt

SEQ ID NO: 254966 - DNA, 20 bp, Artificial Sequence
  Description of Artificial Sequence: Synthetic oligonucleotide
  Target: ATXN1; (+) strand; PAM type: YTN; PAM sequence: TTA
aaatgacgttaggctacgta

SEQ ID NO: 254967 - DNA, 20 bp, Artificial Sequence
  Description of Artificial Sequence: Synthetic oligonucleotide
  Target: ATXN1; (+) strand; PAM type: YTN; PAM sequence: TTA
ggctacgtagccaacacttt

SEQ ID NO: 254968 - DNA, 20 bp, Artificial Sequence
  Description of Artificial Sequence: Synthetic oligonucleotide
  Target: ATXN1; (+) strand; PAM type: YTN; PAM sequence: CTA
cgtagccaacactttcttgg

SEQ ID NO: 254969 - DNA, 20 bp, Artificial Sequence
  Description of Artificial Sequence: Synthetic oligonucleotide
  Target: ATXN1; (+) strand; PAM type: YTN; PAM sequence: CTT
tcttggaaaggactttccct

SEQ ID NO: 254970 - DNA, 20 bp, Artificial Sequence
  Description of Artificial Sequence: Synthetic oligonucleotide
  Target: ATXN1; (+) strand; PAM type: YTN; PAM sequence: TTT
cttggaaaggactttccctg

SEQ ID NO: 254971 - DNA, 20 bp, Artificial Sequence
  Description of Artificial Sequence: Synthetic oligonucleotide
  Target: ATXN1; (+) strand; PAM type: YTN; PAM sequence: TTC
ttggaaaggactttccctgc

SEQ ID NO: 254972 - DNA, 20 bp, Artificial Sequence
  Description of Artificial Sequence: Synthetic oligonucleotide
  Target: ATXN1; (+) strand; PAM type: YTN; PAM sequence: CTT
ggaaaggactttccctgctg

SEQ ID NO: 254973 - DNA, 20 bp, Artificial Sequence
  Description of Artificial Sequence: Synthetic oligonucleotide
  Target: ATXN1; (+) strand; PAM type: YTN; PAM sequence: TTG
gaaaggactttccctgctgt

SEQ ID NO: 254974 - DNA, 20 bp, Artificial Sequence
  Description of Artificial Sequence: Synthetic oligonucleotide
  Target: ATXN1; (+) strand; PAM type: YTN; PAM sequence: CTT
tccctgctgttctattaaaa

SEQ ID NO: 254975 - DNA, 20 bp, Artificial Sequence
  Description of Artificial Sequence: Synthetic oligonucleotide
  Target: ATXN1; (+) strand; PAM type: YTN; PAM sequence: TTT
ccctgctgttctattaaaac

SEQ ID NO: 254976 - DNA, 20 bp, Artificial Sequence
  Description of Artificial Sequence: Synthetic oligonucleotide
  Target: ATXN1; (+) strand; PAM type: YTN; PAM sequence: TTC
cctgctgttctattaaaact

SEQ ID NO: 254977 - DNA, 20 bp, Artificial Sequence
  Description of Artificial Sequence: Synthetic oligonucleotide
  Target: ATXN1; (+) strand; PAM type: YTN; PAM sequence: CTG
ctgttctattaaaactgtca

SEQ ID NO: 254978 - DNA, 20 bp, Artificial Sequence
  Description of Artificial Sequence: Synthetic oligonucleotide
  Target: ATXN1; (+) strand; PAM type: YTN; PAM sequence: CTG
ttctattaaaactgtcagca

SEQ ID NO: 254979 - DNA, 20 bp, Artificial Sequence
  Description of Artificial Sequence: Synthetic oligonucleotide
  Target: ATXN1; (+) strand; PAM type: YTN; PAM sequence: TTC
tattaaaactgtcagcaaat

SEQ ID NO: 254980 - DNA, 20 bp, Artificial Sequence
  Description of Artificial Sequence: Synthetic oligonucleotide
  Target: ATXN1; (+) strand; PAM type: YTN; PAM sequence: CTA
ttaaaactgtcagcaaatag

SEQ ID NO: 254981 - DNA, 20 bp, Artificial Sequence
  Description of Artificial Sequence: Synthetic oligonucleotide
  Target: ATXN1; (+) strand; PAM type: YTN; PAM sequence: TTA
aaactgtcagcaaatagggc

SEQ ID NO: 254982 - DNA, 20 bp, Artificial Sequence
  Description of Artificial Sequence: Synthetic oligonucleotide
  Target: ATXN1; (+) strand; PAM type: YTN; PAM sequence: CTG
tcagcaaatagggccaaggc

SEQ ID NO: 254983 - DNA, 20 bp, Artificial Sequence
  Description of Artificial Sequence: Synthetic oligonucleotide
  Target: ATXN1; (+) strand; PAM type: YTN; PAM sequence: CTC
actggtctatgccgaggaca

SEQ ID NO: 254984 - DNA, 20 bp, Artificial Sequence
  Description of Artificial Sequence: Synthetic oligonucleotide
  Target: ATXN1; (+) strand; PAM type: YTN; PAM sequence: CTG
gtctatgccgaggacacctt

SEQ ID NO: 254985 - DNA, 20 bp, Artificial Sequence
  Description of Artificial Sequence: Synthetic oligonucleotide
  Target: ATXN1; (+) strand; PAM type: YTN; PAM sequence: CTA
tgccgaggacaccttaaagt

SEQ ID NO: 254986 - DNA, 20 bp, Artificial Sequence
  Description of Artificial Sequence: Synthetic oligonucleotide
  Target: ATXN1; (+) strand; PAM type: YTN; PAM sequence: CTT
aaagtaatcaggccgtcaaa

SEQ ID NO: 254987 - DNA, 20 bp, Artificial Sequence
  Description of Artificial Sequence: Synthetic oligonucleotide
  Target: ATXN1; (+) strand; PAM type: YTN; PAM sequence: TTA
aagtaatcaggccgtcaaat

SEQ ID NO: 254988 - DNA, 20 bp, Artificial Sequence
  Description of Artificial Sequence: Synthetic oligonucleotide
  Target: ATXN1; (+) strand; PAM type: YTN; PAM sequence: CTT
tctcaacatttctaaagaca

SEQ ID NO: 254989 - DNA, 20 bp, Artificial Sequence
  Description of Artificial Sequence: Synthetic oligonucleotide
  Target: ATXN1; (+) strand; PAM type: YTN; PAM sequence: TTT
ctcaacatttctaaagacag

SEQ ID NO: 254990 - DNA, 20 bp, Artificial Sequence
  Description of Artificial Sequence: Synthetic oligonucleotide
  Target: ATXN1; (+) strand; PAM type: YTN; PAM sequence: TTC
tcaacatttctaaagacaga

SEQ ID NO: 254991 - DNA, 20 bp, Artificial Sequence
  Description of Artificial Sequence: Synthetic oligonucleotide
  Target: ATXN1; (+) strand; PAM type: YTN; PAM sequence: CTC
aacatttctaaagacagaaa

SEQ ID NO: 254992 - DNA, 20 bp, Artificial Sequence
  Description of Artificial Sequence: Synthetic oligonucleotide
  Target: ATXN1; (+) strand; PAM type: YTN; PAM sequence: TTT
ctaaagacagaaatagcgaa

SEQ ID NO: 254993 - DNA, 20 bp, Artificial Sequence
  Description of Artificial Sequence: Synthetic oligonucleotide
  Target: ATXN1; (+) strand; PAM type: YTN; PAM sequence: TTC
taaagacagaaatagcgaaa

SEQ ID NO: 254994 - DNA, 20 bp, Artificial Sequence
  Description of Artificial Sequence: Synthetic oligonucleotide
  Target: ATXN1; (+) strand; PAM type: YTN; PAM sequence: CTA
aagacagaaatagcgaaaag

SEQ ID NO: 254995 - DNA, 20 bp, Artificial Sequence
  Description of Artificial Sequence: Synthetic oligonucleotide
  Target: ATXN1; (+) strand; PAM type: YTN; PAM sequence: TTG
cgttccaagcatatcagact

SEQ ID NO: 254996 - DNA, 20 bp, Artificial Sequence
  Description of Artificial Sequence: Synthetic oligonucleotide
  Target: ATXN1; (+) strand; PAM type: YTN; PAM sequence: TTC
caagcatatcagacttaagt

SEQ ID NO: 254997 - DNA, 20 bp, Artificial Sequence
  Description of Artificial Sequence: Synthetic oligonucleotide
  Target: ATXN1; (+) strand; PAM type: YTN; PAM sequence: CTT
aagtcatttctgcctcatgg

SEQ ID NO: 254998 - DNA, 20 bp, Artificial Sequence
  Description of Artificial Sequence: Synthetic oligonucleotide
  Target: ATXN1; (+) strand; PAM type: YTN; PAM sequence: TTA
agtcatttctgcctcatggt

SEQ ID NO: 254999 - DNA, 20 bp, Artificial Sequence
  Description of Artificial Sequence: Synthetic oligonucleotide
  Target: ATXN1; (+) strand; PAM type: YTN; PAM sequence: TTT
ctgcctcatggttctagaag

SEQ ID NO: 255000 - DNA, 20 bp, Artificial Sequence
  Description of Artificial Sequence: Synthetic oligonucleotide
  Target: ATXN1; (+) strand; PAM type: YTN; PAM sequence: TTC
tgcctcatggttctagaaga

SEQ ID NO: 255001 - DNA, 20 bp, Artificial Sequence
  Description of Artificial Sequence: Synthetic oligonucleotide
  Target: ATXN1; (+) strand; PAM type: YTN; PAM sequence: CTG
cctcatggttctagaagaca

SEQ ID NO: 255002 - DNA, 20 bp, Artificial Sequence
  Description of Artificial Sequence: Synthetic oligonucleotide
  Target: ATXN1; (+) strand; PAM type: YTN; PAM sequence: CTC
atggttctagaagacaagag

SEQ ID NO: 255003 - DNA, 20 bp, Artificial Sequence
  Description of Artificial Sequence: Synthetic oligonucleotide
  Target: ATXN1; (+) strand; PAM type: YTN; PAM sequence: TTC
tagaagacaagaggtggagg

SEQ ID NO: 255004 - DNA, 20 bp, Artificial Sequence
  Description of Artificial Sequence: Synthetic oligonucleotide
  Target: ATXN1; (+) strand; PAM type: YTN; PAM sequence: CTA
gaagacaagaggtggaggtg

SEQ ID NO: 255005 - DNA, 20 bp, Artificial Sequence
  Description of Artificial Sequence: Synthetic oligonucleotide
  Target: ATXN1; (+) strand; PAM type: YTN; PAM sequence: TTC
tccttctaaccctctggctc

SEQ ID NO: 255006 - DNA, 20 bp, Artificial Sequence
  Description of Artificial Sequence: Synthetic oligonucleotide
  Target: ATXN1; (+) strand; PAM type: YTN; PAM sequence: CTC
cttctaaccctctggctctc

SEQ ID NO: 255007 - DNA, 20 bp, Artificial Sequence
  Description of Artificial Sequence: Synthetic oligonucleotide
  Target: ATXN1; (+) strand; PAM type: YTN; PAM sequence: CTT
ctaaccctctggctctcaac

SEQ ID NO: 255008 - DNA, 20 bp, Artificial Sequence
  Description of Artificial Sequence: Synthetic oligonucleotide
  Target: ATXN1; (+) strand; PAM type: YTN; PAM sequence: TTC
taaccctctggctctcaacc

SEQ ID NO: 255009 - DNA, 20 bp, Artificial Sequence
  Description of Artificial Sequence: Synthetic oligonucleotide
  Target: ATXN1; (+) strand; PAM type: YTN; PAM sequence: CTA
accctctggctctcaaccgg

SEQ ID NO: 255010 - DNA, 20 bp, Artificial Sequence
  Description of Artificial Sequence: Synthetic oligonucleotide
  Target: ATXN1; (+) strand; PAM type: YTN; PAM sequence: CTC
tggctctcaaccggaagcaa

SEQ ID NO: 255011 - DNA, 20 bp, Artificial Sequence
  Description of Artificial Sequence: Synthetic oligonucleotide
  Target: ATXN1; (+) strand; PAM type: YTN; PAM sequence: CTG
gctctcaaccggaagcaatt

SEQ ID NO: 255012 - DNA, 20 bp, Artificial Sequence
  Description of Artificial Sequence: Synthetic oligonucleotide
  Target: ATXN1; (+) strand; PAM type: YTN; PAM sequence: CTC
tcaaccggaagcaattttgc

SEQ ID NO: 255013 - DNA, 20 bp, Artificial Sequence
  Description of Artificial Sequence: Synthetic oligonucleotide
  Target: ATXN1; (+) strand; PAM type: YTN; PAM sequence: CTC
aaccggaagcaattttgctc

SEQ ID NO: 255014 - DNA, 20 bp, Artificial Sequence
  Description of Artificial Sequence: Synthetic oligonucleotide
  Target: ATXN1; (+) strand; PAM type: YTN; PAM sequence: TTT
tgctctgcaagggacacctg

SEQ ID NO: 255015 - DNA, 20 bp, Artificial Sequence
  Description of Artificial Sequence: Synthetic oligonucleotide
  Target: ATXN1; (+) strand; PAM type: YTN; PAM sequence: TTT
gctctgcaagggacacctgg

SEQ ID NO: 255016 - DNA, 20 bp, Artificial Sequence
  Description of Artificial Sequence: Synthetic oligonucleotide
  Target: ATXN1; (+) strand; PAM type: YTN; PAM sequence: TTG
ctctgcaagggacacctgga

SEQ ID NO: 255017 - DNA, 20 bp, Artificial Sequence
  Description of Artificial Sequence: Synthetic oligonucleotide
  Target: ATXN1; (+) strand; PAM type: YTN; PAM sequence: CTC
tgcaagggacacctggaagt

SEQ ID NO: 255018 - DNA, 20 bp, Artificial Sequence
  Description of Artificial Sequence: Synthetic oligonucleotide
  Target: ATXN1; (+) strand; PAM type: YTN; PAM sequence: CTG
caagggacacctggaagtgt

SEQ ID NO: 255019 - DNA, 20 bp, Artificial Sequence
  Description of Artificial Sequence: Synthetic oligonucleotide
  Target: ATXN1; (+) strand; PAM type: YTN; PAM sequence: CTG
gaagtgtctgaggacatttt

SEQ ID NO: 255020 - DNA, 20 bp, Artificial Sequence
  Description of Artificial Sequence: Synthetic oligonucleotide
  Target: ATXN1; (+) strand; PAM type: YTN; PAM sequence: CTG
aggacatttttgattgtcac

SEQ ID NO: 255021 - DNA, 20 bp, Artificial Sequence
  Description of Artificial Sequence: Synthetic oligonucleotide
  Target: ATXN1; (+) strand; PAM type: YTN; PAM sequence: TTT
ttgattgtcacaactgccgg

SEQ ID NO: 255022 - DNA, 20 bp, Artificial Sequence
  Description of Artificial Sequence: Synthetic oligonucleotide
  Target: ATXN1; (+) strand; PAM type: YTN; PAM sequence: TTT
tgattgtcacaactgccggg

SEQ ID NO: 255023 - DNA, 20 bp, Artificial Sequence
  Description of Artificial Sequence: Synthetic oligonucleotide
  Target: ATXN1; (+) strand; PAM type: YTN; PAM sequence: TTT
gattgtcacaactgccgggt

SEQ ID NO: 255024 - DNA, 20 bp, Artificial Sequence
  Description of Artificial Sequence: Synthetic oligonucleotide
  Target: ATXN1; (+) strand; PAM type: YTN; PAM sequence: TTG
attgtcacaactgccgggtg

SEQ ID NO: 255025 - DNA, 20 bp, Artificial Sequence
  Description of Artificial Sequence: Synthetic oligonucleotide
  Target: ATXN1; (+) strand; PAM type: YTN; PAM sequence: TTG
tcacaactgccgggtgctac

SEQ ID NO: 255026 - DNA, 20 bp, Artificial Sequence
  Description of Artificial Sequence: Synthetic oligonucleotide
  Target: ATXN1; (+) strand; PAM type: YTN; PAM sequence: CTG
ccgggtgctaccagcatcca

SEQ ID NO: 255027 - DNA, 20 bp, Artificial Sequence
  Description of Artificial Sequence: Synthetic oligonucleotide
  Target: ATXN1; (+) strand; PAM type: YTN; PAM sequence: CTA
ccagcatccagcgcatagag

SEQ ID NO: 255028 - DNA, 20 bp, Artificial Sequence
  Description of Artificial Sequence: Synthetic oligonucleotide
  Target: ATXN1; (+) strand; PAM type: YTN; PAM sequence: CTG
ctaaatttctcccaatgcac

SEQ ID NO: 255029 - DNA, 20 bp, Artificial Sequence
  Description of Artificial Sequence: Synthetic oligonucleotide
  Target: ATXN1; (+) strand; PAM type: YTN; PAM sequence: CTA
aatttctcccaatgcacggg

SEQ ID NO: 255030 - DNA, 20 bp, Artificial Sequence
  Description of Artificial Sequence: Synthetic oligonucleotide
  Target: ATXN1; (+) strand; PAM type: YTN; PAM sequence: TTT
ctcccaatgcacgggacacc

SEQ ID NO: 255031 - DNA, 20 bp, Artificial Sequence
  Description of Artificial Sequence: Synthetic oligonucleotide
  Target: ATXN1; (+) strand; PAM type: YTN; PAM sequence: TTC
tcccaatgcacgggacacct

SEQ ID NO: 255032 - DNA, 20 bp, Artificial Sequence
  Description of Artificial Sequence: Synthetic oligonucleotide
  Target: ATXN1; (+) strand; PAM type: YTN; PAM sequence: CTC
ccaatgcacgggacacctcc

SEQ ID NO: 255033 - DNA, 20 bp, Artificial Sequence
  Description of Artificial Sequence: Synthetic oligonucleotide
  Target: ATXN1; (+) strand; PAM type: YTN; PAM sequence: CTC
caccccctccatctccctgc

SEQ ID NO: 255034 - DNA, 20 bp, Artificial Sequence
  Description of Artificial Sequence: Synthetic oligonucleotide
  Target: ATXN1; (+) strand; PAM type: YTN; PAM sequence: CTC
catctccctgcttccccaaa

SEQ ID NO: 255035 - DNA, 20 bp, Artificial Sequence
  Description of Artificial Sequence: Synthetic oligonucleotide
  Target: ATXN1; (+) strand; PAM type: YTN; PAM sequence: CTC
cctgcttccccaaataggat

SEQ ID NO: 255036 - DNA, 20 bp, Artificial Sequence
  Description of Artificial Sequence: Synthetic oligonucleotide
  Target: ATXN1; (+) strand; PAM type: YTN; PAM sequence: CTG
cttccccaaataggatgatc

SEQ ID NO: 255037 - DNA, 20 bp, Artificial Sequence
  Description of Artificial Sequence: Synthetic oligonucleotide
  Target: ATXN1; (+) strand; PAM type: YTN; PAM sequence: CTT
ccccaaataggatgatctgg

SEQ ID NO: 255038 - DNA, 20 bp, Artificial Sequence
  Description of Artificial Sequence: Synthetic oligonucleotide
  Target: ATXN1; (+) strand; PAM type: YTN; PAM sequence: TTC
cccaaataggatgatctggg

SEQ ID NO: 255039 - DNA, 20 bp, Artificial Sequence
  Description of Artificial Sequence: Synthetic oligonucleotide
  Target: ATXN1; (+) strand; PAM type: YTN; PAM sequence: CTG
ggccccaaatgtcaacagtg

SEQ ID NO: 255040 - DNA, 20 bp, Artificial Sequence
  Description of Artificial Sequence: Synthetic oligonucleotide
  Target: ATXN1; (+) strand; PAM type: YTN; PAM sequence: CTG
ttgagattccctgctctaaa

SEQ ID NO: 255041 - DNA, 20 bp, Artificial Sequence
  Description of Artificial Sequence: Synthetic oligonucleotide
  Target: ATXN1; (+) strand; PAM type: YTN; PAM sequence: TTG
agattccctgctctaaaggg

SEQ ID NO: 255042 - DNA, 20 bp, Artificial Sequence
  Description of Artificial Sequence: Synthetic oligonucleotide
  Target: ATXN1; (+) strand; PAM type: YTN; PAM sequence: TTC
cctgctctaaagggaagcag

SEQ ID NO: 255043 - DNA, 20 bp, Artificial Sequence
  Description of Artificial Sequence: Synthetic oligonucleotide
  Target: ATXN1; (+) strand; PAM type: YTN; PAM sequence: CTG
ctctaaagggaagcagaaaa

SEQ ID NO: 255044 - DNA, 20 bp, Artificial Sequence
  Description of Artificial Sequence: Synthetic oligonucleotide
  Target: ATXN1; (+) strand; PAM type: YTN; PAM sequence: CTC
taaagggaagcagaaaagat

SEQ ID NO: 255045 - DNA, 20 bp, Artificial Sequence
  Description of Artificial Sequence: Synthetic oligonucleotide
  Target: ATXN1; (+) strand; PAM type: YTN; PAM sequence: CTA
aagggaagcagaaaagatca

SEQ ID NO: 255046 - DNA, 20 bp, Artificial Sequence
  Description of Artificial Sequence: Synthetic oligonucleotide
  Target: ATXN1; (+) strand; PAM type: YTN; PAM sequence: CTG
cagccagagaattttccatt

SEQ ID NO: 255047 - DNA, 20 bp, Artificial Sequence
  Description of Artificial Sequence: Synthetic oligonucleotide
  Target: ATXN1; (+) strand; PAM type: YTN; PAM sequence: TTT
tccattgaccttctaactgt

SEQ ID NO: 255048 - DNA, 20 bp, Artificial Sequence
  Description of Artificial Sequence: Synthetic oligonucleotide
  Target: ATXN1; (+) strand; PAM type: YTN; PAM sequence: TTT
ccattgaccttctaactgtt

SEQ ID NO: 255049 - DNA, 20 bp, Artificial Sequence
  Description of Artificial Sequence: Synthetic oligonucleotide
  Target: ATXN1; (+) strand; PAM type: YTN; PAM sequence: TTC
cattgaccttctaactgttg

SEQ ID NO: 255050 - DNA, 20 bp, Artificial Sequence
  Description of Artificial Sequence: Synthetic oligonucleotide
  Target: ATXN1; (+) strand; PAM type: YTN; PAM sequence: TTG
accttctaactgttgcctgg

SEQ ID NO: 255051 - DNA, 20 bp, Artificial Sequence
  Description of Artificial Sequence: Synthetic oligonucleotide
  Target: ATXN1; (+) strand; PAM type: YTN; PAM sequence: CTT
ctaactgttgcctgggctcc

SEQ ID NO: 255052 - DNA, 20 bp, Artificial Sequence
  Description of Artificial Sequence: Synthetic oligonucleotide
  Target: ATXN1; (+) strand; PAM type: YTN; PAM sequence: TTC
taactgttgcctgggctcct

SEQ ID NO: 255053 - DNA, 20 bp, Artificial Sequence
  Description of Artificial Sequence: Synthetic oligonucleotide
  Target: ATXN1; (+) strand; PAM type: YTN; PAM sequence: CTA
actgttgcctgggctcctgg

SEQ ID NO: 255054 - DNA, 20 bp, Artificial Sequence
  Description of Artificial Sequence: Synthetic oligonucleotide
  Target: ATXN1; (+) strand; PAM type: YTN; PAM sequence: CTG
ttgcctgggctcctggagga

SEQ ID NO: 255055 - DNA, 20 bp, Artificial Sequence
  Description of Artificial Sequence: Synthetic oligonucleotide
  Target: ATXN1; (+) strand; PAM type: YTN; PAM sequence: TTG
cctgggctcctggaggacat

SEQ ID NO: 255056 - DNA, 20 bp, Artificial Sequence
  Description of Artificial Sequence: Synthetic oligonucleotide
  Target: ATXN1; (+) strand; PAM type: YTN; PAM sequence: CTG
ggctcctggaggacatcctc

SEQ ID NO: 255057 - DNA, 20 bp, Artificial Sequence
  Description of Artificial Sequence: Synthetic oligonucleotide
  Target: ATXN1; (+) strand; PAM type: YTN; PAM sequence: CTC
ctggaggacatcctctgaag

SEQ ID NO: 255058 - DNA, 20 bp, Artificial Sequence
  Description of Artificial Sequence: Synthetic oligonucleotide
  Target: ATXN1; (+) strand; PAM type: YTN; PAM sequence: CTG
gaggacatcctctgaagatg

SEQ ID NO: 255059 - DNA, 20 bp, Artificial Sequence
  Description of Artificial Sequence: Synthetic oligonucleotide
  Target: ATXN1; (+) strand; PAM type: YTN; PAM sequence: CTC
tgaagatgcttgtttccttg

SEQ ID NO: 255060 - DNA, 20 bp, Artificial Sequence
  Description of Artificial Sequence: Synthetic oligonucleotide
  Target: ATXN1; (+) strand; PAM type: YTN; PAM sequence: CTG
aagatgcttgtttccttgac

SEQ ID NO: 255061 - DNA, 20 bp, Artificial Sequence
  Description of Artificial Sequence: Synthetic oligonucleotide
  Target: ATXN1; (+) strand; PAM type: YTN; PAM sequence: CTT
gtttccttgacctaaacgct

SEQ ID NO: 255062 - DNA, 20 bp, Artificial Sequence
  Description of Artificial Sequence: Synthetic oligonucleotide
  Target: ATXN1; (+) strand; PAM type: YTN; PAM sequence: TTG
tttccttgacctaaacgcta

SEQ ID NO: 255063 - DNA, 20 bp, Artificial Sequence
  Description of Artificial Sequence: Synthetic oligonucleotide
  Target: ATXN1; (+) strand; PAM type: YTN; PAM sequence: TTT
ccttgacctaaacgctagcc

SEQ ID NO: 255064 - DNA, 20 bp, Artificial Sequence
  Description of Artificial Sequence: Synthetic oligonucleotide
  Target: ATXN1; (+) strand; PAM type: YTN; PAM sequence: TTC
cttgacctaaacgctagcct

SEQ ID NO: 255065 - DNA, 20 bp, Artificial Sequence
  Description of Artificial Sequence: Synthetic oligonucleotide
  Target: ATXN1; (+) strand; PAM type: YTN; PAM sequence: CTT
gacctaaacgctagcctcac

SEQ ID NO: 255066 - DNA, 20 bp, Artificial Sequence
  Description of Artificial Sequence: Synthetic oligonucleotide
  Target: ATXN1; (+) strand; PAM type: YTN; PAM sequence: TTG
acctaaacgctagcctcacc

SEQ ID NO: 255067 - DNA, 20 bp, Artificial Sequence
  Description of Artificial Sequence: Synthetic oligonucleotide
  Target: ATXN1; (+) strand; PAM type: YTN; PAM sequence: CTA
aacgctagcctcaccatggc

SEQ ID NO: 255068 - DNA, 20 bp, Artificial Sequence
  Description of Artificial Sequence: Synthetic oligonucleotide
  Target: ATXN1; (+) strand; PAM type: YTN; PAM sequence: CTA
gcctcaccatggcccacagc

SEQ ID NO: 255069 - DNA, 20 bp, Artificial Sequence
  Description of Artificial Sequence: Synthetic oligonucleotide
  Target: ATXN1; (+) strand; PAM type: YTN; PAM sequence: CTC
accatggcccacagcccagc

SEQ ID NO: 255070 - DNA, 20 bp, Artificial Sequence
  Description of Artificial Sequence: Synthetic oligonucleotide
  Target: ATXN1; (+) strand; PAM type: YTN; PAM sequence: CTA
gggagcatgtgggaaatgca

SEQ ID NO: 255071 - DNA, 20 bp, Artificial Sequence
  Description of Artificial Sequence: Synthetic oligonucleotide
  Target: ATXN1; (+) strand; PAM type: YTN; PAM sequence: CTC
aggtcccacccagactgaca

SEQ ID NO: 255072 - DNA, 20 bp, Artificial Sequence
  Description of Artificial Sequence: Synthetic oligonucleotide
  Target: ATXN1; (+) strand; PAM type: YTN; PAM sequence: CTG
acagaaccagaatgtgcatt

SEQ ID NO: 255073 - DNA, 20 bp, Artificial Sequence
  Description of Artificial Sequence: Synthetic oligonucleotide
  Target: ATXN1; (+) strand; PAM type: YTN; PAM sequence: TTT
ccactagaacgctgggggct

SEQ ID NO: 255074 - DNA, 20 bp, Artificial Sequence
  Description of Artificial Sequence: Synthetic oligonucleotide
  Target: ATXN1; (+) strand; PAM type: YTN; PAM sequence: TTC
cactagaacgctgggggctt

SEQ ID NO: 255075 - DNA, 20 bp, Artificial Sequence
  Description of Artificial Sequence: Synthetic oligonucleotide
  Target: ATXN1; (+) strand; PAM type: YTN; PAM sequence: CTA
gaacgctgggggcttcctag

SEQ ID NO: 255076 - DNA, 20 bp, Artificial Sequence
  Description of Artificial Sequence: Synthetic oligonucleotide
  Target: ATXN1; (+) strand; PAM type: YTN; PAM sequence: CTG
ggggcttcctagacacttga

SEQ ID NO: 255077 - DNA, 20 bp, Artificial Sequence
  Description of Artificial Sequence: Synthetic oligonucleotide
  Target: ATXN1; (+) strand; PAM type: YTN; PAM sequence: CTT
cctagacacttgaaactttc

SEQ ID NO: 255078 - DNA, 20 bp, Artificial Sequence
  Description of Artificial Sequence: Synthetic oligonucleotide
  Target: ATXN1; (+) strand; PAM type: YTN; PAM sequence: TTC
ctagacacttgaaactttca

SEQ ID NO: 255079 - DNA, 20 bp, Artificial Sequence
  Description of Artificial Sequence: Synthetic oligonucleotide
  Target: ATXN1; (+) strand; PAM type: YTN; PAM sequence: CTA
gacacttgaaactttcagaa

SEQ ID NO: 255080 - DNA, 20 bp, Artificial Sequence
  Description of Artificial Sequence: Synthetic oligonucleotide
  Target: ATXN1; (+) strand; PAM type: YTN; PAM sequence: CTT
gaaactttcagaagcaccag

SEQ ID NO: 255081 - DNA, 20 bp, Artificial Sequence
  Description of Artificial Sequence: Synthetic oligonucleotide
  Target: ATXN1; (+) strand; PAM type: YTN; PAM sequence: TTG
aaactttcagaagcaccaga

SEQ ID NO: 255082 - DNA, 20 bp, Artificial Sequence
  Description of Artificial Sequence: Synthetic oligonucleotide
  Target: ATXN1; (+) strand; PAM type: YTN; PAM sequence: CTT
tcagaagcaccagacagacc

SEQ ID NO: 255083 - DNA, 20 bp, Artificial Sequence
  Description of Artificial Sequence: Synthetic oligonucleotide
  Target: ATXN1; (+) strand; PAM type: YTN; PAM sequence: TTT
cagaagcaccagacagacct

SEQ ID NO: 255084 - DNA, 20 bp, Artificial Sequence
  Description of Artificial Sequence: Synthetic oligonucleotide
  Target: ATXN1; (+) strand; PAM type: YTN; PAM sequence: TTC
agaagcaccagacagacctc

SEQ ID NO: 255085 - DNA, 20 bp, Artificial Sequence
  Description of Artificial Sequence: Synthetic oligonucleotide
  Target: ATXN1; (+) strand; PAM type: YTN; PAM sequence: CTC
tctcacctatccttaggtct

SEQ ID NO: 255086 - DNA, 20 bp, Artificial Sequence
  Description of Artificial Sequence: Synthetic oligonucleotide
  Target: ATXN1; (+) strand; PAM type: YTN; PAM sequence: CTC
tcacctatccttaggtctgt

SEQ ID NO: 255087 - DNA, 20 bp, Artificial Sequence
  Description of Artificial Sequence: Synthetic oligonucleotide
  Target: ATXN1; (+) strand; PAM type: YTN; PAM sequence: CTC
acctatccttaggtctgtct

SEQ ID NO: 255088 - DNA, 20 bp, Artificial Sequence
  Description of Artificial Sequence: Synthetic oligonucleotide
  Target: ATXN1; (+) strand; PAM type: YTN; PAM sequence: CTA
tccttaggtctgtctgtcct

SEQ ID NO: 255089 - DNA, 20 bp, Artificial Sequence
  Description of Artificial Sequence: Synthetic oligonucleotide
  Target: ATXN1; (+) strand; PAM type: YTN; PAM sequence: CTT
aggtctgtctgtccttctat

SEQ ID NO: 255090 - DNA, 20 bp, Artificial Sequence
  Description of Artificial Sequence: Synthetic oligonucleotide
  Target: ATXN1; (+) strand; PAM type: YTN; PAM sequence: TTA
ggtctgtctgtccttctatt

SEQ ID NO: 255091 - DNA, 20 bp, Artificial Sequence
  Description of Artificial Sequence: Synthetic oligonucleotide
  Target: ATXN1; (+) strand; PAM type: YTN; PAM sequence: CTG
tctgtccttctattcactca

SEQ ID NO: 255092 - DNA, 20 bp, Artificial Sequence
  Description of Artificial Sequence: Synthetic oligonucleotide
  Target: ATXN1; (+) strand; PAM type: YTN; PAM sequence: CTG
tccttctattcactcagtat

SEQ ID NO: 255093 - DNA, 20 bp, Artificial Sequence
  Description of Artificial Sequence: Synthetic oligonucleotide
  Target: ATXN1; (+) strand; PAM type: YTN; PAM sequence: CTT
ctattcactcagtattaatt

SEQ ID NO: 255094 - DNA, 20 bp, Artificial Sequence
  Description of Artificial Sequence: Synthetic oligonucleotide
  Target: ATXN1; (+) strand; PAM type: YTN; PAM sequence: TTC
tattcactcagtattaatta

SEQ ID NO: 255095 - DNA, 20 bp, Artificial Sequence
  Description of Artificial Sequence: Synthetic oligonucleotide
  Target: ATXN1; (+) strand; PAM type: YTN; PAM sequence: CTA
ttcactcagtattaattatt

SEQ ID NO: 255096 - DNA, 20 bp, Artificial Sequence
  Description of Artificial Sequence: Synthetic oligonucleotide
  Target: ATXN1; (+) strand; PAM type: YTN; PAM sequence: TTC
actcagtattaattatttcc

SEQ ID NO: 255097 - DNA, 20 bp, Artificial Sequence
  Description of Artificial Sequence: Synthetic oligonucleotide
  Target: ATXN1; (+) strand; PAM type: YTN; PAM sequence: CTC
agtattaattatttccactc

SEQ ID NO: 255098 - DNA, 20 bp, Artificial Sequence
  Description of Artificial Sequence: Synthetic oligonucleotide
  Target: ATXN1; (+) strand; PAM type: YTN; PAM sequence: TTA
attatttccactctgccctc

SEQ ID NO: 255099 - DNA, 20 bp, Artificial Sequence
  Description of Artificial Sequence: Synthetic oligonucleotide
  Target: ATXN1; (+) strand; PAM type: YTN; PAM sequence: TTA
tttccactctgccctctgaa

SEQ ID NO: 255100 - DNA, 20 bp, Artificial Sequence
  Description of Artificial Sequence: Synthetic oligonucleotide
  Target: ATXN1; (+) strand; PAM type: YTN; PAM sequence: TTT
ccactctgccctctgaatac

SEQ ID NO: 255101 - DNA, 20 bp, Artificial Sequence
  Description of Artificial Sequence: Synthetic oligonucleotide
  Target: ATXN1; (+) strand; PAM type: YTN; PAM sequence: TTC
cactctgccctctgaataca

SEQ ID NO: 255102 - DNA, 20 bp, Artificial Sequence
  Description of Artificial Sequence: Synthetic oligonucleotide
  Target: ATXN1; (+) strand; PAM type: YTN; PAM sequence: CTC
tgccctctgaatacacagta

SEQ ID NO: 255103 - DNA, 20 bp, Artificial Sequence
  Description of Artificial Sequence: Synthetic oligonucleotide
  Target: ATXN1; (+) strand; PAM type: YTN; PAM sequence: CTG
ccctctgaatacacagtaat

SEQ ID NO: 255104 - DNA, 20 bp, Artificial Sequence
  Description of Artificial Sequence: Synthetic oligonucleotide
  Target: ATXN1; (+) strand; PAM type: YTN; PAM sequence: CTC
tgaatacacagtaatctagt

SEQ ID NO: 255105 - DNA, 20 bp, Artificial Sequence
  Description of Artificial Sequence: Synthetic oligonucleotide
  Target: ATXN1; (+) strand; PAM type: YTN; PAM sequence: CTG
aatacacagtaatctagtaa

SEQ ID NO: 255106 - DNA, 20 bp, Artificial Sequence
  Description of Artificial Sequence: Synthetic oligonucleotide
  Target: ATXN1; (+) strand; PAM type: YTN; PAM sequence: CTA
gtaaaaagtagctctcttct

SEQ ID NO: 255107 - DNA, 20 bp, Artificial Sequence
  Description of Artificial Sequence: Synthetic oligonucleotide
  Target: ATXN1; (+) strand; PAM type: YTN; PAM sequence: CTC
tcttcttgcttcagcctttc

SEQ ID NO: 255108 - DNA, 20 bp, Artificial Sequence
  Description of Artificial Sequence: Synthetic oligonucleotide
  Target: ATXN1; (+) strand; PAM type: YTN; PAM sequence: CTC
ttcttgcttcagcctttcct

SEQ ID NO: 255109 - DNA, 20 bp, Artificial Sequence
  Description of Artificial Sequence: Synthetic oligonucleotide
  Target: ATXN1; (+) strand; PAM type: YTN; PAM sequence: CTT
cttgcttcagcctttcctca

SEQ ID NO: 255110 - DNA, 20 bp, Artificial Sequence
  Description of Artificial Sequence: Synthetic oligonucleotide
  Target: ATXN1; (+) strand; PAM type: YTN; PAM sequence: TTC
ttgcttcagcctttcctcag

SEQ ID NO: 255111 - DNA, 20 bp, Artificial Sequence
  Description of Artificial Sequence: Synthetic oligonucleotide
  Target: ATXN1; (+) strand; PAM type: YTN; PAM sequence: CTT
gcttcagcctttcctcagaa

SEQ ID NO: 255112 - DNA, 20 bp, Artificial Sequence
  Description of Artificial Sequence: Synthetic oligonucleotide
  Target: ATXN1; (+) strand; PAM type: YTN; PAM sequence: TTG
cttcagcctttcctcagaac

SEQ ID NO: 255113 - DNA, 20 bp, Artificial Sequence
  Description of Artificial Sequence: Synthetic oligonucleotide
  Target: ATXN1; (+) strand; PAM type: YTN; PAM sequence: CTT
cagcctttcctcagaacatt

SEQ ID NO: 255114 - DNA, 20 bp, Artificial Sequence
  Description of Artificial Sequence: Synthetic oligonucleotide
  Target: ATXN1; (+) strand; PAM type: YTN; PAM sequence: TTC
agcctttcctcagaacattc

SEQ ID NO: 255115 - DNA, 20 bp, Artificial Sequence
  Description of Artificial Sequence: Synthetic oligonucleotide
  Target: ATXN1; (+) strand; PAM type: YTN; PAM sequence: CTT
tcctcagaacattctctcca

SEQ ID NO: 255116 - DNA, 20 bp, Artificial Sequence
  Description of Artificial Sequence: Synthetic oligonucleotide
  Target: ATXN1; (+) strand; PAM type: YTN; PAM sequence: TTT
cctcagaacattctctccaa

SEQ ID NO: 255117 - DNA, 20 bp, Artificial Sequence
  Description of Artificial Sequence: Synthetic oligonucleotide
  Target: ATXN1; (+) strand; PAM type: YTN; PAM sequence: TTC
ctcagaacattctctccaac

SEQ ID NO: 255118 - DNA, 20 bp, Artificial Sequence
  Description of Artificial Sequence: Synthetic oligonucleotide
  Target: ATXN1; (+) strand; PAM type: YTN; PAM sequence: CTC
agaacattctctccaaccca

SEQ ID NO: 255119 - DNA, 20 bp, Artificial Sequence
  Description of Artificial Sequence: Synthetic oligonucleotide
  Target: ATXN1; (+) strand; PAM type: YTN; PAM sequence: TTC
tctccaacccagactgtaac

SEQ ID NO: 255120 - DNA, 20 bp, Artificial Sequence
  Description of Artificial Sequence: Synthetic oligonucleotide
  Target: ATXN1; (+) strand; PAM type: YTN; PAM sequence: CTC
tccaacccagactgtaacct

SEQ ID NO: 255121 - DNA, 20 bp, Artificial Sequence
  Description of Artificial Sequence: Synthetic oligonucleotide
  Target: ATXN1; (+) strand; PAM type: YTN; PAM sequence: CTC
caacccagactgtaaccttg

SEQ ID NO: 255122 - DNA, 20 bp, Artificial Sequence
  Description of Artificial Sequence: Synthetic oligonucleotide
  Target: ATXN1; (+) strand; PAM type: YTN; PAM sequence: CTG
taaccttggctccctgcaga

SEQ ID NO: 255123 - DNA, 20 bp, Artificial Sequence
  Description of Artificial Sequence: Synthetic oligonucleotide
  Target: ATXN1; (+) strand; PAM type: YTN; PAM sequence: CTT
ggctccctgcagacagccct

SEQ ID NO: 255124 - DNA, 20 bp, Artificial Sequence
  Description of Artificial Sequence: Synthetic oligonucleotide
  Target: ATXN1; (+) strand; PAM type: YTN; PAM sequence: TTG
gctccctgcagacagccctg

SEQ ID NO: 255125 - DNA, 20 bp, Artificial Sequence
  Description of Artificial Sequence: Synthetic oligonucleotide
  Target: ATXN1; (+) strand; PAM type: YTN; PAM sequence: CTC
cctgcagacagccctgtttc

SEQ ID NO: 255126 - DNA, 20 bp, Artificial Sequence
  Description of Artificial Sequence: Synthetic oligonucleotide
  Target: ATXN1; (+) strand; PAM type: YTN; PAM sequence: CTG
cagacagccctgtttctcct

SEQ ID NO: 255127 - DNA, 20 bp, Artificial Sequence
  Description of Artificial Sequence: Synthetic oligonucleotide
  Target: ATXN1; (+) strand; PAM type: YTN; PAM sequence: CTG
tttctcctacagccctctga

SEQ ID NO: 255128 - DNA, 20 bp, Artificial Sequence
  Description of Artificial Sequence: Synthetic oligonucleotide
  Target: ATXN1; (+) strand; PAM type: YTN; PAM sequence: TTT
ctcctacagccctctgaggt

SEQ ID NO: 255129 - DNA, 20 bp, Artificial Sequence
  Description of Artificial Sequence: Synthetic oligonucleotide
  Target: ATXN1; (+) strand; PAM type: YTN; PAM sequence: TTC
tcctacagccctctgaggtg

SEQ ID NO: 255130 - DNA, 20 bp, Artificial Sequence
  Description of Artificial Sequence: Synthetic oligonucleotide
  Target: ATXN1; (+) strand; PAM type: YTN; PAM sequence: CTC
ctacagccctctgaggtgga

SEQ ID NO: 255131 - DNA, 20 bp, Artificial Sequence
  Description of Artificial Sequence: Synthetic oligonucleotide
  Target: ATXN1; (+) strand; PAM type: YTN; PAM sequence: CTA
cagccctctgaggtggagag

SEQ ID NO: 255132 - DNA, 20 bp, Artificial Sequence
  Description of Artificial Sequence: Synthetic oligonucleotide
  Target: ATXN1; (+) strand; PAM type: YTN; PAM sequence: CTC
tgaggtggagagagctcaac

SEQ ID NO: 255133 - DNA, 20 bp, Artificial Sequence
  Description of Artificial Sequence: Synthetic oligonucleotide
  Target: ATXN1; (+) strand; PAM type: YTN; PAM sequence: CTG
aggtggagagagctcaacct

SEQ ID NO: 255134 - DNA, 20 bp, Artificial Sequence
  Description of Artificial Sequence: Synthetic oligonucleotide
  Target: ATXN1; (+) strand; PAM type: YTN; PAM sequence: CTC
aacctcccaagcccctgttc

SEQ ID NO: 255135 - DNA, 20 bp, Artificial Sequence
  Description of Artificial Sequence: Synthetic oligonucleotide
  Target: ATXN1; (+) strand; PAM type: YTN; PAM sequence: CTC
ccaagcccctgttcagggct

SEQ ID NO: 255136 - DNA, 20 bp, Artificial Sequence
  Description of Artificial Sequence: Synthetic oligonucleotide
  Target: ATXN1; (+) strand; PAM type: YTN; PAM sequence: CTG
ttcagggctccgtggctact

SEQ ID NO: 255137 - DNA, 20 bp, Artificial Sequence
  Description of Artificial Sequence: Synthetic oligonucleotide
  Target: ATXN1; (+) strand; PAM type: YTN; PAM sequence: TTC
agggctccgtggctacttcc

SEQ ID NO: 255138 - DNA, 20 bp, Artificial Sequence
  Description of Artificial Sequence: Synthetic oligonucleotide
  Target: ATXN1; (+) strand; PAM type: YTN; PAM sequence: CTC
cgtggctacttcctctatcc

SEQ ID NO: 255139 - DNA, 20 bp, Artificial Sequence
  Description of Artificial Sequence: Synthetic oligonucleotide
  Target: ATXN1; (+) strand; PAM type: YTN; PAM sequence: CTA
cttcctctatcctcattcga

SEQ ID NO: 255140 - DNA, 20 bp, Artificial Sequence
  Description of Artificial Sequence: Synthetic oligonucleotide
  Target: ATXN1; (+) strand; PAM type: YTN; PAM sequence: CTT
cctctatcctcattcgaaaa

SEQ ID NO: 255141 - DNA, 20 bp, Artificial Sequence
  Description of Artificial Sequence: Synthetic oligonucleotide
  Target: ATXN1; (+) strand; PAM type: YTN; PAM sequence: TTC
ctctatcctcattcgaaaat

SEQ ID NO: 255142 - DNA, 20 bp, Artificial Sequence
  Description of Artificial Sequence: Synthetic oligonucleotide
  Target: ATXN1; (+) strand; PAM type: YTN; PAM sequence: CTC
tatcctcattcgaaaattcc

SEQ ID NO: 255143 - DNA, 20 bp, Artificial Sequence
  Description of Artificial Sequence: Synthetic oligonucleotide
  Target: ATXN1; (+) strand; PAM type: YTN; PAM sequence: CTA
tcctcattcgaaaattcctt

SEQ ID NO: 255144 - DNA, 20 bp, Artificial Sequence
  Description of Artificial Sequence: Synthetic oligonucleotide
  Target: ATXN1; (+) strand; PAM type: YTN; PAM sequence: CTC
attcgaaaattccttctctt

SEQ ID NO: 255145 - DNA, 20 bp, Artificial Sequence
  Description of Artificial Sequence: Synthetic oligonucleotide
  Target: ATXN1; (+) strand; PAM type: YTN; PAM sequence: TTC
gaaaattccttctcttctga

SEQ ID NO: 255146 - DNA, 20 bp, Artificial Sequence
  Description of Artificial Sequence: Synthetic oligonucleotide
  Target: ATXN1; (+) strand; PAM type: YTN; PAM sequence: TTC
cttctcttctgaccacgtgg

SEQ ID NO: 255147 - DNA, 20 bp, Artificial Sequence
  Description of Artificial Sequence: Synthetic oligonucleotide
  Target: ATXN1; (+) strand; PAM type: YTN; PAM sequence: CTT
ctcttctgaccacgtggcca

SEQ ID NO: 255148 - DNA, 20 bp, Artificial Sequence
  Description of Artificial Sequence: Synthetic oligonucleotide
  Target: ATXN1; (+) strand; PAM type: YTN; PAM sequence: TTC
tcttctgaccacgtggccat

SEQ ID NO: 255149 - DNA, 20 bp, Artificial Sequence
  Description of Artificial Sequence: Synthetic oligonucleotide
  Target: ATXN1; (+) strand; PAM type: YTN; PAM sequence: CTC
ttctgaccacgtggccatgg

SEQ ID NO: 255150 - DNA, 20 bp, Artificial Sequence
  Description of Artificial Sequence: Synthetic oligonucleotide
  Target: ATXN1; (+) strand; PAM type: YTN; PAM sequence: CTT
ctgaccacgtggccatggcc

SEQ ID NO: 255151 - DNA, 20 bp, Artificial Sequence
  Description of Artificial Sequence: Synthetic oligonucleotide
  Target: ATXN1; (+) strand; PAM type: YTN; PAM sequence: TTC
tgaccacgtggccatggcca

SEQ ID NO: 255152 - DNA, 20 bp, Artificial Sequence
  Description of Artificial Sequence: Synthetic oligonucleotide
  Target: ATXN1; (+) strand; PAM type: YTN; PAM sequence: CTG
accacgtggccatggccaga

SEQ ID NO: 255153 - DNA, 20 bp, Artificial Sequence
  Description of Artificial Sequence: Synthetic oligonucleotide
  Target: ATXN1; (+) strand; PAM type: YTN; PAM sequence: TTG
gcttccatttattgttgcaa

SEQ ID NO: 255154 - DNA, 20 bp, Artificial Sequence
  Description of Artificial Sequence: Synthetic oligonucleotide
  Target: ATXN1; (+) strand; PAM type: YTN; PAM sequence: CTT
ccatttattgttgcaaggta

SEQ ID NO: 255155 - DNA, 20 bp, Artificial Sequence
  Description of Artificial Sequence: Synthetic oligonucleotide
  Target: ATXN1; (+) strand; PAM type: YTN; PAM sequence: TTC
catttattgttgcaaggtac

SEQ ID NO: 255156 - DNA, 20 bp, Artificial Sequence
  Description of Artificial Sequence: Synthetic oligonucleotide
  Target: ATXN1; (+) strand; PAM type: YTN; PAM sequence: TTT
attgttgcaaggtacaagtt

SEQ ID NO: 255157 - DNA, 20 bp, Artificial Sequence
  Description of Artificial Sequence: Synthetic oligonucleotide
  Target: ATXN1; (+) strand; PAM type: YTN; PAM sequence: TTA
ttgttgcaaggtacaagttt

SEQ ID NO: 255158 - DNA, 20 bp, Artificial Sequence
  Description of Artificial Sequence: Synthetic oligonucleotide
  Target: ATXN1; (+) strand; PAM type: YTN; PAM sequence: TTG
ttgcaaggtacaagttttca

SEQ ID NO: 255159 - DNA, 20 bp, Artificial Sequence
  Description of Artificial Sequence: Synthetic oligonucleotide
  Target: ATXN1; (+) strand; PAM type: YTN; PAM sequence: TTG
caaggtacaagttttcaagc

SEQ ID NO: 255160 - DNA, 20 bp, Artificial Sequence
  Description of Artificial Sequence: Synthetic oligonucleotide
  Target: ATXN1; (+) strand; PAM type: YTN; PAM sequence: TTT
tcaagccagttctaggtacc

SEQ ID NO: 255161 - DNA, 20 bp, Artificial Sequence
  Description of Artificial Sequence: Synthetic oligonucleotide
  Target: ATXN1; (+) strand; PAM type: YTN; PAM sequence: TTT
caagccagttctaggtacct

SEQ ID NO: 255162 - DNA, 20 bp, Artificial Sequence
  Description of Artificial Sequence: Synthetic oligonucleotide
  Target: ATXN1; (+) strand; PAM type: YTN; PAM sequence: TTC
aagccagttctaggtacctg

SEQ ID NO: 255163 - DNA, 20 bp, Artificial Sequence
  Description of Artificial Sequence: Synthetic oligonucleotide
  Target: ATXN1; (+) strand; PAM type: YTN; PAM sequence: TTC
taggtacctggatcatggca

SEQ ID NO: 255164 - DNA, 20 bp, Artificial Sequence
  Description of Artificial Sequence: Synthetic oligonucleotide
  Target: ATXN1; (+) strand; PAM type: YTN; PAM sequence: CTA
ggtacctggatcatggcatt

SEQ ID NO: 255165 - DNA, 20 bp, Artificial Sequence
  Description of Artificial Sequence: Synthetic oligonucleotide
  Target: ATXN1; (+) strand; PAM type: YTN; PAM sequence: CTG
gatcatggcattcctatttg

SEQ ID NO: 255166 - DNA, 20 bp, Artificial Sequence
  Description of Artificial Sequence: Synthetic oligonucleotide
  Target: ATXN1; (+) strand; PAM type: YTN; PAM sequence: TTC
ctatttgccctcaacccaac

SEQ ID NO: 255167 - DNA, 20 bp, Artificial Sequence
  Description of Artificial Sequence: Synthetic oligonucleotide
  Target: ATXN1; (+) strand; PAM type: YTN; PAM sequence: CTA
tttgccctcaacccaactgt

SEQ ID NO: 255168 - DNA, 20 bp, Artificial Sequence
  Description of Artificial Sequence: Synthetic oligonucleotide
  Target: ATXN1; (+) strand; PAM type: YTN; PAM sequence: TTT
gccctcaacccaactgtgga

SEQ ID NO: 255169 - DNA, 20 bp, Artificial Sequence
  Description of Artificial Sequence: Synthetic oligonucleotide
  Target: ATXN1; (+) strand; PAM type: YTN; PAM sequence: TTG
ccctcaacccaactgtggaa

SEQ ID NO: 255170 - DNA, 20 bp, Artificial Sequence
  Description of Artificial Sequence: Synthetic oligonucleotide
  Target: ATXN1; (+) strand; PAM type: YTN; PAM sequence: CTC
aacccaactgtggaattctc

SEQ ID NO: 255171 - DNA, 20 bp, Artificial Sequence
  Description of Artificial Sequence: Synthetic oligonucleotide
  Target: ATXN1; (+) strand; PAM type: YTN; PAM sequence: CTG
tggaattctccagtgactat

SEQ ID NO: 255172 - DNA, 20 bp, Artificial Sequence
  Description of Artificial Sequence: Synthetic oligonucleotide
  Target: ATXN1; (+) strand; PAM type: YTN; PAM sequence: TTC
tccagtgactatgtggatga

SEQ ID NO: 255173 - DNA, 20 bp, Artificial Sequence
  Description of Artificial Sequence: Synthetic oligonucleotide
  Target: ATXN1; (+) strand; PAM type: YTN; PAM sequence: CTC
cagtgactatgtggatgaca

SEQ ID NO: 255174 - DNA, 20 bp, Artificial Sequence
  Description of Artificial Sequence: Synthetic oligonucleotide
  Target: ATXN1; (+) strand; PAM type: YTN; PAM sequence: CTA
tgtggatgacatcttacaca

SEQ ID NO: 255175 - DNA, 20 bp, Artificial Sequence
  Description of Artificial Sequence: Synthetic oligonucleotide
  Target: ATXN1; (+) strand; PAM type: YTN; PAM sequence: CTT
acacaagaattcctggttcc

SEQ ID NO: 255176 - DNA, 20 bp, Artificial Sequence
  Description of Artificial Sequence: Synthetic oligonucleotide
  Target: ATXN1; (+) strand; PAM type: YTN; PAM sequence: TTA
cacaagaattcctggttcct

SEQ ID NO: 255177 - DNA, 20 bp, Artificial Sequence
  Description of Artificial Sequence: Synthetic oligonucleotide
  Target: ATXN1; (+) strand; PAM type: YTN; PAM sequence: TTC
ctggttcctgaaccttttct

SEQ ID NO: 255178 - DNA, 20 bp, Artificial Sequence
  Description of Artificial Sequence: Synthetic oligonucleotide
  Target: ATXN1; (+) strand; PAM type: YTN; PAM sequence: CTG
gttcctgaaccttttctaca

SEQ ID NO: 255179 - DNA, 20 bp, Artificial Sequence
  Description of Artificial Sequence: Synthetic oligonucleotide
  Target: ATXN1; (+) strand; PAM type: YTN; PAM sequence: TTC
ctgaaccttttctacagtgg

SEQ ID NO: 255180 - DNA, 20 bp, Artificial Sequence
  Description of Artificial Sequence: Synthetic oligonucleotide
  Target: ATXN1; (+) strand; PAM type: YTN; PAM sequence: CTG
aaccttttctacagtggcaa

SEQ ID NO: 255181 - DNA, 20 bp, Artificial Sequence
  Description of Artificial Sequence: Synthetic oligonucleotide
  Target: ATXN1; (+) strand; PAM type: YTN; PAM sequence: CTT
ttctacagtggcaacaacca

SEQ ID NO: 255182 - DNA, 20 bp, Artificial Sequence
  Description of Artificial Sequence: Synthetic oligonucleotide
  Target: ATXN1; (+) strand; PAM type: YTN; PAM sequence: TTT
tctacagtggcaacaaccac

SEQ ID NO: 255183 - DNA, 20 bp, Artificial Sequence
  Description of Artificial Sequence: Synthetic oligonucleotide
  Target: ATXN1; (+) strand; PAM type: YTN; PAM sequence: TTT
ctacagtggcaacaaccaca

SEQ ID NO: 255184 - DNA, 20 bp, Artificial Sequence
  Description of Artificial Sequence: Synthetic oligonucleotide
  Target: ATXN1; (+) strand; PAM type: YTN; PAM sequence: TTC
tacagtggcaacaaccacat

SEQ ID NO: 255185 - DNA, 20 bp, Artificial Sequence
  Description of Artificial Sequence: Synthetic oligonucleotide
  Target: ATXN1; (+) strand; PAM type: YTN; PAM sequence: CTA
cagtggcaacaaccacattc

SEQ ID NO: 255186 - DNA, 20 bp, Artificial Sequence
  Description of Artificial Sequence: Synthetic oligonucleotide
  Target: ATXN1; (+) strand; PAM type: YTN; PAM sequence: TTC
cccttcagaacattcatttg

SEQ ID NO: 255187 - DNA, 20 bp, Artificial Sequence
  Description of Artificial Sequence: Synthetic oligonucleotide
  Target: ATXN1; (+) strand; PAM type: YTN; PAM sequence: CTT
cagaacattcatttgttaat

SEQ ID NO: 255188 - DNA, 20 bp, Artificial Sequence
  Description of Artificial Sequence: Synthetic oligonucleotide
  Target: ATXN1; (+) strand; PAM type: YTN; PAM sequence: TTC
agaacattcatttgttaatc

SEQ ID NO: 255189 - DNA, 20 bp, Artificial Sequence
  Description of Artificial Sequence: Synthetic oligonucleotide
  Target: ATXN1; (+) strand; PAM type: YTN; PAM sequence: TTC
atttgttaatccaatattta

SEQ ID NO: 255190 - DNA, 20 bp, Artificial Sequence
  Description of Artificial Sequence: Synthetic oligonucleotide
  Target: ATXN1; (+) strand; PAM type: YTN; PAM sequence: TTT
gttaatccaatatttatgat

SEQ ID NO: 255191 - DNA, 20 bp, Artificial Sequence
  Description of Artificial Sequence: Synthetic oligonucleotide
  Target: ATXN1; (+) strand; PAM type: YTN; PAM sequence: TTG
ttaatccaatatttatgatg

SEQ ID NO: 255192 - DNA, 20 bp, Artificial Sequence
  Description of Artificial Sequence: Synthetic oligonucleotide
  Target: ATXN1; (+) strand; PAM type: YTN; PAM sequence: TTA
atccaatatttatgatgtgt

SEQ ID NO: 255193 - DNA, 20 bp, Artificial Sequence
  Description of Artificial Sequence: Synthetic oligonucleotide
  Target: ATXN1; (+) strand; PAM type: YTN; PAM sequence: TTT
atgatgtgtctctttcatat

SEQ ID NO: 255194 - DNA, 20 bp, Artificial Sequence
  Description of Artificial Sequence: Synthetic oligonucleotide
  Target: ATXN1; (+) strand; PAM type: YTN; PAM sequence: TTA
tgatgtgtctctttcatatc

SEQ ID NO: 255195 - DNA, 20 bp, Artificial Sequence
  Description of Artificial Sequence: Synthetic oligonucleotide
  Target: ATXN1; (+) strand; PAM type: YTN; PAM sequence: CTC
tttcatatctgactgtgtgc

SEQ ID NO: 255196 - DNA, 20 bp, Artificial Sequence
  Description of Artificial Sequence: Synthetic oligonucleotide
  Target: ATXN1; (+) strand; PAM type: YTN; PAM sequence: CTT
tcatatctgactgtgtgcta

SEQ ID NO: 255197 - DNA, 20 bp, Artificial Sequence
  Description of Artificial Sequence: Synthetic oligonucleotide
  Target: ATXN1; (+) strand; PAM type: YTN; PAM sequence: TTT
catatctgactgtgtgctaa

SEQ ID NO: 255198 - DNA, 20 bp, Artificial Sequence
  Description of Artificial Sequence: Synthetic oligonucleotide
  Target: ATXN1; (+) strand; PAM type: YTN; PAM sequence: TTC
atatctgactgtgtgctaaa

SEQ ID NO: 255199 - DNA, 20 bp, Artificial Sequence
  Description of Artificial Sequence: Synthetic oligonucleotide
  Target: ATXN1; (+) strand; PAM type: YTN; PAM sequence: CTG
actgtgtgctaaagatatta

SEQ ID NO: 255200 - DNA, 20 bp, Artificial Sequence
  Description of Artificial Sequence: Synthetic oligonucleotide
  Target: ATXN1; (+) strand; PAM type: YTN; PAM sequence: CTG
tgtgctaaagatattaagat

SEQ ID NO: 255201 - DNA, 20 bp, Artificial Sequence
  Description of Artificial Sequence: Synthetic oligonucleotide
  Target: ATXN1; (+) strand; PAM type: YTN; PAM sequence: CTA
aagatattaagattaccata

SEQ ID NO: 255202 - DNA, 20 bp, Artificial Sequence
  Description of Artificial Sequence: Synthetic oligonucleotide
  Target: ATXN1; (+) strand; PAM type: YTN; PAM sequence: TTA
agattaccatattgtccttg

SEQ ID NO: 255203 - DNA, 20 bp, Artificial Sequence
  Description of Artificial Sequence: Synthetic oligonucleotide
  Target: ATXN1; (+) strand; PAM type: YTN; PAM sequence: TTA
ccatattgtccttgttctca

SEQ ID NO: 255204 - DNA, 20 bp, Artificial Sequence
  Description of Artificial Sequence: Synthetic oligonucleotide
  Target: ATXN1; (+) strand; PAM type: YTN; PAM sequence: TTG
tccttgttctcaatgagctt

SEQ ID NO: 255205 - DNA, 20 bp, Artificial Sequence
  Description of Artificial Sequence: Synthetic oligonucleotide
  Target: ATXN1; (+) strand; PAM type: YTN; PAM sequence: CTT
gttctcaatgagcttacagt

SEQ ID NO: 255206 - DNA, 20 bp, Artificial Sequence
  Description of Artificial Sequence: Synthetic oligonucleotide
  Target: ATXN1; (+) strand; PAM type: YTN; PAM sequence: TTG
ttctcaatgagcttacagtc

SEQ ID NO: 255207 - DNA, 20 bp, Artificial Sequence
  Description of Artificial Sequence: Synthetic oligonucleotide
  Target: ATXN1; (+) strand; PAM type: YTN; PAM sequence: TTC
tcaatgagcttacagtctaa

SEQ ID NO: 255208 - DNA, 20 bp, Artificial Sequence
  Description of Artificial Sequence: Synthetic oligonucleotide
  Target: ATXN1; (+) strand; PAM type: YTN; PAM sequence: CTC
aatgagcttacagtctaaaa

SEQ ID NO: 255209 - DNA, 20 bp, Artificial Sequence
  Description of Artificial Sequence: Synthetic oligonucleotide
  Target: ATXN1; (+) strand; PAM type: YTN; PAM sequence: CTT
acagtctaaaagagggaggg

SEQ ID NO: 255210 - DNA, 20 bp, Artificial Sequence
  Description of Artificial Sequence: Synthetic oligonucleotide
  Target: ATXN1; (+) strand; PAM type: YTN; PAM sequence: TTA
cagtctaaaagagggaggga

SEQ ID NO: 255211 - DNA, 20 bp, Artificial Sequence
  Description of Artificial Sequence: Synthetic oligonucleotide
  Target: ATXN1; (+) strand; PAM type: YTN; PAM sequence: CTA
aaagagggagggagggagaa

SEQ ID NO: 255212 - DNA, 20 bp, Artificial Sequence
  Description of Artificial Sequence: Synthetic oligonucleotide
  Target: ATXN1; (+) strand; PAM type: YTN; PAM sequence: TTT
tggcactagaaggagcttcg

SEQ ID NO: 255213 - DNA, 20 bp, Artificial Sequence
  Description of Artificial Sequence: Synthetic oligonucleotide
  Target: ATXN1; (+) strand; PAM type: YTN; PAM sequence: TTT
ggcactagaaggagcttcgg

SEQ ID NO: 255214 - DNA, 20 bp, Artificial Sequence
  Description of Artificial Sequence: Synthetic oligonucleotide
  Target: ATXN1; (+) strand; PAM type: YTN; PAM sequence: TTG
gcactagaaggagcttcggg

SEQ ID NO: 255215 - DNA, 20 bp, Artificial Sequence
  Description of Artificial Sequence: Synthetic oligonucleotide
  Target: ATXN1; (+) strand; PAM type: YTN; PAM sequence: CTA
gaaggagcttcgggaattac

SEQ ID NO: 255216 - DNA, 20 bp, Artificial Sequence
  Description of Artificial Sequence: Synthetic oligonucleotide
  Target: ATXN1; (+) strand; PAM type: YTN; PAM sequence: CTT
cgggaattacaagccagaga

SEQ ID NO: 255217 - DNA, 20 bp, Artificial Sequence
  Description of Artificial Sequence: Synthetic oligonucleotide
  Target: ATXN1; (+) strand; PAM type: YTN; PAM sequence: TTC
gggaattacaagccagagaa

SEQ ID NO: 255218 - DNA, 20 bp, Artificial Sequence
  Description of Artificial Sequence: Synthetic oligonucleotide
  Target: ATXN1; (+) strand; PAM type: YTN; PAM sequence: TTA
caagccagagaaaagctcaa

SEQ ID NO: 255219 - DNA, 20 bp, Artificial Sequence
  Description of Artificial Sequence: Synthetic oligonucleotide
  Target: ATXN1; (+) strand; PAM type: YTN; PAM sequence: CTC
aaagaaggtcatggtctact

SEQ ID NO: 255220 - DNA, 20 bp, Artificial Sequence
  Description of Artificial Sequence: Synthetic oligonucleotide
  Target: ATXN1; (+) strand; PAM type: YTN; PAM sequence: CTA
ctttttggccatttttattg

SEQ ID NO: 255221 - DNA, 20 bp, Artificial Sequence
  Description of Artificial Sequence: Synthetic oligonucleotide
  Target: ATXN1; (+) strand; PAM type: YTN; PAM sequence: CTT
tttggccatttttattggct

SEQ ID NO: 255222 - DNA, 20 bp, Artificial Sequence
  Description of Artificial Sequence: Synthetic oligonucleotide
  Target: ATXN1; (+) strand; PAM type: YTN; PAM sequence: TTT
ttggccatttttattggcta

SEQ ID NO: 255223 - DNA, 20 bp, Artificial Sequence
  Description of Artificial Sequence: Synthetic oligonucleotide
  Target: ATXN1; (+) strand; PAM type: YTN; PAM sequence: TTT
tggccatttttattggctaa

SEQ ID NO: 255224 - DNA, 20 bp, Artificial Sequence
  Description of Artificial Sequence: Synthetic oligonucleotide
  Target: ATXN1; (+) strand; PAM type: YTN; PAM sequence: TTT
ggccatttttattggctaac

SEQ ID NO: 255225 - DNA, 20 bp, Artificial Sequence
  Description of Artificial Sequence: Synthetic oligonucleotide
  Target: ATXN1; (+) strand; PAM type: YTN; PAM sequence: TTG
gccatttttattggctaaca

SEQ ID NO: 255226 - DNA, 20 bp, Artificial Sequence
  Description of Artificial Sequence: Synthetic oligonucleotide
  Target: ATXN1; (+) strand; PAM type: YTN; PAM sequence: TTT
ttattggctaacactccaac

SEQ ID NO: 255227 - DNA, 20 bp, Artificial Sequence
  Description of Artificial Sequence: Synthetic oligonucleotide
  Target: ATXN1; (+) strand; PAM type: YTN; PAM sequence: TTT
tattggctaacactccaacc

SEQ ID NO: 255228 - DNA, 20 bp, Artificial Sequence
  Description of Artificial Sequence: Synthetic oligonucleotide
  Target: ATXN1; (+) strand; PAM type: YTN; PAM sequence: TTT
attggctaacactccaaccc

SEQ ID NO: 255229 - DNA, 20 bp, Artificial Sequence
  Description of Artificial Sequence: Synthetic oligonucleotide
  Target: ATXN1; (+) strand; PAM type: YTN; PAM sequence: TTA
ttggctaacactccaaccca

SEQ ID NO: 255230 - DNA, 20 bp, Artificial Sequence
  Description of Artificial Sequence: Synthetic oligonucleotide
  Target: ATXN1; (+) strand; PAM type: YTN; PAM sequence: TTG
gctaacactccaacccagta

SEQ ID NO: 255231 - DNA, 20 bp, Artificial Sequence
  Description of Artificial Sequence: Synthetic oligonucleotide
  Target: ATXN1; (+) strand; PAM type: YTN; PAM sequence: CTA
acactccaacccagtagttc

SEQ ID NO: 255232 - DNA, 20 bp, Artificial Sequence
  Description of Artificial Sequence: Synthetic oligonucleotide
  Target: ATXN1; (+) strand; PAM type: YTN; PAM sequence: CTC
caacccagtagttcccacat

SEQ ID NO: 255233 - DNA, 20 bp, Artificial Sequence
  Description of Artificial Sequence: Synthetic oligonucleotide
  Target: ATXN1; (+) strand; PAM type: YTN; PAM sequence: TTC
ccacatgctggtctgagaac

SEQ ID NO: 255234 - DNA, 20 bp, Artificial Sequence
  Description of Artificial Sequence: Synthetic oligonucleotide
  Target: ATXN1; (+) strand; PAM type: YTN; PAM sequence: CTG
gtctgagaaccagggccaat

SEQ ID NO: 255235 - DNA, 20 bp, Artificial Sequence
  Description of Artificial Sequence: Synthetic oligonucleotide
  Target: ATXN1; (+) strand; PAM type: YTN; PAM sequence: CTG
agaaccagggccaatccgtg

SEQ ID NO: 255236 - DNA, 20 bp, Artificial Sequence
  Description of Artificial Sequence: Synthetic oligonucleotide
  Target: ATXN1; (+) strand; PAM type: YTN; PAM sequence: TTA
aatttctaggacttactctg

SEQ ID NO: 255237 - DNA, 20 bp, Artificial Sequence
  Description of Artificial Sequence: Synthetic oligonucleotide
  Target: ATXN1; (+) strand; PAM type: YTN; PAM sequence: TTT
ctaggacttactctgatatt

SEQ ID NO: 255238 - DNA, 20 bp, Artificial Sequence
  Description of Artificial Sequence: Synthetic oligonucleotide
  Target: ATXN1; (+) strand; PAM type: YTN; PAM sequence: TTC
taggacttactctgatatta

SEQ ID NO: 255239 - DNA, 20 bp, Artificial Sequence
  Description of Artificial Sequence: Synthetic oligonucleotide
  Target: ATXN1; (+) strand; PAM type: YTN; PAM sequence: CTA
ggacttactctgatattata

SEQ ID NO: 255240 - DNA, 20 bp, Artificial Sequence
  Description of Artificial Sequence: Synthetic oligonucleotide
  Target: ATXN1; (+) strand; PAM type: YTN; PAM sequence: CTT
actctgatattatattattt

SEQ ID NO: 255241 - DNA, 20 bp, Artificial Sequence
  Description of Artificial Sequence: Synthetic oligonucleotide
  Target: ATXN1; (+) strand; PAM type: YTN; PAM sequence: TTA
ctctgatattatattatttt

SEQ ID NO: 255242 - DNA, 20 bp, Artificial Sequence
  Description of Artificial Sequence: Synthetic oligonucleotide
  Target: ATXN1; (+) strand; PAM type: YTN; PAM sequence: CTC
tgatattatattattttcac

SEQ ID NO: 255243 - DNA, 20 bp, Artificial Sequence
  Description of Artificial Sequence: Synthetic oligonucleotide
  Target: ATXN1; (+) strand; PAM type: YTN; PAM sequence: CTG
atattatattattttcactt

SEQ ID NO: 255244 - DNA, 20 bp, Artificial Sequence
  Description of Artificial Sequence: Synthetic oligonucleotide
  Target: ATXN1; (+) strand; PAM type: YTN; PAM sequence: TTA
tattattttcactttgggga

SEQ ID NO: 255245 - DNA, 20 bp, Artificial Sequence
  Description of Artificial Sequence: Synthetic oligonucleotide
  Target: ATXN1; (+) strand; PAM type: YTN; PAM sequence: TTA
ttttcactttggggatgtta

SEQ ID NO: 255246 - DNA, 20 bp, Artificial Sequence
  Description of Artificial Sequence: Synthetic oligonucleotide
  Target: ATXN1; (+) strand; PAM type: YTN; PAM sequence: TTT
tcactttggggatgttaaaa

SEQ ID NO: 255247 - DNA, 20 bp, Artificial Sequence
  Description of Artificial Sequence: Synthetic oligonucleotide
  Target: ATXN1; (+) strand; PAM type: YTN; PAM sequence: TTT
cactttggggatgttaaaat

SEQ ID NO: 255248 - DNA, 20 bp, Artificial Sequence
  Description of Artificial Sequence: Synthetic oligonucleotide
  Target: ATXN1; (+) strand; PAM type: YTN; PAM sequence: TTC
actttggggatgttaaaata

SEQ ID NO: 255249 - DNA, 20 bp, Artificial Sequence
  Description of Artificial Sequence: Synthetic oligonucleotide
  Target: ATXN1; (+) strand; PAM type: YTN; PAM sequence: CTT
tggggatgttaaaatatccc

SEQ ID NO: 255250 - DNA, 20 bp, Artificial Sequence
  Description of Artificial Sequence: Synthetic oligonucleotide
  Target: ATXN1; (+) strand; PAM type: YTN; PAM sequence: TTT
ggggatgttaaaatatccct

SEQ ID NO: 255251 - DNA, 20 bp, Artificial Sequence
  Description of Artificial Sequence: Synthetic oligonucleotide
  Target: ATXN1; (+) strand; PAM type: YTN; PAM sequence: TTG
gggatgttaaaatatccctt

SEQ ID NO: 255252 - DNA, 20 bp, Artificial Sequence
  Description of Artificial Sequence: Synthetic oligonucleotide
  Target: ATXN1; (+) strand; PAM type: YTN; PAM sequence: TTA
aaatatcccttcctttttaa

SEQ ID NO: 255253 - DNA, 20 bp, Artificial Sequence
  Description of Artificial Sequence: Synthetic oligonucleotide
  Target: ATXN1; (+) strand; PAM type: YTN; PAM sequence: CTT
cctttttaaaaagattagaa

SEQ ID NO: 255254 - DNA, 20 bp, Artificial Sequence
  Description of Artificial Sequence: Synthetic oligonucleotide
  Target: ATXN1; (+) strand; PAM type: YTN; PAM sequence: TTC
ctttttaaaaagattagaaa

SEQ ID NO: 255255 - DNA, 20 bp, Artificial Sequence
  Description of Artificial Sequence: Synthetic oligonucleotide
  Target: ATXN1; (+) strand; PAM type: YTN; PAM sequence: CTT
tttaaaaagattagaaaact

SEQ ID NO: 255256 - DNA, 20 bp, Artificial Sequence
  Description of Artificial Sequence: Synthetic oligonucleotide
  Target: ATXN1; (+) strand; PAM type: YTN; PAM sequence: TTT
ttaaaaagattagaaaactt

SEQ ID NO: 255257 - DNA, 20 bp, Artificial Sequence
  Description of Artificial Sequence: Synthetic oligonucleotide
  Target: ATXN1; (+) strand; PAM type: YTN; PAM sequence: TTT
taaaaagattagaaaactta

SEQ ID NO: 255258 - DNA, 20 bp, Artificial Sequence
  Description of Artificial Sequence: Synthetic oligonucleotide
  Target: ATXN1; (+) strand; PAM type: YTN; PAM sequence: TTT
aaaaagattagaaaacttat

SEQ ID NO: 255259 - DNA, 20 bp, Artificial Sequence
  Description of Artificial Sequence: Synthetic oligonucleotide
  Target: ATXN1; (+) strand; PAM type: YTN; PAM sequence: TTA
aaaagattagaaaacttatt

SEQ ID NO: 255260 - DNA, 20 bp, Artificial Sequence
  Description of Artificial Sequence: Synthetic oligonucleotide
  Target: ATXN1; (+) strand; PAM type: YTN; PAM sequence: TTA
gaaaacttattttaaagtgt

SEQ ID NO: 255261 - DNA, 20 bp, Artificial Sequence
  Description of Artificial Sequence: Synthetic oligonucleotide
  Target: ATXN1; (+) strand; PAM type: YTN; PAM sequence: CTT
attttaaagtgtccagtgtc

SEQ ID NO: 255262 - DNA, 20 bp, Artificial Sequence
  Description of Artificial Sequence: Synthetic oligonucleotide
  Target: ATXN1; (+) strand; PAM type: YTN; PAM sequence: TTA
ttttaaagtgtccagtgtcc

SEQ ID NO: 255263 - DNA, 20 bp, Artificial Sequence
  Description of Artificial Sequence: Synthetic oligonucleotide
  Target: ATXN1; (+) strand; PAM type: YTN; PAM sequence: TTT
taaagtgtccagtgtcctta

SEQ ID NO: 255264 - DNA, 20 bp, Artificial Sequence
  Description of Artificial Sequence: Synthetic oligonucleotide
  Target: ATXN1; (+) strand; PAM type: YTN; PAM sequence: TTT
aaagtgtccagtgtccttac

SEQ ID NO: 255265 - DNA, 20 bp, Artificial Sequence
  Description of Artificial Sequence: Synthetic oligonucleotide
  Target: ATXN1; (+) strand; PAM type: YTN; PAM sequence: TTA
aagtgtccagtgtccttaca

SEQ ID NO: 255266 - DNA, 20 bp, Artificial Sequence
  Description of Artificial Sequence: Synthetic oligonucleotide
  Target: ATXN1; (+) strand; PAM type: YTN; PAM sequence: CTT
acattaaaataaagagttga

SEQ ID NO: 255267 - DNA, 20 bp, Artificial Sequence
  Description of Artificial Sequence: Synthetic oligonucleotide
  Target: ATXN1; (+) strand; PAM type: YTN; PAM sequence: TTA
cattaaaataaagagttgac

SEQ ID NO: 255268 - DNA, 20 bp, Artificial Sequence
  Description of Artificial Sequence: Synthetic oligonucleotide
  Target: ATXN1; (+) strand; PAM type: YTN; PAM sequence: TTA
aaataaagagttgacccaca

SEQ ID NO: 255269 - DNA, 20 bp, Artificial Sequence
  Description of Artificial Sequence: Synthetic oligonucleotide
  Target: ATXN1; (+) strand; PAM type: YTN; PAM sequence: TTG
acccacatatgctagtaccc

SEQ ID NO: 255270 - DNA, 20 bp, Artificial Sequence
  Description of Artificial Sequence: Synthetic oligonucleotide
  Target: ATXN1; (+) strand; PAM type: YTN; PAM sequence: CTA
gtaccccattaattttctaa

SEQ ID NO: 255271 - DNA, 20 bp, Artificial Sequence
  Description of Artificial Sequence: Synthetic oligonucleotide
  Target: ATXN1; (+) strand; PAM type: YTN; PAM sequence: TTA
attttctaaaactcatcctt

SEQ ID NO: 255272 - DNA, 20 bp, Artificial Sequence
  Description of Artificial Sequence: Synthetic oligonucleotide
  Target: ATXN1; (+) strand; PAM type: YTN; PAM sequence: TTT
tctaaaactcatccttgaaa

SEQ ID NO: 255273 - DNA, 20 bp, Artificial Sequence
  Description of Artificial Sequence: Synthetic oligonucleotide
  Target: ATXN1; (+) strand; PAM type: YTN; PAM sequence: TTT
ctaaaactcatccttgaaac

SEQ ID NO: 255274 - DNA, 20 bp, Artificial Sequence
  Description of Artificial Sequence: Synthetic oligonucleotide
  Target: ATXN1; (+) strand; PAM type: YTN; PAM sequence: TTC
taaaactcatccttgaaacc

SEQ ID NO: 255275 - DNA, 20 bp, Artificial Sequence
  Description of Artificial Sequence: Synthetic oligonucleotide
  Target: ATXN1; (+) strand; PAM type: YTN; PAM sequence: CTA
aaactcatccttgaaacctg

SEQ ID NO: 255276 - DNA, 20 bp, Artificial Sequence
  Description of Artificial Sequence: Synthetic oligonucleotide
  Target: ATXN1; (+) strand; PAM type: YTN; PAM sequence: CTC
atccttgaaacctggaagtg

SEQ ID NO: 255277 - DNA, 20 bp, Artificial Sequence
  Description of Artificial Sequence: Synthetic oligonucleotide
  Target: ATXN1; (+) strand; PAM type: YTN; PAM sequence: CTT
gaaacctggaagtggctttc

SEQ ID NO: 255278 - DNA, 20 bp, Artificial Sequence
  Description of Artificial Sequence: Synthetic oligonucleotide
  Target: ATXN1; (+) strand; PAM type: YTN; PAM sequence: TTG
aaacctggaagtggctttcc

SEQ ID NO: 255279 - DNA, 20 bp, Artificial Sequence
  Description of Artificial Sequence: Synthetic oligonucleotide
  Target: ATXN1; (+) strand; PAM type: YTN; PAM sequence: CTG
gaagtggctttccaggtcta

SEQ ID NO: 255280 - DNA, 20 bp, Artificial Sequence
  Description of Artificial Sequence: Synthetic oligonucleotide
  Target: ATXN1; (+) strand; PAM type: YTN; PAM sequence: CTT
tccaggtctacatgggaggg

SEQ ID NO: 255281 - DNA, 20 bp, Artificial Sequence
  Description of Artificial Sequence: Synthetic oligonucleotide
  Target: ATXN1; (+) strand; PAM type: YTN; PAM sequence: TTT
ccaggtctacatgggagggg

SEQ ID NO: 255282 - DNA, 20 bp, Artificial Sequence
  Description of Artificial Sequence: Synthetic oligonucleotide
  Target: ATXN1; (+) strand; PAM type: YTN; PAM sequence: TTC
caggtctacatgggaggggc

SEQ ID NO: 255283 - DNA, 20 bp, Artificial Sequence
  Description of Artificial Sequence: Synthetic oligonucleotide
  Target: ATXN1; (+) strand; PAM type: YTN; PAM sequence: CTA
catgggaggggcttgcttag

SEQ ID NO: 255284 - DNA, 20 bp, Artificial Sequence
  Description of Artificial Sequence: Synthetic oligonucleotide
  Target: ATXN1; (+) strand; PAM type: YTN; PAM sequence: CTT
gcttaggccagggacagtct

SEQ ID NO: 255285 - DNA, 20 bp, Artificial Sequence
  Description of Artificial Sequence: Synthetic oligonucleotide
  Target: ATXN1; (+) strand; PAM type: YTN; PAM sequence: TTG
cttaggccagggacagtctg

SEQ ID NO: 255286 - DNA, 20 bp, Artificial Sequence
  Description of Artificial Sequence: Synthetic oligonucleotide
  Target: ATXN1; (+) strand; PAM type: YTN; PAM sequence: CTT
aggccagggacagtctggtt

SEQ ID NO: 255287 - DNA, 20 bp, Artificial Sequence
  Description of Artificial Sequence: Synthetic oligonucleotide
  Target: ATXN1; (+) strand; PAM type: YTN; PAM sequence: TTA
ggccagggacagtctggttg

SEQ ID NO: 255288 - DNA, 20 bp, Artificial Sequence
  Description of Artificial Sequence: Synthetic oligonucleotide
  Target: ATXN1; (+) strand; PAM type: YTN; PAM sequence: CTG
gttgtagcgagggttggcaa

SEQ ID NO: 255289 - DNA, 20 bp, Artificial Sequence
  Description of Artificial Sequence: Synthetic oligonucleotide
  Target: ATXN1; (+) strand; PAM type: YTN; PAM sequence: TTG
tagcgagggttggcaagact

SEQ ID NO: 255290 - DNA, 20 bp, Artificial Sequence
  Description of Artificial Sequence: Synthetic oligonucleotide
  Target: ATXN1; (+) strand; PAM type: YTN; PAM sequence: TTG
gcaagacttgctttgaagcc

SEQ ID NO: 255291 - DNA, 20 bp, Artificial Sequence
  Description of Artificial Sequence: Synthetic oligonucleotide
  Target: ATXN1; (+) strand; PAM type: YTN; PAM sequence: CTT
gctttgaagccacatttgcc

SEQ ID NO: 255292 - DNA, 20 bp, Artificial Sequence
  Description of Artificial Sequence: Synthetic oligonucleotide
  Target: ATXN1; (+) strand; PAM type: YTN; PAM sequence: TTG
ctttgaagccacatttgccc

SEQ ID NO: 255293 - DNA, 20 bp, Artificial Sequence
  Description of Artificial Sequence: Synthetic oligonucleotide
  Target: ATXN1; (+) strand; PAM type: YTN; PAM sequence: CTT
tgaagccacatttgcccgtc

SEQ ID NO: 255294 - DNA, 20 bp, Artificial Sequence
  Description of Artificial Sequence: Synthetic oligonucleotide
  Target: ATXN1; (+) strand; PAM type: YTN; PAM sequence: TTT
gaagccacatttgcccgtct

SEQ ID NO: 255295 - DNA, 20 bp, Artificial Sequence
  Description of Artificial Sequence: Synthetic oligonucleotide
  Target: ATXN1; (+) strand; PAM type: YTN; PAM sequence: TTG
aagccacatttgcccgtctc

SEQ ID NO: 255296 - DNA, 20 bp, Artificial Sequence
  Description of Artificial Sequence: Synthetic oligonucleotide
  Target: ATXN1; (+) strand; PAM type: YTN; PAM sequence: TTT
gcccgtctctttacacaaca

SEQ ID NO: 255297 - DNA, 20 bp, Artificial Sequence
  Description of Artificial Sequence: Synthetic oligonucleotide
  Target: ATXN1; (+) strand; PAM type: YTN; PAM sequence: TTG
cccgtctctttacacaacat

SEQ ID NO: 255298 - DNA, 20 bp, Artificial Sequence
  Description of Artificial Sequence: Synthetic oligonucleotide
  Target: ATXN1; (+) strand; PAM type: YTN; PAM sequence: CTC
tttacacaacatgggaagtc

SEQ ID NO: 255299 - DNA, 20 bp, Artificial Sequence
  Description of Artificial Sequence: Synthetic oligonucleotide
  Target: ATXN1; (+) strand; PAM type: YTN; PAM sequence: CTT
tacacaacatgggaagtcat

SEQ ID NO: 255300 - DNA, 20 bp, Artificial Sequence
  Description of Artificial Sequence: Synthetic oligonucleotide
  Target: ATXN1; (+) strand; PAM type: YTN; PAM sequence: TTT
acacaacatgggaagtcatt

SEQ ID NO: 255301 - DNA, 20 bp, Artificial Sequence
  Description of Artificial Sequence: Synthetic oligonucleotide
  Target: ATXN1; (+) strand; PAM type: YTN; PAM sequence: TTA
cacaacatgggaagtcatta

SEQ ID NO: 255302 - DNA, 20 bp, Artificial Sequence
  Description of Artificial Sequence: Synthetic oligonucleotide
  Target: ATXN1; (+) strand; PAM type: YTN; PAM sequence: TTA
attgttcttcataaaagatt

SEQ ID NO: 255303 - DNA, 20 bp, Artificial Sequence
  Description of Artificial Sequence: Synthetic oligonucleotide
  Target: ATXN1; (+) strand; PAM type: YTN; PAM sequence: TTG
ttcttcataaaagattcaat

SEQ ID NO: 255304 - DNA, 20 bp, Artificial Sequence
  Description of Artificial Sequence: Synthetic oligonucleotide
  Target: ATXN1; (+) strand; PAM type: YTN; PAM sequence: TTC
ttcataaaagattcaatgtg

SEQ ID NO: 255305 - DNA, 20 bp, Artificial Sequence
  Description of Artificial Sequence: Synthetic oligonucleotide
  Target: ATXN1; (+) strand; PAM type: YTN; PAM sequence: CTT
cataaaagattcaatgtgcc

SEQ ID NO: 255306 - DNA, 20 bp, Artificial Sequence
  Description of Artificial Sequence: Synthetic oligonucleotide
  Target: ATXN1; (+) strand; PAM type: YTN; PAM sequence: TTC
ataaaagattcaatgtgcca

SEQ ID NO: 255307 - DNA, 20 bp, Artificial Sequence
  Description of Artificial Sequence: Synthetic oligonucleotide
  Target: ATXN1; (+) strand; PAM type: YTN; PAM sequence: TTC
aatgtgccaagtcaagcctg

SEQ ID NO: 255308 - DNA, 20 bp, Artificial Sequence
  Description of Artificial Sequence: Synthetic oligonucleotide
  Target: ATXN1; (+) strand; PAM type: YTN; PAM sequence: CTG
ggggaccaggctcacacctg

SEQ ID NO: 255309 - DNA, 20 bp, Artificial Sequence
  Description of Artificial Sequence: Synthetic oligonucleotide
  Target: ATXN1; (+) strand; PAM type: YTN; PAM sequence: CTC
acacctgtaatcctggtgtt

SEQ ID NO: 255310 - DNA, 20 bp, Artificial Sequence
  Description of Artificial Sequence: Synthetic oligonucleotide
  Target: ATXN1; (+) strand; PAM type: YTN; PAM sequence: CTG
taatcctggtgttttgggaa

SEQ ID NO: 255311 - DNA, 20 bp, Artificial Sequence
  Description of Artificial Sequence: Synthetic oligonucleotide
  Target: ATXN1; (+) strand; PAM type: YTN; PAM sequence: CTG
gtgttttgggaagctgaggc

SEQ ID NO: 255312 - DNA, 20 bp, Artificial Sequence
  Description of Artificial Sequence: Synthetic oligonucleotide
  Target: ATXN1; (+) strand; PAM type: YTN; PAM sequence: TTT
tgggaagctgaggcaggagg

SEQ ID NO: 255313 - DNA, 20 bp, Artificial Sequence
  Description of Artificial Sequence: Synthetic oligonucleotide
  Target: ATXN1; (+) strand; PAM type: YTN; PAM sequence: TTT
gggaagctgaggcaggagga

SEQ ID NO: 255314 - DNA, 20 bp, Artificial Sequence
  Description of Artificial Sequence: Synthetic oligonucleotide
  Target: ATXN1; (+) strand; PAM type: YTN; PAM sequence: TTG
ggaagctgaggcaggaggat

SEQ ID NO: 255315 - DNA, 20 bp, Artificial Sequence
  Description of Artificial Sequence: Synthetic oligonucleotide
  Target: ATXN1; (+) strand; PAM type: YTN; PAM sequence: CTG
aggcaggaggatcacttgac

SEQ ID NO: 255316 - DNA, 20 bp, Artificial Sequence
  Description of Artificial Sequence: Synthetic oligonucleotide
  Target: ATXN1; (+) strand; PAM type: YTN; PAM sequence: CTT
gacaccaggaggtcaagatc

SEQ ID NO: 255317 - DNA, 20 bp, Artificial Sequence
  Description of Artificial Sequence: Synthetic oligonucleotide
  Target: ATXN1; (+) strand; PAM type: YTN; PAM sequence: TTG
acaccaggaggtcaagatca

SEQ ID NO: 255318 - DNA, 20 bp, Artificial Sequence
  Description of Artificial Sequence: Synthetic oligonucleotide
  Target: ATXN1; (+) strand; PAM type: YTN; PAM sequence: CTT
gactctaaaaaacataattt

SEQ ID NO: 255319 - DNA, 20 bp, Artificial Sequence
  Description of Artificial Sequence: Synthetic oligonucleotide
  Target: ATXN1; (+) strand; PAM type: YTN; PAM sequence: TTG
actctaaaaaacataattta

SEQ ID NO: 255320 - DNA, 20 bp, Artificial Sequence
  Description of Artificial Sequence: Synthetic oligonucleotide
  Target: ATXN1; (+) strand; PAM type: YTN; PAM sequence: CTC
taaaaaacataatttaaaaa

SEQ ID NO: 255321 - DNA, 20 bp, Artificial Sequence
  Description of Artificial Sequence: Synthetic oligonucleotide
  Target: ATXN1; (+) strand; PAM type: YTN; PAM sequence: CTA
aaaaacataatttaaaaatt

SEQ ID NO: 255322 - DNA, 20 bp, Artificial Sequence
  Description of Artificial Sequence: Synthetic oligonucleotide
  Target: ATXN1; (+) strand; PAM type: YTN; PAM sequence: TTT
aaaaatttaaaaaaaatagc

SEQ ID NO: 255323 - DNA, 20 bp, Artificial Sequence
  Description of Artificial Sequence: Synthetic oligonucleotide
  Target: ATXN1; (+) strand; PAM type: YTN; PAM sequence: TTA
aaaatttaaaaaaaatagct

SEQ ID NO: 255324 - DNA, 20 bp, Artificial Sequence
  Description of Artificial Sequence: Synthetic oligonucleotide
  Target: ATXN1; (+) strand; PAM type: YTN; PAM sequence: TTT
aaaaaaaatagctgggtgtg

SEQ ID NO: 255325 - DNA, 20 bp, Artificial Sequence
  Description of Artificial Sequence: Synthetic oligonucleotide
  Target: ATXN1; (+) strand; PAM type: YTN; PAM sequence: TTA
aaaaaaatagctgggtgtgg

SEQ ID NO: 255326 - DNA, 20 bp, Artificial Sequence
  Description of Artificial Sequence: Synthetic oligonucleotide
  Target: ATXN1; (+) strand; PAM type: YTN; PAM sequence: CTG
ggtgtggtacatgtgcctgc

SEQ ID NO: 255327 - DNA, 20 bp, Artificial Sequence
  Description of Artificial Sequence: Synthetic oligonucleotide
  Target: ATXN1; (+) strand; PAM type: YTN; PAM sequence: CTG
cagtcccagctactcagagg

SEQ ID NO: 255328 - DNA, 20 bp, Artificial Sequence
  Description of Artificial Sequence: Synthetic oligonucleotide
  Target: ATXN1; (+) strand; PAM type: YTN; PAM sequence: CTA
ctcagaggctgagggtggag

SEQ ID NO: 255329 - DNA, 20 bp, Artificial Sequence
  Description of Artificial Sequence: Synthetic oligonucleotide
  Target: ATXN1; (+) strand; PAM type: YTN; PAM sequence: CTC
agaggctgagggtggagaat

SEQ ID NO: 255330 - DNA, 20 bp, Artificial Sequence
  Description of Artificial Sequence: Synthetic oligonucleotide
  Target: ATXN1; (+) strand; PAM type: YTN; PAM sequence: CTG
agggtggagaatcgcttgag

SEQ ID NO: 255331 - DNA, 20 bp, Artificial Sequence
  Description of Artificial Sequence: Synthetic oligonucleotide
  Target: ATXN1; (+) strand; PAM type: YTN; PAM sequence: CTT
gagagagctgtggctaggac

SEQ ID NO: 255332 - DNA, 20 bp, Artificial Sequence
  Description of Artificial Sequence: Synthetic oligonucleotide
  Target: ATXN1; (+) strand; PAM type: YTN; PAM sequence: TTG
agagagctgtggctaggact

SEQ ID NO: 255333 - DNA, 20 bp, Artificial Sequence
  Description of Artificial Sequence: Synthetic oligonucleotide
  Target: ATXN1; (+) strand; PAM type: YTN; PAM sequence: CTG
tggctaggacttttagttgg

SEQ ID NO: 255334 - DNA, 20 bp, Artificial Sequence
  Description of Artificial Sequence: Synthetic oligonucleotide
  Target: ATXN1; (+) strand; PAM type: YTN; PAM sequence: CTA
ggacttttagttggggcaga

SEQ ID NO: 255335 - DNA, 20 bp, Artificial Sequence
  Description of Artificial Sequence: Synthetic oligonucleotide
  Target: ATXN1; (+) strand; PAM type: YTN; PAM sequence: CTT
ttagttggggcagatgaaat

SEQ ID NO: 255336 - DNA, 20 bp, Artificial Sequence
  Description of Artificial Sequence: Synthetic oligonucleotide
  Target: ATXN1; (+) strand; PAM type: YTN; PAM sequence: TTT
tagttggggcagatgaaatg

SEQ ID NO: 255337 - DNA, 20 bp, Artificial Sequence
  Description of Artificial Sequence: Synthetic oligonucleotide
  Target: ATXN1; (+) strand; PAM type: YTN; PAM sequence: TTT
agttggggcagatgaaatgg

SEQ ID NO: 255338 - DNA, 20 bp, Artificial Sequence
  Description of Artificial Sequence: Synthetic oligonucleotide
  Target: ATXN1; (+) strand; PAM type: YTN; PAM sequence: TTA
gttggggcagatgaaatggt

SEQ ID NO: 255339 - DNA, 20 bp, Artificial Sequence
  Description of Artificial Sequence: Synthetic oligonucleotide
  Target: ATXN1; (+) strand; PAM type: YTN; PAM sequence: TTG
gggcagatgaaatggtctaa

SEQ ID NO: 255340 - DNA, 20 bp, Artificial Sequence
  Description of Artificial Sequence: Synthetic oligonucleotide
  Target: ATXN1; (+) strand; PAM type: YTN; PAM sequence: CTA
aggttagacagcaacaaaaa

SEQ ID NO: 255341 - DNA, 20 bp, Artificial Sequence
  Description of Artificial Sequence: Synthetic oligonucleotide
  Target: ATXN1; (+) strand; PAM type: YTN; PAM sequence: TTA
gacagcaacaaaaacaactt

SEQ ID NO: 255342 - DNA, 20 bp, Artificial Sequence
  Description of Artificial Sequence: Synthetic oligonucleotide
  Target: ATXN1; (+) strand; PAM type: YTN; PAM sequence: CTT
tggcagattttgcctccatt

SEQ ID NO: 255343 - DNA, 20 bp, Artificial Sequence
  Description of Artificial Sequence: Synthetic oligonucleotide
  Target: ATXN1; (+) strand; PAM type: YTN; PAM sequence: TTT
ggcagattttgcctccattg

SEQ ID NO: 255344 - DNA, 20 bp, Artificial Sequence
  Description of Artificial Sequence: Synthetic oligonucleotide
  Target: ATXN1; (+) strand; PAM type: YTN; PAM sequence: TTG
gcagattttgcctccattgg

SEQ ID NO: 255345 - DNA, 20 bp, Artificial Sequence
  Description of Artificial Sequence: Synthetic oligonucleotide
  Target: ATXN1; (+) strand; PAM type: YTN; PAM sequence: TTT
tgcctccattgggaagagtg

SEQ ID NO: 255346 - DNA, 20 bp, Artificial Sequence
  Description of Artificial Sequence: Synthetic oligonucleotide
  Target: ATXN1; (+) strand; PAM type: YTN; PAM sequence: TTT
gcctccattgggaagagtgc

SEQ ID NO: 255347 - DNA, 20 bp, Artificial Sequence
  Description of Artificial Sequence: Synthetic oligonucleotide
  Target: ATXN1; (+) strand; PAM type: YTN; PAM sequence: TTG
cctccattgggaagagtgct

SEQ ID NO: 255348 - DNA, 20 bp, Artificial Sequence
  Description of Artificial Sequence: Synthetic oligonucleotide
  Target: ATXN1; (+) strand; PAM type: YTN; PAM sequence: CTC
cattgggaagagtgctcctg

SEQ ID NO: 255349 - DNA, 20 bp, Artificial Sequence
  Description of Artificial Sequence: Synthetic oligonucleotide
  Target: ATXN1; (+) strand; PAM type: YTN; PAM sequence: TTG
ggaagagtgctcctggtgga

SEQ ID NO: 255350 - DNA, 20 bp, Artificial Sequence
  Description of Artificial Sequence: Synthetic oligonucleotide
  Target: ATXN1; (+) strand; PAM type: YTN; PAM sequence: CTC
ctggtggacacactttgagt

SEQ ID NO: 255351 - DNA, 20 bp, Artificial Sequence
  Description of Artificial Sequence: Synthetic oligonucleotide
  Target: ATXN1; (+) strand; PAM type: YTN; PAM sequence: CTG
gtggacacactttgagtctc

SEQ ID NO: 255352 - DNA, 20 bp, Artificial Sequence
  Description of Artificial Sequence: Synthetic oligonucleotide
  Target: ATXN1; (+) strand; PAM type: YTN; PAM sequence: CTT
tgagtctcaaaaaggaaaat

SEQ ID NO: 255353 - DNA, 20 bp, Artificial Sequence
  Description of Artificial Sequence: Synthetic oligonucleotide
  Target: ATXN1; (+) strand; PAM type: YTN; PAM sequence: TTT
gagtctcaaaaaggaaaata

SEQ ID NO: 255354 - DNA, 20 bp, Artificial Sequence
  Description of Artificial Sequence: Synthetic oligonucleotide
  Target: ATXN1; (+) strand; PAM type: YTN; PAM sequence: TTG
agtctcaaaaaggaaaataa

SEQ ID NO: 255355 - DNA, 20 bp, Artificial Sequence
  Description of Artificial Sequence: Synthetic oligonucleotide
  Target: ATXN1; (+) strand; PAM type: YTN; PAM sequence: CTC
aaaaaggaaaataatgttga

SEQ ID NO: 255356 - DNA, 20 bp, Artificial Sequence
  Description of Artificial Sequence: Synthetic oligonucleotide
  Target: ATXN1; (+) strand; PAM type: YTN; PAM sequence: TTG
acttttagctcttcagttct

SEQ ID NO: 255357 - DNA, 20 bp, Artificial Sequence
  Description of Artificial Sequence: Synthetic oligonucleotide
  Target: ATXN1; (+) strand; PAM type: YTN; PAM sequence: CTT
ttagctcttcagttctcagc

SEQ ID NO: 255358 - DNA, 20 bp, Artificial Sequence
  Description of Artificial Sequence: Synthetic oligonucleotide
  Target: ATXN1; (+) strand; PAM type: YTN; PAM sequence: TTT
tagctcttcagttctcagca

SEQ ID NO: 255359 - DNA, 20 bp, Artificial Sequence
  Description of Artificial Sequence: Synthetic oligonucleotide
  Target: ATXN1; (+) strand; PAM type: YTN; PAM sequence: TTT
agctcttcagttctcagcag

SEQ ID NO: 255360 - DNA, 20 bp, Artificial Sequence
  Description of Artificial Sequence: Synthetic oligonucleotide
  Target: ATXN1; (+) strand; PAM type: YTN; PAM sequence: TTA
gctcttcagttctcagcagt

SEQ ID NO: 255361 - DNA, 20 bp, Artificial Sequence
  Description of Artificial Sequence: Synthetic oligonucleotide
  Target: ATXN1; (+) strand; PAM type: YTN; PAM sequence: CTC
ttcagttctcagcagttaca

SEQ ID NO: 255362 - DNA, 20 bp, Artificial Sequence
  Description of Artificial Sequence: Synthetic oligonucleotide
  Target: ATXN1; (+) strand; PAM type: YTN; PAM sequence: CTT
cagttctcagcagttacaac

SEQ ID NO: 255363 - DNA, 20 bp, Artificial Sequence
  Description of Artificial Sequence: Synthetic oligonucleotide
  Target: ATXN1; (+) strand; PAM type: YTN; PAM sequence: TTC
agttctcagcagttacaaca

SEQ ID NO: 255364 - DNA, 20 bp, Artificial Sequence
  Description of Artificial Sequence: Synthetic oligonucleotide
  Target: ATXN1; (+) strand; PAM type: YTN; PAM sequence: TTC
tcagcagttacaacaaaagt

SEQ ID NO: 255365 - DNA, 20 bp, Artificial Sequence
  Description of Artificial Sequence: Synthetic oligonucleotide
  Target: ATXN1; (+) strand; PAM type: YTN; PAM sequence: CTC
agcagttacaacaaaagtac

SEQ ID NO: 255366 - DNA, 20 bp, Artificial Sequence
  Description of Artificial Sequence: Synthetic oligonucleotide
  Target: ATXN1; (+) strand; PAM type: YTN; PAM sequence: TTA
caacaaaagtactatgttta

SEQ ID NO: 255367 - DNA, 20 bp, Artificial Sequence
  Description of Artificial Sequence: Synthetic oligonucleotide
  Target: ATXN1; (+) strand; PAM type: YTN; PAM sequence: CTA
tgtttatatctcatgagtgt

SEQ ID NO: 255368 - DNA, 20 bp, Artificial Sequence
  Description of Artificial Sequence: Synthetic oligonucleotide
  Target: ATXN1; (+) strand; PAM type: YTN; PAM sequence: TTT
atatctcatgagtgtaactg

SEQ ID NO: 255369 - DNA, 20 bp, Artificial Sequence
  Description of Artificial Sequence: Synthetic oligonucleotide
  Target: ATXN1; (+) strand; PAM type: YTN; PAM sequence: TTA
tatctcatgagtgtaactga

SEQ ID NO: 255370 - DNA, 20 bp, Artificial Sequence
  Description of Artificial Sequence: Synthetic oligonucleotide
  Target: ATXN1; (+) strand; PAM type: YTN; PAM sequence: CTC
atgagtgtaactgaatattt

SEQ ID NO: 255371 - DNA, 20 bp, Artificial Sequence
  Description of Artificial Sequence: Synthetic oligonucleotide
  Target: ATXN1; (+) strand; PAM type: YTN; PAM sequence: CTG
aatatttttcccctttaggg

SEQ ID NO: 255372 - DNA, 20 bp, Artificial Sequence
  Description of Artificial Sequence: Synthetic oligonucleotide
  Target: ATXN1; (+) strand; PAM type: YTN; PAM sequence: TTT
ttcccctttagggtcaaggg

SEQ ID NO: 255373 - DNA, 20 bp, Artificial Sequence
  Description of Artificial Sequence: Synthetic oligonucleotide
  Target: ATXN1; (+) strand; PAM type: YTN; PAM sequence: TTT
tcccctttagggtcaagggc

SEQ ID NO: 255374 - DNA, 20 bp, Artificial Sequence
  Description of Artificial Sequence: Synthetic oligonucleotide
  Target: ATXN1; (+) strand; PAM type: YTN; PAM sequence: TTT
cccctttagggtcaagggct

SEQ ID NO: 255375 - DNA, 20 bp, Artificial Sequence
  Description of Artificial Sequence: Synthetic oligonucleotide
  Target: ATXN1; (+) strand; PAM type: YTN; PAM sequence: TTC
ccctttagggtcaagggctc

SEQ ID NO: 255376 - DNA, 20 bp, Artificial Sequence
  Description of Artificial Sequence: Synthetic oligonucleotide
  Target: ATXN1; (+) strand; PAM type: YTN; PAM sequence: CTT
tagggtcaagggctctgtct

SEQ ID NO: 255377 - DNA, 20 bp, Artificial Sequence
  Description of Artificial Sequence: Synthetic oligonucleotide
  Target: ATXN1; (+) strand; PAM type: YTN; PAM sequence: TTT
agggtcaagggctctgtctc

SEQ ID NO: 255378 - DNA, 20 bp, Artificial Sequence
  Description of Artificial Sequence: Synthetic oligonucleotide
  Target: ATXN1; (+) strand; PAM type: YTN; PAM sequence: TTA
gggtcaagggctctgtctca

SEQ ID NO: 255379 - DNA, 20 bp, Artificial Sequence
  Description of Artificial Sequence: Synthetic oligonucleotide
  Target: ATXN1; (+) strand; PAM type: YTN; PAM sequence: CTC
tgtctcagggatcacttgtt

SEQ ID NO: 255380 - DNA, 20 bp, Artificial Sequence
  Description of Artificial Sequence: Synthetic oligonucleotide
  Target: ATXN1; (+) strand; PAM type: YTN; PAM sequence: CTG
tctcagggatcacttgtttc

SEQ ID NO: 255381 - DNA, 20 bp, Artificial Sequence
  Description of Artificial Sequence: Synthetic oligonucleotide
  Target: ATXN1; (+) strand; PAM type: YTN; PAM sequence: CTC
agggatcacttgtttcttaa

SEQ ID NO: 255382 - DNA, 20 bp, Artificial Sequence
  Description of Artificial Sequence: Synthetic oligonucleotide
  Target: ATXN1; (+) strand; PAM type: YTN; PAM sequence: CTT
gtttcttaaatctcaggctg

SEQ ID NO: 255383 - DNA, 20 bp, Artificial Sequence
  Description of Artificial Sequence: Synthetic oligonucleotide
  Target: ATXN1; (+) strand; PAM type: YTN; PAM sequence: TTG
tttcttaaatctcaggctgc

SEQ ID NO: 255384 - DNA, 20 bp, Artificial Sequence
  Description of Artificial Sequence: Synthetic oligonucleotide
  Target: ATXN1; (+) strand; PAM type: YTN; PAM sequence: TTT
cttaaatctcaggctgctac

SEQ ID NO: 255385 - DNA, 20 bp, Artificial Sequence
  Description of Artificial Sequence: Synthetic oligonucleotide
  Target: ATXN1; (+) strand; PAM type: YTN; PAM sequence: TTC
ttaaatctcaggctgctaca

SEQ ID NO: 255386 - DNA, 20 bp, Artificial Sequence
  Description of Artificial Sequence: Synthetic oligonucleotide
  Target: ATXN1; (+) strand; PAM type: YTN; PAM sequence: CTT
aaatctcaggctgctacatt

SEQ ID NO: 255387 - DNA, 20 bp, Artificial Sequence
  Description of Artificial Sequence: Synthetic oligonucleotide
  Target: ATXN1; (+) strand; PAM type: YTN; PAM sequence: TTA
aatctcaggctgctacattt

SEQ ID NO: 255388 - DNA, 20 bp, Artificial Sequence
  Description of Artificial Sequence: Synthetic oligonucleotide
  Target: ATXN1; (+) strand; PAM type: YTN; PAM sequence: CTC
aggctgctacattttctcaa

SEQ ID NO: 255389 - DNA, 20 bp, Artificial Sequence
  Description of Artificial Sequence: Synthetic oligonucleotide
  Target: ATXN1; (+) strand; PAM type: YTN; PAM sequence: CTG
ctacattttctcaaccacca

SEQ ID NO: 255390 - DNA, 20 bp, Artificial Sequence
  Description of Artificial Sequence: Synthetic oligonucleotide
  Target: ATXN1; (+) strand; PAM type: YTN; PAM sequence: CTA
cattttctcaaccaccagtc

SEQ ID NO: 255391 - DNA, 20 bp, Artificial Sequence
  Description of Artificial Sequence: Synthetic oligonucleotide
  Target: ATXN1; (+) strand; PAM type: YTN; PAM sequence: TTT
tctcaaccaccagtcgtatt

SEQ ID NO: 255392 - DNA, 20 bp, Artificial Sequence
  Description of Artificial Sequence: Synthetic oligonucleotide
  Target: ATXN1; (+) strand; PAM type: YTN; PAM sequence: TTT
ctcaaccaccagtcgtatta

SEQ ID NO: 255393 - DNA, 20 bp, Artificial Sequence
  Description of Artificial Sequence: Synthetic oligonucleotide
  Target: ATXN1; (+) strand; PAM type: YTN; PAM sequence: TTC
tcaaccaccagtcgtattag

SEQ ID NO: 255394 - DNA, 20 bp, Artificial Sequence
  Description of Artificial Sequence: Synthetic oligonucleotide
  Target: ATXN1; (+) strand; PAM type: YTN; PAM sequence: CTC
aaccaccagtcgtattagtc

SEQ ID NO: 255395 - DNA, 20 bp, Artificial Sequence
  Description of Artificial Sequence: Synthetic oligonucleotide
  Target: ATXN1; (+) strand; PAM type: YTN; PAM sequence: TTA
gtccatttttatgctgttga

SEQ ID NO: 255396 - DNA, 20 bp, Artificial Sequence
  Description of Artificial Sequence: Synthetic oligonucleotide
  Target: ATXN1; (+) strand; PAM type: YTN; PAM sequence: TTT
ttatgctgttgataaagaca

SEQ ID NO: 255397 - DNA, 20 bp, Artificial Sequence
  Description of Artificial Sequence: Synthetic oligonucleotide
  Target: ATXN1; (+) strand; PAM type: YTN; PAM sequence: TTT
tatgctgttgataaagacat

SEQ ID NO: 255398 - DNA, 20 bp, Artificial Sequence
  Description of Artificial Sequence: Synthetic oligonucleotide
  Target: ATXN1; (+) strand; PAM type: YTN; PAM sequence: TTT
atgctgttgataaagacata

SEQ ID NO: 255399 - DNA, 20 bp, Artificial Sequence
  Description of Artificial Sequence: Synthetic oligonucleotide
  Target: ATXN1; (+) strand; PAM type: YTN; PAM sequence: TTA
tgctgttgataaagacatac

SEQ ID NO: 255400 - DNA, 20 bp, Artificial Sequence
  Description of Artificial Sequence: Synthetic oligonucleotide
  Target: ATXN1; (+) strand; PAM type: YTN; PAM sequence: CTG
ttgataaagacatacccgag

SEQ ID NO: 255401 - DNA, 20 bp, Artificial Sequence
  Description of Artificial Sequence: Synthetic oligonucleotide
  Target: ATXN1; (+) strand; PAM type: YTN; PAM sequence: TTG
ataaagacatacccgagact

SEQ ID NO: 255402 - DNA, 20 bp, Artificial Sequence
  Description of Artificial Sequence: Synthetic oligonucleotide
  Target: ATXN1; (+) strand; PAM type: YTN; PAM sequence: CTG
agcaatttacaaaagaaaga

SEQ ID NO: 255403 - DNA, 20 bp, Artificial Sequence
  Description of Artificial Sequence: Synthetic oligonucleotide
  Target: ATXN1; (+) strand; PAM type: YTN; PAM sequence: TTT
acaaaagaaagaggtttaat

SEQ ID NO: 255404 - DNA, 20 bp, Artificial Sequence
  Description of Artificial Sequence: Synthetic oligonucleotide
  Target: ATXN1; (+) strand; PAM type: YTN; PAM sequence: TTA
caaaagaaagaggtttaatt

SEQ ID NO: 255405 - DNA, 20 bp, Artificial Sequence
  Description of Artificial Sequence: Synthetic oligonucleotide
  Target: ATXN1; (+) strand; PAM type: YTN; PAM sequence: TTT
aattggacttacagttccac

SEQ ID NO: 255406 - DNA, 20 bp, Artificial Sequence
  Description of Artificial Sequence: Synthetic oligonucleotide
  Target: ATXN1; (+) strand; PAM type: YTN; PAM sequence: TTA
attggacttacagttccaca

SEQ ID NO: 255407 - DNA, 20 bp, Artificial Sequence
  Description of Artificial Sequence: Synthetic oligonucleotide
  Target: ATXN1; (+) strand; PAM type: YTN; PAM sequence: TTG
gacttacagttccacatggc

SEQ ID NO: 255408 - DNA, 20 bp, Artificial Sequence
  Description of Artificial Sequence: Synthetic oligonucleotide
  Target: ATXN1; (+) strand; PAM type: YTN; PAM sequence: CTT
acagttccacatggctgagg

SEQ ID NO: 255409 - DNA, 20 bp, Artificial Sequence
  Description of Artificial Sequence: Synthetic oligonucleotide
  Target: ATXN1; (+) strand; PAM type: YTN; PAM sequence: TTA
cagttccacatggctgagga

SEQ ID NO: 255410 - DNA, 20 bp, Artificial Sequence
  Description of Artificial Sequence: Synthetic oligonucleotide
  Target: ATXN1; (+) strand; PAM type: YTN; PAM sequence: TTC
cacatggctgaggaagcctc

SEQ ID NO: 255411 - DNA, 20 bp, Artificial Sequence
  Description of Artificial Sequence: Synthetic oligonucleotide
  Target: ATXN1; (+) strand; PAM type: YTN; PAM sequence: CTG
aggaagcctctcaatcatgg

SEQ ID NO: 255412 - DNA, 20 bp, Artificial Sequence
  Description of Artificial Sequence: Synthetic oligonucleotide
  Target: ATXN1; (+) strand; PAM type: YTN; PAM sequence: CTC
tcaatcatggtggaaggcaa

SEQ ID NO: 255413 - DNA, 20 bp, Artificial Sequence
  Description of Artificial Sequence: Synthetic oligonucleotide
  Target: ATXN1; (+) strand; PAM type: YTN; PAM sequence: CTC
aatcatggtggaaggcaagg

SEQ ID NO: 255414 - DNA, 20 bp, Artificial Sequence
  Description of Artificial Sequence: Synthetic oligonucleotide
  Target: ATXN1; (+) strand; PAM type: YTN; PAM sequence: CTT
acatggatggtggcaggcaa

SEQ ID NO: 255415 - DNA, 20 bp, Artificial Sequence
  Description of Artificial Sequence: Synthetic oligonucleotide
  Target: ATXN1; (+) strand; PAM type: YTN; PAM sequence: TTA
catggatggtggcaggcaaa

SEQ ID NO: 255416 - DNA, 20 bp, Artificial Sequence
  Description of Artificial Sequence: Synthetic oligonucleotide
  Target: ATXN1; (+) strand; PAM type: YTN; PAM sequence: CTT
atgcaggggaatgcctcttt

SEQ ID NO: 255417 - DNA, 20 bp, Artificial Sequence
  Description of Artificial Sequence: Synthetic oligonucleotide
  Target: ATXN1; (+) strand; PAM type: YTN; PAM sequence: TTA
tgcaggggaatgcctctttt

SEQ ID NO: 255418 - DNA, 20 bp, Artificial Sequence
  Description of Artificial Sequence: Synthetic oligonucleotide
  Target: ATXN1; (+) strand; PAM type: YTN; PAM sequence: CTC
tttttaaaaccatcagatct

SEQ ID NO: 255419 - DNA, 20 bp, Artificial Sequence
  Description of Artificial Sequence: Synthetic oligonucleotide
  Target: ATXN1; (+) strand; PAM type: YTN; PAM sequence: CTT
tttaaaaccatcagatctcg

SEQ ID NO: 255420 - DNA, 20 bp, Artificial Sequence
  Description of Artificial Sequence: Synthetic oligonucleotide
  Target: ATXN1; (+) strand; PAM type: YTN; PAM sequence: TTT
ttaaaaccatcagatctcgt

SEQ ID NO: 255421 - DNA, 20 bp, Artificial Sequence
  Description of Artificial Sequence: Synthetic oligonucleotide
  Target: ATXN1; (+) strand; PAM type: YTN; PAM sequence: TTT
taaaaccatcagatctcgtg

SEQ ID NO: 255422 - DNA, 20 bp, Artificial Sequence
  Description of Artificial Sequence: Synthetic oligonucleotide
  Target: ATXN1; (+) strand; PAM type: YTN; PAM sequence: TTT
aaaaccatcagatctcgtga

SEQ ID NO: 255423 - DNA, 20 bp, Artificial Sequence
  Description of Artificial Sequence: Synthetic oligonucleotide
  Target: ATXN1; (+) strand; PAM type: YTN; PAM sequence: TTA
aaaccatcagatctcgtgag

SEQ ID NO: 255424 - DNA, 20 bp, Artificial Sequence
  Description of Artificial Sequence: Synthetic oligonucleotide
  Target: ATXN1; (+) strand; PAM type: YTN; PAM sequence: CTC
gtgagacttatccattacca

SEQ ID NO: 255425 - DNA, 20 bp, Artificial Sequence
  Description of Artificial Sequence: Synthetic oligonucleotide
  Target: ATXN1; (+) strand; PAM type: YTN; PAM sequence: CTT
atccattaccacgagaacag

SEQ ID NO: 255426 - DNA, 20 bp, Artificial Sequence
  Description of Artificial Sequence: Synthetic oligonucleotide
  Target: ATXN1; (+) strand; PAM type: YTN; PAM sequence: TTA
tccattaccacgagaacagc

SEQ ID NO: 255427 - DNA, 20 bp, Artificial Sequence
  Description of Artificial Sequence: Synthetic oligonucleotide
  Target: ATXN1; (+) strand; PAM type: YTN; PAM sequence: TTA
ccacgagaacagcatgggaa

SEQ ID NO: 255428 - DNA, 20 bp, Artificial Sequence
  Description of Artificial Sequence: Synthetic oligonucleotide
  Target: ATXN1; (+) strand; PAM type: YTN; PAM sequence: CTG
ccccccatgattcaatacct

SEQ ID NO: 255429 - DNA, 20 bp, Artificial Sequence
  Description of Artificial Sequence: Synthetic oligonucleotide
  Target: ATXN1; (+) strand; PAM type: YTN; PAM sequence: TTC
aatacctcccaccaggtccc

SEQ ID NO: 255430 - DNA, 20 bp, Artificial Sequence
  Description of Artificial Sequence: Synthetic oligonucleotide
  Target: ATXN1; (+) strand; PAM type: YTN; PAM sequence: CTC
ccaccaggtccctcccacac

SEQ ID NO: 255431 - DNA, 20 bp, Artificial Sequence
  Description of Artificial Sequence: Synthetic oligonucleotide
  Target: ATXN1; (+) strand; PAM type: YTN; PAM sequence: CTC
ccacacacatgggaggtcaa

SEQ ID NO: 255432 - DNA, 20 bp, Artificial Sequence
  Description of Artificial Sequence: Synthetic oligonucleotide
  Target: ATXN1; (+) strand; PAM type: YTN; PAM sequence: CTG
ggcagggacacagccaaacc

SEQ ID NO: 255433 - DNA, 20 bp, Artificial Sequence
  Description of Artificial Sequence: Synthetic oligonucleotide
  Target: ATXN1; (+) strand; PAM type: YTN; PAM sequence: TTG
atctatatggctggaaaaaa

SEQ ID NO: 255434 - DNA, 20 bp, Artificial Sequence
  Description of Artificial Sequence: Synthetic oligonucleotide
  Target: ATXN1; (+) strand; PAM type: YTN; PAM sequence: CTA
tatggctggaaaaaacaaga

SEQ ID NO: 255435 - DNA, 20 bp, Artificial Sequence
  Description of Artificial Sequence: Synthetic oligonucleotide
  Target: ATXN1; (+) strand; PAM type: YTN; PAM sequence: CTG
gaaaaaacaagacttctcgc

SEQ ID NO: 255436 - DNA, 20 bp, Artificial Sequence
  Description of Artificial Sequence: Synthetic oligonucleotide
  Target: ATXN1; (+) strand; PAM type: YTN; PAM sequence: CTT
ctcgccaaccactgacagtt

SEQ ID NO: 255437 - DNA, 20 bp, Artificial Sequence
  Description of Artificial Sequence: Synthetic oligonucleotide
  Target: ATXN1; (+) strand; PAM type: YTN; PAM sequence: TTC
tcgccaaccactgacagttt

SEQ ID NO: 255438 - DNA, 20 bp, Artificial Sequence
  Description of Artificial Sequence: Synthetic oligonucleotide
  Target: ATXN1; (+) strand; PAM type: YTN; PAM sequence: CTC
gccaaccactgacagttttt

SEQ ID NO: 255439 - DNA, 20 bp, Artificial Sequence
  Description of Artificial Sequence: Synthetic oligonucleotide
  Target: ATXN1; (+) strand; PAM type: YTN; PAM sequence: CTG
acagtttttttttttttttt

SEQ ID NO: 255440 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255441 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255442 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255443 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255444 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255445 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255446 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255447 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255448 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255449 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255450 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255451 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255452 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255453 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255454 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255455 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 255456 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttg

SEQ ID NO: 255457 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttgc

SEQ ID NO: 255458 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttgct

SEQ ID NO: 255459 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttgctt

SEQ ID NO: 255460 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttgcttc

SEQ ID NO: 255461 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgcttct

SEQ ID NO: 255462 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgcttcta

SEQ ID NO: 255463 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgcttctag

SEQ ID NO: 255464 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgcttctagt

SEQ ID NO: 255465 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgcttctagtt

SEQ ID NO: 255466 - DNA, 20 bp, Artificial Sequence
  Description of Artificial Sequence: Synthetic oligonucleotide
  Target: ATXN1; (+) strand; PAM type: YTN; PAM sequence: TTT
tttttttttgcttctagttc

SEQ ID NO: 255467 - DNA, 20 bp, Artificial Sequence
  Description of Artificial Sequence: Synthetic oligonucleotide
  Target: ATXN1; (+) strand; PAM type: YTN; PAM sequence: TTT
ttttttttgcttctagttct

SEQ ID NO: 255468 - DNA, 20 bp, Artificial Sequence
  Description of Artificial Sequence: Synthetic oligonucleotide
  Target: ATXN1; (+) strand; PAM type: YTN; PAM sequence: TTT
tttttttgcttctagttcta

SEQ ID NO: 255469 - DNA, 20 bp, Artificial Sequence
  Description of Artificial Sequence: Synthetic oligonucleotide
  Target: ATXN1; (+) strand; PAM type: YTN; PAM sequence: TTT
ttttttgcttctagttctaa

SEQ ID NO: 255470 - DNA, 20 bp, Artificial Sequence
  Description of Artificial Sequence: Synthetic oligonucleotide
  Target: ATXN1; (+) strand; PAM type: YTN; PAM sequence: TTT
tttttgcttctagttctaat

SEQ ID NO: 255471 - DNA, 20 bp, Artificial Sequence
  Description of Artificial Sequence: Synthetic oligonucleotide
  Target: ATXN1; (+) strand; PAM type: YTN; PAM sequence: TTT
ttttgcttctagttctaatg

SEQ ID NO: 255472 - DNA, 20 bp, Artificial Sequence
  Description of Artificial Sequence: Synthetic oligonucleotide
  Target: ATXN1; (+) strand; PAM type: YTN; PAM sequence: TTT
tttgcttctagttctaatgc

SEQ ID NO: 255473 - DNA, 20 bp, Artificial Sequence
  Description of Artificial Sequence: Synthetic oligonucleotide
  Target: ATXN1; (+) strand; PAM type: YTN; PAM sequence: TTT
ttgcttctagttctaatgct

SEQ ID NO: 255474 - DNA, 20 bp, Artificial Sequence
  Description of Artificial Sequence: Synthetic oligonucleotide
  Target: ATXN1; (+) strand; PAM type: YTN; PAM sequence: TTT
tgcttctagttctaatgctt

SEQ ID NO: 255475 - DNA, 20 bp, Artificial Sequence
  Description of Artificial Sequence: Synthetic oligonucleotide
  Target: ATXN1; (+) strand; PAM type: YTN; PAM sequence: TTT
gcttctagttctaatgcttg

SEQ ID NO: 255476 - DNA, 20 bp, Artificial Sequence
  Description of Artificial Sequence: Synthetic oligonucleotide
  Target: ATXN1; (+) strand; PAM type: YTN; PAM sequence: TTG
cttctagttctaatgcttgg

SEQ ID NO: 255477 - DNA, 20 bp, Artificial Sequence
  Description of Artificial Sequence: Synthetic oligonucleotide
  Target: ATXN1; (+) strand; PAM type: YTN; PAM sequence: CTT
ctagttctaatgcttggtca

SEQ ID NO: 255478 - DNA, 20 bp, Artificial Sequence
  Description of Artificial Sequence: Synthetic oligonucleotide
  Target: ATXN1; (+) strand; PAM type: YTN; PAM sequence: TTC
tagttctaatgcttggtcat

SEQ ID NO: 255479 - DNA, 20 bp, Artificial Sequence
  Description of Artificial Sequence: Synthetic oligonucleotide
  Target: ATXN1; (+) strand; PAM type: YTN; PAM sequence: CTA
gttctaatgcttggtcatta

SEQ ID NO: 255480 - DNA, 20 bp, Artificial Sequence
  Description of Artificial Sequence: Synthetic oligonucleotide
  Target: ATXN1; (+) strand; PAM type: YTN; PAM sequence: TTC
taatgcttggtcattaattt

SEQ ID NO: 255481 - DNA, 20 bp, Artificial Sequence
  Description of Artificial Sequence: Synthetic oligonucleotide
  Target: ATXN1; (+) strand; PAM type: YTN; PAM sequence: CTA
atgcttggtcattaatttct

SEQ ID NO: 255482 - DNA, 20 bp, Artificial Sequence
  Description of Artificial Sequence: Synthetic oligonucleotide
  Target: ATXN1; (+) strand; PAM type: YTN; PAM sequence: CTT
ggtcattaatttctctagaa

SEQ ID NO: 255483 - DNA, 20 bp, Artificial Sequence
  Description of Artificial Sequence: Synthetic oligonucleotide
  Target: ATXN1; (+) strand; PAM type: YTN; PAM sequence: TTG
gtcattaatttctctagaac

SEQ ID NO: 255484 - DNA, 20 bp, Artificial Sequence
  Description of Artificial Sequence: Synthetic oligonucleotide
  Target: ATXN1; (+) strand; PAM type: YTN; PAM sequence: TTA
atttctctagaactcagaat

SEQ ID NO: 255485 - DNA, 20 bp, Artificial Sequence
  Description of Artificial Sequence: Synthetic oligonucleotide
  Target: ATXN1; (+) strand; PAM type: YTN; PAM sequence: TTT
ctctagaactcagaatatat

SEQ ID NO: 255486 - DNA, 20 bp, Artificial Sequence
  Description of Artificial Sequence: Synthetic oligonucleotide
  Target: ATXN1; (+) strand; PAM type: YTN; PAM sequence: TTC
tctagaactcagaatatatt

SEQ ID NO: 255487 - DNA, 20 bp, Artificial Sequence
  Description of Artificial Sequence: Synthetic oligonucleotide
  Target: ATXN1; (+) strand; PAM type: YTN; PAM sequence: CTC
tagaactcagaatatatttg

SEQ ID NO: 255488 - DNA, 20 bp, Artificial Sequence
  Description of Artificial Sequence: Synthetic oligonucleotide
  Target: ATXN1; (+) strand; PAM type: YTN; PAM sequence: CTA
gaactcagaatatatttgat

SEQ ID NO: 255489 - DNA, 20 bp, Artificial Sequence
  Description of Artificial Sequence: Synthetic oligonucleotide
  Target: ATXN1; (+) strand; PAM type: YTN; PAM sequence: CTC
agaatatatttgatgcacat

SEQ ID NO: 255490 - DNA, 20 bp, Artificial Sequence
  Description of Artificial Sequence: Synthetic oligonucleotide
  Target: ATXN1; (+) strand; PAM type: YTN; PAM sequence: TTT
gatgcacattattgactgtt

SEQ ID NO: 255491 - DNA, 20 bp, Artificial Sequence
  Description of Artificial Sequence: Synthetic oligonucleotide
  Target: ATXN1; (+) strand; PAM type: YTN; PAM sequence: TTG
atgcacattattgactgttc

SEQ ID NO: 255492 - DNA, 20 bp, Artificial Sequence
  Description of Artificial Sequence: Synthetic oligonucleotide
  Target: ATXN1; (+) strand; PAM type: YTN; PAM sequence: TTA
ttgactgttctccttccttt

SEQ ID NO: 255493 - DNA, 20 bp, Artificial Sequence
  Description of Artificial Sequence: Synthetic oligonucleotide
  Target: ATXN1; (+) strand; PAM type: YTN; PAM sequence: TTG
actgttctccttccttttta

SEQ ID NO: 255494 - DNA, 20 bp, Artificial Sequence
  Description of Artificial Sequence: Synthetic oligonucleotide
  Target: ATXN1; (+) strand; PAM type: YTN; PAM sequence: CTG
ttctccttcctttttattta

SEQ ID NO: 255495 - DNA, 20 bp, Artificial Sequence
  Description of Artificial Sequence: Synthetic oligonucleotide
  Target: ATXN1; (+) strand; PAM type: YTN; PAM sequence: TTC
tccttcctttttatttaccc

SEQ ID NO: 255496 - DNA, 20 bp, Artificial Sequence
  Description of Artificial Sequence: Synthetic oligonucleotide
  Target: ATXN1; (+) strand; PAM type: YTN; PAM sequence: CTC
cttcctttttatttaccctt

SEQ ID NO: 255497 - DNA, 20 bp, Artificial Sequence
  Description of Artificial Sequence: Synthetic oligonucleotide
  Target: ATXN1; (+) strand; PAM type: YTN; PAM sequence: CTT
cctttttatttaccctttaa

SEQ ID NO: 255498 - DNA, 20 bp, Artificial Sequence
  Description of Artificial Sequence: Synthetic oligonucleotide
  Target: ATXN1; (+) strand; PAM type: YTN; PAM sequence: TTC
ctttttatttaccctttaat

SEQ ID NO: 255499 - DNA, 20 bp, Artificial Sequence
  Description of Artificial Sequence: Synthetic oligonucleotide
  Target: ATXN1; (+) strand; PAM type: YTN; PAM sequence: CTT
tttatttaccctttaatgtt

SEQ ID NO: 255500 - DNA, 20 bp, Artificial Sequence
  Description of Artificial Sequence: Synthetic oligonucleotide
  Target: ATXN1; (+) strand; PAM type: YTN; PAM sequence: TTT
ttatttaccctttaatgttt

SEQ ID NO: 255501 - DNA, 20 bp, Artificial Sequence
  Description of Artificial Sequence: Synthetic oligonucleotide
  Target: ATXN1; (+) strand; PAM type: YTN; PAM sequence: TTT
tatttaccctttaatgtttt

SEQ ID NO: 255502 - DNA, 20 bp, Artificial Sequence
  Description of Artificial Sequence: Synthetic oligonucleotide
  Target: ATXN1; (+) strand; PAM type: YTN; PAM sequence: TTT
atttaccctttaatgttttc

SEQ ID NO: 255503 - DNA, 20 bp, Artificial Sequence
  Description of Artificial Sequence: Synthetic oligonucleotide
  Target: ATXN1; (+) strand; PAM type: YTN; PAM sequence: TTA
tttaccctttaatgttttca

SEQ ID NO: 255504 - DNA, 20 bp, Artificial Sequence
  Description of Artificial Sequence: Synthetic oligonucleotide
  Target: ATXN1; (+) strand; PAM type: YTN; PAM sequence: TTT
accctttaatgttttcacaa

SEQ ID NO: 255505 - DNA, 20 bp, Artificial Sequence
  Description of Artificial Sequence: Synthetic oligonucleotide
  Target: ATXN1; (+) strand; PAM type: YTN; PAM sequence: TTA
ccctttaatgttttcacaaa

SEQ ID NO: 255506 - DNA, 20 bp, Artificial Sequence
  Description of Artificial Sequence: Synthetic oligonucleotide
  Target: ATXN1; (+) strand; PAM type: YTN; PAM sequence: CTT
taatgttttcacaaaacagg

SEQ ID NO: 255507 - DNA, 20 bp, Artificial Sequence
  Description of Artificial Sequence: Synthetic oligonucleotide
  Target: ATXN1; (+) strand; PAM type: YTN; PAM sequence: TTT
aatgttttcacaaaacaggg

SEQ ID NO: 255508 - DNA, 20 bp, Artificial Sequence
  Description of Artificial Sequence: Synthetic oligonucleotide
  Target: ATXN1; (+) strand; PAM type: YTN; PAM sequence: TTA
atgttttcacaaaacaggga

SEQ ID NO: 255509 - DNA, 20 bp, Artificial Sequence
  Description of Artificial Sequence: Synthetic oligonucleotide
  Target: ATXN1; (+) strand; PAM type: YTN; PAM sequence: TTT
tcacaaaacagggacaatgt

SEQ ID NO: 255510 - DNA, 20 bp, Artificial Sequence
  Description of Artificial Sequence: Synthetic oligonucleotide
  Target: ATXN1; (+) strand; PAM type: YTN; PAM sequence: TTT
cacaaaacagggacaatgtg

SEQ ID NO: 255511 - DNA, 20 bp, Artificial Sequence
  Description of Artificial Sequence: Synthetic oligonucleotide
  Target: ATXN1; (+) strand; PAM type: YTN; PAM sequence: TTC
acaaaacagggacaatgtgc

SEQ ID NO: 255512 - DNA, 20 bp, Artificial Sequence
  Description of Artificial Sequence: Synthetic oligonucleotide
  Target: ATXN1; (+) strand; PAM type: YTN; PAM sequence: TTT
tatggtttttctaattcgtt

SEQ ID NO: 255513 - DNA, 20 bp, Artificial Sequence
  Description of Artificial Sequence: Synthetic oligonucleotide
  Target: ATXN1; (+) strand; PAM type: YTN; PAM sequence: TTT
atggtttttctaattcgttt

SEQ ID NO: 255514 - DNA, 20 bp, Artificial Sequence
  Description of Artificial Sequence: Synthetic oligonucleotide
  Target: ATXN1; (+) strand; PAM type: YTN; PAM sequence: TTA
tggtttttctaattcgtttt

SEQ ID NO: 255515 - DNA, 20 bp, Artificial Sequence
  Description of Artificial Sequence: Synthetic oligonucleotide
  Target: ATXN1; (+) strand; PAM type: YTN; PAM sequence: TTT
ttctaattcgtttttaaaac

SEQ ID NO: 255516 - DNA, 20 bp, Artificial Sequence
  Description of Artificial Sequence: Synthetic oligonucleotide
  Target: ATXN1; (+) strand; PAM type: YTN; PAM sequence: TTT
tctaattcgtttttaaaact

SEQ ID NO: 255517 - DNA, 20 bp, Artificial Sequence
  Description of Artificial Sequence: Synthetic oligonucleotide
  Target: ATXN1; (+) strand; PAM type: YTN; PAM sequence: TTT
ctaattcgtttttaaaactt

SEQ ID NO: 255518 - DNA, 20 bp, Artificial Sequence
  Description of Artificial Sequence: Synthetic oligonucleotide
  Target: ATXN1; (+) strand; PAM type: YTN; PAM sequence: TTC
taattcgtttttaaaactta

SEQ ID NO: 255519 - DNA, 20 bp, Artificial Sequence
  Description of Artificial Sequence: Synthetic oligonucleotide
  Target: ATXN1; (+) strand; PAM type: YTN; PAM sequence: CTA
attcgtttttaaaacttacg

SEQ ID NO: 255520 - DNA, 20 bp, Artificial Sequence
  Description of Artificial Sequence: Synthetic oligonucleotide
  Target: ATXN1; (+) strand; PAM type: YTN; PAM sequence: TTC
gtttttaaaacttacgagac

SEQ ID NO: 255521 - DNA, 20 bp, Artificial Sequence
  Description of Artificial Sequence: Synthetic oligonucleotide
  Target: ATXN1; (+) strand; PAM type: YTN; PAM sequence: TTT
ttaaaacttacgagacaact

SEQ ID NO: 255522 - DNA, 20 bp, Artificial Sequence
  Description of Artificial Sequence: Synthetic oligonucleotide
  Target: ATXN1; (+) strand; PAM type: YTN; PAM sequence: TTT
taaaacttacgagacaactg

SEQ ID NO: 255523 - DNA, 20 bp, Artificial Sequence
  Description of Artificial Sequence: Synthetic oligonucleotide
  Target: ATXN1; (+) strand; PAM type: YTN; PAM sequence: TTT
aaaacttacgagacaactgg

SEQ ID NO: 255524 - DNA, 20 bp, Artificial Sequence
  Description of Artificial Sequence: Synthetic oligonucleotide
  Target: ATXN1; (+) strand; PAM type: YTN; PAM sequence: TTA
aaacttacgagacaactggc

SEQ ID NO: 255525 - DNA, 20 bp, Artificial Sequence
  Description of Artificial Sequence: Synthetic oligonucleotide
  Target: ATXN1; (+) strand; PAM type: YTN; PAM sequence: CTT
acgagacaactggcttatag

SEQ ID NO: 255526 - DNA, 20 bp, Artificial Sequence
  Description of Artificial Sequence: Synthetic oligonucleotide
  Target: ATXN1; (+) strand; PAM type: YTN; PAM sequence: TTA
cgagacaactggcttatagc

SEQ ID NO: 255527 - DNA, 20 bp, Artificial Sequence
  Description of Artificial Sequence: Synthetic oligonucleotide
  Target: ATXN1; (+) strand; PAM type: YTN; PAM sequence: CTG
gcttatagcaattttccagt

SEQ ID NO: 255528 - DNA, 20 bp, Artificial Sequence
  Description of Artificial Sequence: Synthetic oligonucleotide
  Target: ATXN1; (+) strand; PAM type: YTN; PAM sequence: CTT
atagcaattttccagttaac

SEQ ID NO: 255529 - DNA, 20 bp, Artificial Sequence
  Description of Artificial Sequence: Synthetic oligonucleotide
  Target: ATXN1; (+) strand; PAM type: YTN; PAM sequence: TTA
tagcaattttccagttaaca

SEQ ID NO: 255530 - DNA, 20 bp, Artificial Sequence
  Description of Artificial Sequence: Synthetic oligonucleotide
  Target: ATXN1; (+) strand; PAM type: YTN; PAM sequence: TTT
tccagttaacaacacgaaca

SEQ ID NO: 255531 - DNA, 20 bp, Artificial Sequence
  Description of Artificial Sequence: Synthetic oligonucleotide
  Target: ATXN1; (+) strand; PAM type: YTN; PAM sequence: TTT
ccagttaacaacacgaacac

SEQ ID NO: 255532 - DNA, 20 bp, Artificial Sequence
  Description of Artificial Sequence: Synthetic oligonucleotide
  Target: ATXN1; (+) strand; PAM type: YTN; PAM sequence: TTC
cagttaacaacacgaacaca

SEQ ID NO: 255533 - DNA, 20 bp, Artificial Sequence
  Description of Artificial Sequence: Synthetic oligonucleotide
  Target: ATXN1; (+) strand; PAM type: YTN; PAM sequence: TTA
acaacacgaacacaacccac

SEQ ID NO: 255534 - DNA, 20 bp, Artificial Sequence
  Description of Artificial Sequence: Synthetic oligonucleotide
  Target: ATXN1; (+) strand; PAM type: YTN; PAM sequence: TTA
cttatgagatctttcccact

SEQ ID NO: 255535 - DNA, 20 bp, Artificial Sequence
  Description of Artificial Sequence: Synthetic oligonucleotide
  Target: ATXN1; (+) strand; PAM type: YTN; PAM sequence: CTT
atgagatctttcccactgct

SEQ ID NO: 255536 - DNA, 20 bp, Artificial Sequence
  Description of Artificial Sequence: Synthetic oligonucleotide
  Target: ATXN1; (+) strand; PAM type: YTN; PAM sequence: TTA
tgagatctttcccactgctt

SEQ ID NO: 255537 - DNA, 20 bp, Artificial Sequence
  Description of Artificial Sequence: Synthetic oligonucleotide
  Target: ATXN1; (+) strand; PAM type: YTN; PAM sequence: CTT
tcccactgcttagcaccaga

SEQ ID NO: 255538 - DNA, 20 bp, Artificial Sequence
  Description of Artificial Sequence: Synthetic oligonucleotide
  Target: ATXN1; (+) strand; PAM type: YTN; PAM sequence: TTT
cccactgcttagcaccagat

SEQ ID NO: 255539 - DNA, 20 bp, Artificial Sequence
  Description of Artificial Sequence: Synthetic oligonucleotide
  Target: ATXN1; (+) strand; PAM type: YTN; PAM sequence: TTC
ccactgcttagcaccagatc

SEQ ID NO: 255540 - DNA, 20 bp, Artificial Sequence
  Description of Artificial Sequence: Synthetic oligonucleotide
  Target: ATXN1; (+) strand; PAM type: YTN; PAM sequence: CTG
cttagcaccagatctataat

SEQ ID NO: 255541 - DNA, 20 bp, Artificial Sequence
  Description of Artificial Sequence: Synthetic oligonucleotide
  Target: ATXN1; (+) strand; PAM type: YTN; PAM sequence: CTT
agcaccagatctataatgca

SEQ ID NO: 255542 - DNA, 20 bp, Artificial Sequence
  Description of Artificial Sequence: Synthetic oligonucleotide
  Target: ATXN1; (+) strand; PAM type: YTN; PAM sequence: TTA
gcaccagatctataatgcat

SEQ ID NO: 255543 - DNA, 20 bp, Artificial Sequence
  Description of Artificial Sequence: Synthetic oligonucleotide
  Target: ATXN1; (+) strand; PAM type: YTN; PAM sequence: CTA
taatgcatgcaaggcttagc

SEQ ID NO: 255544 - DNA, 20 bp, Artificial Sequence
  Description of Artificial Sequence: Synthetic oligonucleotide
  Target: ATXN1; (+) strand; PAM type: YTN; PAM sequence: CTT
agctggaacaaatgatgaaa

SEQ ID NO: 255545 - DNA, 20 bp, Artificial Sequence
  Description of Artificial Sequence: Synthetic oligonucleotide
  Target: ATXN1; (+) strand; PAM type: YTN; PAM sequence: TTA
gctggaacaaatgatgaaag

SEQ ID NO: 255546 - DNA, 20 bp, Artificial Sequence
  Description of Artificial Sequence: Synthetic oligonucleotide
  Target: ATXN1; (+) strand; PAM type: YTN; PAM sequence: CTG
gaacaaatgatgaaagctgt

SEQ ID NO: 255547 - DNA, 20 bp, Artificial Sequence
  Description of Artificial Sequence: Synthetic oligonucleotide
  Target: ATXN1; (+) strand; PAM type: YTN; PAM sequence: CTG
ttcctcctttcaagggagga

SEQ ID NO: 255548 - DNA, 20 bp, Artificial Sequence
  Description of Artificial Sequence: Synthetic oligonucleotide
  Target: ATXN1; (+) strand; PAM type: YTN; PAM sequence: TTC
ctcctttcaagggaggatca

SEQ ID NO: 255549 - DNA, 20 bp, Artificial Sequence
  Description of Artificial Sequence: Synthetic oligonucleotide
  Target: ATXN1; (+) strand; PAM type: YTN; PAM sequence: CTC
ctttcaagggaggatcattt

SEQ ID NO: 255550 - DNA, 20 bp, Artificial Sequence
  Description of Artificial Sequence: Synthetic oligonucleotide
  Target: ATXN1; (+) strand; PAM type: YTN; PAM sequence: CTT
tcaagggaggatcatttaca

SEQ ID NO: 255551 - DNA, 20 bp, Artificial Sequence
  Description of Artificial Sequence: Synthetic oligonucleotide
  Target: ATXN1; (+) strand; PAM type: YTN; PAM sequence: TTT
caagggaggatcatttacat

SEQ ID NO: 255552 - DNA, 20 bp, Artificial Sequence
  Description of Artificial Sequence: Synthetic oligonucleotide
  Target: ATXN1; (+) strand; PAM type: YTN; PAM sequence: TTC
aagggaggatcatttacatg

SEQ ID NO: 255553 - DNA, 20 bp, Artificial Sequence
  Description of Artificial Sequence: Synthetic oligonucleotide
  Target: ATXN1; (+) strand; PAM type: YTN; PAM sequence: TTT
acatgggcccagaccactcc

SEQ ID NO: 255554 - DNA, 20 bp, Artificial Sequence
  Description of Artificial Sequence: Synthetic oligonucleotide
  Target: ATXN1; (+) strand; PAM type: YTN; PAM sequence: TTA
catgggcccagaccactcct

SEQ ID NO: 255555 - DNA, 20 bp, Artificial Sequence
  Description of Artificial Sequence: Synthetic oligonucleotide
  Target: ATXN1; (+) strand; PAM type: YTN; PAM sequence: CTC
ctgttctcatttattcaact

SEQ ID NO: 255556 - DNA, 20 bp, Artificial Sequence
  Description of Artificial Sequence: Synthetic oligonucleotide
  Target: ATXN1; (+) strand; PAM type: YTN; PAM sequence: CTG
ttctcatttattcaacttcc

SEQ ID NO: 255557 - DNA, 20 bp, Artificial Sequence
  Description of Artificial Sequence: Synthetic oligonucleotide
  Target: ATXN1; (+) strand; PAM type: YTN; PAM sequence: TTC
tcatttattcaacttccagc

SEQ ID NO: 255558 - DNA, 20 bp, Artificial Sequence
  Description of Artificial Sequence: Synthetic oligonucleotide
  Target: ATXN1; (+) strand; PAM type: YTN; PAM sequence: CTC
atttattcaacttccagccc

SEQ ID NO: 255559 - DNA, 20 bp, Artificial Sequence
  Description of Artificial Sequence: Synthetic oligonucleotide
  Target: ATXN1; (+) strand; PAM type: YTN; PAM sequence: TTT
attcaacttccagccctcac

SEQ ID NO: 255560 - DNA, 20 bp, Artificial Sequence
  Description of Artificial Sequence: Synthetic oligonucleotide
  Target: ATXN1; (+) strand; PAM type: YTN; PAM sequence: TTA
ttcaacttccagccctcact

SEQ ID NO: 255561 - DNA, 20 bp, Artificial Sequence
  Description of Artificial Sequence: Synthetic oligonucleotide
  Target: ATXN1; (+) strand; PAM type: YTN; PAM sequence: TTC
aacttccagccctcactgac

SEQ ID NO: 255562 - DNA, 20 bp, Artificial Sequence
  Description of Artificial Sequence: Synthetic oligonucleotide
  Target: ATXN1; (+) strand; PAM type: YTN; PAM sequence: CTT
ccagccctcactgacattaa

SEQ ID NO: 255563 - DNA, 20 bp, Artificial Sequence
  Description of Artificial Sequence: Synthetic oligonucleotide
  Target: ATXN1; (+) strand; PAM type: YTN; PAM sequence: TTC
cagccctcactgacattaac

SEQ ID NO: 255564 - DNA, 20 bp, Artificial Sequence
  Description of Artificial Sequence: Synthetic oligonucleotide
  Target: ATXN1; (+) strand; PAM type: YTN; PAM sequence: CTC
actgacattaaccaggagca

SEQ ID NO: 255565 - DNA, 20 bp, Artificial Sequence
  Description of Artificial Sequence: Synthetic oligonucleotide
  Target: ATXN1; (+) strand; PAM type: YTN; PAM sequence: CTG
acattaaccaggagcagaga

SEQ ID NO: 255566 - DNA, 20 bp, Artificial Sequence
  Description of Artificial Sequence: Synthetic oligonucleotide
  Target: ATXN1; (+) strand; PAM type: YTN; PAM sequence: TTA
accaggagcagagaacatct

SEQ ID NO: 255567 - DNA, 20 bp, Artificial Sequence
  Description of Artificial Sequence: Synthetic oligonucleotide
  Target: ATXN1; (+) strand; PAM type: YTN; PAM sequence: CTG
gtgtcagaaccaactcccgc

SEQ ID NO: 255568 - DNA, 20 bp, Artificial Sequence
  Description of Artificial Sequence: Synthetic oligonucleotide
  Target: ATXN1; (+) strand; PAM type: YTN; PAM sequence: CTC
ccgctgtgcccagggctgtt

SEQ ID NO: 255569 - DNA, 20 bp, Artificial Sequence
  Description of Artificial Sequence: Synthetic oligonucleotide
  Target: ATXN1; (+) strand; PAM type: YTN; PAM sequence: CTG
tgcccagggctgttgtctca

SEQ ID NO: 255570 - DNA, 20 bp, Artificial Sequence
  Description of Artificial Sequence: Synthetic oligonucleotide
  Target: ATXN1; (+) strand; PAM type: YTN; PAM sequence: CTG
ttgtctcactgttgcagaaa

SEQ ID NO: 255571 - DNA, 20 bp, Artificial Sequence
  Description of Artificial Sequence: Synthetic oligonucleotide
  Target: ATXN1; (+) strand; PAM type: YTN; PAM sequence: TTG
tctcactgttgcagaaaagg

SEQ ID NO: 255572 - DNA, 20 bp, Artificial Sequence
  Description of Artificial Sequence: Synthetic oligonucleotide
  Target: ATXN1; (+) strand; PAM type: YTN; PAM sequence: CTC
actgttgcagaaaaggccag

SEQ ID NO: 255573 - DNA, 20 bp, Artificial Sequence
  Description of Artificial Sequence: Synthetic oligonucleotide
  Target: ATXN1; (+) strand; PAM type: YTN; PAM sequence: CTG
ttgcagaaaaggccagaggg

SEQ ID NO: 255574 - DNA, 20 bp, Artificial Sequence
  Description of Artificial Sequence: Synthetic oligonucleotide
  Target: ATXN1; (+) strand; PAM type: YTN; PAM sequence: TTG
cagaaaaggccagagggcaa

SEQ ID NO: 255575 - DNA, 20 bp, Artificial Sequence
  Description of Artificial Sequence: Synthetic oligonucleotide
  Target: ATXN1; (+) strand; PAM type: YTN; PAM sequence: CTG
cttggctgaagatgggcctc

SEQ ID NO: 255576 - DNA, 20 bp, Artificial Sequence
  Description of Artificial Sequence: Synthetic oligonucleotide
  Target: ATXN1; (+) strand; PAM type: YTN; PAM sequence: CTT
ggctgaagatgggcctcaga

SEQ ID NO: 255577 - DNA, 20 bp, Artificial Sequence
  Description of Artificial Sequence: Synthetic oligonucleotide
  Target: ATXN1; (+) strand; PAM type: YTN; PAM sequence: TTG
gctgaagatgggcctcagag

SEQ ID NO: 255578 - DNA, 20 bp, Artificial Sequence
  Description of Artificial Sequence: Synthetic oligonucleotide
  Target: ATXN1; (+) strand; PAM type: YTN; PAM sequence: CTG
aagatgggcctcagaggttc

SEQ ID NO: 255579 - DNA, 20 bp, Artificial Sequence
  Description of Artificial Sequence: Synthetic oligonucleotide
  Target: ATXN1; (+) strand; PAM type: YTN; PAM sequence: CTC
agaggttctgggctttttat

SEQ ID NO: 255580 - DNA, 20 bp, Artificial Sequence
  Description of Artificial Sequence: Synthetic oligonucleotide
  Target: ATXN1; (+) strand; PAM type: YTN; PAM sequence: TTC
tgggctttttatggaattag

SEQ ID NO: 255581 - DNA, 20 bp, Artificial Sequence
  Description of Artificial Sequence: Synthetic oligonucleotide
  Target: ATXN1; (+) strand; PAM type: YTN; PAM sequence: CTG
ggctttttatggaattaggc

SEQ ID NO: 255582 - DNA, 20 bp, Artificial Sequence
  Description of Artificial Sequence: Synthetic oligonucleotide
  Target: ATXN1; (+) strand; PAM type: YTN; PAM sequence: CTT
tttatggaattaggcatggg

SEQ ID NO: 255583 - DNA, 20 bp, Artificial Sequence
  Description of Artificial Sequence: Synthetic oligonucleotide
  Target: ATXN1; (+) strand; PAM type: YTN; PAM sequence: TTT
ttatggaattaggcatggga

SEQ ID NO: 255584 - DNA, 20 bp, Artificial Sequence
  Description of Artificial Sequence: Synthetic oligonucleotide
  Target: ATXN1; (+) strand; PAM type: YTN; PAM sequence: TTT
tatggaattaggcatgggaa

SEQ ID NO: 255585 - DNA, 20 bp, Artificial Sequence
  Description of Artificial Sequence: Synthetic oligonucleotide
  Target: ATXN1; (+) strand; PAM type: YTN; PAM sequence: TTT
atggaattaggcatgggaag

SEQ ID NO: 255586 - DNA, 20 bp, Artificial Sequence
  Description of Artificial Sequence: Synthetic oligonucleotide
  Target: ATXN1; (+) strand; PAM type: YTN; PAM sequence: TTA
tggaattaggcatgggaagc

SEQ ID NO: 255587 - DNA, 20 bp, Artificial Sequence
  Description of Artificial Sequence: Synthetic oligonucleotide
  Target: ATXN1; (+) strand; PAM type: YTN; PAM sequence: TTA
ggcatgggaagcagctttgc

SEQ ID NO: 255588 - DNA, 20 bp, Artificial Sequence
  Description of Artificial Sequence: Synthetic oligonucleotide
  Target: ATXN1; (+) strand; PAM type: YTN; PAM sequence: CTT
tgctctcctacatcaaacgt

SEQ ID NO: 255589 - DNA, 20 bp, Artificial Sequence
  Description of Artificial Sequence: Synthetic oligonucleotide
  Target: ATXN1; (+) strand; PAM type: YTN; PAM sequence: TTT
gctctcctacatcaaacgtt

SEQ ID NO: 255590 - DNA, 20 bp, Artificial Sequence
  Description of Artificial Sequence: Synthetic oligonucleotide
  Target: ATXN1; (+) strand; PAM type: YTN; PAM sequence: TTG
ctctcctacatcaaacgtta

SEQ ID NO: 255591 - DNA, 20 bp, Artificial Sequence
  Description of Artificial Sequence: Synthetic oligonucleotide
  Target: ATXN1; (+) strand; PAM type: YTN; PAM sequence: CTC
tcctacatcaaacgttatct

SEQ ID NO: 255592 - DNA, 20 bp, Artificial Sequence
  Description of Artificial Sequence: Synthetic oligonucleotide
  Target: ATXN1; (+) strand; PAM type: YTN; PAM sequence: CTC
ctacatcaaacgttatctta

SEQ ID NO: 255593 - DNA, 20 bp, Artificial Sequence
  Description of Artificial Sequence: Synthetic oligonucleotide
  Target: ATXN1; (+) strand; PAM type: YTN; PAM sequence: CTA
catcaaacgttatcttaact

SEQ ID NO: 255594 - DNA, 20 bp, Artificial Sequence
  Description of Artificial Sequence: Synthetic oligonucleotide
  Target: ATXN1; (+) strand; PAM type: YTN; PAM sequence: TTA
tcttaactccacagaaaaaa

SEQ ID NO: 255595 - DNA, 20 bp, Artificial Sequence
  Description of Artificial Sequence: Synthetic oligonucleotide
  Target: ATXN1; (+) strand; PAM type: YTN; PAM sequence: CTT
aactccacagaaaaaattca

SEQ ID NO: 255596 - DNA, 20 bp, Artificial Sequence
  Description of Artificial Sequence: Synthetic oligonucleotide
  Target: ATXN1; (+) strand; PAM type: YTN; PAM sequence: TTA
actccacagaaaaaattcac

SEQ ID NO: 255597 - DNA, 20 bp, Artificial Sequence
  Description of Artificial Sequence: Synthetic oligonucleotide
  Target: ATXN1; (+) strand; PAM type: YTN; PAM sequence: CTC
cacagaaaaaattcacgaac

SEQ ID NO: 255598 - DNA, 20 bp, Artificial Sequence
  Description of Artificial Sequence: Synthetic oligonucleotide
  Target: ATXN1; (+) strand; PAM type: YTN; PAM sequence: TTC
acgaactccaaaaccttcct

SEQ ID NO: 255599 - DNA, 20 bp, Artificial Sequence
  Description of Artificial Sequence: Synthetic oligonucleotide
  Target: ATXN1; (+) strand; PAM type: YTN; PAM sequence: CTC
caaaaccttcctcttgacaa

SEQ ID NO: 255600 - DNA, 20 bp, Artificial Sequence
  Description of Artificial Sequence: Synthetic oligonucleotide
  Target: ATXN1; (+) strand; PAM type: YTN; PAM sequence: CTT
cctcttgacaaccagaggag

SEQ ID NO: 255601 - DNA, 20 bp, Artificial Sequence
  Description of Artificial Sequence: Synthetic oligonucleotide
  Target: ATXN1; (+) strand; PAM type: YTN; PAM sequence: TTC
ctcttgacaaccagaggagg

SEQ ID NO: 255602 - DNA, 20 bp, Artificial Sequence
  Description of Artificial Sequence: Synthetic oligonucleotide
  Target: ATXN1; (+) strand; PAM type: YTN; PAM sequence: CTC
ttgacaaccagaggaggaag

SEQ ID NO: 255603 - DNA, 20 bp, Artificial Sequence
  Description of Artificial Sequence: Synthetic oligonucleotide
  Target: ATXN1; (+) strand; PAM type: YTN; PAM sequence: CTT
gacaaccagaggaggaaggt

SEQ ID NO: 255604 - DNA, 20 bp, Artificial Sequence
  Description of Artificial Sequence: Synthetic oligonucleotide
  Target: ATXN1; (+) strand; PAM type: YTN; PAM sequence: TTG
acaaccagaggaggaaggtg

SEQ ID NO: 255605 - DNA, 20 bp, Artificial Sequence
  Description of Artificial Sequence: Synthetic oligonucleotide
  Target: ATXN1; (+) strand; PAM type: YTN; PAM sequence: TTT
taacccagtctgaattcaaa

SEQ ID NO: 255606 - DNA, 20 bp, Artificial Sequence
  Description of Artificial Sequence: Synthetic oligonucleotide
  Target: ATXN1; (+) strand; PAM type: YTN; PAM sequence: TTT
aacccagtctgaattcaaat

SEQ ID NO: 255607 - DNA, 20 bp, Artificial Sequence
  Description of Artificial Sequence: Synthetic oligonucleotide
  Target: ATXN1; (+) strand; PAM type: YTN; PAM sequence: TTA
acccagtctgaattcaaatc

SEQ ID NO: 255608 - DNA, 20 bp, Artificial Sequence
  Description of Artificial Sequence: Synthetic oligonucleotide
  Target: ATXN1; (+) strand; PAM type: YTN; PAM sequence: CTG
aattcaaatctgtagatagt

SEQ ID NO: 255609 - DNA, 20 bp, Artificial Sequence
  Description of Artificial Sequence: Synthetic oligonucleotide
  Target: ATXN1; (+) strand; PAM type: YTN; PAM sequence: TTC
aaatctgtagatagtgaatt

SEQ ID NO: 255610 - DNA, 20 bp, Artificial Sequence
  Description of Artificial Sequence: Synthetic oligonucleotide
  Target: ATXN1; (+) strand; PAM type: YTN; PAM sequence: CTG
tagatagtgaatttttttta

SEQ ID NO: 255611 - DNA, 20 bp, Artificial Sequence
  Description of Artificial Sequence: Synthetic oligonucleotide
  Target: ATXN1; (+) strand; PAM type: YTN; PAM sequence: TTT
tttttaactctcttaaaaca

SEQ ID NO: 255612 - DNA, 20 bp, Artificial Sequence
  Description of Artificial Sequence: Synthetic oligonucleotide
  Target: ATXN1; (+) strand; PAM type: YTN; PAM sequence: TTT
ttttaactctcttaaaacag

SEQ ID NO: 255613 - DNA, 20 bp, Artificial Sequence
  Description of Artificial Sequence: Synthetic oligonucleotide
  Target: ATXN1; (+) strand; PAM type: YTN; PAM sequence: TTT
tttaactctcttaaaacagc

SEQ ID NO: 255614 - DNA, 20 bp, Artificial Sequence
  Description of Artificial Sequence: Synthetic oligonucleotide
  Target: ATXN1; (+) strand; PAM type: YTN; PAM sequence: TTT
ttaactctcttaaaacagcg

SEQ ID NO: 255615 - DNA, 20 bp, Artificial Sequence
  Description of Artificial Sequence: Synthetic oligonucleotide
  Target: ATXN1; (+) strand; PAM type: YTN; PAM sequence: TTT
taactctcttaaaacagcgc

SEQ ID NO: 255616 - DNA, 20 bp, Artificial Sequence
  Description of Artificial Sequence: Synthetic oligonucleotide
  Target: ATXN1; (+) strand; PAM type: YTN; PAM sequence: TTT
aactctcttaaaacagcgct

SEQ ID NO: 255617 - DNA, 20 bp, Artificial Sequence
  Description of Artificial Sequence: Synthetic oligonucleotide
  Target: ATXN1; (+) strand; PAM type: YTN; PAM sequence: TTA
actctcttaaaacagcgctt

SEQ ID NO: 255618 - DNA, 20 bp, Artificial Sequence
  Description of Artificial Sequence: Synthetic oligonucleotide
  Target: ATXN1; (+) strand; PAM type: YTN; PAM sequence: CTC
tcttaaaacagcgctttgaa

SEQ ID NO: 255619 - DNA, 20 bp, Artificial Sequence
  Description of Artificial Sequence: Synthetic oligonucleotide
  Target: ATXN1; (+) strand; PAM type: YTN; PAM sequence: CTC
ttaaaacagcgctttgaatt

SEQ ID NO: 255620 - DNA, 20 bp, Artificial Sequence
  Description of Artificial Sequence: Synthetic oligonucleotide
  Target: ATXN1; (+) strand; PAM type: YTN; PAM sequence: CTT
aaaacagcgctttgaatttt

SEQ ID NO: 255621 - DNA, 20 bp, Artificial Sequence
  Description of Artificial Sequence: Synthetic oligonucleotide
  Target: ATXN1; (+) strand; PAM type: YTN; PAM sequence: TTA
aaacagcgctttgaattttg

SEQ ID NO: 255622 - DNA, 20 bp, Artificial Sequence
  Description of Artificial Sequence: Synthetic oligonucleotide
  Target: ATXN1; (+) strand; PAM type: YTN; PAM sequence: CTT
tgaattttgaacatcttgat

SEQ ID NO: 255623 - DNA, 20 bp, Artificial Sequence
  Description of Artificial Sequence: Synthetic oligonucleotide
  Target: ATXN1; (+) strand; PAM type: YTN; PAM sequence: TTT
gaattttgaacatcttgatt

SEQ ID NO: 255624 - DNA, 20 bp, Artificial Sequence
  Description of Artificial Sequence: Synthetic oligonucleotide
  Target: ATXN1; (+) strand; PAM type: YTN; PAM sequence: TTG
aattttgaacatcttgatta

SEQ ID NO: 255625 - DNA, 20 bp, Artificial Sequence
  Description of Artificial Sequence: Synthetic oligonucleotide
  Target: ATXN1; (+) strand; PAM type: YTN; PAM sequence: TTT
tgaacatcttgattatatat

SEQ ID NO: 255626 - DNA, 20 bp, Artificial Sequence
  Description of Artificial Sequence: Synthetic oligonucleotide
  Target: ATXN1; (+) strand; PAM type: YTN; PAM sequence: TTT
gaacatcttgattatatata

SEQ ID NO: 255627 - DNA, 20 bp, Artificial Sequence
  Description of Artificial Sequence: Synthetic oligonucleotide
  Target: ATXN1; (+) strand; PAM type: YTN; PAM sequence: TTG
aacatcttgattatatatac

SEQ ID NO: 255628 - DNA, 20 bp, Artificial Sequence
  Description of Artificial Sequence: Synthetic oligonucleotide
  Target: ATXN1; (+) strand; PAM type: YTN; PAM sequence: CTT
gattatatatacatacacat

SEQ ID NO: 255629 - DNA, 20 bp, Artificial Sequence
  Description of Artificial Sequence: Synthetic oligonucleotide
  Target: ATXN1; (+) strand; PAM type: YTN; PAM sequence: TTG
attatatatacatacacatg

SEQ ID NO: 255630 - DNA, 20 bp, Artificial Sequence
  Description of Artificial Sequence: Synthetic oligonucleotide
  Target: ATXN1; (+) strand; PAM type: YTN; PAM sequence: TTA
tatatacatacacatgtaga

SEQ ID NO: 255631 - DNA, 20 bp, Artificial Sequence
  Description of Artificial Sequence: Synthetic oligonucleotide
  Target: ATXN1; (+) strand; PAM type: YTN; PAM sequence: CTC
agaaagactgggactctggc

SEQ ID NO: 255632 - DNA, 20 bp, Artificial Sequence
  Description of Artificial Sequence: Synthetic oligonucleotide
  Target: ATXN1; (+) strand; PAM type: YTN; PAM sequence: CTG
ggactctggcaggaaccaga

SEQ ID NO: 255633 - DNA, 20 bp, Artificial Sequence
  Description of Artificial Sequence: Synthetic oligonucleotide
  Target: ATXN1; (+) strand; PAM type: YTN; PAM sequence: CTC
tggcaggaaccagaattctg

SEQ ID NO: 255634 - DNA, 20 bp, Artificial Sequence
  Description of Artificial Sequence: Synthetic oligonucleotide
  Target: ATXN1; (+) strand; PAM type: YTN; PAM sequence: CTG
gcaggaaccagaattctgcc

SEQ ID NO: 255635 - DNA, 20 bp, Artificial Sequence
  Description of Artificial Sequence: Synthetic oligonucleotide
  Target: ATXN1; (+) strand; PAM type: YTN; PAM sequence: TTC
tgccacatcccaaacctagc

SEQ ID NO: 255636 - DNA, 20 bp, Artificial Sequence
  Description of Artificial Sequence: Synthetic oligonucleotide
  Target: ATXN1; (+) strand; PAM type: YTN; PAM sequence: CTG
ccacatcccaaacctagcag

SEQ ID NO: 255637 - DNA, 20 bp, Artificial Sequence
  Description of Artificial Sequence: Synthetic oligonucleotide
  Target: ATXN1; (+) strand; PAM type: YTN; PAM sequence: CTA
gcagaccaagttcaactttg

SEQ ID NO: 255638 - DNA, 20 bp, Artificial Sequence
  Description of Artificial Sequence: Synthetic oligonucleotide
  Target: ATXN1; (+) strand; PAM type: YTN; PAM sequence: TTC
aactttggaaatgcatcatc

SEQ ID NO: 255639 - DNA, 20 bp, Artificial Sequence
  Description of Artificial Sequence: Synthetic oligonucleotide
  Target: ATXN1; (+) strand; PAM type: YTN; PAM sequence: CTT
tggaaatgcatcatcacctt

SEQ ID NO: 255640 - DNA, 20 bp, Artificial Sequence
  Description of Artificial Sequence: Synthetic oligonucleotide
  Target: ATXN1; (+) strand; PAM type: YTN; PAM sequence: TTT
ggaaatgcatcatcaccttc

SEQ ID NO: 255641 - DNA, 20 bp, Artificial Sequence
  Description of Artificial Sequence: Synthetic oligonucleotide
  Target: ATXN1; (+) strand; PAM type: YTN; PAM sequence: TTG
gaaatgcatcatcaccttca

SEQ ID NO: 255642 - DNA, 20 bp, Artificial Sequence
  Description of Artificial Sequence: Synthetic oligonucleotide
  Target: ATXN1; (+) strand; PAM type: YTN; PAM sequence: CTT
cacgccagaatcacaaacac

SEQ ID NO: 255643 - DNA, 20 bp, Artificial Sequence
  Description of Artificial Sequence: Synthetic oligonucleotide
  Target: ATXN1; (+) strand; PAM type: YTN; PAM sequence: TTC
acgccagaatcacaaacaca

SEQ ID NO: 255644 - DNA, 20 bp, Artificial Sequence
  Description of Artificial Sequence: Synthetic oligonucleotide
  Target: ATXN1; (+) strand; PAM type: YTN; PAM sequence: TTG
aaatcccaggtcctcggctt

SEQ ID NO: 255645 - DNA, 20 bp, Artificial Sequence
  Description of Artificial Sequence: Synthetic oligonucleotide
  Target: ATXN1; (+) strand; PAM type: YTN; PAM sequence: CTC
ggcttctcagctgacacatc

SEQ ID NO: 255646 - DNA, 20 bp, Artificial Sequence
  Description of Artificial Sequence: Synthetic oligonucleotide
  Target: ATXN1; (+) strand; PAM type: YTN; PAM sequence: CTT
ctcagctgacacatcagagt

SEQ ID NO: 255647 - DNA, 20 bp, Artificial Sequence
  Description of Artificial Sequence: Synthetic oligonucleotide
  Target: ATXN1; (+) strand; PAM type: YTN; PAM sequence: TTC
tcagctgacacatcagagtt

SEQ ID NO: 255648 - DNA, 20 bp, Artificial Sequence
  Description of Artificial Sequence: Synthetic oligonucleotide
  Target: ATXN1; (+) strand; PAM type: YTN; PAM sequence: CTC
agctgacacatcagagttta

SEQ ID NO: 255649 - DNA, 20 bp, Artificial Sequence
  Description of Artificial Sequence: Synthetic oligonucleotide
  Target: ATXN1; (+) strand; PAM type: YTN; PAM sequence: CTG
acacatcagagtttatgcgt

SEQ ID NO: 255650 - DNA, 20 bp, Artificial Sequence
  Description of Artificial Sequence: Synthetic oligonucleotide
  Target: ATXN1; (+) strand; PAM type: YTN; PAM sequence: TTT
atgcgttttctaagaagagg

SEQ ID NO: 255651 - DNA, 20 bp, Artificial Sequence
  Description of Artificial Sequence: Synthetic oligonucleotide
  Target: ATXN1; (+) strand; PAM type: YTN; PAM sequence: TTA
tgcgttttctaagaagagga

SEQ ID NO: 255652 - DNA, 20 bp, Artificial Sequence
  Description of Artificial Sequence: Synthetic oligonucleotide
  Target: ATXN1; (+) strand; PAM type: YTN; PAM sequence: TTT
tctaagaagaggaagttatt

SEQ ID NO: 255653 - DNA, 20 bp, Artificial Sequence
  Description of Artificial Sequence: Synthetic oligonucleotide
  Target: ATXN1; (+) strand; PAM type: YTN; PAM sequence: TTT
ctaagaagaggaagttattc

SEQ ID NO: 255654 - DNA, 20 bp, Artificial Sequence
  Description of Artificial Sequence: Synthetic oligonucleotide
  Target: ATXN1; (+) strand; PAM type: YTN; PAM sequence: TTC
taagaagaggaagttattca

SEQ ID NO: 255655 - DNA, 20 bp, Artificial Sequence
  Description of Artificial Sequence: Synthetic oligonucleotide
  Target: ATXN1; (+) strand; PAM type: YTN; PAM sequence: CTA
agaagaggaagttattcaag

SEQ ID NO: 255656 - DNA, 20 bp, Artificial Sequence
  Description of Artificial Sequence: Synthetic oligonucleotide
  Target: ATXN1; (+) strand; PAM type: YTN; PAM sequence: TTA
ttcaagctctttaaaaaaaa

SEQ ID NO: 255657 - DNA, 20 bp, Artificial Sequence
  Description of Artificial Sequence: Synthetic oligonucleotide
  Target: ATXN1; (+) strand; PAM type: YTN; PAM sequence: TTC
aagctctttaaaaaaaaatt

SEQ ID NO: 255658 - DNA, 20 bp, Artificial Sequence
  Description of Artificial Sequence: Synthetic oligonucleotide
  Target: ATXN1; (+) strand; PAM type: YTN; PAM sequence: CTC
tttaaaaaaaaattttttaa

SEQ ID NO: 255659 - DNA, 20 bp, Artificial Sequence
  Description of Artificial Sequence: Synthetic oligonucleotide
  Target: ATXN1; (+) strand; PAM type: YTN; PAM sequence: CTT
taaaaaaaaattttttaaga

SEQ ID NO: 255660 - DNA, 20 bp, Artificial Sequence
  Description of Artificial Sequence: Synthetic oligonucleotide
  Target: ATXN1; (+) strand; PAM type: YTN; PAM sequence: TTT
aaaaaaaaattttttaagac

SEQ ID NO: 255661 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaattttttaagaca

SEQ ID NO: 255662 - DNA, 20 bp, Artificial Sequence
  Description of Artificial Sequence: Synthetic oligonucleotide
  Target: ATXN1; (+) strand; PAM type: YTN; PAM sequence: TTT
tttaagacagggtctcactt

SEQ ID NO: 255663 - DNA, 20 bp, Artificial Sequence
  Description of Artificial Sequence: Synthetic oligonucleotide
  Target: ATXN1; (+) strand; PAM type: YTN; PAM sequence: TTT
ttaagacagggtctcacttt

SEQ ID NO: 255664 - DNA, 20 bp, Artificial Sequence
  Description of Artificial Sequence: Synthetic oligonucleotide
  Target: ATXN1; (+) strand; PAM type: YTN; PAM sequence: TTT
taagacagggtctcactttg

SEQ ID NO: 255665 - DNA, 20 bp, Artificial Sequence
  Description of Artificial Sequence: Synthetic oligonucleotide
  Target: ATXN1; (+) strand; PAM type: YTN; PAM sequence: TTT
aagacagggtctcactttgt

SEQ ID NO: 255666 - DNA, 20 bp, Artificial Sequence
  Description of Artificial Sequence: Synthetic oligonucleotide
  Target: ATXN1; (+) strand; PAM type: YTN; PAM sequence: TTA
agacagggtctcactttgtc

SEQ ID NO: 255667 - DNA, 20 bp, Artificial Sequence
  Description of Artificial Sequence: Synthetic oligonucleotide
  Target: ATXN1; (+) strand; PAM type: YTN; PAM sequence: CTC
actttgtcactcaggttgga

SEQ ID NO: 255668 - DNA, 20 bp, Artificial Sequence
  Description of Artificial Sequence: Synthetic oligonucleotide
  Target: ATXN1; (+) strand; PAM type: YTN; PAM sequence: CTT
tgtcactcaggttggagtgc

SEQ ID NO: 255669 - DNA, 20 bp, Artificial Sequence
  Description of Artificial Sequence: Synthetic oligonucleotide
  Target: ATXN1; (+) strand; PAM type: YTN; PAM sequence: TTT
gtcactcaggttggagtgca

SEQ ID NO: 255670 - DNA, 20 bp, Artificial Sequence
  Description of Artificial Sequence: Synthetic oligonucleotide
  Target: ATXN1; (+) strand; PAM type: YTN; PAM sequence: TTG
tcactcaggttggagtgcag

SEQ ID NO: 255671 - DNA, 20 bp, Artificial Sequence
  Description of Artificial Sequence: Synthetic oligonucleotide
  Target: ATXN1; (+) strand; PAM type: YTN; PAM sequence: CTC
aggttggagtgcagtggtgt

SEQ ID NO: 255672 - DNA, 20 bp, Artificial Sequence
  Description of Artificial Sequence: Synthetic oligonucleotide
  Target: ATXN1; (+) strand; PAM type: YTN; PAM sequence: TTG
gagtgcagtggtgtaatctc

SEQ ID NO: 255673 - DNA, 20 bp, Artificial Sequence
  Description of Artificial Sequence: Synthetic oligonucleotide
  Target: ATXN1; (+) strand; PAM type: YTN; PAM sequence: CTC
agctcacttcagccttgacc

SEQ ID NO: 255674 - DNA, 20 bp, Artificial Sequence
  Description of Artificial Sequence: Synthetic oligonucleotide
  Target: ATXN1; (+) strand; PAM type: YTN; PAM sequence: CTC
acttcagccttgaccttctg

SEQ ID NO: 255675 - DNA, 20 bp, Artificial Sequence
  Description of Artificial Sequence: Synthetic oligonucleotide
  Target: ATXN1; (+) strand; PAM type: YTN; PAM sequence: CTT
cagccttgaccttctgggtt

SEQ ID NO: 255676 - DNA, 20 bp, Artificial Sequence
  Description of Artificial Sequence: Synthetic oligonucleotide
  Target: ATXN1; (+) strand; PAM type: YTN; PAM sequence: TTC
agccttgaccttctgggttc

SEQ ID NO: 255677 - DNA, 20 bp, Artificial Sequence
  Description of Artificial Sequence: Synthetic oligonucleotide
  Target: ATXN1; (+) strand; PAM type: YTN; PAM sequence: CTT
gaccttctgggttcaagcaa

SEQ ID NO: 255678 - DNA, 20 bp, Artificial Sequence
  Description of Artificial Sequence: Synthetic oligonucleotide
  Target: ATXN1; (+) strand; PAM type: YTN; PAM sequence: TTG
accttctgggttcaagcaat

SEQ ID NO: 255679 - DNA, 20 bp, Artificial Sequence
  Description of Artificial Sequence: Synthetic oligonucleotide
  Target: ATXN1; (+) strand; PAM type: YTN; PAM sequence: CTT
ctgggttcaagcaattctcc

SEQ ID NO: 255680 - DNA, 20 bp, Artificial Sequence
  Description of Artificial Sequence: Synthetic oligonucleotide
  Target: ATXN1; (+) strand; PAM type: YTN; PAM sequence: TTC
tgggttcaagcaattctcct

SEQ ID NO: 255681 - DNA, 20 bp, Artificial Sequence
  Description of Artificial Sequence: Synthetic oligonucleotide
  Target: ATXN1; (+) strand; PAM type: YTN; PAM sequence: CTG
ggttcaagcaattctcctgc

SEQ ID NO: 255682 - DNA, 20 bp, Artificial Sequence
  Description of Artificial Sequence: Synthetic oligonucleotide
  Target: ATXN1; (+) strand; PAM type: YTN; PAM sequence: TTC
aagcaattctcctgcttcag

SEQ ID NO: 255683 - DNA, 20 bp, Artificial Sequence
  Description of Artificial Sequence: Synthetic oligonucleotide
  Target: ATXN1; (+) strand; PAM type: YTN; PAM sequence: TTC
tcctgcttcagccccttaag

SEQ ID NO: 255684 - DNA, 20 bp, Artificial Sequence
  Description of Artificial Sequence: Synthetic oligonucleotide
  Target: ATXN1; (+) strand; PAM type: YTN; PAM sequence: CTC
ctgcttcagccccttaagta

SEQ ID NO: 255685 - DNA, 20 bp, Artificial Sequence
  Description of Artificial Sequence: Synthetic oligonucleotide
  Target: ATXN1; (+) strand; PAM type: YTN; PAM sequence: CTG
cttcagccccttaagtagtt

SEQ ID NO: 255686 - DNA, 20 bp, Artificial Sequence
  Description of Artificial Sequence: Synthetic oligonucleotide
  Target: ATXN1; (+) strand; PAM type: YTN; PAM sequence: CTT
cagccccttaagtagttggg

SEQ ID NO: 255687 - DNA, 20 bp, Artificial Sequence
  Description of Artificial Sequence: Synthetic oligonucleotide
  Target: ATXN1; (+) strand; PAM type: YTN; PAM sequence: TTC
agccccttaagtagttggga

SEQ ID NO: 255688 - DNA, 20 bp, Artificial Sequence
  Description of Artificial Sequence: Synthetic oligonucleotide
  Target: ATXN1; (+) strand; PAM type: YTN; PAM sequence: CTT
aagtagttgggactacagat

SEQ ID NO: 255689 - DNA, 20 bp, Artificial Sequence
  Description of Artificial Sequence: Synthetic oligonucleotide
  Target: ATXN1; (+) strand; PAM type: YTN; PAM sequence: TTA
agtagttgggactacagatg

SEQ ID NO: 255690 - DNA, 20 bp, Artificial Sequence
  Description of Artificial Sequence: Synthetic oligonucleotide
  Target: ATXN1; (+) strand; PAM type: YTN; PAM sequence: TTG
ggactacagatgcatgccaa

SEQ ID NO: 255691 - DNA, 20 bp, Artificial Sequence
  Description of Artificial Sequence: Synthetic oligonucleotide
  Target: ATXN1; (+) strand; PAM type: YTN; PAM sequence: CTA
cagatgcatgccaatacacc

SEQ ID NO: 255692 - DNA, 20 bp, Artificial Sequence
  Description of Artificial Sequence: Synthetic oligonucleotide
  Target: ATXN1; (+) strand; PAM type: YTN; PAM sequence: CTG
actaatttttgtatttttag

SEQ ID NO: 255693 - DNA, 20 bp, Artificial Sequence
  Description of Artificial Sequence: Synthetic oligonucleotide
  Target: ATXN1; (+) strand; PAM type: YTN; PAM sequence: CTA
atttttgtatttttagtaga

SEQ ID NO: 255694 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagatg

SEQ ID NO: 255695 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagatgg

SEQ ID NO: 255696 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagatggg

SEQ ID NO: 255697 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagatgggg

SEQ ID NO: 255698 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatggggtttcg

SEQ ID NO: 255699 - DNA, 20 bp, Artificial Sequence
  Description of Artificial Sequence: Synthetic oligonucleotide
  Target: ATXN1; (+) strand; PAM type: YTN; PAM sequence: TTT
tagtagagatggggtttcgc

SEQ ID NO: 255700 - DNA, 20 bp, Artificial Sequence
  Description of Artificial Sequence: Synthetic oligonucleotide
  Target: ATXN1; (+) strand; PAM type: YTN; PAM sequence: TTT
agtagagatggggtttcgcc

SEQ ID NO: 255701 - DNA, 20 bp, Artificial Sequence
  Description of Artificial Sequence: Synthetic oligonucleotide
  Target: ATXN1; (+) strand; PAM type: YTN; PAM sequence: TTA
gtagagatggggtttcgcca

SEQ ID NO: 255702 - DNA, 20 bp, Artificial Sequence
  Description of Artificial Sequence: Synthetic oligonucleotide
  Target: ATXN1; (+) strand; PAM type: YTN; PAM sequence: TTT
cgccacattggccaggctgg

SEQ ID NO: 255703 - DNA, 20 bp, Artificial Sequence
  Description of Artificial Sequence: Synthetic oligonucleotide
  Target: ATXN1; (+) strand; PAM type: YTN; PAM sequence: TTC
gccacattggccaggctggt

SEQ ID NO: 255704 - DNA, 20 bp, Artificial Sequence
  Description of Artificial Sequence: Synthetic oligonucleotide
  Target: ATXN1; (+) strand; PAM type: YTN; PAM sequence: TTG
gccaggctggtctcgaactc

SEQ ID NO: 255705 - DNA, 20 bp, Artificial Sequence
  Description of Artificial Sequence: Synthetic oligonucleotide
  Target: ATXN1; (+) strand; PAM type: YTN; PAM sequence: CTG
gtctcgaactcttgagctca

SEQ ID NO: 255706 - DNA, 20 bp, Artificial Sequence
  Description of Artificial Sequence: Synthetic oligonucleotide
  Target: ATXN1; (+) strand; PAM type: YTN; PAM sequence: CTC
gaactcttgagctcaagtga

SEQ ID NO: 255707 - DNA, 20 bp, Artificial Sequence
  Description of Artificial Sequence: Synthetic oligonucleotide
  Target: ATXN1; (+) strand; PAM type: YTN; PAM sequence: CTC
ttgagctcaagtgatcctca

SEQ ID NO: 255708 - DNA, 20 bp, Artificial Sequence
  Description of Artificial Sequence: Synthetic oligonucleotide
  Target: ATXN1; (+) strand; PAM type: YTN; PAM sequence: CTT
gagctcaagtgatcctcaca

SEQ ID NO: 255709 - DNA, 20 bp, Artificial Sequence
  Description of Artificial Sequence: Synthetic oligonucleotide
  Target: ATXN1; (+) strand; PAM type: YTN; PAM sequence: TTG
agctcaagtgatcctcacac

SEQ ID NO: 255710 - DNA, 20 bp, Artificial Sequence
  Description of Artificial Sequence: Synthetic oligonucleotide
  Target: ATXN1; (+) strand; PAM type: YTN; PAM sequence: CTC
aagtgatcctcacaccttgg

SEQ ID NO: 255711 - DNA, 20 bp, Artificial Sequence
  Description of Artificial Sequence: Synthetic oligonucleotide
  Target: ATXN1; (+) strand; PAM type: YTN; PAM sequence: CTC
acaccttggcctccaaaagt

SEQ ID NO: 255712 - DNA, 20 bp, Artificial Sequence
  Description of Artificial Sequence: Synthetic oligonucleotide
  Target: ATXN1; (+) strand; PAM type: YTN; PAM sequence: CTT
ggcctccaaaagtgctagga

SEQ ID NO: 255713 - DNA, 20 bp, Artificial Sequence
  Description of Artificial Sequence: Synthetic oligonucleotide
  Target: ATXN1; (+) strand; PAM type: YTN; PAM sequence: TTG
gcctccaaaagtgctaggat

SEQ ID NO: 255714 - DNA, 20 bp, Artificial Sequence
  Description of Artificial Sequence: Synthetic oligonucleotide
  Target: ATXN1; (+) strand; PAM type: YTN; PAM sequence: CTC
caaaagtgctaggattacag

SEQ ID NO: 255715 - DNA, 20 bp, Artificial Sequence
  Description of Artificial Sequence: Synthetic oligonucleotide
  Target: ATXN1; (+) strand; PAM type: YTN; PAM sequence: CTA
ggattacaggcgtgagccat

SEQ ID NO: 255716 - DNA, 20 bp, Artificial Sequence
  Description of Artificial Sequence: Synthetic oligonucleotide
  Target: ATXN1; (+) strand; PAM type: YTN; PAM sequence: TTA
caggcgtgagccatggcgcc

SEQ ID NO: 255717 - DNA, 20 bp, Artificial Sequence
  Description of Artificial Sequence: Synthetic oligonucleotide
  Target: ATXN1; (+) strand; PAM type: YTN; PAM sequence: CTA
agctctttaaatgcagcaac

SEQ ID NO: 255718 - DNA, 20 bp, Artificial Sequence
  Description of Artificial Sequence: Synthetic oligonucleotide
  Target: ATXN1; (+) strand; PAM type: YTN; PAM sequence: CTC
tttaaatgcagcaactttca

SEQ ID NO: 255719 - DNA, 20 bp, Artificial Sequence
  Description of Artificial Sequence: Synthetic oligonucleotide
  Target: ATXN1; (+) strand; PAM type: YTN; PAM sequence: CTT
taaatgcagcaactttcata

SEQ ID NO: 255720 - DNA, 20 bp, Artificial Sequence
  Description of Artificial Sequence: Synthetic oligonucleotide
  Target: ATXN1; (+) strand; PAM type: YTN; PAM sequence: TTT
aaatgcagcaactttcatac

SEQ ID NO: 255721 - DNA, 20 bp, Artificial Sequence
  Description of Artificial Sequence: Synthetic oligonucleotide
  Target: ATXN1; (+) strand; PAM type: YTN; PAM sequence: TTA
aatgcagcaactttcatacc

SEQ ID NO: 255722 - DNA, 20 bp, Artificial Sequence
  Description of Artificial Sequence: Synthetic oligonucleotide
  Target: ATXN1; (+) strand; PAM type: YTN; PAM sequence: CTT
tcataccatatttattaccc

SEQ ID NO: 255723 - DNA, 20 bp, Artificial Sequence
  Description of Artificial Sequence: Synthetic oligonucleotide
  Target: ATXN1; (+) strand; PAM type: YTN; PAM sequence: TTT
cataccatatttattaccct

SEQ ID NO: 255724 - DNA, 20 bp, Artificial Sequence
  Description of Artificial Sequence: Synthetic oligonucleotide
  Target: ATXN1; (+) strand; PAM type: YTN; PAM sequence: TTC
ataccatatttattaccctg

SEQ ID NO: 255725 - DNA, 20 bp, Artificial Sequence
  Description of Artificial Sequence: Synthetic oligonucleotide
  Target: ATXN1; (+) strand; PAM type: YTN; PAM sequence: TTT
attaccctgtcccctcctga

SEQ ID NO: 255726 - DNA, 20 bp, Artificial Sequence
  Description of Artificial Sequence: Synthetic oligonucleotide
  Target: ATXN1; (+) strand; PAM type: YTN; PAM sequence: TTA
ttaccctgtcccctcctgag

SEQ ID NO: 255727 - DNA, 20 bp, Artificial Sequence
  Description of Artificial Sequence: Synthetic oligonucleotide
  Target: ATXN1; (+) strand; PAM type: YTN; PAM sequence: TTA
ccctgtcccctcctgagtcc

SEQ ID NO: 255728 - DNA, 20 bp, Artificial Sequence
  Description of Artificial Sequence: Synthetic oligonucleotide
  Target: ATXN1; (+) strand; PAM type: YTN; PAM sequence: CTG
tcccctcctgagtcccatcc

SEQ ID NO: 255729 - DNA, 20 bp, Artificial Sequence
  Description of Artificial Sequence: Synthetic oligonucleotide
  Target: ATXN1; (+) strand; PAM type: YTN; PAM sequence: CTC
ctgagtcccatcctctgacc

SEQ ID NO: 255730 - DNA, 20 bp, Artificial Sequence
  Description of Artificial Sequence: Synthetic oligonucleotide
  Target: ATXN1; (+) strand; PAM type: YTN; PAM sequence: CTG
agtcccatcctctgaccact

SEQ ID NO: 255731 - DNA, 20 bp, Artificial Sequence
  Description of Artificial Sequence: Synthetic oligonucleotide
  Target: ATXN1; (+) strand; PAM type: YTN; PAM sequence: CTC
tgaccacttcatcttcttct

SEQ ID NO: 255732 - DNA, 20 bp, Artificial Sequence
  Description of Artificial Sequence: Synthetic oligonucleotide
  Target: ATXN1; (+) strand; PAM type: YTN; PAM sequence: CTG
accacttcatcttcttctac

SEQ ID NO: 255733 - DNA, 20 bp, Artificial Sequence
  Description of Artificial Sequence: Synthetic oligonucleotide
  Target: ATXN1; (+) strand; PAM type: YTN; PAM sequence: CTT
catcttcttctacctccaaa

SEQ ID NO: 255734 - DNA, 20 bp, Artificial Sequence
  Description of Artificial Sequence: Synthetic oligonucleotide
  Target: ATXN1; (+) strand; PAM type: YTN; PAM sequence: TTC
atcttcttctacctccaaaa

SEQ ID NO: 255735 - DNA, 20 bp, Artificial Sequence
  Description of Artificial Sequence: Synthetic oligonucleotide
  Target: ATXN1; (+) strand; PAM type: YTN; PAM sequence: CTT
cttctacctccaaaactctc

SEQ ID NO: 255736 - DNA, 20 bp, Artificial Sequence
  Description of Artificial Sequence: Synthetic oligonucleotide
  Target: ATXN1; (+) strand; PAM type: YTN; PAM sequence: TTC
ttctacctccaaaactctcc

SEQ ID NO: 255737 - DNA, 20 bp, Artificial Sequence
  Description of Artificial Sequence: Synthetic oligonucleotide
  Target: ATXN1; (+) strand; PAM type: YTN; PAM sequence: CTT
ctacctccaaaactctcctc

SEQ ID NO: 255738 - DNA, 20 bp, Artificial Sequence
  Description of Artificial Sequence: Synthetic oligonucleotide
  Target: ATXN1; (+) strand; PAM type: YTN; PAM sequence: TTC
tacctccaaaactctcctca

SEQ ID NO: 255739 - DNA, 20 bp, Artificial Sequence
  Description of Artificial Sequence: Synthetic oligonucleotide
  Target: ATXN1; (+) strand; PAM type: YTN; PAM sequence: CTA
cctccaaaactctcctcatc

SEQ ID NO: 255740 - DNA, 20 bp, Artificial Sequence
  Description of Artificial Sequence: Synthetic oligonucleotide
  Target: ATXN1; (+) strand; PAM type: YTN; PAM sequence: CTC
caaaactctcctcatcctga

SEQ ID NO: 255741 - DNA, 20 bp, Artificial Sequence
  Description of Artificial Sequence: Synthetic oligonucleotide
  Target: ATXN1; (+) strand; PAM type: YTN; PAM sequence: CTC
tcctcatcctgaaaaaaagc

SEQ ID NO: 255742 - DNA, 20 bp, Artificial Sequence
  Description of Artificial Sequence: Synthetic oligonucleotide
  Target: ATXN1; (+) strand; PAM type: YTN; PAM sequence: CTC
ctcatcctgaaaaaaagcac

SEQ ID NO: 255743 - DNA, 20 bp, Artificial Sequence
  Description of Artificial Sequence: Synthetic oligonucleotide
  Target: ATXN1; (+) strand; PAM type: YTN; PAM sequence: CTC
atcctgaaaaaaagcacaga

SEQ ID NO: 255744 - DNA, 20 bp, Artificial Sequence
  Description of Artificial Sequence: Synthetic oligonucleotide
  Target: ATXN1; (+) strand; PAM type: YTN; PAM sequence: CTG
aaaaaaagcacagacagcag

SEQ ID NO: 255745 - DNA, 20 bp, Artificial Sequence
  Description of Artificial Sequence: Synthetic oligonucleotide
  Target: ATXN1; (+) strand; PAM type: YTN; PAM sequence: CTA
taggttgtggggctgcatgt

SEQ ID NO: 255746 - DNA, 20 bp, Artificial Sequence
  Description of Artificial Sequence: Synthetic oligonucleotide
  Target: ATXN1; (+) strand; PAM type: YTN; PAM sequence: TTG
tggggctgcatgtgatattt

SEQ ID NO: 255747 - DNA, 20 bp, Artificial Sequence
  Description of Artificial Sequence: Synthetic oligonucleotide
  Target: ATXN1; (+) strand; PAM type: YTN; PAM sequence: CTG
catgtgatatttctggcttt

SEQ ID NO: 255748 - DNA, 20 bp, Artificial Sequence
  Description of Artificial Sequence: Synthetic oligonucleotide
  Target: ATXN1; (+) strand; PAM type: YTN; PAM sequence: TTT
ctggctttcacgttctgttc

SEQ ID NO: 255749 - DNA, 20 bp, Artificial Sequence
  Description of Artificial Sequence: Synthetic oligonucleotide
  Target: ATXN1; (+) strand; PAM type: YTN; PAM sequence: TTC
tggctttcacgttctgttct

SEQ ID NO: 255750 - DNA, 20 bp, Artificial Sequence
  Description of Artificial Sequence: Synthetic oligonucleotide
  Target: ATXN1; (+) strand; PAM type: YTN; PAM sequence: CTG
gctttcacgttctgttcttg

SEQ ID NO: 255751 - DNA, 20 bp, Artificial Sequence
  Description of Artificial Sequence: Synthetic oligonucleotide
  Target: ATXN1; (+) strand; PAM type: YTN; PAM sequence: CTT
tcacgttctgttcttgaagt

SEQ ID NO: 255752 - DNA, 20 bp, Artificial Sequence
  Description of Artificial Sequence: Synthetic oligonucleotide
  Target: ATXN1; (+) strand; PAM type: YTN; PAM sequence: TTT
cacgttctgttcttgaagta

SEQ ID NO: 255753 - DNA, 20 bp, Artificial Sequence
  Description of Artificial Sequence: Synthetic oligonucleotide
  Target: ATXN1; (+) strand; PAM type: YTN; PAM sequence: TTC
acgttctgttcttgaagtaa

SEQ ID NO: 255754 - DNA, 20 bp, Artificial Sequence
  Description of Artificial Sequence: Synthetic oligonucleotide
  Target: ATXN1; (+) strand; PAM type: YTN; PAM sequence: TTC
tgttcttgaagtaagcttaa

SEQ ID NO: 255755 - DNA, 20 bp, Artificial Sequence
  Description of Artificial Sequence: Synthetic oligonucleotide
  Target: ATXN1; (+) strand; PAM type: YTN; PAM sequence: CTG
ttcttgaagtaagcttaaag

SEQ ID NO: 255756 - DNA, 20 bp, Artificial Sequence
  Description of Artificial Sequence: Synthetic oligonucleotide
  Target: ATXN1; (+) strand; PAM type: YTN; PAM sequence: TTC
ttgaagtaagcttaaagaca

SEQ ID NO: 255757 - DNA, 20 bp, Artificial Sequence
  Description of Artificial Sequence: Synthetic oligonucleotide
  Target: ATXN1; (+) strand; PAM type: YTN; PAM sequence: CTT
gaagtaagcttaaagacaat

SEQ ID NO: 255758 - DNA, 20 bp, Artificial Sequence
  Description of Artificial Sequence: Synthetic oligonucleotide
  Target: ATXN1; (+) strand; PAM type: YTN; PAM sequence: TTG
aagtaagcttaaagacaata

SEQ ID NO: 255759 - DNA, 20 bp, Artificial Sequence
  Description of Artificial Sequence: Synthetic oligonucleotide
  Target: ATXN1; (+) strand; PAM type: YTN; PAM sequence: CTT
aaagacaataacatactctc

SEQ ID NO: 255760 - DNA, 20 bp, Artificial Sequence
  Description of Artificial Sequence: Synthetic oligonucleotide
  Target: ATXN1; (+) strand; PAM type: YTN; PAM sequence: TTA
aagacaataacatactctcc

SEQ ID NO: 255761 - DNA, 20 bp, Artificial Sequence
  Description of Artificial Sequence: Synthetic oligonucleotide
  Target: ATXN1; (+) strand; PAM type: YTN; PAM sequence: CTC
tccctgctatggttaaaaga

SEQ ID NO: 255762 - DNA, 20 bp, Artificial Sequence
  Description of Artificial Sequence: Synthetic oligonucleotide
  Target: ATXN1; (+) strand; PAM type: YTN; PAM sequence: CTC
cctgctatggttaaaagaat

SEQ ID NO: 255763 - DNA, 20 bp, Artificial Sequence
  Description of Artificial Sequence: Synthetic oligonucleotide
  Target: ATXN1; (+) strand; PAM type: YTN; PAM sequence: CTG
ctatggttaaaagaattctt

SEQ ID NO: 255764 - DNA, 20 bp, Artificial Sequence
  Description of Artificial Sequence: Synthetic oligonucleotide
  Target: ATXN1; (+) strand; PAM type: YTN; PAM sequence: CTA
tggttaaaagaattcttagg

SEQ ID NO: 255765 - DNA, 20 bp, Artificial Sequence
  Description of Artificial Sequence: Synthetic oligonucleotide
  Target: ATXN1; (+) strand; PAM type: YTN; PAM sequence: TTA
aaagaattcttaggatcttt

SEQ ID NO: 255766 - DNA, 20 bp, Artificial Sequence
  Description of Artificial Sequence: Synthetic oligonucleotide
  Target: ATXN1; (+) strand; PAM type: YTN; PAM sequence: TTC
ttaggatctttgggaaaaaa

SEQ ID NO: 255767 - DNA, 20 bp, Artificial Sequence
  Description of Artificial Sequence: Synthetic oligonucleotide
  Target: ATXN1; (+) strand; PAM type: YTN; PAM sequence: CTT
aggatctttgggaaaaaaaa

SEQ ID NO: 255768 - DNA, 20 bp, Artificial Sequence
  Description of Artificial Sequence: Synthetic oligonucleotide
  Target: ATXN1; (+) strand; PAM type: YTN; PAM sequence: TTA
ggatctttgggaaaaaaaaa

SEQ ID NO: 255769 - DNA, 20 bp, Artificial Sequence
  Description of Artificial Sequence: Synthetic oligonucleotide
  Target: ATXN1; (+) strand; PAM type: YTN; PAM sequence: CTT
tgggaaaaaaaaaaatctca

SEQ ID NO: 255770 - DNA, 20 bp, Artificial Sequence
  Description of Artificial Sequence: Synthetic oligonucleotide
  Target: ATXN1; (+) strand; PAM type: YTN; PAM sequence: TTT
gggaaaaaaaaaaatctcaa

SEQ ID NO: 255771 - DNA, 20 bp, Artificial Sequence
  Description of Artificial Sequence: Synthetic oligonucleotide
  Target: ATXN1; (+) strand; PAM type: YTN; PAM sequence: TTG
ggaaaaaaaaaaatctcaaa

SEQ ID NO: 255772 - DNA, 20 bp, Artificial Sequence
  Description of Artificial Sequence: Synthetic oligonucleotide
  Target: ATXN1; (+) strand; PAM type: YTN; PAM sequence: CTC
aaagtaaatatgacaatata

SEQ ID NO: 255773 - DNA, 20 bp, Artificial Sequence
  Description of Artificial Sequence: Synthetic oligonucleotide
  Target: ATXN1; (+) strand; PAM type: YTN; PAM sequence: CTG
gagggagctctaaacatcta

SEQ ID NO: 255774 - DNA, 20 bp, Artificial Sequence
  Description of Artificial Sequence: Synthetic oligonucleotide
  Target: ATXN1; (+) strand; PAM type: YTN; PAM sequence: CTC
taaacatctagtgataggaa

SEQ ID NO: 255775 - DNA, 20 bp, Artificial Sequence
  Description of Artificial Sequence: Synthetic oligonucleotide
  Target: ATXN1; (+) strand; PAM type: YTN; PAM sequence: CTA
aacatctagtgataggaaaa

SEQ ID NO: 255776 - DNA, 20 bp, Artificial Sequence
  Description of Artificial Sequence: Synthetic oligonucleotide
  Target: ATXN1; (+) strand; PAM type: YTN; PAM sequence: CTA
gtgataggaaaaatgctgaa

SEQ ID NO: 255777 - DNA, 20 bp, Artificial Sequence
  Description of Artificial Sequence: Synthetic oligonucleotide
  Target: ATXN1; (+) strand; PAM type: YTN; PAM sequence: CTG
aaattatgtatcctaaaatt

SEQ ID NO: 255778 - DNA, 20 bp, Artificial Sequence
  Description of Artificial Sequence: Synthetic oligonucleotide
  Target: ATXN1; (+) strand; PAM type: YTN; PAM sequence: TTA
tgtatcctaaaattgaaaag

SEQ ID NO: 255779 - DNA, 20 bp, Artificial Sequence
  Description of Artificial Sequence: Synthetic oligonucleotide
  Target: ATXN1; (+) strand; PAM type: YTN; PAM sequence: CTA
aaattgaaaagttactgctt

SEQ ID NO: 255780 - DNA, 20 bp, Artificial Sequence
  Description of Artificial Sequence: Synthetic oligonucleotide
  Target: ATXN1; (+) strand; PAM type: YTN; PAM sequence: TTG
aaaagttactgctttgtggg

SEQ ID NO: 255781 - DNA, 20 bp, Artificial Sequence
  Description of Artificial Sequence: Synthetic oligonucleotide
  Target: ATXN1; (+) strand; PAM type: YTN; PAM sequence: TTA
ctgctttgtgggataatatg

SEQ ID NO: 255782 - DNA, 20 bp, Artificial Sequence
  Description of Artificial Sequence: Synthetic oligonucleotide
  Target: ATXN1; (+) strand; PAM type: YTN; PAM sequence: CTG
ctttgtgggataatatggta

SEQ ID NO: 255783 - DNA, 20 bp, Artificial Sequence
  Description of Artificial Sequence: Synthetic oligonucleotide
  Target: ATXN1; (+) strand; PAM type: YTN; PAM sequence: CTT
tgtgggataatatggtaaat

SEQ ID NO: 255784 - DNA, 20 bp, Artificial Sequence
  Description of Artificial Sequence: Synthetic oligonucleotide
  Target: ATXN1; (+) strand; PAM type: YTN; PAM sequence: TTT
gtgggataatatggtaaatt

SEQ ID NO: 255785 - DNA, 20 bp, Artificial Sequence
  Description of Artificial Sequence: Synthetic oligonucleotide
  Target: ATXN1; (+) strand; PAM type: YTN; PAM sequence: TTG
tgggataatatggtaaattc

SEQ ID NO: 255786 - DNA, 20 bp, Artificial Sequence
  Description of Artificial Sequence: Synthetic oligonucleotide
  Target: ATXN1; (+) strand; PAM type: YTN; PAM sequence: TTC
tggcttttagtcatctctgt

SEQ ID NO: 255787 - DNA, 20 bp, Artificial Sequence
  Description of Artificial Sequence: Synthetic oligonucleotide
  Target: ATXN1; (+) strand; PAM type: YTN; PAM sequence: CTG
gcttttagtcatctctgtgc

SEQ ID NO: 255788 - DNA, 20 bp, Artificial Sequence
  Description of Artificial Sequence: Synthetic oligonucleotide
  Target: ATXN1; (+) strand; PAM type: YTN; PAM sequence: CTT
ttagtcatctctgtgcccat

SEQ ID NO: 255789 - DNA, 20 bp, Artificial Sequence
  Description of Artificial Sequence: Synthetic oligonucleotide
  Target: ATXN1; (+) strand; PAM type: YTN; PAM sequence: TTT
tagtcatctctgtgcccatt

SEQ ID NO: 255790 - DNA, 20 bp, Artificial Sequence
  Description of Artificial Sequence: Synthetic oligonucleotide
  Target: ATXN1; (+) strand; PAM type: YTN; PAM sequence: TTT
agtcatctctgtgcccattc

SEQ ID NO: 255791 - DNA, 20 bp, Artificial Sequence
  Description of Artificial Sequence: Synthetic oligonucleotide
  Target: ATXN1; (+) strand; PAM type: YTN; PAM sequence: TTA
gtcatctctgtgcccattct

SEQ ID NO: 255792 - DNA, 20 bp, Artificial Sequence
  Description of Artificial Sequence: Synthetic oligonucleotide
  Target: ATXN1; (+) strand; PAM type: YTN; PAM sequence: CTC
tgtgcccattcttaatactg

SEQ ID NO: 255793 - DNA, 20 bp, Artificial Sequence
  Description of Artificial Sequence: Synthetic oligonucleotide
  Target: ATXN1; (+) strand; PAM type: YTN; PAM sequence: CTG
tgcccattcttaatactgat

SEQ ID NO: 255794 - DNA, 20 bp, Artificial Sequence
  Description of Artificial Sequence: Synthetic oligonucleotide
  Target: ATXN1; (+) strand; PAM type: YTN; PAM sequence: TTC
ttaatactgattcagagcag

SEQ ID NO: 255795 - DNA, 20 bp, Artificial Sequence
  Description of Artificial Sequence: Synthetic oligonucleotide
  Target: ATXN1; (+) strand; PAM type: YTN; PAM sequence: CTT
aatactgattcagagcagaa

SEQ ID NO: 255796 - DNA, 20 bp, Artificial Sequence
  Description of Artificial Sequence: Synthetic oligonucleotide
  Target: ATXN1; (+) strand; PAM type: YTN; PAM sequence: TTA
atactgattcagagcagaag

SEQ ID NO: 255797 - DNA, 20 bp, Artificial Sequence
  Description of Artificial Sequence: Synthetic oligonucleotide
  Target: ATXN1; (+) strand; PAM type: YTN; PAM sequence: CTG
attcagagcagaagatagtt

SEQ ID NO: 255798 - DNA, 20 bp, Artificial Sequence
  Description of Artificial Sequence: Synthetic oligonucleotide
  Target: ATXN1; (+) strand; PAM type: YTN; PAM sequence: TTC
agagcagaagatagttaacc

SEQ ID NO: 255799 - DNA, 20 bp, Artificial Sequence
  Description of Artificial Sequence: Synthetic oligonucleotide
  Target: ATXN1; (+) strand; PAM type: YTN; PAM sequence: TTA
accatatcaacgtgtgtgca

SEQ ID NO: 255800 - DNA, 20 bp, Artificial Sequence
  Description of Artificial Sequence: Synthetic oligonucleotide
  Target: ATXN1; (+) strand; PAM type: YTN; PAM sequence: CTA
tcttaaacatatgactcttt

SEQ ID NO: 255801 - DNA, 20 bp, Artificial Sequence
  Description of Artificial Sequence: Synthetic oligonucleotide
  Target: ATXN1; (+) strand; PAM type: YTN; PAM sequence: CTT
aaacatatgactctttaccc

SEQ ID NO: 255802 - DNA, 20 bp, Artificial Sequence
  Description of Artificial Sequence: Synthetic oligonucleotide
  Target: ATXN1; (+) strand; PAM type: YTN; PAM sequence: TTA
aacatatgactctttaccca

SEQ ID NO: 255803 - DNA, 20 bp, Artificial Sequence
  Description of Artificial Sequence: Synthetic oligonucleotide
  Target: ATXN1; (+) strand; PAM type: YTN; PAM sequence: CTC
tttacccaaaaaaggaggcc

SEQ ID NO: 255804 - DNA, 20 bp, Artificial Sequence
  Description of Artificial Sequence: Synthetic oligonucleotide
  Target: ATXN1; (+) strand; PAM type: YTN; PAM sequence: CTT
tacccaaaaaaggaggccat

SEQ ID NO: 255805 - DNA, 20 bp, Artificial Sequence
  Description of Artificial Sequence: Synthetic oligonucleotide
  Target: ATXN1; (+) strand; PAM type: YTN; PAM sequence: TTT
acccaaaaaaggaggccatt

SEQ ID NO: 255806 - DNA, 20 bp, Artificial Sequence
  Description of Artificial Sequence: Synthetic oligonucleotide
  Target: ATXN1; (+) strand; PAM type: YTN; PAM sequence: TTA
cccaaaaaaggaggccattt

SEQ ID NO: 255807 - DNA, 20 bp, Artificial Sequence
  Description of Artificial Sequence: Synthetic oligonucleotide
  Target: ATXN1; (+) strand; PAM type: YTN; PAM sequence: TTT
attcttggcttccacagggc

SEQ ID NO: 255808 - DNA, 20 bp, Artificial Sequence
  Description of Artificial Sequence: Synthetic oligonucleotide
  Target: ATXN1; (+) strand; PAM type: YTN; PAM sequence: TTA
ttcttggcttccacagggcc

SEQ ID NO: 255809 - DNA, 20 bp, Artificial Sequence
  Description of Artificial Sequence: Synthetic oligonucleotide
  Target: ATXN1; (+) strand; PAM type: YTN; PAM sequence: TTC
ttggcttccacagggcctct

SEQ ID NO: 255810 - DNA, 20 bp, Artificial Sequence
  Description of Artificial Sequence: Synthetic oligonucleotide
  Target: ATXN1; (+) strand; PAM type: YTN; PAM sequence: CTT
ggcttccacagggcctctga

SEQ ID NO: 255811 - DNA, 20 bp, Artificial Sequence
  Description of Artificial Sequence: Synthetic oligonucleotide
  Target: ATXN1; (+) strand; PAM type: YTN; PAM sequence: TTG
gcttccacagggcctctgaa

SEQ ID NO: 255812 - DNA, 20 bp, Artificial Sequence
  Description of Artificial Sequence: Synthetic oligonucleotide
  Target: ATXN1; (+) strand; PAM type: YTN; PAM sequence: CTT
ccacagggcctctgaaaagt

SEQ ID NO: 255813 - DNA, 20 bp, Artificial Sequence
  Description of Artificial Sequence: Synthetic oligonucleotide
  Target: ATXN1; (+) strand; PAM type: YTN; PAM sequence: TTC
cacagggcctctgaaaagta

SEQ ID NO: 255814 - DNA, 20 bp, Artificial Sequence
  Description of Artificial Sequence: Synthetic oligonucleotide
  Target: ATXN1; (+) strand; PAM type: YTN; PAM sequence: CTC
tgaaaagtatactctgaaaa

SEQ ID NO: 255815 - DNA, 20 bp, Artificial Sequence
  Description of Artificial Sequence: Synthetic oligonucleotide
  Target: ATXN1; (+) strand; PAM type: YTN; PAM sequence: CTG
aaaagtatactctgaaaata

SEQ ID NO: 255816 - DNA, 20 bp, Artificial Sequence
  Description of Artificial Sequence: Synthetic oligonucleotide
  Target: ATXN1; (+) strand; PAM type: YTN; PAM sequence: CTC
tgaaaatattttcttggaga

SEQ ID NO: 255817 - DNA, 20 bp, Artificial Sequence
  Description of Artificial Sequence: Synthetic oligonucleotide
  Target: ATXN1; (+) strand; PAM type: YTN; PAM sequence: CTG
aaaatattttcttggagagt

SEQ ID NO: 255818 - DNA, 20 bp, Artificial Sequence
  Description of Artificial Sequence: Synthetic oligonucleotide
  Target: ATXN1; (+) strand; PAM type: YTN; PAM sequence: TTT
tcttggagagttctttaaag

SEQ ID NO: 255819 - DNA, 20 bp, Artificial Sequence
  Description of Artificial Sequence: Synthetic oligonucleotide
  Target: ATXN1; (+) strand; PAM type: YTN; PAM sequence: TTT
cttggagagttctttaaagc

SEQ ID NO: 255820 - DNA, 20 bp, Artificial Sequence
  Description of Artificial Sequence: Synthetic oligonucleotide
  Target: ATXN1; (+) strand; PAM type: YTN; PAM sequence: TTC
ttggagagttctttaaagca

SEQ ID NO: 255821 - DNA, 20 bp, Artificial Sequence
  Description of Artificial Sequence: Synthetic oligonucleotide
  Target: ATXN1; (+) strand; PAM type: YTN; PAM sequence: CTT
ggagagttctttaaagcaga

SEQ ID NO: 255822 - DNA, 20 bp, Artificial Sequence
  Description of Artificial Sequence: Synthetic oligonucleotide
  Target: ATXN1; (+) strand; PAM type: YTN; PAM sequence: TTG
gagagttctttaaagcagaa

SEQ ID NO: 255823 - DNA, 20 bp, Artificial Sequence
  Description of Artificial Sequence: Synthetic oligonucleotide
  Target: ATXN1; (+) strand; PAM type: YTN; PAM sequence: TTC
tttaaagcagaaagatttaa

SEQ ID NO: 255824 - DNA, 20 bp, Artificial Sequence
  Description of Artificial Sequence: Synthetic oligonucleotide
  Target: ATXN1; (+) strand; PAM type: YTN; PAM sequence: CTT
taaagcagaaagatttaaga

SEQ ID NO: 255825 - DNA, 20 bp, Artificial Sequence
  Description of Artificial Sequence: Synthetic oligonucleotide
  Target: ATXN1; (+) strand; PAM type: YTN; PAM sequence: TTT
aaagcagaaagatttaagag

SEQ ID NO: 255826 - DNA, 20 bp, Artificial Sequence
  Description of Artificial Sequence: Synthetic oligonucleotide
  Target: ATXN1; (+) strand; PAM type: YTN; PAM sequence: TTA
aagcagaaagatttaagagg

SEQ ID NO: 255827 - DNA, 20 bp, Artificial Sequence
  Description of Artificial Sequence: Synthetic oligonucleotide
  Target: ATXN1; (+) strand; PAM type: YTN; PAM sequence: TTT
aagaggcaggaacataacaa

SEQ ID NO: 255828 - DNA, 20 bp, Artificial Sequence
  Description of Artificial Sequence: Synthetic oligonucleotide
  Target: ATXN1; (+) strand; PAM type: YTN; PAM sequence: TTA
agaggcaggaacataacaaa

SEQ ID NO: 255829 - DNA, 20 bp, Artificial Sequence
  Description of Artificial Sequence: Synthetic oligonucleotide
  Target: ATXN1; (+) strand; PAM type: YTN; PAM sequence: CTG
gaccaaagtgagccttgttt

SEQ ID NO: 255830 - DNA, 20 bp, Artificial Sequence
  Description of Artificial Sequence: Synthetic oligonucleotide
  Target: ATXN1; (+) strand; PAM type: YTN; PAM sequence: CTT
gtttgaactgagcatgtttt

SEQ ID NO: 255831 - DNA, 20 bp, Artificial Sequence
  Description of Artificial Sequence: Synthetic oligonucleotide
  Target: ATXN1; (+) strand; PAM type: YTN; PAM sequence: TTG
tttgaactgagcatgttttg

SEQ ID NO: 255832 - DNA, 20 bp, Artificial Sequence
  Description of Artificial Sequence: Synthetic oligonucleotide
  Target: ATXN1; (+) strand; PAM type: YTN; PAM sequence: TTT
gaactgagcatgttttgttt

SEQ ID NO: 255833 - DNA, 20 bp, Artificial Sequence
  Description of Artificial Sequence: Synthetic oligonucleotide
  Target: ATXN1; (+) strand; PAM type: YTN; PAM sequence: TTG
aactgagcatgttttgtttt

SEQ ID NO: 255834 - DNA, 20 bp, Artificial Sequence
  Description of Artificial Sequence: Synthetic oligonucleotide
  Target: ATXN1; (+) strand; PAM type: YTN; PAM sequence: CTG
agcatgttttgttttcacat

SEQ ID NO: 255835 - DNA, 20 bp, Artificial Sequence
  Description of Artificial Sequence: Synthetic oligonucleotide
  Target: ATXN1; (+) strand; PAM type: YTN; PAM sequence: TTT
tgttttcacattttccacta

SEQ ID NO: 255836 - DNA, 20 bp, Artificial Sequence
  Description of Artificial Sequence: Synthetic oligonucleotide
  Target: ATXN1; (+) strand; PAM type: YTN; PAM sequence: TTT
gttttcacattttccactaa

SEQ ID NO: 255837 - DNA, 20 bp, Artificial Sequence
  Description of Artificial Sequence: Synthetic oligonucleotide
  Target: ATXN1; (+) strand; PAM type: YTN; PAM sequence: TTG
ttttcacattttccactaaa

SEQ ID NO: 255838 - DNA, 20 bp, Artificial Sequence
  Description of Artificial Sequence: Synthetic oligonucleotide
  Target: ATXN1; (+) strand; PAM type: YTN; PAM sequence: TTT
tcacattttccactaaaagg

SEQ ID NO: 255839 - DNA, 20 bp, Artificial Sequence
  Description of Artificial Sequence: Synthetic oligonucleotide
  Target: ATXN1; (+) strand; PAM type: YTN; PAM sequence: TTT
cacattttccactaaaaggt

SEQ ID NO: 255840 - DNA, 20 bp, Artificial Sequence
  Description of Artificial Sequence: Synthetic oligonucleotide
  Target: ATXN1; (+) strand; PAM type: YTN; PAM sequence: TTC
acattttccactaaaaggtg

SEQ ID NO: 255841 - DNA, 20 bp, Artificial Sequence
  Description of Artificial Sequence: Synthetic oligonucleotide
  Target: ATXN1; (+) strand; PAM type: YTN; PAM sequence: TTT
tccactaaaaggtgctttgt

SEQ ID NO: 255842 - DNA, 20 bp, Artificial Sequence
  Description of Artificial Sequence: Synthetic oligonucleotide
  Target: ATXN1; (+) strand; PAM type: YTN; PAM sequence: TTT
ccactaaaaggtgctttgtc

SEQ ID NO: 255843 - DNA, 20 bp, Artificial Sequence
  Description of Artificial Sequence: Synthetic oligonucleotide
  Target: ATXN1; (+) strand; PAM type: YTN; PAM sequence: TTC
cactaaaaggtgctttgtcc

SEQ ID NO: 255844 - DNA, 20 bp, Artificial Sequence
  Description of Artificial Sequence: Synthetic oligonucleotide
  Target: ATXN1; (+) strand; PAM type: YTN; PAM sequence: CTA
aaaggtgctttgtcctttgg

SEQ ID NO: 255845 - DNA, 20 bp, Artificial Sequence
  Description of Artificial Sequence: Synthetic oligonucleotide
  Target: ATXN1; (+) strand; PAM type: YTN; PAM sequence: CTT
tgtcctttgggaggaatgtg

SEQ ID NO: 255846 - DNA, 20 bp, Artificial Sequence
  Description of Artificial Sequence: Synthetic oligonucleotide
  Target: ATXN1; (+) strand; PAM type: YTN; PAM sequence: TTT
gtcctttgggaggaatgtgc

SEQ ID NO: 255847 - DNA, 20 bp, Artificial Sequence
  Description of Artificial Sequence: Synthetic oligonucleotide
  Target: ATXN1; (+) strand; PAM type: YTN; PAM sequence: TTG
tcctttgggaggaatgtgcc

SEQ ID NO: 255848 - DNA, 20 bp, Artificial Sequence
  Description of Artificial Sequence: Synthetic oligonucleotide
  Target: ATXN1; (+) strand; PAM type: YTN; PAM sequence: CTT
tgggaggaatgtgccctctt

SEQ ID NO: 255849 - DNA, 20 bp, Artificial Sequence
  Description of Artificial Sequence: Synthetic oligonucleotide
  Target: ATXN1; (+) strand; PAM type: YTN; PAM sequence: TTT
gggaggaatgtgccctcttc

SEQ ID NO: 255850 - DNA, 20 bp, Artificial Sequence
  Description of Artificial Sequence: Synthetic oligonucleotide
  Target: ATXN1; (+) strand; PAM type: YTN; PAM sequence: TTG
ggaggaatgtgccctcttca

SEQ ID NO: 255851 - DNA, 20 bp, Artificial Sequence
  Description of Artificial Sequence: Synthetic oligonucleotide
  Target: ATXN1; (+) strand; PAM type: YTN; PAM sequence: CTC
ttcatcccacctttccctcc

SEQ ID NO: 255852 - DNA, 20 bp, Artificial Sequence
  Description of Artificial Sequence: Synthetic oligonucleotide
  Target: ATXN1; (+) strand; PAM type: YTN; PAM sequence: CTT
catcccacctttccctccca

SEQ ID NO: 255853 - DNA, 20 bp, Artificial Sequence
  Description of Artificial Sequence: Synthetic oligonucleotide
  Target: ATXN1; (+) strand; PAM type: YTN; PAM sequence: TTC
atcccacctttccctcccag

SEQ ID NO: 255854 - DNA, 20 bp, Artificial Sequence
  Description of Artificial Sequence: Synthetic oligonucleotide
  Target: ATXN1; (+) strand; PAM type: YTN; PAM sequence: CTT
tccctcccagagcccccagc

SEQ ID NO: 255855 - DNA, 20 bp, Artificial Sequence
  Description of Artificial Sequence: Synthetic oligonucleotide
  Target: ATXN1; (+) strand; PAM type: YTN; PAM sequence: TTT
ccctcccagagcccccagca

SEQ ID NO: 255856 - DNA, 20 bp, Artificial Sequence
  Description of Artificial Sequence: Synthetic oligonucleotide
  Target: ATXN1; (+) strand; PAM type: YTN; PAM sequence: TTC
cctcccagagcccccagcaa

SEQ ID NO: 255857 - DNA, 20 bp, Artificial Sequence
  Description of Artificial Sequence: Synthetic oligonucleotide
  Target: ATXN1; (+) strand; PAM type: YTN; PAM sequence: CTC
ccagagcccccagcaatgag

SEQ ID NO: 255858 - DNA, 20 bp, Artificial Sequence
  Description of Artificial Sequence: Synthetic oligonucleotide
  Target: ATXN1; (+) strand; PAM type: YTN; PAM sequence: CTG
gttcacatctgtcaggtcca

SEQ ID NO: 255859 - DNA, 20 bp, Artificial Sequence
  Description of Artificial Sequence: Synthetic oligonucleotide
  Target: ATXN1; (+) strand; PAM type: YTN; PAM sequence: TTC
acatctgtcaggtccagaac

SEQ ID NO: 255860 - DNA, 20 bp, Artificial Sequence
  Description of Artificial Sequence: Synthetic oligonucleotide
  Target: ATXN1; (+) strand; PAM type: YTN; PAM sequence: CTG
tcaggtccagaacctgacta

SEQ ID NO: 255861 - DNA, 20 bp, Artificial Sequence
  Description of Artificial Sequence: Synthetic oligonucleotide
  Target: ATXN1; (+) strand; PAM type: YTN; PAM sequence: CTG
actaagcacaagttctgtcc

SEQ ID NO: 255862 - DNA, 20 bp, Artificial Sequence
  Description of Artificial Sequence: Synthetic oligonucleotide
  Target: ATXN1; (+) strand; PAM type: YTN; PAM sequence: CTA
agcacaagttctgtcctgat

SEQ ID NO: 255863 - DNA, 20 bp, Artificial Sequence
  Description of Artificial Sequence: Synthetic oligonucleotide
  Target: ATXN1; (+) strand; PAM type: YTN; PAM sequence: TTC
tgtcctgatgggactcaaga

SEQ ID NO: 255864 - DNA, 20 bp, Artificial Sequence
  Description of Artificial Sequence: Synthetic oligonucleotide
  Target: ATXN1; (+) strand; PAM type: YTN; PAM sequence: CTG
tcctgatgggactcaagaga

SEQ ID NO: 255865 - DNA, 20 bp, Artificial Sequence
  Description of Artificial Sequence: Synthetic oligonucleotide
  Target: ATXN1; (+) strand; PAM type: YTN; PAM sequence: CTG
atgggactcaagagatgctg

SEQ ID NO: 255866 - DNA, 20 bp, Artificial Sequence
  Description of Artificial Sequence: Synthetic oligonucleotide
  Target: ATXN1; (+) strand; PAM type: YTN; PAM sequence: CTC
aagagatgctgagtgagggg

SEQ ID NO: 255867 - DNA, 20 bp, Artificial Sequence
  Description of Artificial Sequence: Synthetic oligonucleotide
  Target: ATXN1; (+) strand; PAM type: YTN; PAM sequence: CTG
agtgagggggcattttgaca

SEQ ID NO: 255868 - DNA, 20 bp, Artificial Sequence
  Description of Artificial Sequence: Synthetic oligonucleotide
  Target: ATXN1; (+) strand; PAM type: YTN; PAM sequence: TTT
tgacacccttggggttcctg

SEQ ID NO: 255869 - DNA, 20 bp, Artificial Sequence
  Description of Artificial Sequence: Synthetic oligonucleotide
  Target: ATXN1; (+) strand; PAM type: YTN; PAM sequence: TTT
gacacccttggggttcctgt

SEQ ID NO: 255870 - DNA, 20 bp, Artificial Sequence
  Description of Artificial Sequence: Synthetic oligonucleotide
  Target: ATXN1; (+) strand; PAM type: YTN; PAM sequence: TTG
acacccttggggttcctgtc

SEQ ID NO: 255871 - DNA, 20 bp, Artificial Sequence
  Description of Artificial Sequence: Synthetic oligonucleotide
  Target: ATXN1; (+) strand; PAM type: YTN; PAM sequence: CTT
ggggttcctgtcacgctcag

SEQ ID NO: 255872 - DNA, 20 bp, Artificial Sequence
  Description of Artificial Sequence: Synthetic oligonucleotide
  Target: ATXN1; (+) strand; PAM type: YTN; PAM sequence: TTG
gggttcctgtcacgctcagc

SEQ ID NO: 255873 - DNA, 20 bp, Artificial Sequence
  Description of Artificial Sequence: Synthetic oligonucleotide
  Target: ATXN1; (+) strand; PAM type: YTN; PAM sequence: TTC
ctgtcacgctcagcttcctg

SEQ ID NO: 255874 - DNA, 20 bp, Artificial Sequence
  Description of Artificial Sequence: Synthetic oligonucleotide
  Target: ATXN1; (+) strand; PAM type: YTN; PAM sequence: CTG
tcacgctcagcttcctgctc

SEQ ID NO: 255875 - DNA, 20 bp, Artificial Sequence
  Description of Artificial Sequence: Synthetic oligonucleotide
  Target: ATXN1; (+) strand; PAM type: YTN; PAM sequence: CTC
agcttcctgctcgactttta

SEQ ID NO: 255876 - DNA, 20 bp, Artificial Sequence
  Description of Artificial Sequence: Synthetic oligonucleotide
  Target: ATXN1; (+) strand; PAM type: YTN; PAM sequence: CTT
cctgctcgacttttaccaga

SEQ ID NO: 255877 - DNA, 20 bp, Artificial Sequence
  Description of Artificial Sequence: Synthetic oligonucleotide
  Target: ATXN1; (+) strand; PAM type: YTN; PAM sequence: TTC
ctgctcgacttttaccagag

SEQ ID NO: 255878 - DNA, 20 bp, Artificial Sequence
  Description of Artificial Sequence: Synthetic oligonucleotide
  Target: ATXN1; (+) strand; PAM type: YTN; PAM sequence: CTG
ctcgacttttaccagagtct

SEQ ID NO: 255879 - DNA, 20 bp, Artificial Sequence
  Description of Artificial Sequence: Synthetic oligonucleotide
  Target: ATXN1; (+) strand; PAM type: YTN; PAM sequence: CTC
gacttttaccagagtctgcc

SEQ ID NO: 255880 - DNA, 20 bp, Artificial Sequence
  Description of Artificial Sequence: Synthetic oligonucleotide
  Target: ATXN1; (+) strand; PAM type: YTN; PAM sequence: CTT
ttaccagagtctgcctggta

SEQ ID NO: 255881 - DNA, 20 bp, Artificial Sequence
  Description of Artificial Sequence: Synthetic oligonucleotide
  Target: ATXN1; (+) strand; PAM type: YTN; PAM sequence: TTT
taccagagtctgcctggtaa

SEQ ID NO: 255882 - DNA, 20 bp, Artificial Sequence
  Description of Artificial Sequence: Synthetic oligonucleotide
  Target: ATXN1; (+) strand; PAM type: YTN; PAM sequence: TTT
accagagtctgcctggtaaa

SEQ ID NO: 255883 - DNA, 20 bp, Artificial Sequence
  Description of Artificial Sequence: Synthetic oligonucleotide
  Target: ATXN1; (+) strand; PAM type: YTN; PAM sequence: TTA
ccagagtctgcctggtaaag

SEQ ID NO: 255884 - DNA, 20 bp, Artificial Sequence
  Description of Artificial Sequence: Synthetic oligonucleotide
  Target: ATXN1; (+) strand; PAM type: YTN; PAM sequence: CTG
cctggtaaagtctttcctcc

SEQ ID NO: 255885 - DNA, 20 bp, Artificial Sequence
  Description of Artificial Sequence: Synthetic oligonucleotide
  Target: ATXN1; (+) strand; PAM type: YTN; PAM sequence: CTG
gtaaagtctttcctccagtt

SEQ ID NO: 255886 - DNA, 20 bp, Artificial Sequence
  Description of Artificial Sequence: Synthetic oligonucleotide
  Target: ATXN1; (+) strand; PAM type: YTN; PAM sequence: CTT
tcctccagttaaggtccctg

SEQ ID NO: 255887 - DNA, 20 bp, Artificial Sequence
  Description of Artificial Sequence: Synthetic oligonucleotide
  Target: ATXN1; (+) strand; PAM type: YTN; PAM sequence: TTT
cctccagttaaggtccctgg

SEQ ID NO: 255888 - DNA, 20 bp, Artificial Sequence
  Description of Artificial Sequence: Synthetic oligonucleotide
  Target: ATXN1; (+) strand; PAM type: YTN; PAM sequence: TTC
ctccagttaaggtccctggg

SEQ ID NO: 255889 - DNA, 20 bp, Artificial Sequence
  Description of Artificial Sequence: Synthetic oligonucleotide
  Target: ATXN1; (+) strand; PAM type: YTN; PAM sequence: CTC
cagttaaggtccctgggttg

SEQ ID NO: 255890 - DNA, 20 bp, Artificial Sequence
  Description of Artificial Sequence: Synthetic oligonucleotide
  Target: ATXN1; (+) strand; PAM type: YTN; PAM sequence: TTA
aggtccctgggttgtattca

SEQ ID NO: 255891 - DNA, 20 bp, Artificial Sequence
  Description of Artificial Sequence: Synthetic oligonucleotide
  Target: ATXN1; (+) strand; PAM type: YTN; PAM sequence: CTG
ggttgtattcaagctgtccc

SEQ ID NO: 255892 - DNA, 20 bp, Artificial Sequence
  Description of Artificial Sequence: Synthetic oligonucleotide
  Target: ATXN1; (+) strand; PAM type: YTN; PAM sequence: TTG
tattcaagctgtccccagcc

SEQ ID NO: 255893 - DNA, 20 bp, Artificial Sequence
  Description of Artificial Sequence: Synthetic oligonucleotide
  Target: ATXN1; (+) strand; PAM type: YTN; PAM sequence: TTC
aagctgtccccagcccccac

SEQ ID NO: 255894 - DNA, 20 bp, Artificial Sequence
  Description of Artificial Sequence: Synthetic oligonucleotide
  Target: ATXN1; (+) strand; PAM type: YTN; PAM sequence: CTG
tccccagcccccaccacatg

SEQ ID NO: 255895 - DNA, 20 bp, Artificial Sequence
  Description of Artificial Sequence: Synthetic oligonucleotide
  Target: ATXN1; (+) strand; PAM type: YTN; PAM sequence: CTC
gcgcgcgcgcacacacgcac

SEQ ID NO: 255896 - DNA, 20 bp, Artificial Sequence
  Description of Artificial Sequence: Synthetic oligonucleotide
  Target: ATXN1; (+) strand; PAM type: YTN; PAM sequence: CTC
cacgttgttagttttctggg

SEQ ID NO: 255897 - DNA, 20 bp, Artificial Sequence
  Description of Artificial Sequence: Synthetic oligonucleotide
  Target: ATXN1; (+) strand; PAM type: YTN; PAM sequence: TTG
ttagttttctgggtcatttc

SEQ ID NO: 255898 - DNA, 20 bp, Artificial Sequence
  Description of Artificial Sequence: Synthetic oligonucleotide
  Target: ATXN1; (+) strand; PAM type: YTN; PAM sequence: TTA
gttttctgggtcatttcctg

SEQ ID NO: 255899 - DNA, 20 bp, Artificial Sequence
  Description of Artificial Sequence: Synthetic oligonucleotide
  Target: ATXN1; (+) strand; PAM type: YTN; PAM sequence: TTT
tctgggtcatttcctgtgaa

SEQ ID NO: 255900 - DNA, 20 bp, Artificial Sequence
  Description of Artificial Sequence: Synthetic oligonucleotide
  Target: ATXN1; (+) strand; PAM type: YTN; PAM sequence: TTT
ctgggtcatttcctgtgaaa

SEQ ID NO: 255901 - DNA, 20 bp, Artificial Sequence
  Description of Artificial Sequence: Synthetic oligonucleotide
  Target: ATXN1; (+) strand; PAM type: YTN; PAM sequence: TTC
tgggtcatttcctgtgaaat

SEQ ID NO: 255902 - DNA, 20 bp, Artificial Sequence
  Description of Artificial Sequence: Synthetic oligonucleotide
  Target: ATXN1; (+) strand; PAM type: YTN; PAM sequence: CTG
ggtcatttcctgtgaaatgt

SEQ ID NO: 255903 - DNA, 20 bp, Artificial Sequence
  Description of Artificial Sequence: Synthetic oligonucleotide
  Target: ATXN1; (+) strand; PAM type: YTN; PAM sequence: TTT
cctgtgaaatgtcactgttc

SEQ ID NO: 255904 - DNA, 20 bp, Artificial Sequence
  Description of Artificial Sequence: Synthetic oligonucleotide
  Target: ATXN1; (+) strand; PAM type: YTN; PAM sequence: TTC
ctgtgaaatgtcactgttcc

SEQ ID NO: 255905 - DNA, 20 bp, Artificial Sequence
  Description of Artificial Sequence: Synthetic oligonucleotide
  Target: ATXN1; (+) strand; PAM type: YTN; PAM sequence: CTG
tgaaatgtcactgttccctc

SEQ ID NO: 255906 - DNA, 20 bp, Artificial Sequence
  Description of Artificial Sequence: Synthetic oligonucleotide
  Target: ATXN1; (+) strand; PAM type: YTN; PAM sequence: CTG
ttccctctttagtggccgga

SEQ ID NO: 255907 - DNA, 20 bp, Artificial Sequence
  Description of Artificial Sequence: Synthetic oligonucleotide
  Target: ATXN1; (+) strand; PAM type: YTN; PAM sequence: TTC
cctctttagtggccggatct

SEQ ID NO: 255908 - DNA, 20 bp, Artificial Sequence
  Description of Artificial Sequence: Synthetic oligonucleotide
  Target: ATXN1; (+) strand; PAM type: YTN; PAM sequence: CTC
tttagtggccggatctcagc

SEQ ID NO: 255909 - DNA, 20 bp, Artificial Sequence
  Description of Artificial Sequence: Synthetic oligonucleotide
  Target: ATXN1; (+) strand; PAM type: YTN; PAM sequence: CTT
tagtggccggatctcagcct

SEQ ID NO: 255910 - DNA, 20 bp, Artificial Sequence
  Description of Artificial Sequence: Synthetic oligonucleotide
  Target: ATXN1; (+) strand; PAM type: YTN; PAM sequence: TTT
agtggccggatctcagcctg

SEQ ID NO: 255911 - DNA, 20 bp, Artificial Sequence
  Description of Artificial Sequence: Synthetic oligonucleotide
  Target: ATXN1; (+) strand; PAM type: YTN; PAM sequence: TTA
gtggccggatctcagcctgg

SEQ ID NO: 255912 - DNA, 20 bp, Artificial Sequence
  Description of Artificial Sequence: Synthetic oligonucleotide
  Target: ATXN1; (+) strand; PAM type: YTN; PAM sequence: CTC
agcctgggagtccgactgag

SEQ ID NO: 255913 - DNA, 20 bp, Artificial Sequence
  Description of Artificial Sequence: Synthetic oligonucleotide
  Target: ATXN1; (+) strand; PAM type: YTN; PAM sequence: CTG
ggagtccgactgagagcaag

SEQ ID NO: 255914 - DNA, 20 bp, Artificial Sequence
  Description of Artificial Sequence: Synthetic oligonucleotide
  Target: ATXN1; (+) strand; PAM type: YTN; PAM sequence: CTG
agagcaaggggctgtcggta

SEQ ID NO: 255915 - DNA, 20 bp, Artificial Sequence
  Description of Artificial Sequence: Synthetic oligonucleotide
  Target: ATXN1; (+) strand; PAM type: YTN; PAM sequence: CTG
tcggtacagcctggggagag

SEQ ID NO: 255916 - DNA, 20 bp, Artificial Sequence
  Description of Artificial Sequence: Synthetic oligonucleotide
  Target: ATXN1; (+) strand; PAM type: YTN; PAM sequence: CTG
gggagagggtcccaccccca

SEQ ID NO: 255917 - DNA, 20 bp, Artificial Sequence
  Description of Artificial Sequence: Synthetic oligonucleotide
  Target: ATXN1; (+) strand; PAM type: YTN; PAM sequence: CTC
acaccagattttgtattaat

SEQ ID NO: 255918 - DNA, 20 bp, Artificial Sequence
  Description of Artificial Sequence: Synthetic oligonucleotide
  Target: ATXN1; (+) strand; PAM type: YTN; PAM sequence: TTT
tgtattaataataatcacgt

SEQ ID NO: 255919 - DNA, 20 bp, Artificial Sequence
  Description of Artificial Sequence: Synthetic oligonucleotide
  Target: ATXN1; (+) strand; PAM type: YTN; PAM sequence: TTT
gtattaataataatcacgtc

SEQ ID NO: 255920 - DNA, 20 bp, Artificial Sequence
  Description of Artificial Sequence: Synthetic oligonucleotide
  Target: ATXN1; (+) strand; PAM type: YTN; PAM sequence: TTG
tattaataataatcacgtct

SEQ ID NO: 255921 - DNA, 20 bp, Artificial Sequence
  Description of Artificial Sequence: Synthetic oligonucleotide
  Target: ATXN1; (+) strand; PAM type: YTN; PAM sequence: TTA
ataataatcacgtctccact

SEQ ID NO: 255922 - DNA, 20 bp, Artificial Sequence
  Description of Artificial Sequence: Synthetic oligonucleotide
  Target: ATXN1; (+) strand; PAM type: YTN; PAM sequence: CTC
cactcacctgtttctagcct

SEQ ID NO: 255923 - DNA, 20 bp, Artificial Sequence
  Description of Artificial Sequence: Synthetic oligonucleotide
  Target: ATXN1; (+) strand; PAM type: YTN; PAM sequence: CTC
acctgtttctagcctgggaa

SEQ ID NO: 255924 - DNA, 20 bp, Artificial Sequence
  Description of Artificial Sequence: Synthetic oligonucleotide
  Target: ATXN1; (+) strand; PAM type: YTN; PAM sequence: CTG
tttctagcctgggaaacttt

SEQ ID NO: 255925 - DNA, 20 bp, Artificial Sequence
  Description of Artificial Sequence: Synthetic oligonucleotide
  Target: ATXN1; (+) strand; PAM type: YTN; PAM sequence: TTT
ctagcctgggaaactttctt

SEQ ID NO: 255926 - DNA, 20 bp, Artificial Sequence
  Description of Artificial Sequence: Synthetic oligonucleotide
  Target: ATXN1; (+) strand; PAM type: YTN; PAM sequence: TTC
tagcctgggaaactttcttc

SEQ ID NO: 255927 - DNA, 20 bp, Artificial Sequence
  Description of Artificial Sequence: Synthetic oligonucleotide
  Target: ATXN1; (+) strand; PAM type: YTN; PAM sequence: CTA
gcctgggaaactttcttcct

SEQ ID NO: 255928 - DNA, 20 bp, Artificial Sequence
  Description of Artificial Sequence: Synthetic oligonucleotide
  Target: ATXN1; (+) strand; PAM type: YTN; PAM sequence: CTG
ggaaactttcttccttcatt

SEQ ID NO: 255929 - DNA, 20 bp, Artificial Sequence
  Description of Artificial Sequence: Synthetic oligonucleotide
  Target: ATXN1; (+) strand; PAM type: YTN; PAM sequence: CTT
tcttccttcattcagcacta

SEQ ID NO: 255930 - DNA, 20 bp, Artificial Sequence
  Description of Artificial Sequence: Synthetic oligonucleotide
  Target: ATXN1; (+) strand; PAM type: YTN; PAM sequence: TTT
cttccttcattcagcactat

SEQ ID NO: 255931 - DNA, 20 bp, Artificial Sequence
  Description of Artificial Sequence: Synthetic oligonucleotide
  Target: ATXN1; (+) strand; PAM type: YTN; PAM sequence: TTC
ttccttcattcagcactatt

SEQ ID NO: 255932 - DNA, 20 bp, Artificial Sequence
  Description of Artificial Sequence: Synthetic oligonucleotide
  Target: ATXN1; (+) strand; PAM type: YTN; PAM sequence: CTT
ccttcattcagcactattta

SEQ ID NO: 255933 - DNA, 20 bp, Artificial Sequence
  Description of Artificial Sequence: Synthetic oligonucleotide
  Target: ATXN1; (+) strand; PAM type: YTN; PAM sequence: TTC
cttcattcagcactatttat

SEQ ID NO: 255934 - DNA, 20 bp, Artificial Sequence
  Description of Artificial Sequence: Synthetic oligonucleotide
  Target: ATXN1; (+) strand; PAM type: YTN; PAM sequence: CTT
cattcagcactatttattgc

SEQ ID NO: 255935 - DNA, 20 bp, Artificial Sequence
  Description of Artificial Sequence: Synthetic oligonucleotide
  Target: ATXN1; (+) strand; PAM type: YTN; PAM sequence: TTC
attcagcactatttattgca

SEQ ID NO: 255936 - DNA, 20 bp, Artificial Sequence
  Description of Artificial Sequence: Synthetic oligonucleotide
  Target: ATXN1; (+) strand; PAM type: YTN; PAM sequence: TTC
agcactatttattgcacacc

SEQ ID NO: 255937 - DNA, 20 bp, Artificial Sequence
  Description of Artificial Sequence: Synthetic oligonucleotide
  Target: ATXN1; (+) strand; PAM type: YTN; PAM sequence: CTA
tttattgcacacctaaaaca

SEQ ID NO: 255938 - DNA, 20 bp, Artificial Sequence
  Description of Artificial Sequence: Synthetic oligonucleotide
  Target: ATXN1; (+) strand; PAM type: YTN; PAM sequence: TTT
attgcacacctaaaacatta

SEQ ID NO: 255939 - DNA, 20 bp, Artificial Sequence
  Description of Artificial Sequence: Synthetic oligonucleotide
  Target: ATXN1; (+) strand; PAM type: YTN; PAM sequence: TTA
ttgcacacctaaaacattaa

SEQ ID NO: 255940 - DNA, 20 bp, Artificial Sequence
  Description of Artificial Sequence: Synthetic oligonucleotide
  Target: ATXN1; (+) strand; PAM type: YTN; PAM sequence: TTG
cacacctaaaacattaatgc

SEQ ID NO: 255941 - DNA, 20 bp, Artificial Sequence
  Description of Artificial Sequence: Synthetic oligonucleotide
  Target: ATXN1; (+) strand; PAM type: YTN; PAM sequence: CTA
aaacattaatgctactgtgt

SEQ ID NO: 255942 - DNA, 20 bp, Artificial Sequence
  Description of Artificial Sequence: Synthetic oligonucleotide
  Target: ATXN1; (+) strand; PAM type: YTN; PAM sequence: TTA
atgctactgtgtggggcttg

SEQ ID NO: 255943 - DNA, 20 bp, Artificial Sequence
  Description of Artificial Sequence: Synthetic oligonucleotide
  Target: ATXN1; (+) strand; PAM type: YTN; PAM sequence: CTA
ctgtgtggggcttggaagat

SEQ ID NO: 255944 - DNA, 20 bp, Artificial Sequence
  Description of Artificial Sequence: Synthetic oligonucleotide
  Target: ATXN1; (+) strand; PAM type: YTN; PAM sequence: CTG
tgtggggcttggaagatgtc

SEQ ID NO: 255945 - DNA, 20 bp, Artificial Sequence
  Description of Artificial Sequence: Synthetic oligonucleotide
  Target: ATXN1; (+) strand; PAM type: YTN; PAM sequence: CTT
ggaagatgtcctggtgtttg

SEQ ID NO: 255946 - DNA, 20 bp, Artificial Sequence
  Description of Artificial Sequence: Synthetic oligonucleotide
  Target: ATXN1; (+) strand; PAM type: YTN; PAM sequence: TTG
gaagatgtcctggtgtttgg

SEQ ID NO: 255947 - DNA, 20 bp, Artificial Sequence
  Description of Artificial Sequence: Synthetic oligonucleotide
  Target: ATXN1; (+) strand; PAM type: YTN; PAM sequence: CTG
gtgtttgggtactttctcag

SEQ ID NO: 255948 - DNA, 20 bp, Artificial Sequence
  Description of Artificial Sequence: Synthetic oligonucleotide
  Target: ATXN1; (+) strand; PAM type: YTN; PAM sequence: TTT
gggtactttctcagaagcaa

SEQ ID NO: 255949 - DNA, 20 bp, Artificial Sequence
  Description of Artificial Sequence: Synthetic oligonucleotide
  Target: ATXN1; (+) strand; PAM type: YTN; PAM sequence: TTG
ggtactttctcagaagcaag

SEQ ID NO: 255950 - DNA, 20 bp, Artificial Sequence
  Description of Artificial Sequence: Synthetic oligonucleotide
  Target: ATXN1; (+) strand; PAM type: YTN; PAM sequence: CTT
tctcagaagcaagactttct

SEQ ID NO: 255951 - DNA, 20 bp, Artificial Sequence
  Description of Artificial Sequence: Synthetic oligonucleotide
  Target: ATXN1; (+) strand; PAM type: YTN; PAM sequence: TTT
ctcagaagcaagactttctc

SEQ ID NO: 255952 - DNA, 20 bp, Artificial Sequence
  Description of Artificial Sequence: Synthetic oligonucleotide
  Target: ATXN1; (+) strand; PAM type: YTN; PAM sequence: TTC
tcagaagcaagactttctca

SEQ ID NO: 255953 - DNA, 20 bp, Artificial Sequence
  Description of Artificial Sequence: Synthetic oligonucleotide
  Target: ATXN1; (+) strand; PAM type: YTN; PAM sequence: CTC
agaagcaagactttctcatt

SEQ ID NO: 255954 - DNA, 20 bp, Artificial Sequence
  Description of Artificial Sequence: Synthetic oligonucleotide
  Target: ATXN1; (+) strand; PAM type: YTN; PAM sequence: CTT
tctcatttgggtctctgaat

SEQ ID NO: 255955 - DNA, 20 bp, Artificial Sequence
  Description of Artificial Sequence: Synthetic oligonucleotide
  Target: ATXN1; (+) strand; PAM type: YTN; PAM sequence: TTT
ctcatttgggtctctgaata

SEQ ID NO: 255956 - DNA, 20 bp, Artificial Sequence
  Description of Artificial Sequence: Synthetic oligonucleotide
  Target: ATXN1; (+) strand; PAM type: YTN; PAM sequence: TTC
tcatttgggtctctgaatat

SEQ ID NO: 255957 - DNA, 20 bp, Artificial Sequence
  Description of Artificial Sequence: Synthetic oligonucleotide
  Target: ATXN1; (+) strand; PAM type: YTN; PAM sequence: CTC
atttgggtctctgaatatca

SEQ ID NO: 255958 - DNA, 20 bp, Artificial Sequence
  Description of Artificial Sequence: Synthetic oligonucleotide
  Target: ATXN1; (+) strand; PAM type: YTN; PAM sequence: TTT
gggtctctgaatatcaaatg

SEQ ID NO: 255959 - DNA, 20 bp, Artificial Sequence
  Description of Artificial Sequence: Synthetic oligonucleotide
  Target: ATXN1; (+) strand; PAM type: YTN; PAM sequence: TTG
ggtctctgaatatcaaatgt

SEQ ID NO: 255960 - DNA, 20 bp, Artificial Sequence
  Description of Artificial Sequence: Synthetic oligonucleotide
  Target: ATXN1; (+) strand; PAM type: YTN; PAM sequence: CTC
tgaatatcaaatgtgaccag

SEQ ID NO: 255961 - DNA, 20 bp, Artificial Sequence
  Description of Artificial Sequence: Synthetic oligonucleotide
  Target: ATXN1; (+) strand; PAM type: YTN; PAM sequence: CTG
aatatcaaatgtgaccagcc

SEQ ID NO: 255962 - DNA, 20 bp, Artificial Sequence
  Description of Artificial Sequence: Synthetic oligonucleotide
  Target: ATXN1; (+) strand; PAM type: YTN; PAM sequence: TTT
cagtccctcaccttttcctg

SEQ ID NO: 255963 - DNA, 20 bp, Artificial Sequence
  Description of Artificial Sequence: Synthetic oligonucleotide
  Target: ATXN1; (+) strand; PAM type: YTN; PAM sequence: TTC
agtccctcaccttttcctgg

SEQ ID NO: 255964 - DNA, 20 bp, Artificial Sequence
  Description of Artificial Sequence: Synthetic oligonucleotide
  Target: ATXN1; (+) strand; PAM type: YTN; PAM sequence: CTC
accttttcctggagaataga

SEQ ID NO: 255965 - DNA, 20 bp, Artificial Sequence
  Description of Artificial Sequence: Synthetic oligonucleotide
  Target: ATXN1; (+) strand; PAM type: YTN; PAM sequence: CTT
ttcctggagaatagagtttg

SEQ ID NO: 255966 - DNA, 20 bp, Artificial Sequence
  Description of Artificial Sequence: Synthetic oligonucleotide
  Target: ATXN1; (+) strand; PAM type: YTN; PAM sequence: TTT
tcctggagaatagagtttga

SEQ ID NO: 255967 - DNA, 20 bp, Artificial Sequence
  Description of Artificial Sequence: Synthetic oligonucleotide
  Target: ATXN1; (+) strand; PAM type: YTN; PAM sequence: TTT
cctggagaatagagtttgat

SEQ ID NO: 255968 - DNA, 20 bp, Artificial Sequence
  Description of Artificial Sequence: Synthetic oligonucleotide
  Target: ATXN1; (+) strand; PAM type: YTN; PAM sequence: TTC
ctggagaatagagtttgata

SEQ ID NO: 255969 - DNA, 20 bp, Artificial Sequence
  Description of Artificial Sequence: Synthetic oligonucleotide
  Target: ATXN1; (+) strand; PAM type: YTN; PAM sequence: CTG
gagaatagagtttgatatga

SEQ ID NO: 255970 - DNA, 20 bp, Artificial Sequence
  Description of Artificial Sequence: Synthetic oligonucleotide
  Target: ATXN1; (+) strand; PAM type: YTN; PAM sequence: TTT
gatatgaacattaagtggat

SEQ ID NO: 255971 - DNA, 20 bp, Artificial Sequence
  Description of Artificial Sequence: Synthetic oligonucleotide
  Target: ATXN1; (+) strand; PAM type: YTN; PAM sequence: TTG
atatgaacattaagtggatt

SEQ ID NO: 255972 - DNA, 20 bp, Artificial Sequence
  Description of Artificial Sequence: Synthetic oligonucleotide
  Target: ATXN1; (+) strand; PAM type: YTN; PAM sequence: TTA
agtggatttacatcagtgct

SEQ ID NO: 255973 - DNA, 20 bp, Artificial Sequence
  Description of Artificial Sequence: Synthetic oligonucleotide
  Target: ATXN1; (+) strand; PAM type: YTN; PAM sequence: TTT
acatcagtgctcctcagcac

SEQ ID NO: 255974 - DNA, 20 bp, Artificial Sequence
  Description of Artificial Sequence: Synthetic oligonucleotide
  Target: ATXN1; (+) strand; PAM type: YTN; PAM sequence: TTA
catcagtgctcctcagcaca

SEQ ID NO: 255975 - DNA, 20 bp, Artificial Sequence
  Description of Artificial Sequence: Synthetic oligonucleotide
  Target: ATXN1; (+) strand; PAM type: YTN; PAM sequence: CTC
ctcagcacacacgacagaaa

SEQ ID NO: 255976 - DNA, 20 bp, Artificial Sequence
  Description of Artificial Sequence: Synthetic oligonucleotide
  Target: ATXN1; (+) strand; PAM type: YTN; PAM sequence: CTC
agcacacacgacagaaaata

SEQ ID NO: 255977 - DNA, 20 bp, Artificial Sequence
  Description of Artificial Sequence: Synthetic oligonucleotide
  Target: ATXN1; (+) strand; PAM type: YTN; PAM sequence: CTG
ctctggactaataagtatat

SEQ ID NO: 255978 - DNA, 20 bp, Artificial Sequence
  Description of Artificial Sequence: Synthetic oligonucleotide
  Target: ATXN1; (+) strand; PAM type: YTN; PAM sequence: CTC
tggactaataagtatatcac

SEQ ID NO: 255979 - DNA, 20 bp, Artificial Sequence
  Description of Artificial Sequence: Synthetic oligonucleotide
  Target: ATXN1; (+) strand; PAM type: YTN; PAM sequence: CTG
gactaataagtatatcacag

SEQ ID NO: 255980 - DNA, 20 bp, Artificial Sequence
  Description of Artificial Sequence: Synthetic oligonucleotide
  Target: ATXN1; (+) strand; PAM type: YTN; PAM sequence: CTA
ataagtatatcacaggcaca

SEQ ID NO: 255981 - DNA, 20 bp, Artificial Sequence
  Description of Artificial Sequence: Synthetic oligonucleotide
  Target: ATXN1; (+) strand; PAM type: YTN; PAM sequence: CTC
tgtagccaacttttgattaa

SEQ ID NO: 255982 - DNA, 20 bp, Artificial Sequence
  Description of Artificial Sequence: Synthetic oligonucleotide
  Target: ATXN1; (+) strand; PAM type: YTN; PAM sequence: CTG
tagccaacttttgattaaag

SEQ ID NO: 255983 - DNA, 20 bp, Artificial Sequence
  Description of Artificial Sequence: Synthetic oligonucleotide
  Target: ATXN1; (+) strand; PAM type: YTN; PAM sequence: CTT
ttgattaaagacacagtctc

SEQ ID NO: 255984 - DNA, 20 bp, Artificial Sequence
  Description of Artificial Sequence: Synthetic oligonucleotide
  Target: ATXN1; (+) strand; PAM type: YTN; PAM sequence: TTT
tgattaaagacacagtctct

SEQ ID NO: 255985 - DNA, 20 bp, Artificial Sequence
  Description of Artificial Sequence: Synthetic oligonucleotide
  Target: ATXN1; (+) strand; PAM type: YTN; PAM sequence: TTT
gattaaagacacagtctcta

SEQ ID NO: 255986 - DNA, 20 bp, Artificial Sequence
  Description of Artificial Sequence: Synthetic oligonucleotide
  Target: ATXN1; (+) strand; PAM type: YTN; PAM sequence: TTG
attaaagacacagtctctac

SEQ ID NO: 255987 - DNA, 20 bp, Artificial Sequence
  Description of Artificial Sequence: Synthetic oligonucleotide
  Target: ATXN1; (+) strand; PAM type: YTN; PAM sequence: TTA
aagacacagtctctaccatt

SEQ ID NO: 255988 - DNA, 20 bp, Artificial Sequence
  Description of Artificial Sequence: Synthetic oligonucleotide
  Target: ATXN1; (+) strand; PAM type: YTN; PAM sequence: CTC
taccattaaggagcagcgca

SEQ ID NO: 255989 - DNA, 20 bp, Artificial Sequence
  Description of Artificial Sequence: Synthetic oligonucleotide
  Target: ATXN1; (+) strand; PAM type: YTN; PAM sequence: CTA
ccattaaggagcagcgcatc

SEQ ID NO: 255990 - DNA, 20 bp, Artificial Sequence
  Description of Artificial Sequence: Synthetic oligonucleotide
  Target: ATXN1; (+) strand; PAM type: YTN; PAM sequence: TTA
aggagcagcgcatctatatc

SEQ ID NO: 255991 - DNA, 20 bp, Artificial Sequence
  Description of Artificial Sequence: Synthetic oligonucleotide
  Target: ATXN1; (+) strand; PAM type: YTN; PAM sequence: CTA
tatcacaccaataaaagcca

SEQ ID NO: 255992 - DNA, 20 bp, Artificial Sequence
  Description of Artificial Sequence: Synthetic oligonucleotide
  Target: ATXN1; (+) strand; PAM type: YTN; PAM sequence: CTA
gcagtttgctacaaacgact

SEQ ID NO: 255993 - DNA, 20 bp, Artificial Sequence
  Description of Artificial Sequence: Synthetic oligonucleotide
  Target: ATXN1; (+) strand; PAM type: YTN; PAM sequence: TTT
gctacaaacgactacgtagt

SEQ ID NO: 255994 - DNA, 20 bp, Artificial Sequence
  Description of Artificial Sequence: Synthetic oligonucleotide
  Target: ATXN1; (+) strand; PAM type: YTN; PAM sequence: TTG
ctacaaacgactacgtagtg

SEQ ID NO: 255995 - DNA, 20 bp, Artificial Sequence
  Description of Artificial Sequence: Synthetic oligonucleotide
  Target: ATXN1; (+) strand; PAM type: YTN; PAM sequence: CTA
caaacgactacgtagtgaga

SEQ ID NO: 255996 - DNA, 20 bp, Artificial Sequence
  Description of Artificial Sequence: Synthetic oligonucleotide
  Target: ATXN1; (+) strand; PAM type: YTN; PAM sequence: CTA
cgtagtgagagttaggaact

SEQ ID NO: 255997 - DNA, 20 bp, Artificial Sequence
  Description of Artificial Sequence: Synthetic oligonucleotide
  Target: ATXN1; (+) strand; PAM type: YTN; PAM sequence: TTA
ggaactattctggattctgt

SEQ ID NO: 255998 - DNA, 20 bp, Artificial Sequence
  Description of Artificial Sequence: Synthetic oligonucleotide
  Target: ATXN1; (+) strand; PAM type: YTN; PAM sequence: CTA
ttctggattctgtattttat

SEQ ID NO: 255999 - DNA, 20 bp, Artificial Sequence
  Description of Artificial Sequence: Synthetic oligonucleotide
  Target: ATXN1; (+) strand; PAM type: YTN; PAM sequence: TTC
tggattctgtattttatcct

SEQ ID NO: 256000 - DNA, 20 bp, Artificial Sequence
  Description of Artificial Sequence: Synthetic oligonucleotide
  Target: ATXN1; (+) strand; PAM type: YTN; PAM sequence: CTG
gattctgtattttatcctaa

SEQ ID NO: 256001 - DNA, 20 bp, Artificial Sequence
  Description of Artificial Sequence: Synthetic oligonucleotide
  Target: ATXN1; (+) strand; PAM type: YTN; PAM sequence: TTC
tgtattttatcctaaagacc

SEQ ID NO: 256002 - DNA, 20 bp, Artificial Sequence
  Description of Artificial Sequence: Synthetic oligonucleotide
  Target: ATXN1; (+) strand; PAM type: YTN; PAM sequence: CTG
tattttatcctaaagacctt

SEQ ID NO: 256003 - DNA, 20 bp, Artificial Sequence
  Description of Artificial Sequence: Synthetic oligonucleotide
  Target: ATXN1; (+) strand; PAM type: YTN; PAM sequence: TTT
tatcctaaagacctttattt

SEQ ID NO: 256004 - DNA, 20 bp, Artificial Sequence
  Description of Artificial Sequence: Synthetic oligonucleotide
  Target: ATXN1; (+) strand; PAM type: YTN; PAM sequence: TTT
atcctaaagacctttattta

SEQ ID NO: 256005 - DNA, 20 bp, Artificial Sequence
  Description of Artificial Sequence: Synthetic oligonucleotide
  Target: ATXN1; (+) strand; PAM type: YTN; PAM sequence: TTA
tcctaaagacctttatttaa

SEQ ID NO: 256006 - DNA, 20 bp, Artificial Sequence
  Description of Artificial Sequence: Synthetic oligonucleotide
  Target: ATXN1; (+) strand; PAM type: YTN; PAM sequence: CTA
aagacctttatttaaatttt

SEQ ID NO: 256007 - DNA, 20 bp, Artificial Sequence
  Description of Artificial Sequence: Synthetic oligonucleotide
  Target: ATXN1; (+) strand; PAM type: YTN; PAM sequence: CTT
tatttaaattttccagccta

SEQ ID NO: 256008 - DNA, 20 bp, Artificial Sequence
  Description of Artificial Sequence: Synthetic oligonucleotide
  Target: ATXN1; (+) strand; PAM type: YTN; PAM sequence: TTT
atttaaattttccagcctat

SEQ ID NO: 256009 - DNA, 20 bp, Artificial Sequence
  Description of Artificial Sequence: Synthetic oligonucleotide
  Target: ATXN1; (+) strand; PAM type: YTN; PAM sequence: TTA
tttaaattttccagcctatc

SEQ ID NO: 256010 - DNA, 20 bp, Artificial Sequence
  Description of Artificial Sequence: Synthetic oligonucleotide
  Target: ATXN1; (+) strand; PAM type: YTN; PAM sequence: TTT
aaattttccagcctatctcc

SEQ ID NO: 256011 - DNA, 20 bp, Artificial Sequence
  Description of Artificial Sequence: Synthetic oligonucleotide
  Target: ATXN1; (+) strand; PAM type: YTN; PAM sequence: TTA
aattttccagcctatctcct

SEQ ID NO: 256012 - DNA, 20 bp, Artificial Sequence
  Description of Artificial Sequence: Synthetic oligonucleotide
  Target: ATXN1; (+) strand; PAM type: YTN; PAM sequence: TTT
tccagcctatctccttccca

SEQ ID NO: 256013 - DNA, 20 bp, Artificial Sequence
  Description of Artificial Sequence: Synthetic oligonucleotide
  Target: ATXN1; (+) strand; PAM type: YTN; PAM sequence: TTT
ccagcctatctccttcccat

SEQ ID NO: 256014 - DNA, 20 bp, Artificial Sequence
  Description of Artificial Sequence: Synthetic oligonucleotide
  Target: ATXN1; (+) strand; PAM type: YTN; PAM sequence: TTC
cagcctatctccttcccatt

SEQ ID NO: 256015 - DNA, 20 bp, Artificial Sequence
  Description of Artificial Sequence: Synthetic oligonucleotide
  Target: ATXN1; (+) strand; PAM type: YTN; PAM sequence: CTA
tctccttcccattccactca

SEQ ID NO: 256016 - DNA, 20 bp, Artificial Sequence
  Description of Artificial Sequence: Synthetic oligonucleotide
  Target: ATXN1; (+) strand; PAM type: YTN; PAM sequence: CTC
cttcccattccactcagtct

SEQ ID NO: 256017 - DNA, 20 bp, Artificial Sequence
  Description of Artificial Sequence: Synthetic oligonucleotide
  Target: ATXN1; (+) strand; PAM type: YTN; PAM sequence: CTT
cccattccactcagtctcat

SEQ ID NO: 256018 - DNA, 20 bp, Artificial Sequence
  Description of Artificial Sequence: Synthetic oligonucleotide
  Target: ATXN1; (+) strand; PAM type: YTN; PAM sequence: TTC
ccattccactcagtctcatt

SEQ ID NO: 256019 - DNA, 20 bp, Artificial Sequence
  Description of Artificial Sequence: Synthetic oligonucleotide
  Target: ATXN1; (+) strand; PAM type: YTN; PAM sequence: TTC
cactcagtctcatttgacat

SEQ ID NO: 256020 - DNA, 20 bp, Artificial Sequence
  Description of Artificial Sequence: Synthetic oligonucleotide
  Target: ATXN1; (+) strand; PAM type: YTN; PAM sequence: CTC
agtctcatttgacattgctt

SEQ ID NO: 256021 - DNA, 20 bp, Artificial Sequence
  Description of Artificial Sequence: Synthetic oligonucleotide
  Target: ATXN1; (+) strand; PAM type: YTN; PAM sequence: CTC
atttgacattgcttccccca

SEQ ID NO: 256022 - DNA, 20 bp, Artificial Sequence
  Description of Artificial Sequence: Synthetic oligonucleotide
  Target: ATXN1; (+) strand; PAM type: YTN; PAM sequence: TTT
gacattgcttcccccaagtc

SEQ ID NO: 256023 - DNA, 20 bp, Artificial Sequence
  Description of Artificial Sequence: Synthetic oligonucleotide
  Target: ATXN1; (+) strand; PAM type: YTN; PAM sequence: TTG
acattgcttcccccaagtcc

SEQ ID NO: 256024 - DNA, 20 bp, Artificial Sequence
  Description of Artificial Sequence: Synthetic oligonucleotide
  Target: ATXN1; (+) strand; PAM type: YTN; PAM sequence: TTG
cttcccccaagtccactgtg

SEQ ID NO: 256025 - DNA, 20 bp, Artificial Sequence
  Description of Artificial Sequence: Synthetic oligonucleotide
  Target: ATXN1; (+) strand; PAM type: YTN; PAM sequence: CTT
cccccaagtccactgtgatg

SEQ ID NO: 256026 - DNA, 20 bp, Artificial Sequence
  Description of Artificial Sequence: Synthetic oligonucleotide
  Target: ATXN1; (+) strand; PAM type: YTN; PAM sequence: TTC
ccccaagtccactgtgatgt

SEQ ID NO: 256027 - DNA, 20 bp, Artificial Sequence
  Description of Artificial Sequence: Synthetic oligonucleotide
  Target: ATXN1; (+) strand; PAM type: YTN; PAM sequence: CTG
tgatgtcatgcaccttgtgg

SEQ ID NO: 256028 - DNA, 20 bp, Artificial Sequence
  Description of Artificial Sequence: Synthetic oligonucleotide
  Target: ATXN1; (+) strand; PAM type: YTN; PAM sequence: CTT
gtggatggcaatgatctgtg

SEQ ID NO: 256029 - DNA, 20 bp, Artificial Sequence
  Description of Artificial Sequence: Synthetic oligonucleotide
  Target: ATXN1; (+) strand; PAM type: YTN; PAM sequence: TTG
tggatggcaatgatctgtgc

SEQ ID NO: 256030 - DNA, 20 bp, Artificial Sequence
  Description of Artificial Sequence: Synthetic oligonucleotide
  Target: ATXN1; (+) strand; PAM type: YTN; PAM sequence: CTG
tgctataattcaaaatgctc

SEQ ID NO: 256031 - DNA, 20 bp, Artificial Sequence
  Description of Artificial Sequence: Synthetic oligonucleotide
  Target: ATXN1; (+) strand; PAM type: YTN; PAM sequence: CTA
taattcaaaatgctctcagg

SEQ ID NO: 256032 - DNA, 20 bp, Artificial Sequence
  Description of Artificial Sequence: Synthetic oligonucleotide
  Target: ATXN1; (+) strand; PAM type: YTN; PAM sequence: TTC
aaaatgctctcagggagctg

SEQ ID NO: 256033 - DNA, 20 bp, Artificial Sequence
  Description of Artificial Sequence: Synthetic oligonucleotide
  Target: ATXN1; (+) strand; PAM type: YTN; PAM sequence: CTC
tcagggagctgggagcaaag

SEQ ID NO: 256034 - DNA, 20 bp, Artificial Sequence
  Description of Artificial Sequence: Synthetic oligonucleotide
  Target: ATXN1; (+) strand; PAM type: YTN; PAM sequence: CTC
agggagctgggagcaaagag

SEQ ID NO: 256035 - DNA, 20 bp, Artificial Sequence
  Description of Artificial Sequence: Synthetic oligonucleotide
  Target: ATXN1; (+) strand; PAM type: YTN; PAM sequence: CTG
ggagcaaagagaaaacacat

SEQ ID NO: 256036 - DNA, 20 bp, Artificial Sequence
  Description of Artificial Sequence: Synthetic oligonucleotide
  Target: ATXN1; (+) strand; PAM type: YTN; PAM sequence: TTG
gtgatgcaggaagcaataaa

SEQ ID NO: 256037 - DNA, 20 bp, Artificial Sequence
  Description of Artificial Sequence: Synthetic oligonucleotide
  Target: ATXN1; (+) strand; PAM type: YTN; PAM sequence: CTG
tttgaaaagcacaggtttca

SEQ ID NO: 256038 - DNA, 20 bp, Artificial Sequence
  Description of Artificial Sequence: Synthetic oligonucleotide
  Target: ATXN1; (+) strand; PAM type: YTN; PAM sequence: TTT
gaaaagcacaggtttcataa

SEQ ID NO: 256039 - DNA, 20 bp, Artificial Sequence
  Description of Artificial Sequence: Synthetic oligonucleotide
  Target: ATXN1; (+) strand; PAM type: YTN; PAM sequence: TTG
aaaagcacaggtttcataaa

SEQ ID NO: 256040 - DNA, 20 bp, Artificial Sequence
  Description of Artificial Sequence: Synthetic oligonucleotide
  Target: ATXN1; (+) strand; PAM type: YTN; PAM sequence: TTT
cataaaatgttagcgctgga

SEQ ID NO: 256041 - DNA, 20 bp, Artificial Sequence
  Description of Artificial Sequence: Synthetic oligonucleotide
  Target: ATXN1; (+) strand; PAM type: YTN; PAM sequence: TTC
ataaaatgttagcgctggaa

SEQ ID NO: 256042 - DNA, 20 bp, Artificial Sequence
  Description of Artificial Sequence: Synthetic oligonucleotide
  Target: ATXN1; (+) strand; PAM type: YTN; PAM sequence: TTA
gcgctggaatggaagcgatt

SEQ ID NO: 256043 - DNA, 20 bp, Artificial Sequence
  Description of Artificial Sequence: Synthetic oligonucleotide
  Target: ATXN1; (+) strand; PAM type: YTN; PAM sequence: CTG
gaatggaagcgatttcagag

SEQ ID NO: 256044 - DNA, 20 bp, Artificial Sequence
  Description of Artificial Sequence: Synthetic oligonucleotide
  Target: ATXN1; (+) strand; PAM type: YTN; PAM sequence: TTT
cagagatgaactcttgcaag

SEQ ID NO: 256045 - DNA, 20 bp, Artificial Sequence
  Description of Artificial Sequence: Synthetic oligonucleotide
  Target: ATXN1; (+) strand; PAM type: YTN; PAM sequence: TTC
agagatgaactcttgcaagc

SEQ ID NO: 256046 - DNA, 20 bp, Artificial Sequence
  Description of Artificial Sequence: Synthetic oligonucleotide
  Target: ATXN1; (+) strand; PAM type: YTN; PAM sequence: CTC
ttgcaagcactctggcggcc

SEQ ID NO: 256047 - DNA, 20 bp, Artificial Sequence
  Description of Artificial Sequence: Synthetic oligonucleotide
  Target: ATXN1; (+) strand; PAM type: YTN; PAM sequence: CTT
gcaagcactctggcggccga

SEQ ID NO: 256048 - DNA, 20 bp, Artificial Sequence
  Description of Artificial Sequence: Synthetic oligonucleotide
  Target: ATXN1; (+) strand; PAM type: YTN; PAM sequence: TTG
caagcactctggcggccgaa

SEQ ID NO: 256049 - DNA, 20 bp, Artificial Sequence
  Description of Artificial Sequence: Synthetic oligonucleotide
  Target: ATXN1; (+) strand; PAM type: YTN; PAM sequence: CTC
tggcggccgaagcatccaaa

SEQ ID NO: 256050 - DNA, 20 bp, Artificial Sequence
  Description of Artificial Sequence: Synthetic oligonucleotide
  Target: ATXN1; (+) strand; PAM type: YTN; PAM sequence: CTG
gcggccgaagcatccaaatt

SEQ ID NO: 256051 - DNA, 20 bp, Artificial Sequence
  Description of Artificial Sequence: Synthetic oligonucleotide
  Target: ATXN1; (+) strand; PAM type: YTN; PAM sequence: TTC
ctggttgctgtggttggctg

SEQ ID NO: 256052 - DNA, 20 bp, Artificial Sequence
  Description of Artificial Sequence: Synthetic oligonucleotide
  Target: ATXN1; (+) strand; PAM type: YTN; PAM sequence: CTG
gttgctgtggttggctggag

SEQ ID NO: 256053 - DNA, 20 bp, Artificial Sequence
  Description of Artificial Sequence: Synthetic oligonucleotide
  Target: ATXN1; (+) strand; PAM type: YTN; PAM sequence: TTG
ctgtggttggctggaggagt

SEQ ID NO: 256054 - DNA, 20 bp, Artificial Sequence
  Description of Artificial Sequence: Synthetic oligonucleotide
  Target: ATXN1; (+) strand; PAM type: YTN; PAM sequence: CTG
tggttggctggaggagtcta

SEQ ID NO: 256055 - DNA, 20 bp, Artificial Sequence
  Description of Artificial Sequence: Synthetic oligonucleotide
  Target: ATXN1; (+) strand; PAM type: YTN; PAM sequence: TTG
gctggaggagtctacaaccc

SEQ ID NO: 256056 - DNA, 20 bp, Artificial Sequence
  Description of Artificial Sequence: Synthetic oligonucleotide
  Target: ATXN1; (+) strand; PAM type: YTN; PAM sequence: CTG
gaggagtctacaaccccaac

SEQ ID NO: 256057 - DNA, 20 bp, Artificial Sequence
  Description of Artificial Sequence: Synthetic oligonucleotide
  Target: ATXN1; (+) strand; PAM type: YTN; PAM sequence: CTA
caaccccaactcctgccttt

SEQ ID NO: 256058 - DNA, 20 bp, Artificial Sequence
  Description of Artificial Sequence: Synthetic oligonucleotide
  Target: ATXN1; (+) strand; PAM type: YTN; PAM sequence: CTC
ctgcctttgactcttatcat

SEQ ID NO: 256059 - DNA, 20 bp, Artificial Sequence
  Description of Artificial Sequence: Synthetic oligonucleotide
  Target: ATXN1; (+) strand; PAM type: YTN; PAM sequence: CTG
cctttgactcttatcataga

SEQ ID NO: 256060 - DNA, 20 bp, Artificial Sequence
  Description of Artificial Sequence: Synthetic oligonucleotide
  Target: ATXN1; (+) strand; PAM type: YTN; PAM sequence: CTT
tgactcttatcatagactgc

SEQ ID NO: 256061 - DNA, 20 bp, Artificial Sequence
  Description of Artificial Sequence: Synthetic oligonucleotide
  Target: ATXN1; (+) strand; PAM type: YTN; PAM sequence: TTT
gactcttatcatagactgct

SEQ ID NO: 256062 - DNA, 20 bp, Artificial Sequence
  Description of Artificial Sequence: Synthetic oligonucleotide
  Target: ATXN1; (+) strand; PAM type: YTN; PAM sequence: TTG
actcttatcatagactgctt

SEQ ID NO: 256063 - DNA, 20 bp, Artificial Sequence
  Description of Artificial Sequence: Synthetic oligonucleotide
  Target: ATXN1; (+) strand; PAM type: YTN; PAM sequence: CTC
ttatcatagactgcttgcag

SEQ ID NO: 256064 - DNA, 20 bp, Artificial Sequence
  Description of Artificial Sequence: Synthetic oligonucleotide
  Target: ATXN1; (+) strand; PAM type: YTN; PAM sequence: CTT
atcatagactgcttgcagct

SEQ ID NO: 256065 - DNA, 20 bp, Artificial Sequence
  Description of Artificial Sequence: Synthetic oligonucleotide
  Target: ATXN1; (+) strand; PAM type: YTN; PAM sequence: TTA
tcatagactgcttgcagctc

SEQ ID NO: 256066 - DNA, 20 bp, Artificial Sequence
  Description of Artificial Sequence: Synthetic oligonucleotide
  Target: ATXN1; (+) strand; PAM type: YTN; PAM sequence: CTG
cttgcagctcatcctgtcct

SEQ ID NO: 256067 - DNA, 20 bp, Artificial Sequence
  Description of Artificial Sequence: Synthetic oligonucleotide
  Target: ATXN1; (+) strand; PAM type: YTN; PAM sequence: CTT
gcagctcatcctgtccttgg

SEQ ID NO: 256068 - DNA, 20 bp, Artificial Sequence
  Description of Artificial Sequence: Synthetic oligonucleotide
  Target: ATXN1; (+) strand; PAM type: YTN; PAM sequence: TTG
cagctcatcctgtccttgga

SEQ ID NO: 256069 - DNA, 20 bp, Artificial Sequence
  Description of Artificial Sequence: Synthetic oligonucleotide
  Target: ATXN1; (+) strand; PAM type: YTN; PAM sequence: CTC
atcctgtccttggacttgcc

SEQ ID NO: 256070 - DNA, 20 bp, Artificial Sequence
  Description of Artificial Sequence: Synthetic oligonucleotide
  Target: ATXN1; (+) strand; PAM type: YTN; PAM sequence: CTG
tccttggacttgcctaatat

SEQ ID NO: 256071 - DNA, 20 bp, Artificial Sequence
  Description of Artificial Sequence: Synthetic oligonucleotide
  Target: ATXN1; (+) strand; PAM type: YTN; PAM sequence: CTT
ggacttgcctaatatttgtg

SEQ ID NO: 256072 - DNA, 20 bp, Artificial Sequence
  Description of Artificial Sequence: Synthetic oligonucleotide
  Target: ATXN1; (+) strand; PAM type: YTN; PAM sequence: TTG
gacttgcctaatatttgtgc

SEQ ID NO: 256073 - DNA, 20 bp, Artificial Sequence
  Description of Artificial Sequence: Synthetic oligonucleotide
  Target: ATXN1; (+) strand; PAM type: YTN; PAM sequence: CTT
gcctaatatttgtgcatacc

SEQ ID NO: 256074 - DNA, 20 bp, Artificial Sequence
  Description of Artificial Sequence: Synthetic oligonucleotide
  Target: ATXN1; (+) strand; PAM type: YTN; PAM sequence: TTG
cctaatatttgtgcatacca

SEQ ID NO: 256075 - DNA, 20 bp, Artificial Sequence
  Description of Artificial Sequence: Synthetic oligonucleotide
  Target: ATXN1; (+) strand; PAM type: YTN; PAM sequence: CTA
atatttgtgcataccatgtg

SEQ ID NO: 256076 - DNA, 20 bp, Artificial Sequence
  Description of Artificial Sequence: Synthetic oligonucleotide
  Target: ATXN1; (+) strand; PAM type: YTN; PAM sequence: TTT
gtgcataccatgtgcgaagt

SEQ ID NO: 256077 - DNA, 20 bp, Artificial Sequence
  Description of Artificial Sequence: Synthetic oligonucleotide
  Target: ATXN1; (+) strand; PAM type: YTN; PAM sequence: TTG
tgcataccatgtgcgaagta

SEQ ID NO: 256078 - DNA, 20 bp, Artificial Sequence
  Description of Artificial Sequence: Synthetic oligonucleotide
  Target: ATXN1; (+) strand; PAM type: YTN; PAM sequence: CTG
ctaatgtcctttacgctcat

SEQ ID NO: 256079 - DNA, 20 bp, Artificial Sequence
  Description of Artificial Sequence: Synthetic oligonucleotide
  Target: ATXN1; (+) strand; PAM type: YTN; PAM sequence: CTA
atgtcctttacgctcatgaa

SEQ ID NO: 256080 - DNA, 20 bp, Artificial Sequence
  Description of Artificial Sequence: Synthetic oligonucleotide
  Target: ATXN1; (+) strand; PAM type: YTN; PAM sequence: CTT
tacgctcatgaaatcagtgc

SEQ ID NO: 256081 - DNA, 20 bp, Artificial Sequence
  Description of Artificial Sequence: Synthetic oligonucleotide
  Target: ATXN1; (+) strand; PAM type: YTN; PAM sequence: TTT
acgctcatgaaatcagtgct

SEQ ID NO: 256082 - DNA, 20 bp, Artificial Sequence
  Description of Artificial Sequence: Synthetic oligonucleotide
  Target: ATXN1; (+) strand; PAM type: YTN; PAM sequence: TTA
cgctcatgaaatcagtgctc

SEQ ID NO: 256083 - DNA, 20 bp, Artificial Sequence
  Description of Artificial Sequence: Synthetic oligonucleotide
  Target: ATXN1; (+) strand; PAM type: YTN; PAM sequence: CTC
atgaaatcagtgctcagctg

SEQ ID NO: 256084 - DNA, 20 bp, Artificial Sequence
  Description of Artificial Sequence: Synthetic oligonucleotide
  Target: ATXN1; (+) strand; PAM type: YTN; PAM sequence: CTC
agctgaagacattaaattta

SEQ ID NO: 256085 - DNA, 20 bp, Artificial Sequence
  Description of Artificial Sequence: Synthetic oligonucleotide
  Target: ATXN1; (+) strand; PAM type: YTN; PAM sequence: CTG
aagacattaaatttactggc

SEQ ID NO: 256086 - DNA, 20 bp, Artificial Sequence
  Description of Artificial Sequence: Synthetic oligonucleotide
  Target: ATXN1; (+) strand; PAM type: YTN; PAM sequence: TTA
aatttactggcggtgaaaga

SEQ ID NO: 256087 - DNA, 20 bp, Artificial Sequence
  Description of Artificial Sequence: Synthetic oligonucleotide
  Target: ATXN1; (+) strand; PAM type: YTN; PAM sequence: TTT
actggcggtgaaagaaaagt

SEQ ID NO: 256088 - DNA, 20 bp, Artificial Sequence
  Description of Artificial Sequence: Synthetic oligonucleotide
  Target: ATXN1; (+) strand; PAM type: YTN; PAM sequence: TTA
ctggcggtgaaagaaaagtc

SEQ ID NO: 256089 - DNA, 20 bp, Artificial Sequence
  Description of Artificial Sequence: Synthetic oligonucleotide
  Target: ATXN1; (+) strand; PAM type: YTN; PAM sequence: CTG
gcggtgaaagaaaagtcggg

SEQ ID NO: 256090 - DNA, 20 bp, Artificial Sequence
  Description of Artificial Sequence: Synthetic oligonucleotide
  Target: ATXN1; (+) strand; PAM type: YTN; PAM sequence: CTG
gaacgggggctgggaaggaa

SEQ ID NO: 256091 - DNA, 20 bp, Artificial Sequence
  Description of Artificial Sequence: Synthetic oligonucleotide
  Target: ATXN1; (+) strand; PAM type: YTN; PAM sequence: CTG
ggaaggaaggccgcactgca

SEQ ID NO: 256092 - DNA, 20 bp, Artificial Sequence
  Description of Artificial Sequence: Synthetic oligonucleotide
  Target: ATXN1; (+) strand; PAM type: YTN; PAM sequence: CTG
cagtgctcttggtggggtta

SEQ ID NO: 256093 - DNA, 20 bp, Artificial Sequence
  Description of Artificial Sequence: Synthetic oligonucleotide
  Target: ATXN1; (+) strand; PAM type: YTN; PAM sequence: CTC
ttggtggggttaactctgct

SEQ ID NO: 256094 - DNA, 20 bp, Artificial Sequence
  Description of Artificial Sequence: Synthetic oligonucleotide
  Target: ATXN1; (+) strand; PAM type: YTN; PAM sequence: CTT
ggtggggttaactctgctcc

SEQ ID NO: 256095 - DNA, 20 bp, Artificial Sequence
  Description of Artificial Sequence: Synthetic oligonucleotide
  Target: ATXN1; (+) strand; PAM type: YTN; PAM sequence: TTG
gtggggttaactctgctccc

SEQ ID NO: 256096 - DNA, 20 bp, Artificial Sequence
  Description of Artificial Sequence: Synthetic oligonucleotide
  Target: ATXN1; (+) strand; PAM type: YTN; PAM sequence: TTA
actctgctccctactgcttc

SEQ ID NO: 256097 - DNA, 20 bp, Artificial Sequence
  Description of Artificial Sequence: Synthetic oligonucleotide
  Target: ATXN1; (+) strand; PAM type: YTN; PAM sequence: CTC
tgctccctactgcttcatga

SEQ ID NO: 256098 - DNA, 20 bp, Artificial Sequence
  Description of Artificial Sequence: Synthetic oligonucleotide
  Target: ATXN1; (+) strand; PAM type: YTN; PAM sequence: CTG
ctccctactgcttcatgaaa

SEQ ID NO: 256099 - DNA, 20 bp, Artificial Sequence
  Description of Artificial Sequence: Synthetic oligonucleotide
  Target: ATXN1; (+) strand; PAM type: YTN; PAM sequence: CTC
cctactgcttcatgaaatgc

SEQ ID NO: 256100 - DNA, 20 bp, Artificial Sequence
  Description of Artificial Sequence: Synthetic oligonucleotide
  Target: ATXN1; (+) strand; PAM type: YTN; PAM sequence: CTA
ctgcttcatgaaatgccagt

SEQ ID NO: 256101 - DNA, 20 bp, Artificial Sequence
  Description of Artificial Sequence: Synthetic oligonucleotide
  Target: ATXN1; (+) strand; PAM type: YTN; PAM sequence: CTG
cttcatgaaatgccagtgta

SEQ ID NO: 256102 - DNA, 20 bp, Artificial Sequence
  Description of Artificial Sequence: Synthetic oligonucleotide
  Target: ATXN1; (+) strand; PAM type: YTN; PAM sequence: CTT
catgaaatgccagtgtatga

SEQ ID NO: 256103 - DNA, 20 bp, Artificial Sequence
  Description of Artificial Sequence: Synthetic oligonucleotide
  Target: ATXN1; (+) strand; PAM type: YTN; PAM sequence: TTC
atgaaatgccagtgtatgaa

SEQ ID NO: 256104 - DNA, 20 bp, Artificial Sequence
  Description of Artificial Sequence: Synthetic oligonucleotide
  Target: ATXN1; (+) strand; PAM type: YTN; PAM sequence: CTT
ttactgcacaatgttcactc

SEQ ID NO: 256105 - DNA, 20 bp, Artificial Sequence
  Description of Artificial Sequence: Synthetic oligonucleotide
  Target: ATXN1; (+) strand; PAM type: YTN; PAM sequence: TTT
tactgcacaatgttcactct

SEQ ID NO: 256106 - DNA, 20 bp, Artificial Sequence
  Description of Artificial Sequence: Synthetic oligonucleotide
  Target: ATXN1; (+) strand; PAM type: YTN; PAM sequence: TTT
actgcacaatgttcactctc

SEQ ID NO: 256107 - DNA, 20 bp, Artificial Sequence
  Description of Artificial Sequence: Synthetic oligonucleotide
  Target: ATXN1; (+) strand; PAM type: YTN; PAM sequence: TTA
ctgcacaatgttcactctca

SEQ ID NO: 256108 - DNA, 20 bp, Artificial Sequence
  Description of Artificial Sequence: Synthetic oligonucleotide
  Target: ATXN1; (+) strand; PAM type: YTN; PAM sequence: CTG
cacaatgttcactctcagaa

SEQ ID NO: 256109 - DNA, 20 bp, Artificial Sequence
  Description of Artificial Sequence: Synthetic oligonucleotide
  Target: ATXN1; (+) strand; PAM type: YTN; PAM sequence: TTC
actctcagaaagaaaatact

SEQ ID NO: 256110 - DNA, 20 bp, Artificial Sequence
  Description of Artificial Sequence: Synthetic oligonucleotide
  Target: ATXN1; (+) strand; PAM type: YTN; PAM sequence: CTC
tcagaaagaaaatactataa

SEQ ID NO: 256111 - DNA, 20 bp, Artificial Sequence
  Description of Artificial Sequence: Synthetic oligonucleotide
  Target: ATXN1; (+) strand; PAM type: YTN; PAM sequence: CTC
agaaagaaaatactataaac

SEQ ID NO: 256112 - DNA, 20 bp, Artificial Sequence
  Description of Artificial Sequence: Synthetic oligonucleotide
  Target: ATXN1; (+) strand; PAM type: YTN; PAM sequence: CTA
taaacctgtgtttgagctat

SEQ ID NO: 256113 - DNA, 20 bp, Artificial Sequence
  Description of Artificial Sequence: Synthetic oligonucleotide
  Target: ATXN1; (+) strand; PAM type: YTN; PAM sequence: CTG
tgtttgagctatttctcttg

SEQ ID NO: 256114 - DNA, 20 bp, Artificial Sequence
  Description of Artificial Sequence: Synthetic oligonucleotide
  Target: ATXN1; (+) strand; PAM type: YTN; PAM sequence: TTT
gagctatttctcttgctttc

SEQ ID NO: 256115 - DNA, 20 bp, Artificial Sequence
  Description of Artificial Sequence: Synthetic oligonucleotide
  Target: ATXN1; (+) strand; PAM type: YTN; PAM sequence: TTG
agctatttctcttgctttca

SEQ ID NO: 256116 - DNA, 20 bp, Artificial Sequence
  Description of Artificial Sequence: Synthetic oligonucleotide
  Target: ATXN1; (+) strand; PAM type: YTN; PAM sequence: CTA
tttctcttgctttcaatgca

SEQ ID NO: 256117 - DNA, 20 bp, Artificial Sequence
  Description of Artificial Sequence: Synthetic oligonucleotide
  Target: ATXN1; (+) strand; PAM type: YTN; PAM sequence: TTT
ctcttgctttcaatgcagat

SEQ ID NO: 256118 - DNA, 20 bp, Artificial Sequence
  Description of Artificial Sequence: Synthetic oligonucleotide
  Target: ATXN1; (+) strand; PAM type: YTN; PAM sequence: TTC
tcttgctttcaatgcagatt

SEQ ID NO: 256119 - DNA, 20 bp, Artificial Sequence
  Description of Artificial Sequence: Synthetic oligonucleotide
  Target: ATXN1; (+) strand; PAM type: YTN; PAM sequence: CTC
ttgctttcaatgcagattta

SEQ ID NO: 256120 - DNA, 20 bp, Artificial Sequence
  Description of Artificial Sequence: Synthetic oligonucleotide
  Target: ATXN1; (+) strand; PAM type: YTN; PAM sequence: CTT
gctttcaatgcagatttagc

SEQ ID NO: 256121 - DNA, 20 bp, Artificial Sequence
  Description of Artificial Sequence: Synthetic oligonucleotide
  Target: ATXN1; (+) strand; PAM type: YTN; PAM sequence: TTG
ctttcaatgcagatttagct

SEQ ID NO: 256122 - DNA, 20 bp, Artificial Sequence
  Description of Artificial Sequence: Synthetic oligonucleotide
  Target: ATXN1; (+) strand; PAM type: YTN; PAM sequence: CTT
tcaatgcagatttagctgat

SEQ ID NO: 256123 - DNA, 20 bp, Artificial Sequence
  Description of Artificial Sequence: Synthetic oligonucleotide
  Target: ATXN1; (+) strand; PAM type: YTN; PAM sequence: TTT
caatgcagatttagctgatt

SEQ ID NO: 256124 - DNA, 20 bp, Artificial Sequence
  Description of Artificial Sequence: Synthetic oligonucleotide
  Target: ATXN1; (+) strand; PAM type: YTN; PAM sequence: TTC
aatgcagatttagctgattg

SEQ ID NO: 256125 - DNA, 20 bp, Artificial Sequence
  Description of Artificial Sequence: Synthetic oligonucleotide
  Target: ATXN1; (+) strand; PAM type: YTN; PAM sequence: TTT
agctgattgttcaacgtgag

SEQ ID NO: 256126 - DNA, 20 bp, Artificial Sequence
  Description of Artificial Sequence: Synthetic oligonucleotide
  Target: ATXN1; (+) strand; PAM type: YTN; PAM sequence: TTA
gctgattgttcaacgtgagg

SEQ ID NO: 256127 - DNA, 20 bp, Artificial Sequence
  Description of Artificial Sequence: Synthetic oligonucleotide
  Target: ATXN1; (+) strand; PAM type: YTN; PAM sequence: CTG
attgttcaacgtgaggtctt

SEQ ID NO: 256128 - DNA, 20 bp, Artificial Sequence
  Description of Artificial Sequence: Synthetic oligonucleotide
  Target: ATXN1; (+) strand; PAM type: YTN; PAM sequence: TTG
ttcaacgtgaggtcttaaaa

SEQ ID NO: 256129 - DNA, 20 bp, Artificial Sequence
  Description of Artificial Sequence: Synthetic oligonucleotide
  Target: ATXN1; (+) strand; PAM type: YTN; PAM sequence: TTC
aacgtgaggtcttaaaacaa

SEQ ID NO: 256130 - DNA, 20 bp, Artificial Sequence
  Description of Artificial Sequence: Synthetic oligonucleotide
  Target: ATXN1; (+) strand; PAM type: YTN; PAM sequence: CTT
aaaacaaccctctctcttca

SEQ ID NO: 256131 - DNA, 20 bp, Artificial Sequence
  Description of Artificial Sequence: Synthetic oligonucleotide
  Target: ATXN1; (+) strand; PAM type: YTN; PAM sequence: TTA
aaacaaccctctctcttcac

SEQ ID NO: 256132 - DNA, 20 bp, Artificial Sequence
  Description of Artificial Sequence: Synthetic oligonucleotide
  Target: ATXN1; (+) strand; PAM type: YTN; PAM sequence: CTC
tctcttcacagccttatctt

SEQ ID NO: 256133 - DNA, 20 bp, Artificial Sequence
  Description of Artificial Sequence: Synthetic oligonucleotide
  Target: ATXN1; (+) strand; PAM type: YTN; PAM sequence: CTC
tcttcacagccttatcttct

SEQ ID NO: 256134 - DNA, 20 bp, Artificial Sequence
  Description of Artificial Sequence: Synthetic oligonucleotide
  Target: ATXN1; (+) strand; PAM type: YTN; PAM sequence: CTC
ttcacagccttatcttcttt

SEQ ID NO: 256135 - DNA, 20 bp, Artificial Sequence
  Description of Artificial Sequence: Synthetic oligonucleotide
  Target: ATXN1; (+) strand; PAM type: YTN; PAM sequence: CTT
cacagccttatcttcttttc

SEQ ID NO: 256136 - DNA, 20 bp, Artificial Sequence
  Description of Artificial Sequence: Synthetic oligonucleotide
  Target: ATXN1; (+) strand; PAM type: YTN; PAM sequence: TTC
acagccttatcttcttttct

SEQ ID NO: 256137 - DNA, 20 bp, Artificial Sequence
  Description of Artificial Sequence: Synthetic oligonucleotide
  Target: ATXN1; (+) strand; PAM type: YTN; PAM sequence: CTT
atcttcttttctctctcttt

SEQ ID NO: 256138 - DNA, 20 bp, Artificial Sequence
  Description of Artificial Sequence: Synthetic oligonucleotide
  Target: ATXN1; (+) strand; PAM type: YTN; PAM sequence: TTA
tcttcttttctctctctttt

SEQ ID NO: 256139 - DNA, 20 bp, Artificial Sequence
  Description of Artificial Sequence: Synthetic oligonucleotide
  Target: ATXN1; (+) strand; PAM type: YTN; PAM sequence: CTT
cttttctctctcttttttct

SEQ ID NO: 256140 - DNA, 20 bp, Artificial Sequence
  Description of Artificial Sequence: Synthetic oligonucleotide
  Target: ATXN1; (+) strand; PAM type: YTN; PAM sequence: TTC
ttttctctctcttttttctc

SEQ ID NO: 256141 - DNA, 20 bp, Artificial Sequence
  Description of Artificial Sequence: Synthetic oligonucleotide
  Target: ATXN1; (+) strand; PAM type: YTN; PAM sequence: CTT
ttctctctcttttttctccc

SEQ ID NO: 256142 - DNA, 20 bp, Artificial Sequence
  Description of Artificial Sequence: Synthetic oligonucleotide
  Target: ATXN1; (+) strand; PAM type: YTN; PAM sequence: TTT
tctctctcttttttctccct

SEQ ID NO: 256143 - DNA, 20 bp, Artificial Sequence
  Description of Artificial Sequence: Synthetic oligonucleotide
  Target: ATXN1; (+) strand; PAM type: YTN; PAM sequence: TTT
ctctctcttttttctcccta

SEQ ID NO: 256144 - DNA, 20 bp, Artificial Sequence
  Description of Artificial Sequence: Synthetic oligonucleotide
  Target: ATXN1; (+) strand; PAM type: YTN; PAM sequence: TTC
tctctcttttttctccctat

SEQ ID NO: 256145 - DNA, 20 bp, Artificial Sequence
  Description of Artificial Sequence: Synthetic oligonucleotide
  Target: ATXN1; (+) strand; PAM type: YTN; PAM sequence: CTC
tctcttttttctccctatga

SEQ ID NO: 256146 - DNA, 20 bp, Artificial Sequence
  Description of Artificial Sequence: Synthetic oligonucleotide
  Target: ATXN1; (+) strand; PAM type: YTN; PAM sequence: CTC
tcttttttctccctatgact

SEQ ID NO: 256147 - DNA, 20 bp, Artificial Sequence
  Description of Artificial Sequence: Synthetic oligonucleotide
  Target: ATXN1; (+) strand; PAM type: YTN; PAM sequence: CTC
ttttttctccctatgacttt

SEQ ID NO: 256148 - DNA, 20 bp, Artificial Sequence
  Description of Artificial Sequence: Synthetic oligonucleotide
  Target: ATXN1; (+) strand; PAM type: YTN; PAM sequence: CTT
ttttctccctatgactttcc

SEQ ID NO: 256149 - DNA, 20 bp, Artificial Sequence
  Description of Artificial Sequence: Synthetic oligonucleotide
  Target: ATXN1; (+) strand; PAM type: YTN; PAM sequence: TTT
tttctccctatgactttcct

SEQ ID NO: 256150 - DNA, 20 bp, Artificial Sequence
  Description of Artificial Sequence: Synthetic oligonucleotide
  Target: ATXN1; (+) strand; PAM type: YTN; PAM sequence: TTT
ttctccctatgactttcctt

SEQ ID NO: 256151 - DNA, 20 bp, Artificial Sequence
  Description of Artificial Sequence: Synthetic oligonucleotide
  Target: ATXN1; (+) strand; PAM type: YTN; PAM sequence: TTT
tctccctatgactttccttc

SEQ ID NO: 256152 - DNA, 20 bp, Artificial Sequence
  Description of Artificial Sequence: Synthetic oligonucleotide
  Target: ATXN1; (+) strand; PAM type: YTN; PAM sequence: TTT
ctccctatgactttccttca

SEQ ID NO: 256153 - DNA, 20 bp, Artificial Sequence
  Description of Artificial Sequence: Synthetic oligonucleotide
  Target: ATXN1; (+) strand; PAM type: YTN; PAM sequence: TTC
tccctatgactttccttcat

SEQ ID NO: 256154 - DNA, 20 bp, Artificial Sequence
  Description of Artificial Sequence: Synthetic oligonucleotide
  Target: ATXN1; (+) strand; PAM type: YTN; PAM sequence: CTC
cctatgactttccttcatta

SEQ ID NO: 256155 - DNA, 20 bp, Artificial Sequence
  Description of Artificial Sequence: Synthetic oligonucleotide
  Target: ATXN1; (+) strand; PAM type: YTN; PAM sequence: CTA
tgactttccttcattaagtt

SEQ ID NO: 256156 - DNA, 20 bp, Artificial Sequence
  Description of Artificial Sequence: Synthetic oligonucleotide
  Target: ATXN1; (+) strand; PAM type: YTN; PAM sequence: CTT
tccttcattaagttaaaatg

SEQ ID NO: 256157 - DNA, 20 bp, Artificial Sequence
  Description of Artificial Sequence: Synthetic oligonucleotide
  Target: ATXN1; (+) strand; PAM type: YTN; PAM sequence: TTT
ccttcattaagttaaaatga

SEQ ID NO: 256158 - DNA, 20 bp, Artificial Sequence
  Description of Artificial Sequence: Synthetic oligonucleotide
  Target: ATXN1; (+) strand; PAM type: YTN; PAM sequence: TTC
cttcattaagttaaaatgag

SEQ ID NO: 256159 - DNA, 20 bp, Artificial Sequence
  Description of Artificial Sequence: Synthetic oligonucleotide
  Target: ATXN1; (+) strand; PAM type: YTN; PAM sequence: CTT
cattaagttaaaatgagaga

SEQ ID NO: 256160 - DNA, 20 bp, Artificial Sequence
  Description of Artificial Sequence: Synthetic oligonucleotide
  Target: ATXN1; (+) strand; PAM type: YTN; PAM sequence: TTC
attaagttaaaatgagagac

SEQ ID NO: 256161 - DNA, 20 bp, Artificial Sequence
  Description of Artificial Sequence: Synthetic oligonucleotide
  Target: ATXN1; (+) strand; PAM type: YTN; PAM sequence: TTA
agttaaaatgagagactaaa

SEQ ID NO: 256162 - DNA, 20 bp, Artificial Sequence
  Description of Artificial Sequence: Synthetic oligonucleotide
  Target: ATXN1; (+) strand; PAM type: YTN; PAM sequence: TTA
aaatgagagactaaaaaagt

SEQ ID NO: 256163 - DNA, 20 bp, Artificial Sequence
  Description of Artificial Sequence: Synthetic oligonucleotide
  Target: ATXN1; (+) strand; PAM type: YTN; PAM sequence: CTA
aaaaagtggaacatgtgaag

SEQ ID NO: 256164 - DNA, 20 bp, Artificial Sequence
  Description of Artificial Sequence: Synthetic oligonucleotide
  Target: ATXN1; (+) strand; PAM type: YTN; PAM sequence: TTC
tcagattcctttctctctaa

SEQ ID NO: 256165 - DNA, 20 bp, Artificial Sequence
  Description of Artificial Sequence: Synthetic oligonucleotide
  Target: ATXN1; (+) strand; PAM type: YTN; PAM sequence: CTC
agattcctttctctctaaat

SEQ ID NO: 256166 - DNA, 20 bp, Artificial Sequence
  Description of Artificial Sequence: Synthetic oligonucleotide
  Target: ATXN1; (+) strand; PAM type: YTN; PAM sequence: TTC
ctttctctctaaattaatca

SEQ ID NO: 256167 - DNA, 20 bp, Artificial Sequence
  Description of Artificial Sequence: Synthetic oligonucleotide
  Target: ATXN1; (+) strand; PAM type: YTN; PAM sequence: CTT
tctctctaaattaatcatac

SEQ ID NO: 256168 - DNA, 20 bp, Artificial Sequence
  Description of Artificial Sequence: Synthetic oligonucleotide
  Target: ATXN1; (+) strand; PAM type: YTN; PAM sequence: TTT
ctctctaaattaatcatacc

SEQ ID NO: 256169 - DNA, 20 bp, Artificial Sequence
  Description of Artificial Sequence: Synthetic oligonucleotide
  Target: ATXN1; (+) strand; PAM type: YTN; PAM sequence: TTC
tctctaaattaatcatacca

SEQ ID NO: 256170 - DNA, 20 bp, Artificial Sequence
  Description of Artificial Sequence: Synthetic oligonucleotide
  Target: ATXN1; (+) strand; PAM type: YTN; PAM sequence: CTC
tctaaattaatcataccaag

SEQ ID NO: 256171 - DNA, 20 bp, Artificial Sequence
  Description of Artificial Sequence: Synthetic oligonucleotide
  Target: ATXN1; (+) strand; PAM type: YTN; PAM sequence: CTC
taaattaatcataccaagga

SEQ ID NO: 256172 - DNA, 20 bp, Artificial Sequence
  Description of Artificial Sequence: Synthetic oligonucleotide
  Target: ATXN1; (+) strand; PAM type: YTN; PAM sequence: CTA
aattaatcataccaaggaga

SEQ ID NO: 256173 - DNA, 20 bp, Artificial Sequence
  Description of Artificial Sequence: Synthetic oligonucleotide
  Target: ATXN1; (+) strand; PAM type: YTN; PAM sequence: TTA
atcataccaaggagaaccca

SEQ ID NO: 256174 - DNA, 20 bp, Artificial Sequence
  Description of Artificial Sequence: Synthetic oligonucleotide
  Target: ATXN1; (+) strand; PAM type: YTN; PAM sequence: TTA
aataattttttcaagaatct

SEQ ID NO: 256175 - DNA, 20 bp, Artificial Sequence
  Description of Artificial Sequence: Synthetic oligonucleotide
  Target: ATXN1; (+) strand; PAM type: YTN; PAM sequence: TTT
tttcaagaatctaaataaaa

SEQ ID NO: 256176 - DNA, 20 bp, Artificial Sequence
  Description of Artificial Sequence: Synthetic oligonucleotide
  Target: ATXN1; (+) strand; PAM type: YTN; PAM sequence: TTT
ttcaagaatctaaataaaac

SEQ ID NO: 256177 - DNA, 20 bp, Artificial Sequence
  Description of Artificial Sequence: Synthetic oligonucleotide
  Target: ATXN1; (+) strand; PAM type: YTN; PAM sequence: TTT
tcaagaatctaaataaaact

SEQ ID NO: 256178 - DNA, 20 bp, Artificial Sequence
  Description of Artificial Sequence: Synthetic oligonucleotide
  Target: ATXN1; (+) strand; PAM type: YTN; PAM sequence: TTT
caagaatctaaataaaactt

SEQ ID NO: 256179 - DNA, 20 bp, Artificial Sequence
  Description of Artificial Sequence: Synthetic oligonucleotide
  Target: ATXN1; (+) strand; PAM type: YTN; PAM sequence: TTC
aagaatctaaataaaacttt

SEQ ID NO: 256180 - DNA, 20 bp, Artificial Sequence
  Description of Artificial Sequence: Synthetic oligonucleotide
  Target: ATXN1; (+) strand; PAM type: YTN; PAM sequence: CTA
aataaaactttaaataaagc

SEQ ID NO: 256181 - DNA, 20 bp, Artificial Sequence
  Description of Artificial Sequence: Synthetic oligonucleotide
  Target: ATXN1; (+) strand; PAM type: YTN; PAM sequence: CTT
taaataaagctttatttggt

SEQ ID NO: 256182 - DNA, 20 bp, Artificial Sequence
  Description of Artificial Sequence: Synthetic oligonucleotide
  Target: ATXN1; (+) strand; PAM type: YTN; PAM sequence: TTT
aaataaagctttatttggtt

SEQ ID NO: 256183 - DNA, 20 bp, Artificial Sequence
  Description of Artificial Sequence: Synthetic oligonucleotide
  Target: ATXN1; (+) strand; PAM type: YTN; PAM sequence: TTA
aataaagctttatttggttt

SEQ ID NO: 256184 - DNA, 20 bp, Artificial Sequence
  Description of Artificial Sequence: Synthetic oligonucleotide
  Target: ATXN1; (+) strand; PAM type: YTN; PAM sequence: CTT
tatttggttttactcacagc

SEQ ID NO: 256185 - DNA, 20 bp, Artificial Sequence
  Description of Artificial Sequence: Synthetic oligonucleotide
  Target: ATXN1; (+) strand; PAM type: YTN; PAM sequence: TTT
atttggttttactcacagcc

SEQ ID NO: 256186 - DNA, 20 bp, Artificial Sequence
  Description of Artificial Sequence: Synthetic oligonucleotide
  Target: ATXN1; (+) strand; PAM type: YTN; PAM sequence: TTA
tttggttttactcacagcca

SEQ ID NO: 256187 - DNA, 20 bp, Artificial Sequence
  Description of Artificial Sequence: Synthetic oligonucleotide
  Target: ATXN1; (+) strand; PAM type: YTN; PAM sequence: TTT
ggttttactcacagccaacc

SEQ ID NO: 256188 - DNA, 20 bp, Artificial Sequence
  Description of Artificial Sequence: Synthetic oligonucleotide
  Target: ATXN1; (+) strand; PAM type: YTN; PAM sequence: TTG
gttttactcacagccaacca

SEQ ID NO: 256189 - DNA, 20 bp, Artificial Sequence
  Description of Artificial Sequence: Synthetic oligonucleotide
  Target: ATXN1; (+) strand; PAM type: YTN; PAM sequence: TTT
tactcacagccaaccaataa

SEQ ID NO: 256190 - DNA, 20 bp, Artificial Sequence
  Description of Artificial Sequence: Synthetic oligonucleotide
  Target: ATXN1; (+) strand; PAM type: YTN; PAM sequence: TTT
actcacagccaaccaataat

SEQ ID NO: 256191 - DNA, 20 bp, Artificial Sequence
  Description of Artificial Sequence: Synthetic oligonucleotide
  Target: ATXN1; (+) strand; PAM type: YTN; PAM sequence: TTA
ctcacagccaaccaataatt

SEQ ID NO: 256192 - DNA, 20 bp, Artificial Sequence
  Description of Artificial Sequence: Synthetic oligonucleotide
  Target: ATXN1; (+) strand; PAM type: YTN; PAM sequence: CTC
acagccaaccaataattgag

SEQ ID NO: 256193 - DNA, 20 bp, Artificial Sequence
  Description of Artificial Sequence: Synthetic oligonucleotide
  Target: ATXN1; (+) strand; PAM type: YTN; PAM sequence: TTG
agtcatctctatttttaaag

SEQ ID NO: 256194 - DNA, 20 bp, Artificial Sequence
  Description of Artificial Sequence: Synthetic oligonucleotide
  Target: ATXN1; (+) strand; PAM type: YTN; PAM sequence: CTC
tatttttaaagtaatgtgaa

SEQ ID NO: 256195 - DNA, 20 bp, Artificial Sequence
  Description of Artificial Sequence: Synthetic oligonucleotide
  Target: ATXN1; (+) strand; PAM type: YTN; PAM sequence: CTA
tttttaaagtaatgtgaaga

SEQ ID NO: 256196 - DNA, 20 bp, Artificial Sequence
  Description of Artificial Sequence: Synthetic oligonucleotide
  Target: ATXN1; (+) strand; PAM type: YTN; PAM sequence: TTT
ttaaagtaatgtgaagatca

SEQ ID NO: 256197 - DNA, 20 bp, Artificial Sequence
  Description of Artificial Sequence: Synthetic oligonucleotide
  Target: ATXN1; (+) strand; PAM type: YTN; PAM sequence: TTT
taaagtaatgtgaagatcag

SEQ ID NO: 256198 - DNA, 20 bp, Artificial Sequence
  Description of Artificial Sequence: Synthetic oligonucleotide
  Target: ATXN1; (+) strand; PAM type: YTN; PAM sequence: TTT
aaagtaatgtgaagatcagt

SEQ ID NO: 256199 - DNA, 20 bp, Artificial Sequence
  Description of Artificial Sequence: Synthetic oligonucleotide
  Target: ATXN1; (+) strand; PAM type: YTN; PAM sequence: TTA
aagtaatgtgaagatcagtt

SEQ ID NO: 256200 - DNA, 20 bp, Artificial Sequence
  Description of Artificial Sequence: Synthetic oligonucleotide
  Target: ATXN1; (+) strand; PAM type: YTN; PAM sequence: TTA
gttcaaacctaacggatacc

SEQ ID NO: 256201 - DNA, 20 bp, Artificial Sequence
  Description of Artificial Sequence: Synthetic oligonucleotide
  Target: ATXN1; (+) strand; PAM type: YTN; PAM sequence: TTC
aaacctaacggataccgggc

SEQ ID NO: 256202 - DNA, 20 bp, Artificial Sequence
  Description of Artificial Sequence: Synthetic oligonucleotide
  Target: ATXN1; (+) strand; PAM type: YTN; PAM sequence: CTA
acggataccgggcattcata

SEQ ID NO: 256203 - DNA, 20 bp, Artificial Sequence
  Description of Artificial Sequence: Synthetic oligonucleotide
  Target: ATXN1; (+) strand; PAM type: YTN; PAM sequence: TTC
ataacttttgagggcattac

SEQ ID NO: 256204 - DNA, 20 bp, Artificial Sequence
  Description of Artificial Sequence: Synthetic oligonucleotide
  Target: ATXN1; (+) strand; PAM type: YTN; PAM sequence: CTT
ttgagggcattactagacac

SEQ ID NO: 256205 - DNA, 20 bp, Artificial Sequence
  Description of Artificial Sequence: Synthetic oligonucleotide
  Target: ATXN1; (+) strand; PAM type: YTN; PAM sequence: TTT
tgagggcattactagacacc

SEQ ID NO: 256206 - DNA, 20 bp, Artificial Sequence
  Description of Artificial Sequence: Synthetic oligonucleotide
  Target: ATXN1; (+) strand; PAM type: YTN; PAM sequence: TTT
gagggcattactagacaccc

SEQ ID NO: 256207 - DNA, 20 bp, Artificial Sequence
  Description of Artificial Sequence: Synthetic oligonucleotide
  Target: ATXN1; (+) strand; PAM type: YTN; PAM sequence: TTG
agggcattactagacaccct

SEQ ID NO: 256208 - DNA, 20 bp, Artificial Sequence
  Description of Artificial Sequence: Synthetic oligonucleotide
  Target: ATXN1; (+) strand; PAM type: YTN; PAM sequence: TTA
ctagacaccctatttcctta

SEQ ID NO: 256209 - DNA, 20 bp, Artificial Sequence
  Description of Artificial Sequence: Synthetic oligonucleotide
  Target: ATXN1; (+) strand; PAM type: YTN; PAM sequence: CTA
gacaccctatttccttaatg

SEQ ID NO: 256210 - DNA, 20 bp, Artificial Sequence
  Description of Artificial Sequence: Synthetic oligonucleotide
  Target: ATXN1; (+) strand; PAM type: YTN; PAM sequence: CTA
tttccttaatgtaaaaagta

SEQ ID NO: 256211 - DNA, 20 bp, Artificial Sequence
  Description of Artificial Sequence: Synthetic oligonucleotide
  Target: ATXN1; (+) strand; PAM type: YTN; PAM sequence: TTT
ccttaatgtaaaaagtaaag

SEQ ID NO: 256212 - DNA, 20 bp, Artificial Sequence
  Description of Artificial Sequence: Synthetic oligonucleotide
  Target: ATXN1; (+) strand; PAM type: YTN; PAM sequence: TTC
cttaatgtaaaaagtaaagt

SEQ ID NO: 256213 - DNA, 20 bp, Artificial Sequence
  Description of Artificial Sequence: Synthetic oligonucleotide
  Target: ATXN1; (+) strand; PAM type: YTN; PAM sequence: CTT
aatgtaaaaagtaaagtaga

SEQ ID NO: 256214 - DNA, 20 bp, Artificial Sequence
  Description of Artificial Sequence: Synthetic oligonucleotide
  Target: ATXN1; (+) strand; PAM type: YTN; PAM sequence: TTA
atgtaaaaagtaaagtagag

SEQ ID NO: 256215 - DNA, 20 bp, Artificial Sequence
  Description of Artificial Sequence: Synthetic oligonucleotide
  Target: ATXN1; (+) strand; PAM type: YTN; PAM sequence: TTC
ctcttcaaagattttcctcc

SEQ ID NO: 256216 - DNA, 20 bp, Artificial Sequence
  Description of Artificial Sequence: Synthetic oligonucleotide
  Target: ATXN1; (+) strand; PAM type: YTN; PAM sequence: CTC
ttcaaagattttcctcccca

SEQ ID NO: 256217 - DNA, 20 bp, Artificial Sequence
  Description of Artificial Sequence: Synthetic oligonucleotide
  Target: ATXN1; (+) strand; PAM type: YTN; PAM sequence: CTT
caaagattttcctccccatc

SEQ ID NO: 256218 - DNA, 20 bp, Artificial Sequence
  Description of Artificial Sequence: Synthetic oligonucleotide
  Target: ATXN1; (+) strand; PAM type: YTN; PAM sequence: TTC
aaagattttcctccccatct

SEQ ID NO: 256219 - DNA, 20 bp, Artificial Sequence
  Description of Artificial Sequence: Synthetic oligonucleotide
  Target: ATXN1; (+) strand; PAM type: YTN; PAM sequence: TTT
tcctccccatctaattagga

SEQ ID NO: 256220 - DNA, 20 bp, Artificial Sequence
  Description of Artificial Sequence: Synthetic oligonucleotide
  Target: ATXN1; (+) strand; PAM type: YTN; PAM sequence: TTT
cctccccatctaattaggaa

SEQ ID NO: 256221 - DNA, 20 bp, Artificial Sequence
  Description of Artificial Sequence: Synthetic oligonucleotide
  Target: ATXN1; (+) strand; PAM type: YTN; PAM sequence: TTC
ctccccatctaattaggaat

SEQ ID NO: 256222 - DNA, 20 bp, Artificial Sequence
  Description of Artificial Sequence: Synthetic oligonucleotide
  Target: ATXN1; (+) strand; PAM type: YTN; PAM sequence: CTC
cccatctaattaggaattaa

SEQ ID NO: 256223 - DNA, 20 bp, Artificial Sequence
  Description of Artificial Sequence: Synthetic oligonucleotide
  Target: ATXN1; (+) strand; PAM type: YTN; PAM sequence: CTA
attaggaattaatagtactt

SEQ ID NO: 256224 - DNA, 20 bp, Artificial Sequence
  Description of Artificial Sequence: Synthetic oligonucleotide
  Target: ATXN1; (+) strand; PAM type: YTN; PAM sequence: TTA
ggaattaatagtactttctc

SEQ ID NO: 256225 - DNA, 20 bp, Artificial Sequence
  Description of Artificial Sequence: Synthetic oligonucleotide
  Target: ATXN1; (+) strand; PAM type: YTN; PAM sequence: TTA
atagtactttctcttagaag

SEQ ID NO: 256226 - DNA, 20 bp, Artificial Sequence
  Description of Artificial Sequence: Synthetic oligonucleotide
  Target: ATXN1; (+) strand; PAM type: YTN; PAM sequence: CTT
tctcttagaagcaaaattta

SEQ ID NO: 256227 - DNA, 20 bp, Artificial Sequence
  Description of Artificial Sequence: Synthetic oligonucleotide
  Target: ATXN1; (+) strand; PAM type: YTN; PAM sequence: TTT
ctcttagaagcaaaatttat

SEQ ID NO: 256228 - DNA, 20 bp, Artificial Sequence
  Description of Artificial Sequence: Synthetic oligonucleotide
  Target: ATXN1; (+) strand; PAM type: YTN; PAM sequence: TTC
tcttagaagcaaaatttatt

SEQ ID NO: 256229 - DNA, 20 bp, Artificial Sequence
  Description of Artificial Sequence: Synthetic oligonucleotide
  Target: ATXN1; (+) strand; PAM type: YTN; PAM sequence: CTC
ttagaagcaaaatttattca

SEQ ID NO: 256230 - DNA, 20 bp, Artificial Sequence
  Description of Artificial Sequence: Synthetic oligonucleotide
  Target: ATXN1; (+) strand; PAM type: YTN; PAM sequence: CTT
agaagcaaaatttattcaaa

SEQ ID NO: 256231 - DNA, 20 bp, Artificial Sequence
  Description of Artificial Sequence: Synthetic oligonucleotide
  Target: ATXN1; (+) strand; PAM type: YTN; PAM sequence: TTA
gaagcaaaatttattcaaag

SEQ ID NO: 256232 - DNA, 20 bp, Artificial Sequence
  Description of Artificial Sequence: Synthetic oligonucleotide
  Target: ATXN1; (+) strand; PAM type: YTN; PAM sequence: TTT
attcaaagacctgtgctaac

SEQ ID NO: 256233 - DNA, 20 bp, Artificial Sequence
  Description of Artificial Sequence: Synthetic oligonucleotide
  Target: ATXN1; (+) strand; PAM type: YTN; PAM sequence: TTA
ttcaaagacctgtgctaaca

SEQ ID NO: 256234 - DNA, 20 bp, Artificial Sequence
  Description of Artificial Sequence: Synthetic oligonucleotide
  Target: ATXN1; (+) strand; PAM type: YTN; PAM sequence: TTC
aaagacctgtgctaacattc

SEQ ID NO: 256235 - DNA, 20 bp, Artificial Sequence
  Description of Artificial Sequence: Synthetic oligonucleotide
  Target: ATXN1; (+) strand; PAM type: YTN; PAM sequence: CTG
tgctaacattcttaaatatc

SEQ ID NO: 256236 - DNA, 20 bp, Artificial Sequence
  Description of Artificial Sequence: Synthetic oligonucleotide
  Target: ATXN1; (+) strand; PAM type: YTN; PAM sequence: CTA
acattcttaaatatctgcta

SEQ ID NO: 256237 - DNA, 20 bp, Artificial Sequence
  Description of Artificial Sequence: Synthetic oligonucleotide
  Target: ATXN1; (+) strand; PAM type: YTN; PAM sequence: TTC
ttaaatatctgctagctgta

SEQ ID NO: 256238 - DNA, 20 bp, Artificial Sequence
  Description of Artificial Sequence: Synthetic oligonucleotide
  Target: ATXN1; (+) strand; PAM type: YTN; PAM sequence: CTT
aaatatctgctagctgtaat

SEQ ID NO: 256239 - DNA, 20 bp, Artificial Sequence
  Description of Artificial Sequence: Synthetic oligonucleotide
  Target: ATXN1; (+) strand; PAM type: YTN; PAM sequence: TTA
aatatctgctagctgtaata

SEQ ID NO: 256240 - DNA, 20 bp, Artificial Sequence
  Description of Artificial Sequence: Synthetic oligonucleotide
  Target: ATXN1; (+) strand; PAM type: YTN; PAM sequence: CTG
ctagctgtaataaagaaatc

SEQ ID NO: 256241 - DNA, 20 bp, Artificial Sequence
  Description of Artificial Sequence: Synthetic oligonucleotide
  Target: ATXN1; (+) strand; PAM type: YTN; PAM sequence: CTA
gctgtaataaagaaatcaat

SEQ ID NO: 256242 - DNA, 20 bp, Artificial Sequence
  Description of Artificial Sequence: Synthetic oligonucleotide
  Target: ATXN1; (+) strand; PAM type: YTN; PAM sequence: CTG
taataaagaaatcaatgtac

SEQ ID NO: 256243 - DNA, 20 bp, Artificial Sequence
  Description of Artificial Sequence: Synthetic oligonucleotide
  Target: ATXN1; (+) strand; PAM type: YTN; PAM sequence: CTT
tatgttcttagctcccacaa

SEQ ID NO: 256244 - DNA, 20 bp, Artificial Sequence
  Description of Artificial Sequence: Synthetic oligonucleotide
  Target: ATXN1; (+) strand; PAM type: YTN; PAM sequence: TTT
atgttcttagctcccacaat

SEQ ID NO: 256245 - DNA, 20 bp, Artificial Sequence
  Description of Artificial Sequence: Synthetic oligonucleotide
  Target: ATXN1; (+) strand; PAM type: YTN; PAM sequence: TTA
tgttcttagctcccacaatt

SEQ ID NO: 256246 - DNA, 20 bp, Artificial Sequence
  Description of Artificial Sequence: Synthetic oligonucleotide
  Target: ATXN1; (+) strand; PAM type: YTN; PAM sequence: TTC
ttagctcccacaatttagcc

SEQ ID NO: 256247 - DNA, 20 bp, Artificial Sequence
  Description of Artificial Sequence: Synthetic oligonucleotide
  Target: ATXN1; (+) strand; PAM type: YTN; PAM sequence: CTT
agctcccacaatttagccta

SEQ ID NO: 256248 - DNA, 20 bp, Artificial Sequence
  Description of Artificial Sequence: Synthetic oligonucleotide
  Target: ATXN1; (+) strand; PAM type: YTN; PAM sequence: TTA
gctcccacaatttagcctaa

SEQ ID NO: 256249 - DNA, 20 bp, Artificial Sequence
  Description of Artificial Sequence: Synthetic oligonucleotide
  Target: ATXN1; (+) strand; PAM type: YTN; PAM sequence: CTC
ccacaatttagcctaaatat

SEQ ID NO: 256250 - DNA, 20 bp, Artificial Sequence
  Description of Artificial Sequence: Synthetic oligonucleotide
  Target: ATXN1; (+) strand; PAM type: YTN; PAM sequence: TTT
agcctaaatatttaccctag

SEQ ID NO: 256251 - DNA, 20 bp, Artificial Sequence
  Description of Artificial Sequence: Synthetic oligonucleotide
  Target: ATXN1; (+) strand; PAM type: YTN; PAM sequence: TTA
gcctaaatatttaccctagc

SEQ ID NO: 256252 - DNA, 20 bp, Artificial Sequence
  Description of Artificial Sequence: Synthetic oligonucleotide
  Target: ATXN1; (+) strand; PAM type: YTN; PAM sequence: CTA
aatatttaccctagcatgct

SEQ ID NO: 256253 - DNA, 20 bp, Artificial Sequence
  Description of Artificial Sequence: Synthetic oligonucleotide
  Target: ATXN1; (+) strand; PAM type: YTN; PAM sequence: TTT
accctagcatgcttatactg

SEQ ID NO: 256254 - DNA, 20 bp, Artificial Sequence
  Description of Artificial Sequence: Synthetic oligonucleotide
  Target: ATXN1; (+) strand; PAM type: YTN; PAM sequence: TTA
ccctagcatgcttatactgg

SEQ ID NO: 256255 - DNA, 20 bp, Artificial Sequence
  Description of Artificial Sequence: Synthetic oligonucleotide
  Target: ATXN1; (+) strand; PAM type: YTN; PAM sequence: CTA
gcatgcttatactggtccaa

SEQ ID NO: 256256 - DNA, 20 bp, Artificial Sequence
  Description of Artificial Sequence: Synthetic oligonucleotide
  Target: ATXN1; (+) strand; PAM type: YTN; PAM sequence: CTT
atactggtccaagcaagcat

SEQ ID NO: 256257 - DNA, 20 bp, Artificial Sequence
  Description of Artificial Sequence: Synthetic oligonucleotide
  Target: ATXN1; (+) strand; PAM type: YTN; PAM sequence: TTA
tactggtccaagcaagcatt

SEQ ID NO: 256258 - DNA, 20 bp, Artificial Sequence
  Description of Artificial Sequence: Synthetic oligonucleotide
  Target: ATXN1; (+) strand; PAM type: YTN; PAM sequence: CTG
gtccaagcaagcattaggtc

SEQ ID NO: 256259 - DNA, 20 bp, Artificial Sequence
  Description of Artificial Sequence: Synthetic oligonucleotide
  Target: ATXN1; (+) strand; PAM type: YTN; PAM sequence: TTA
ggtcatagcctgttcctctt

SEQ ID NO: 256260 - DNA, 20 bp, Artificial Sequence
  Description of Artificial Sequence: Synthetic oligonucleotide
  Target: ATXN1; (+) strand; PAM type: YTN; PAM sequence: CTG
ttcctcttccttatttgaag

SEQ ID NO: 256261 - DNA, 20 bp, Artificial Sequence
  Description of Artificial Sequence: Synthetic oligonucleotide
  Target: ATXN1; (+) strand; PAM type: YTN; PAM sequence: TTC
ctcttccttatttgaaggtt

SEQ ID NO: 256262 - DNA, 20 bp, Artificial Sequence
  Description of Artificial Sequence: Synthetic oligonucleotide
  Target: ATXN1; (+) strand; PAM type: YTN; PAM sequence: CTC
ttccttatttgaaggttttt

SEQ ID NO: 256263 - DNA, 20 bp, Artificial Sequence
  Description of Artificial Sequence: Synthetic oligonucleotide
  Target: ATXN1; (+) strand; PAM type: YTN; PAM sequence: CTT
ccttatttgaaggtttttta

SEQ ID NO: 256264 - DNA, 20 bp, Artificial Sequence
  Description of Artificial Sequence: Synthetic oligonucleotide
  Target: ATXN1; (+) strand; PAM type: YTN; PAM sequence: TTC
cttatttgaaggttttttac

SEQ ID NO: 256265 - DNA, 20 bp, Artificial Sequence
  Description of Artificial Sequence: Synthetic oligonucleotide
  Target: ATXN1; (+) strand; PAM type: YTN; PAM sequence: CTT
atttgaaggttttttacctt

SEQ ID NO: 256266 - DNA, 20 bp, Artificial Sequence
  Description of Artificial Sequence: Synthetic oligonucleotide
  Target: ATXN1; (+) strand; PAM type: YTN; PAM sequence: TTA
tttgaaggttttttaccttt

SEQ ID NO: 256267 - DNA, 20 bp, Artificial Sequence
  Description of Artificial Sequence: Synthetic oligonucleotide
  Target: ATXN1; (+) strand; PAM type: YTN; PAM sequence: TTT
gaaggttttttacctttctc

SEQ ID NO: 256268 - DNA, 20 bp, Artificial Sequence
  Description of Artificial Sequence: Synthetic oligonucleotide
  Target: ATXN1; (+) strand; PAM type: YTN; PAM sequence: TTG
aaggttttttacctttctca

SEQ ID NO: 256269 - DNA, 20 bp, Artificial Sequence
  Description of Artificial Sequence: Synthetic oligonucleotide
  Target: ATXN1; (+) strand; PAM type: YTN; PAM sequence: TTT
tttacctttctcagcatttc

SEQ ID NO: 256270 - DNA, 20 bp, Artificial Sequence
  Description of Artificial Sequence: Synthetic oligonucleotide
  Target: ATXN1; (+) strand; PAM type: YTN; PAM sequence: TTT
ttacctttctcagcatttca

SEQ ID NO: 256271 - DNA, 20 bp, Artificial Sequence
  Description of Artificial Sequence: Synthetic oligonucleotide
  Target: ATXN1; (+) strand; PAM type: YTN; PAM sequence: TTT
tacctttctcagcatttcac

SEQ ID NO: 256272 - DNA, 20 bp, Artificial Sequence
  Description of Artificial Sequence: Synthetic oligonucleotide
  Target: ATXN1; (+) strand; PAM type: YTN; PAM sequence: TTT
acctttctcagcatttcaca

SEQ ID NO: 256273 - DNA, 20 bp, Artificial Sequence
  Description of Artificial Sequence: Synthetic oligonucleotide
  Target: ATXN1; (+) strand; PAM type: YTN; PAM sequence: TTA
cctttctcagcatttcacaa

SEQ ID NO: 256274 - DNA, 20 bp, Artificial Sequence
  Description of Artificial Sequence: Synthetic oligonucleotide
  Target: ATXN1; (+) strand; PAM type: YTN; PAM sequence: CTT
tctcagcatttcacaagtta

SEQ ID NO: 256275 - DNA, 20 bp, Artificial Sequence
  Description of Artificial Sequence: Synthetic oligonucleotide
  Target: ATXN1; (+) strand; PAM type: YTN; PAM sequence: TTT
ctcagcatttcacaagttac

SEQ ID NO: 256276 - DNA, 20 bp, Artificial Sequence
  Description of Artificial Sequence: Synthetic oligonucleotide
  Target: ATXN1; (+) strand; PAM type: YTN; PAM sequence: TTC
tcagcatttcacaagttact

SEQ ID NO: 256277 - DNA, 20 bp, Artificial Sequence
  Description of Artificial Sequence: Synthetic oligonucleotide
  Target: ATXN1; (+) strand; PAM type: YTN; PAM sequence: CTC
agcatttcacaagttacttc

SEQ ID NO: 256278 - DNA, 20 bp, Artificial Sequence
  Description of Artificial Sequence: Synthetic oligonucleotide
  Target: ATXN1; (+) strand; PAM type: YTN; PAM sequence: TTT
cacaagttacttcctccttc

SEQ ID NO: 256279 - DNA, 20 bp, Artificial Sequence
  Description of Artificial Sequence: Synthetic oligonucleotide
  Target: ATXN1; (+) strand; PAM type: YTN; PAM sequence: TTC
acaagttacttcctccttcc

SEQ ID NO: 256280 - DNA, 20 bp, Artificial Sequence
  Description of Artificial Sequence: Synthetic oligonucleotide
  Target: ATXN1; (+) strand; PAM type: YTN; PAM sequence: TTA
cttcctccttcctttgttct

SEQ ID NO: 256281 - DNA, 20 bp, Artificial Sequence
  Description of Artificial Sequence: Synthetic oligonucleotide
  Target: ATXN1; (+) strand; PAM type: YTN; PAM sequence: CTT
cctccttcctttgttctctt

SEQ ID NO: 256282 - DNA, 20 bp, Artificial Sequence
  Description of Artificial Sequence: Synthetic oligonucleotide
  Target: ATXN1; (+) strand; PAM type: YTN; PAM sequence: TTC
ctccttcctttgttctcttc

SEQ ID NO: 256283 - DNA, 20 bp, Artificial Sequence
  Description of Artificial Sequence: Synthetic oligonucleotide
  Target: ATXN1; (+) strand; PAM type: YTN; PAM sequence: CTC
cttcctttgttctcttctgc

SEQ ID NO: 256284 - DNA, 20 bp, Artificial Sequence
  Description of Artificial Sequence: Synthetic oligonucleotide
  Target: ATXN1; (+) strand; PAM type: YTN; PAM sequence: CTT
cctttgttctcttctgcttt

SEQ ID NO: 256285 - DNA, 20 bp, Artificial Sequence
  Description of Artificial Sequence: Synthetic oligonucleotide
  Target: ATXN1; (+) strand; PAM type: YTN; PAM sequence: TTC
ctttgttctcttctgctttt

SEQ ID NO: 256286 - DNA, 20 bp, Artificial Sequence
  Description of Artificial Sequence: Synthetic oligonucleotide
  Target: ATXN1; (+) strand; PAM type: YTN; PAM sequence: CTT
tgttctcttctgcttttgct

SEQ ID NO: 256287 - DNA, 20 bp, Artificial Sequence
  Description of Artificial Sequence: Synthetic oligonucleotide
  Target: ATXN1; (+) strand; PAM type: YTN; PAM sequence: TTT
gttctcttctgcttttgctg

SEQ ID NO: 256288 - DNA, 20 bp, Artificial Sequence
  Description of Artificial Sequence: Synthetic oligonucleotide
  Target: ATXN1; (+) strand; PAM type: YTN; PAM sequence: TTG
ttctcttctgcttttgctgc

SEQ ID NO: 256289 - DNA, 20 bp, Artificial Sequence
  Description of Artificial Sequence: Synthetic oligonucleotide
  Target: ATXN1; (+) strand; PAM type: YTN; PAM sequence: TTC
tcttctgcttttgctgcttt

SEQ ID NO: 256290 - DNA, 20 bp, Artificial Sequence
  Description of Artificial Sequence: Synthetic oligonucleotide
  Target: ATXN1; (+) strand; PAM type: YTN; PAM sequence: CTC
ttctgcttttgctgctttta

SEQ ID NO: 256291 - DNA, 20 bp, Artificial Sequence
  Description of Artificial Sequence: Synthetic oligonucleotide
  Target: ATXN1; (+) strand; PAM type: YTN; PAM sequence: CTT
ctgcttttgctgcttttaaa

SEQ ID NO: 256292 - DNA, 20 bp, Artificial Sequence
  Description of Artificial Sequence: Synthetic oligonucleotide
  Target: ATXN1; (+) strand; PAM type: YTN; PAM sequence: TTC
tgcttttgctgcttttaaaa

SEQ ID NO: 256293 - DNA, 20 bp, Artificial Sequence
  Description of Artificial Sequence: Synthetic oligonucleotide
  Target: ATXN1; (+) strand; PAM type: YTN; PAM sequence: CTG
cttttgctgcttttaaaaag

SEQ ID NO: 256294 - DNA, 20 bp, Artificial Sequence
  Description of Artificial Sequence: Synthetic oligonucleotide
  Target: ATXN1; (+) strand; PAM type: YTN; PAM sequence: CTT
ttgctgcttttaaaaagttc

SEQ ID NO: 256295 - DNA, 20 bp, Artificial Sequence
  Description of Artificial Sequence: Synthetic oligonucleotide
  Target: ATXN1; (+) strand; PAM type: YTN; PAM sequence: TTT
tgctgcttttaaaaagttct

SEQ ID NO: 256296 - DNA, 20 bp, Artificial Sequence
  Description of Artificial Sequence: Synthetic oligonucleotide
  Target: ATXN1; (+) strand; PAM type: YTN; PAM sequence: TTT
gctgcttttaaaaagttcta

SEQ ID NO: 256297 - DNA, 20 bp, Artificial Sequence
  Description of Artificial Sequence: Synthetic oligonucleotide
  Target: ATXN1; (+) strand; PAM type: YTN; PAM sequence: TTG
ctgcttttaaaaagttctaa

SEQ ID NO: 256298 - DNA, 20 bp, Artificial Sequence
  Description of Artificial Sequence: Synthetic oligonucleotide
  Target: ATXN1; (+) strand; PAM type: YTN; PAM sequence: CTG
cttttaaaaagttctaagct

SEQ ID NO: 256299 - DNA, 20 bp, Artificial Sequence
  Description of Artificial Sequence: Synthetic oligonucleotide
  Target: ATXN1; (+) strand; PAM type: YTN; PAM sequence: CTT
ttaaaaagttctaagctgct

SEQ ID NO: 256300 - DNA, 20 bp, Artificial Sequence
  Description of Artificial Sequence: Synthetic oligonucleotide
  Target: ATXN1; (+) strand; PAM type: YTN; PAM sequence: TTT
taaaaagttctaagctgcta

SEQ ID NO: 256301 - DNA, 20 bp, Artificial Sequence
  Description of Artificial Sequence: Synthetic oligonucleotide
  Target: ATXN1; (+) strand; PAM type: YTN; PAM sequence: TTT
aaaaagttctaagctgctag

SEQ ID NO: 256302 - DNA, 20 bp, Artificial Sequence
  Description of Artificial Sequence: Synthetic oligonucleotide
  Target: ATXN1; (+) strand; PAM type: YTN; PAM sequence: TTA
aaaagttctaagctgctagc

SEQ ID NO: 256303 - DNA, 20 bp, Artificial Sequence
  Description of Artificial Sequence: Synthetic oligonucleotide
  Target: ATXN1; (+) strand; PAM type: YTN; PAM sequence: TTC
taagctgctagccattcggg

SEQ ID NO: 256304 - DNA, 20 bp, Artificial Sequence
  Description of Artificial Sequence: Synthetic oligonucleotide
  Target: ATXN1; (+) strand; PAM type: YTN; PAM sequence: CTA
agctgctagccattcgggac

SEQ ID NO: 256305 - DNA, 20 bp, Artificial Sequence
  Description of Artificial Sequence: Synthetic oligonucleotide
  Target: ATXN1; (+) strand; PAM type: YTN; PAM sequence: CTG
ctagccattcgggacaaata

SEQ ID NO: 256306 - DNA, 20 bp, Artificial Sequence
  Description of Artificial Sequence: Synthetic oligonucleotide
  Target: ATXN1; (+) strand; PAM type: YTN; PAM sequence: CTA
gccattcgggacaaatacag

SEQ ID NO: 256307 - DNA, 20 bp, Artificial Sequence
  Description of Artificial Sequence: Synthetic oligonucleotide
  Target: ATXN1; (+) strand; PAM type: YTN; PAM sequence: TTC
gggacaaatacagaatgtga

SEQ ID NO: 256308 - DNA, 20 bp, Artificial Sequence
  Description of Artificial Sequence: Synthetic oligonucleotide
  Target: ATXN1; (+) strand; PAM type: YTN; PAM sequence: TTC
cagccaatggaaactggaca

SEQ ID NO: 256309 - DNA, 20 bp, Artificial Sequence
  Description of Artificial Sequence: Synthetic oligonucleotide
  Target: ATXN1; (+) strand; PAM type: YTN; PAM sequence: CTG
gacatagcagtagggtggac

SEQ ID NO: 256310 - DNA, 20 bp, Artificial Sequence
  Description of Artificial Sequence: Synthetic oligonucleotide
  Target: ATXN1; (+) strand; PAM type: YTN; PAM sequence: TTA
taatgaccctgtctcctttg

SEQ ID NO: 256311 - DNA, 20 bp, Artificial Sequence
  Description of Artificial Sequence: Synthetic oligonucleotide
  Target: ATXN1; (+) strand; PAM type: YTN; PAM sequence: CTG
tctcctttgttccgtgtact

SEQ ID NO: 256312 - DNA, 20 bp, Artificial Sequence
  Description of Artificial Sequence: Synthetic oligonucleotide
  Target: ATXN1; (+) strand; PAM type: YTN; PAM sequence: CTC
ctttgttccgtgtactcttg

SEQ ID NO: 256313 - DNA, 20 bp, Artificial Sequence
  Description of Artificial Sequence: Synthetic oligonucleotide
  Target: ATXN1; (+) strand; PAM type: YTN; PAM sequence: CTT
tgttccgtgtactcttgtgg

SEQ ID NO: 256314 - DNA, 20 bp, Artificial Sequence
  Description of Artificial Sequence: Synthetic oligonucleotide
  Target: ATXN1; (+) strand; PAM type: YTN; PAM sequence: TTT
gttccgtgtactcttgtggc

SEQ ID NO: 256315 - DNA, 20 bp, Artificial Sequence
  Description of Artificial Sequence: Synthetic oligonucleotide
  Target: ATXN1; (+) strand; PAM type: YTN; PAM sequence: TTG
ttccgtgtactcttgtggca

SEQ ID NO: 256316 - DNA, 20 bp, Artificial Sequence
  Description of Artificial Sequence: Synthetic oligonucleotide
  Target: ATXN1; (+) strand; PAM type: YTN; PAM sequence: TTC
cgtgtactcttgtggcaaaa

SEQ ID NO: 256317 - DNA, 20 bp, Artificial Sequence
  Description of Artificial Sequence: Synthetic oligonucleotide
  Target: ATXN1; (+) strand; PAM type: YTN; PAM sequence: CTC
ttgtggcaaaactgctggca

SEQ ID NO: 256318 - DNA, 20 bp, Artificial Sequence
  Description of Artificial Sequence: Synthetic oligonucleotide
  Target: ATXN1; (+) strand; PAM type: YTN; PAM sequence: CTT
gtggcaaaactgctggcaag

SEQ ID NO: 256319 - DNA, 20 bp, Artificial Sequence
  Description of Artificial Sequence: Synthetic oligonucleotide
  Target: ATXN1; (+) strand; PAM type: YTN; PAM sequence: TTG
tggcaaaactgctggcaagt

SEQ ID NO: 256320 - DNA, 20 bp, Artificial Sequence
  Description of Artificial Sequence: Synthetic oligonucleotide
  Target: ATXN1; (+) strand; PAM type: YTN; PAM sequence: CTG
ctggcaagtgtaccctttct

SEQ ID NO: 256321 - DNA, 20 bp, Artificial Sequence
  Description of Artificial Sequence: Synthetic oligonucleotide
  Target: ATXN1; (+) strand; PAM type: YTN; PAM sequence: CTG
gcaagtgtaccctttctgca

SEQ ID NO: 256322 - DNA, 20 bp, Artificial Sequence
  Description of Artificial Sequence: Synthetic oligonucleotide
  Target: ATXN1; (+) strand; PAM type: YTN; PAM sequence: CTT
tctgcagaaagtaaaaatgg

SEQ ID NO: 256323 - DNA, 20 bp, Artificial Sequence
  Description of Artificial Sequence: Synthetic oligonucleotide
  Target: ATXN1; (+) strand; PAM type: YTN; PAM sequence: TTT
ctgcagaaagtaaaaatggt

SEQ ID NO: 256324 - DNA, 20 bp, Artificial Sequence
  Description of Artificial Sequence: Synthetic oligonucleotide
  Target: ATXN1; (+) strand; PAM type: YTN; PAM sequence: TTC
tgcagaaagtaaaaatggtc

SEQ ID NO: 256325 - DNA, 20 bp, Artificial Sequence
  Description of Artificial Sequence: Synthetic oligonucleotide
  Target: ATXN1; (+) strand; PAM type: YTN; PAM sequence: CTG
cagaaagtaaaaatggtctt

SEQ ID NO: 256326 - DNA, 20 bp, Artificial Sequence
  Description of Artificial Sequence: Synthetic oligonucleotide
  Target: ATXN1; (+) strand; PAM type: YTN; PAM sequence: CTT
gctgaggaaattaaatttat

SEQ ID NO: 256327 - DNA, 20 bp, Artificial Sequence
  Description of Artificial Sequence: Synthetic oligonucleotide
  Target: ATXN1; (+) strand; PAM type: YTN; PAM sequence: TTG
ctgaggaaattaaatttatg

SEQ ID NO: 256328 - DNA, 20 bp, Artificial Sequence
  Description of Artificial Sequence: Synthetic oligonucleotide
  Target: ATXN1; (+) strand; PAM type: YTN; PAM sequence: CTG
aggaaattaaatttatgttc

SEQ ID NO: 256329 - DNA, 20 bp, Artificial Sequence
  Description of Artificial Sequence: Synthetic oligonucleotide
  Target: ATXN1; (+) strand; PAM type: YTN; PAM sequence: TTA
aatttatgttcaaggtctat

SEQ ID NO: 256330 - DNA, 20 bp, Artificial Sequence
  Description of Artificial Sequence: Synthetic oligonucleotide
  Target: ATXN1; (+) strand; PAM type: YTN; PAM sequence: TTT
atgttcaaggtctatttctt

SEQ ID NO: 256331 - DNA, 20 bp, Artificial Sequence
  Description of Artificial Sequence: Synthetic oligonucleotide
  Target: ATXN1; (+) strand; PAM type: YTN; PAM sequence: TTA
tgttcaaggtctatttcttt

SEQ ID NO: 256332 - DNA, 20 bp, Artificial Sequence
  Description of Artificial Sequence: Synthetic oligonucleotide
  Target: ATXN1; (+) strand; PAM type: YTN; PAM sequence: TTC
aaggtctatttctttacagc

SEQ ID NO: 256333 - DNA, 20 bp, Artificial Sequence
  Description of Artificial Sequence: Synthetic oligonucleotide
  Target: ATXN1; (+) strand; PAM type: YTN; PAM sequence: CTA
tttctttacagcaccaaaga

SEQ ID NO: 256334 - DNA, 20 bp, Artificial Sequence
  Description of Artificial Sequence: Synthetic oligonucleotide
  Target: ATXN1; (+) strand; PAM type: YTN; PAM sequence: TTT
ctttacagcaccaaagaaca

SEQ ID NO: 256335 - DNA, 20 bp, Artificial Sequence
  Description of Artificial Sequence: Synthetic oligonucleotide
  Target: ATXN1; (+) strand; PAM type: YTN; PAM sequence: TTC
tttacagcaccaaagaacaa

SEQ ID NO: 256336 - DNA, 20 bp, Artificial Sequence
  Description of Artificial Sequence: Synthetic oligonucleotide
  Target: ATXN1; (+) strand; PAM type: YTN; PAM sequence: CTT
tacagcaccaaagaacaagc

SEQ ID NO: 256337 - DNA, 20 bp, Artificial Sequence
  Description of Artificial Sequence: Synthetic oligonucleotide
  Target: ATXN1; (+) strand; PAM type: YTN; PAM sequence: TTT
acagcaccaaagaacaagca

SEQ ID NO: 256338 - DNA, 20 bp, Artificial Sequence
  Description of Artificial Sequence: Synthetic oligonucleotide
  Target: ATXN1; (+) strand; PAM type: YTN; PAM sequence: TTA
cagcaccaaagaacaagcat

SEQ ID NO: 256339 - DNA, 20 bp, Artificial Sequence
  Description of Artificial Sequence: Synthetic oligonucleotide
  Target: ATXN1; (+) strand; PAM type: YTN; PAM sequence: TTT
ctaacacttaagatgtgtac

SEQ ID NO: 256340 - DNA, 20 bp, Artificial Sequence
  Description of Artificial Sequence: Synthetic oligonucleotide
  Target: ATXN1; (+) strand; PAM type: YTN; PAM sequence: TTC
taacacttaagatgtgtact

SEQ ID NO: 256341 - DNA, 20 bp, Artificial Sequence
  Description of Artificial Sequence: Synthetic oligonucleotide
  Target: ATXN1; (+) strand; PAM type: YTN; PAM sequence: CTA
acacttaagatgtgtactat

SEQ ID NO: 256342 - DNA, 20 bp, Artificial Sequence
  Description of Artificial Sequence: Synthetic oligonucleotide
  Target: ATXN1; (+) strand; PAM type: YTN; PAM sequence: CTT
aagatgtgtactatggaatc

SEQ ID NO: 256343 - DNA, 20 bp, Artificial Sequence
  Description of Artificial Sequence: Synthetic oligonucleotide
  Target: ATXN1; (+) strand; PAM type: YTN; PAM sequence: TTA
agatgtgtactatggaatca

SEQ ID NO: 256344 - DNA, 20 bp, Artificial Sequence
  Description of Artificial Sequence: Synthetic oligonucleotide
  Target: ATXN1; (+) strand; PAM type: YTN; PAM sequence: CTA
tggaatcagatttgtaaaag

SEQ ID NO: 256345 - DNA, 20 bp, Artificial Sequence
  Description of Artificial Sequence: Synthetic oligonucleotide
  Target: ATXN1; (+) strand; PAM type: YTN; PAM sequence: TTT
gtaaaagttcacagcggcag

SEQ ID NO: 256346 - DNA, 20 bp, Artificial Sequence
  Description of Artificial Sequence: Synthetic oligonucleotide
  Target: ATXN1; (+) strand; PAM type: YTN; PAM sequence: TTG
taaaagttcacagcggcagg

SEQ ID NO: 256347 - DNA, 20 bp, Artificial Sequence
  Description of Artificial Sequence: Synthetic oligonucleotide
  Target: ATXN1; (+) strand; PAM type: YTN; PAM sequence: TTC
acagcggcaggagactagtg

SEQ ID NO: 256348 - DNA, 20 bp, Artificial Sequence
  Description of Artificial Sequence: Synthetic oligonucleotide
  Target: ATXN1; (+) strand; PAM type: YTN; PAM sequence: CTA
gtgatcatccatgaggaagt

SEQ ID NO: 256349 - DNA, 20 bp, Artificial Sequence
  Description of Artificial Sequence: Synthetic oligonucleotide
  Target: ATXN1; (+) strand; PAM type: YTN; PAM sequence: TTA
tagctcagagagataatggg

SEQ ID NO: 256350 - DNA, 20 bp, Artificial Sequence
  Description of Artificial Sequence: Synthetic oligonucleotide
  Target: ATXN1; (+) strand; PAM type: YTN; PAM sequence: CTC
agagagataatgggcatgcc

SEQ ID NO: 256351 - DNA, 20 bp, Artificial Sequence
  Description of Artificial Sequence: Synthetic oligonucleotide
  Target: ATXN1; (+) strand; PAM type: YTN; PAM sequence: CTG
agatcacagagtaatgactg

SEQ ID NO: 256352 - DNA, 20 bp, Artificial Sequence
  Description of Artificial Sequence: Synthetic oligonucleotide
  Target: ATXN1; (+) strand; PAM type: YTN; PAM sequence: CTG
ttaacttggcttcattttaa

SEQ ID NO: 256353 - DNA, 20 bp, Artificial Sequence
  Description of Artificial Sequence: Synthetic oligonucleotide
  Target: ATXN1; (+) strand; PAM type: YTN; PAM sequence: TTA
acttggcttcattttaaaag

SEQ ID NO: 256354 - DNA, 20 bp, Artificial Sequence
  Description of Artificial Sequence: Synthetic oligonucleotide
  Target: ATXN1; (+) strand; PAM type: YTN; PAM sequence: CTT
ggcttcattttaaaagattg

SEQ ID NO: 256355 - DNA, 20 bp, Artificial Sequence
  Description of Artificial Sequence: Synthetic oligonucleotide
  Target: ATXN1; (+) strand; PAM type: YTN; PAM sequence: TTG
gcttcattttaaaagattgt

SEQ ID NO: 256356 - DNA, 20 bp, Artificial Sequence
  Description of Artificial Sequence: Synthetic oligonucleotide
  Target: ATXN1; (+) strand; PAM type: YTN; PAM sequence: CTT
cattttaaaagattgtgttg

SEQ ID NO: 256357 - DNA, 20 bp, Artificial Sequence
  Description of Artificial Sequence: Synthetic oligonucleotide
  Target: ATXN1; (+) strand; PAM type: YTN; PAM sequence: TTC
attttaaaagattgtgttgt

SEQ ID NO: 256358 - DNA, 20 bp, Artificial Sequence
  Description of Artificial Sequence: Synthetic oligonucleotide
  Target: ATXN1; (+) strand; PAM type: YTN; PAM sequence: TTT
taaaagattgtgttgtgggc

SEQ ID NO: 256359 - DNA, 20 bp, Artificial Sequence
  Description of Artificial Sequence: Synthetic oligonucleotide
  Target: ATXN1; (+) strand; PAM type: YTN; PAM sequence: TTT
aaaagattgtgttgtgggca

SEQ ID NO: 256360 - DNA, 20 bp, Artificial Sequence
  Description of Artificial Sequence: Synthetic oligonucleotide
  Target: ATXN1; (+) strand; PAM type: YTN; PAM sequence: TTA
aaagattgtgttgtgggcac

SEQ ID NO: 256361 - DNA, 20 bp, Artificial Sequence
  Description of Artificial Sequence: Synthetic oligonucleotide
  Target: ATXN1; (+) strand; PAM type: YTN; PAM sequence: TTG
tgttgtgggcactaccctta

SEQ ID NO: 256362 - DNA, 20 bp, Artificial Sequence
  Description of Artificial Sequence: Synthetic oligonucleotide
  Target: ATXN1; (+) strand; PAM type: YTN; PAM sequence: TTG
tgggcactacccttatctta

SEQ ID NO: 256363 - DNA, 20 bp, Artificial Sequence
  Description of Artificial Sequence: Synthetic oligonucleotide
  Target: ATXN1; (+) strand; PAM type: YTN; PAM sequence: CTA
cccttatcttaaagtcttaa

SEQ ID NO: 256364 - DNA, 20 bp, Artificial Sequence
  Description of Artificial Sequence: Synthetic oligonucleotide
  Target: ATXN1; (+) strand; PAM type: YTN; PAM sequence: CTT
atcttaaagtcttaacttca

SEQ ID NO: 256365 - DNA, 20 bp, Artificial Sequence
  Description of Artificial Sequence: Synthetic oligonucleotide
  Target: ATXN1; (+) strand; PAM type: YTN; PAM sequence: TTA
tcttaaagtcttaacttcat

SEQ ID NO: 256366 - DNA, 20 bp, Artificial Sequence
  Description of Artificial Sequence: Synthetic oligonucleotide
  Target: ATXN1; (+) strand; PAM type: YTN; PAM sequence: CTT
aaagtcttaacttcatgtta

SEQ ID NO: 256367 - DNA, 20 bp, Artificial Sequence
  Description of Artificial Sequence: Synthetic oligonucleotide
  Target: ATXN1; (+) strand; PAM type: YTN; PAM sequence: TTA
aagtcttaacttcatgttaa

SEQ ID NO: 256368 - DNA, 20 bp, Artificial Sequence
  Description of Artificial Sequence: Synthetic oligonucleotide
  Target: ATXN1; (+) strand; PAM type: YTN; PAM sequence: CTT
aacttcatgttaatgaaaca

SEQ ID NO: 256369 - DNA, 20 bp, Artificial Sequence
  Description of Artificial Sequence: Synthetic oligonucleotide
  Target: ATXN1; (+) strand; PAM type: YTN; PAM sequence: TTA
acttcatgttaatgaaacaa

SEQ ID NO: 256370 - DNA, 20 bp, Artificial Sequence
  Description of Artificial Sequence: Synthetic oligonucleotide
  Target: ATXN1; (+) strand; PAM type: YTN; PAM sequence: CTT
catgttaatgaaacaaatac

SEQ ID NO: 256371 - DNA, 20 bp, Artificial Sequence
  Description of Artificial Sequence: Synthetic oligonucleotide
  Target: ATXN1; (+) strand; PAM type: YTN; PAM sequence: TTC
atgttaatgaaacaaataca

SEQ ID NO: 256372 - DNA, 20 bp, Artificial Sequence
  Description of Artificial Sequence: Synthetic oligonucleotide
  Target: ATXN1; (+) strand; PAM type: YTN; PAM sequence: TTA
atgaaacaaatacattatta

SEQ ID NO: 256373 - DNA, 20 bp, Artificial Sequence
  Description of Artificial Sequence: Synthetic oligonucleotide
  Target: ATXN1; (+) strand; PAM type: YTN; PAM sequence: TTA
ttaaattttttaaatgttct

SEQ ID NO: 256374 - DNA, 20 bp, Artificial Sequence
  Description of Artificial Sequence: Synthetic oligonucleotide
  Target: ATXN1; (+) strand; PAM type: YTN; PAM sequence: TTA
aattttttaaatgttctcct

SEQ ID NO: 256375 - DNA, 20 bp, Artificial Sequence
  Description of Artificial Sequence: Synthetic oligonucleotide
  Target: ATXN1; (+) strand; PAM type: YTN; PAM sequence: TTT
tttaaatgttctcctctaag

SEQ ID NO: 256376 - DNA, 20 bp, Artificial Sequence
  Description of Artificial Sequence: Synthetic oligonucleotide
  Target: ATXN1; (+) strand; PAM type: YTN; PAM sequence: TTT
ttaaatgttctcctctaagg

SEQ ID NO: 256377 - DNA, 20 bp, Artificial Sequence
  Description of Artificial Sequence: Synthetic oligonucleotide
  Target: ATXN1; (+) strand; PAM type: YTN; PAM sequence: TTT
taaatgttctcctctaagga

SEQ ID NO: 256378 - DNA, 20 bp, Artificial Sequence
  Description of Artificial Sequence: Synthetic oligonucleotide
  Target: ATXN1; (+) strand; PAM type: YTN; PAM sequence: TTT
aaatgttctcctctaaggat

SEQ ID NO: 256379 - DNA, 20 bp, Artificial Sequence
  Description of Artificial Sequence: Synthetic oligonucleotide
  Target: ATXN1; (+) strand; PAM type: YTN; PAM sequence: TTA
aatgttctcctctaaggata

SEQ ID NO: 256380 - DNA, 20 bp, Artificial Sequence
  Description of Artificial Sequence: Synthetic oligonucleotide
  Target: ATXN1; (+) strand; PAM type: YTN; PAM sequence: TTC
tcctctaaggatatgccttt

SEQ ID NO: 256381 - DNA, 20 bp, Artificial Sequence
  Description of Artificial Sequence: Synthetic oligonucleotide
  Target: ATXN1; (+) strand; PAM type: YTN; PAM sequence: CTC
ctctaaggatatgcctttat

SEQ ID NO: 256382 - DNA, 20 bp, Artificial Sequence
  Description of Artificial Sequence: Synthetic oligonucleotide
  Target: ATXN1; (+) strand; PAM type: YTN; PAM sequence: CTC
taaggatatgcctttatgat

SEQ ID NO: 256383 - DNA, 20 bp, Artificial Sequence
  Description of Artificial Sequence: Synthetic oligonucleotide
  Target: ATXN1; (+) strand; PAM type: YTN; PAM sequence: CTA
aggatatgcctttatgattc

SEQ ID NO: 256384 - DNA, 20 bp, Artificial Sequence
  Description of Artificial Sequence: Synthetic oligonucleotide
  Target: ATXN1; (+) strand; PAM type: YTN; PAM sequence: CTT
tatgattcaaaataatatgg

SEQ ID NO: 256385 - DNA, 20 bp, Artificial Sequence
  Description of Artificial Sequence: Synthetic oligonucleotide
  Target: ATXN1; (+) strand; PAM type: YTN; PAM sequence: TTT
atgattcaaaataatatggt

SEQ ID NO: 256386 - DNA, 20 bp, Artificial Sequence
  Description of Artificial Sequence: Synthetic oligonucleotide
  Target: ATXN1; (+) strand; PAM type: YTN; PAM sequence: TTA
tgattcaaaataatatggtc

SEQ ID NO: 256387 - DNA, 20 bp, Artificial Sequence
  Description of Artificial Sequence: Synthetic oligonucleotide
  Target: ATXN1; (+) strand; PAM type: YTN; PAM sequence: TTC
aaaataatatggtcggaatg

SEQ ID NO: 256388 - DNA, 20 bp, Artificial Sequence
  Description of Artificial Sequence: Synthetic oligonucleotide
  Target: ATXN1; (+) strand; PAM type: YTN; PAM sequence: CTG
ctgtgtccaccagtgcctaa

SEQ ID NO: 256389 - DNA, 20 bp, Artificial Sequence
  Description of Artificial Sequence: Synthetic oligonucleotide
  Target: ATXN1; (+) strand; PAM type: YTN; PAM sequence: CTG
tgtccaccagtgcctaactg

SEQ ID NO: 256390 - DNA, 20 bp, Artificial Sequence
  Description of Artificial Sequence: Synthetic oligonucleotide
  Target: ATXN1; (+) strand; PAM type: YTN; PAM sequence: CTA
actggacatttaaatggcag

SEQ ID NO: 256391 - DNA, 20 bp, Artificial Sequence
  Description of Artificial Sequence: Synthetic oligonucleotide
  Target: ATXN1; (+) strand; PAM type: YTN; PAM sequence: CTG
gacatttaaatggcagaagc

SEQ ID NO: 256392 - DNA, 20 bp, Artificial Sequence
  Description of Artificial Sequence: Synthetic oligonucleotide
  Target: ATXN1; (+) strand; PAM type: YTN; PAM sequence: TTT
aaatggcagaagctcttctt

SEQ ID NO: 256393 - DNA, 20 bp, Artificial Sequence
  Description of Artificial Sequence: Synthetic oligonucleotide
  Target: ATXN1; (+) strand; PAM type: YTN; PAM sequence: TTA
aatggcagaagctcttcttc

SEQ ID NO: 256394 - DNA, 20 bp, Artificial Sequence
  Description of Artificial Sequence: Synthetic oligonucleotide
  Target: ATXN1; (+) strand; PAM type: YTN; PAM sequence: CTC
ttcttccaatggcacattga

SEQ ID NO: 256395 - DNA, 20 bp, Artificial Sequence
  Description of Artificial Sequence: Synthetic oligonucleotide
  Target: ATXN1; (+) strand; PAM type: YTN; PAM sequence: CTT
cttccaatggcacattgaaa

SEQ ID NO: 256396 - DNA, 20 bp, Artificial Sequence
  Description of Artificial Sequence: Synthetic oligonucleotide
  Target: ATXN1; (+) strand; PAM type: YTN; PAM sequence: TTC
ttccaatggcacattgaaat

SEQ ID NO: 256397 - DNA, 20 bp, Artificial Sequence
  Description of Artificial Sequence: Synthetic oligonucleotide
  Target: ATXN1; (+) strand; PAM type: YTN; PAM sequence: CTT
ccaatggcacattgaaatca

SEQ ID NO: 256398 - DNA, 20 bp, Artificial Sequence
  Description of Artificial Sequence: Synthetic oligonucleotide
  Target: ATXN1; (+) strand; PAM type: YTN; PAM sequence: TTC
caatggcacattgaaatcac

SEQ ID NO: 256399 - DNA, 20 bp, Artificial Sequence
  Description of Artificial Sequence: Synthetic oligonucleotide
  Target: ATXN1; (+) strand; PAM type: YTN; PAM sequence: TTG
aaatcactgagagatgacct

SEQ ID NO: 256400 - DNA, 20 bp, Artificial Sequence
  Description of Artificial Sequence: Synthetic oligonucleotide
  Target: ATXN1; (+) strand; PAM type: YTN; PAM sequence: CTG
agagatgaccttctcatagt

SEQ ID NO: 256401 - DNA, 20 bp, Artificial Sequence
  Description of Artificial Sequence: Synthetic oligonucleotide
  Target: ATXN1; (+) strand; PAM type: YTN; PAM sequence: CTT
ctcatagtaaggctgtccta

SEQ ID NO: 256402 - DNA, 20 bp, Artificial Sequence
  Description of Artificial Sequence: Synthetic oligonucleotide
  Target: ATXN1; (+) strand; PAM type: YTN; PAM sequence: TTC
tcatagtaaggctgtcctaa

SEQ ID NO: 256403 - DNA, 20 bp, Artificial Sequence
  Description of Artificial Sequence: Synthetic oligonucleotide
  Target: ATXN1; (+) strand; PAM type: YTN; PAM sequence: CTC
atagtaaggctgtcctaagg

SEQ ID NO: 256404 - DNA, 20 bp, Artificial Sequence
  Description of Artificial Sequence: Synthetic oligonucleotide
  Target: ATXN1; (+) strand; PAM type: YTN; PAM sequence: CTG
tcctaaggaatatgttgaaa

SEQ ID NO: 256405 - DNA, 20 bp, Artificial Sequence
  Description of Artificial Sequence: Synthetic oligonucleotide
  Target: ATXN1; (+) strand; PAM type: YTN; PAM sequence: CTA
aggaatatgttgaaacatgc

SEQ ID NO: 256406 - DNA, 20 bp, Artificial Sequence
  Description of Artificial Sequence: Synthetic oligonucleotide
  Target: ATXN1; (+) strand; PAM type: YTN; PAM sequence: TTG
aaacatgctcctcaaaagta

SEQ ID NO: 256407 - DNA, 20 bp, Artificial Sequence
  Description of Artificial Sequence: Synthetic oligonucleotide
  Target: ATXN1; (+) strand; PAM type: YTN; PAM sequence: CTC
ctcaaaagtatctgtatcaa

SEQ ID NO: 256408 - DNA, 20 bp, Artificial Sequence
  Description of Artificial Sequence: Synthetic oligonucleotide
  Target: ATXN1; (+) strand; PAM type: YTN; PAM sequence: CTC
aaaagtatctgtatcaactt

SEQ ID NO: 256409 - DNA, 20 bp, Artificial Sequence
  Description of Artificial Sequence: Synthetic oligonucleotide
  Target: ATXN1; (+) strand; PAM type: YTN; PAM sequence: CTG
tatcaacttttggatgctga

SEQ ID NO: 256410 - DNA, 20 bp, Artificial Sequence
  Description of Artificial Sequence: Synthetic oligonucleotide
  Target: ATXN1; (+) strand; PAM type: YTN; PAM sequence: CTT
ttggatgctgaagctggttt

SEQ ID NO: 256411 - DNA, 20 bp, Artificial Sequence
  Description of Artificial Sequence: Synthetic oligonucleotide
  Target: ATXN1; (+) strand; PAM type: YTN; PAM sequence: TTT
tggatgctgaagctggtttt

SEQ ID NO: 256412 - DNA, 20 bp, Artificial Sequence
  Description of Artificial Sequence: Synthetic oligonucleotide
  Target: ATXN1; (+) strand; PAM type: YTN; PAM sequence: TTT
ggatgctgaagctggtttta

SEQ ID NO: 256413 - DNA, 20 bp, Artificial Sequence
  Description of Artificial Sequence: Synthetic oligonucleotide
  Target: ATXN1; (+) strand; PAM type: YTN; PAM sequence: TTG
gatgctgaagctggttttac

SEQ ID NO: 256414 - DNA, 20 bp, Artificial Sequence
  Description of Artificial Sequence: Synthetic oligonucleotide
  Target: ATXN1; (+) strand; PAM type: YTN; PAM sequence: CTG
aagctggttttactcacaac

SEQ ID NO: 256415 - DNA, 20 bp, Artificial Sequence
  Description of Artificial Sequence: Synthetic oligonucleotide
  Target: ATXN1; (+) strand; PAM type: YTN; PAM sequence: CTG
gttttactcacaacatctgg

SEQ ID NO: 256416 - DNA, 20 bp, Artificial Sequence
  Description of Artificial Sequence: Synthetic oligonucleotide
  Target: ATXN1; (+) strand; PAM type: YTN; PAM sequence: TTT
tactcacaacatctggtttg

SEQ ID NO: 256417 - DNA, 20 bp, Artificial Sequence
  Description of Artificial Sequence: Synthetic oligonucleotide
  Target: ATXN1; (+) strand; PAM type: YTN; PAM sequence: TTT
actcacaacatctggtttgc

SEQ ID NO: 256418 - DNA, 20 bp, Artificial Sequence
  Description of Artificial Sequence: Synthetic oligonucleotide
  Target: ATXN1; (+) strand; PAM type: YTN; PAM sequence: TTA
ctcacaacatctggtttgct

SEQ ID NO: 256419 - DNA, 20 bp, Artificial Sequence
  Description of Artificial Sequence: Synthetic oligonucleotide
  Target: ATXN1; (+) strand; PAM type: YTN; PAM sequence: CTC
acaacatctggtttgcttat

SEQ ID NO: 256420 - DNA, 20 bp, Artificial Sequence
  Description of Artificial Sequence: Synthetic oligonucleotide
  Target: ATXN1; (+) strand; PAM type: YTN; PAM sequence: CTG
gtttgcttatatagcatatc

SEQ ID NO: 256421 - DNA, 20 bp, Artificial Sequence
  Description of Artificial Sequence: Synthetic oligonucleotide
  Target: ATXN1; (+) strand; PAM type: YTN; PAM sequence: TTT
gcttatatagcatatcaatt

SEQ ID NO: 256422 - DNA, 20 bp, Artificial Sequence
  Description of Artificial Sequence: Synthetic oligonucleotide
  Target: ATXN1; (+) strand; PAM type: YTN; PAM sequence: TTG
cttatatagcatatcaattc

SEQ ID NO: 256423 - DNA, 20 bp, Artificial Sequence
  Description of Artificial Sequence: Synthetic oligonucleotide
  Target: ATXN1; (+) strand; PAM type: YTN; PAM sequence: CTT
atatagcatatcaattcaat

SEQ ID NO: 256424 - DNA, 20 bp, Artificial Sequence
  Description of Artificial Sequence: Synthetic oligonucleotide
  Target: ATXN1; (+) strand; PAM type: YTN; PAM sequence: TTA
tatagcatatcaattcaatt

SEQ ID NO: 256425 - DNA, 20 bp, Artificial Sequence
  Description of Artificial Sequence: Synthetic oligonucleotide
  Target: ATXN1; (+) strand; PAM type: YTN; PAM sequence: TTC
aattagatattaaaaggtac

SEQ ID NO: 256426 - DNA, 20 bp, Artificial Sequence
  Description of Artificial Sequence: Synthetic oligonucleotide
  Target: ATXN1; (+) strand; PAM type: YTN; PAM sequence: TTA
gatattaaaaggtacttatt

SEQ ID NO: 256427 - DNA, 20 bp, Artificial Sequence
  Description of Artificial Sequence: Synthetic oligonucleotide
  Target: ATXN1; (+) strand; PAM type: YTN; PAM sequence: TTA
aaaggtacttatttagttgg

SEQ ID NO: 256428 - DNA, 20 bp, Artificial Sequence
  Description of Artificial Sequence: Synthetic oligonucleotide
  Target: ATXN1; (+) strand; PAM type: YTN; PAM sequence: CTT
atttagttggtgaagttgaa

SEQ ID NO: 256429 - DNA, 20 bp, Artificial Sequence
  Description of Artificial Sequence: Synthetic oligonucleotide
  Target: ATXN1; (+) strand; PAM type: YTN; PAM sequence: TTA
tttagttggtgaagttgaaa

SEQ ID NO: 256430 - DNA, 20 bp, Artificial Sequence
  Description of Artificial Sequence: Synthetic oligonucleotide
  Target: ATXN1; (+) strand; PAM type: YTN; PAM sequence: TTT
agttggtgaagttgaaatgc

SEQ ID NO: 256431 - DNA, 20 bp, Artificial Sequence
  Description of Artificial Sequence: Synthetic oligonucleotide
  Target: ATXN1; (+) strand; PAM type: YTN; PAM sequence: TTA
gttggtgaagttgaaatgca

SEQ ID NO: 256432 - DNA, 20 bp, Artificial Sequence
  Description of Artificial Sequence: Synthetic oligonucleotide
  Target: ATXN1; (+) strand; PAM type: YTN; PAM sequence: TTG
gtgaagttgaaatgcagaga

SEQ ID NO: 256433 - DNA, 20 bp, Artificial Sequence
  Description of Artificial Sequence: Synthetic oligonucleotide
  Target: ATXN1; (+) strand; PAM type: YTN; PAM sequence: TTG
aaatgcagagaggagactaa

SEQ ID NO: 256434 - DNA, 20 bp, Artificial Sequence
  Description of Artificial Sequence: Synthetic oligonucleotide
  Target: ATXN1; (+) strand; PAM type: YTN; PAM sequence: CTA
aaattcccaggggcacagtt

SEQ ID NO: 256435 - DNA, 20 bp, Artificial Sequence
  Description of Artificial Sequence: Synthetic oligonucleotide
  Target: ATXN1; (+) strand; PAM type: YTN; PAM sequence: TTC
ccaggggcacagttgtggag

SEQ ID NO: 256436 - DNA, 20 bp, Artificial Sequence
  Description of Artificial Sequence: Synthetic oligonucleotide
  Target: ATXN1; (+) strand; PAM type: YTN; PAM sequence: TTG
tggagttaggctagaaagct

SEQ ID NO: 256437 - DNA, 20 bp, Artificial Sequence
  Description of Artificial Sequence: Synthetic oligonucleotide
  Target: ATXN1; (+) strand; PAM type: YTN; PAM sequence: TTA
ggctagaaagctgtgctctt

SEQ ID NO: 256438 - DNA, 20 bp, Artificial Sequence
  Description of Artificial Sequence: Synthetic oligonucleotide
  Target: ATXN1; (+) strand; PAM type: YTN; PAM sequence: CTA
gaaagctgtgctcttaaatc

SEQ ID NO: 256439 - DNA, 20 bp, Artificial Sequence
  Description of Artificial Sequence: Synthetic oligonucleotide
  Target: ATXN1; (+) strand; PAM type: YTN; PAM sequence: CTG
tgctcttaaatcccaggcca

SEQ ID NO: 256440 - DNA, 20 bp, Artificial Sequence
  Description of Artificial Sequence: Synthetic oligonucleotide
  Target: ATXN1; (+) strand; PAM type: YTN; PAM sequence: CTC
ttaaatcccaggccagtagc

SEQ ID NO: 256441 - DNA, 20 bp, Artificial Sequence
  Description of Artificial Sequence: Synthetic oligonucleotide
  Target: ATXN1; (+) strand; PAM type: YTN; PAM sequence: CTT
aaatcccaggccagtagctt

SEQ ID NO: 256442 - DNA, 20 bp, Artificial Sequence
  Description of Artificial Sequence: Synthetic oligonucleotide
  Target: ATXN1; (+) strand; PAM type: YTN; PAM sequence: TTA
aatcccaggccagtagcttt

SEQ ID NO: 256443 - DNA, 20 bp, Artificial Sequence
  Description of Artificial Sequence: Synthetic oligonucleotide
  Target: ATXN1; (+) strand; PAM type: YTN; PAM sequence: CTT
ttcatcattagactatgtag

SEQ ID NO: 256444 - DNA, 20 bp, Artificial Sequence
  Description of Artificial Sequence: Synthetic oligonucleotide
  Target: ATXN1; (+) strand; PAM type: YTN; PAM sequence: TTT
tcatcattagactatgtagc

SEQ ID NO: 256445 - DNA, 20 bp, Artificial Sequence
  Description of Artificial Sequence: Synthetic oligonucleotide
  Target: ATXN1; (+) strand; PAM type: YTN; PAM sequence: TTT
catcattagactatgtagct

SEQ ID NO: 256446 - DNA, 20 bp, Artificial Sequence
  Description of Artificial Sequence: Synthetic oligonucleotide
  Target: ATXN1; (+) strand; PAM type: YTN; PAM sequence: TTC
atcattagactatgtagcta

SEQ ID NO: 256447 - DNA, 20 bp, Artificial Sequence
  Description of Artificial Sequence: Synthetic oligonucleotide
  Target: ATXN1; (+) strand; PAM type: YTN; PAM sequence: TTA
gactatgtagctagaagccc

SEQ ID NO: 256448 - DNA, 20 bp, Artificial Sequence
  Description of Artificial Sequence: Synthetic oligonucleotide
  Target: ATXN1; (+) strand; PAM type: YTN; PAM sequence: CTA
tgtagctagaagccccattg

SEQ ID NO: 256449 - DNA, 20 bp, Artificial Sequence
  Description of Artificial Sequence: Synthetic oligonucleotide
  Target: ATXN1; (+) strand; PAM type: YTN; PAM sequence: CTA
gaagccccattggagggtct

SEQ ID NO: 256450 - DNA, 20 bp, Artificial Sequence
  Description of Artificial Sequence: Synthetic oligonucleotide
  Target: ATXN1; (+) strand; PAM type: YTN; PAM sequence: TTG
gagggtctgagctgcagaca

SEQ ID NO: 256451 - DNA, 20 bp, Artificial Sequence
  Description of Artificial Sequence: Synthetic oligonucleotide
  Target: ATXN1; (+) strand; PAM type: YTN; PAM sequence: CTG
agctgcagacacacggttaa

SEQ ID NO: 256452 - DNA, 20 bp, Artificial Sequence
  Description of Artificial Sequence: Synthetic oligonucleotide
  Target: ATXN1; (+) strand; PAM type: YTN; PAM sequence: CTG
cagacacacggttaacccag

SEQ ID NO: 256453 - DNA, 20 bp, Artificial Sequence
  Description of Artificial Sequence: Synthetic oligonucleotide
  Target: ATXN1; (+) strand; PAM type: YTN; PAM sequence: TTA
acccaggcaaatcaggtctc

SEQ ID NO: 256454 - DNA, 20 bp, Artificial Sequence
  Description of Artificial Sequence: Synthetic oligonucleotide
  Target: ATXN1; (+) strand; PAM type: YTN; PAM sequence: CTC
atctgggcatctctggatac

SEQ ID NO: 256455 - DNA, 20 bp, Artificial Sequence
  Description of Artificial Sequence: Synthetic oligonucleotide
  Target: ATXN1; (+) strand; PAM type: YTN; PAM sequence: CTG
ggcatctctggatacgtctg

SEQ ID NO: 256456 - DNA, 20 bp, Artificial Sequence
  Description of Artificial Sequence: Synthetic oligonucleotide
  Target: ATXN1; (+) strand; PAM type: YTN; PAM sequence: CTC
tggatacgtctgggtggcct

SEQ ID NO: 256457 - DNA, 20 bp, Artificial Sequence
  Description of Artificial Sequence: Synthetic oligonucleotide
  Target: ATXN1; (+) strand; PAM type: YTN; PAM sequence: CTG
gatacgtctgggtggcctgt

SEQ ID NO: 256458 - DNA, 20 bp, Artificial Sequence
  Description of Artificial Sequence: Synthetic oligonucleotide
  Target: ATXN1; (+) strand; PAM type: YTN; PAM sequence: CTG
ggtggcctgtgaagtggatg

SEQ ID NO: 256459 - DNA, 20 bp, Artificial Sequence
  Description of Artificial Sequence: Synthetic oligonucleotide
  Target: ATXN1; (+) strand; PAM type: YTN; PAM sequence: CTG
tgaagtggatggatgttctg

SEQ ID NO: 256460 - DNA, 20 bp, Artificial Sequence
  Description of Artificial Sequence: Synthetic oligonucleotide
  Target: ATXN1; (+) strand; PAM type: YTN; PAM sequence: TTC
tgtttgtgtggaggcctgtt

SEQ ID NO: 256461 - DNA, 20 bp, Artificial Sequence
  Description of Artificial Sequence: Synthetic oligonucleotide
  Target: ATXN1; (+) strand; PAM type: YTN; PAM sequence: CTG
tttgtgtggaggcctgtttg

SEQ ID NO: 256462 - DNA, 20 bp, Artificial Sequence
  Description of Artificial Sequence: Synthetic oligonucleotide
  Target: ATXN1; (+) strand; PAM type: YTN; PAM sequence: TTT
gtgtggaggcctgtttgatg

SEQ ID NO: 256463 - DNA, 20 bp, Artificial Sequence
  Description of Artificial Sequence: Synthetic oligonucleotide
  Target: ATXN1; (+) strand; PAM type: YTN; PAM sequence: TTG
tgtggaggcctgtttgatga

SEQ ID NO: 256464 - DNA, 20 bp, Artificial Sequence
  Description of Artificial Sequence: Synthetic oligonucleotide
  Target: ATXN1; (+) strand; PAM type: YTN; PAM sequence: CTG
tttgatgagcctcctggaag

SEQ ID NO: 256465 - DNA, 20 bp, Artificial Sequence
  Description of Artificial Sequence: Synthetic oligonucleotide
  Target: ATXN1; (+) strand; PAM type: YTN; PAM sequence: TTT
gatgagcctcctggaagaaa

SEQ ID NO: 256466 - DNA, 20 bp, Artificial Sequence
  Description of Artificial Sequence: Synthetic oligonucleotide
  Target: ATXN1; (+) strand; PAM type: YTN; PAM sequence: TTG
atgagcctcctggaagaaaa

SEQ ID NO: 256467 - DNA, 20 bp, Artificial Sequence
  Description of Artificial Sequence: Synthetic oligonucleotide
  Target: ATXN1; (+) strand; PAM type: YTN; PAM sequence: CTC
ctggaagaaaaagaaacagg

SEQ ID NO: 256468 - DNA, 20 bp, Artificial Sequence
  Description of Artificial Sequence: Synthetic oligonucleotide
  Target: ATXN1; (+) strand; PAM type: YTN; PAM sequence: CTG
gaagaaaaagaaacaggcag

SEQ ID NO: 256469 - DNA, 20 bp, Artificial Sequence
  Description of Artificial Sequence: Synthetic oligonucleotide
  Target: ATXN1; (+) strand; PAM type: YTN; PAM sequence: CTG
ccagggataatggtgccatg

SEQ ID NO: 256470 - DNA, 20 bp, Artificial Sequence
  Description of Artificial Sequence: Synthetic oligonucleotide
  Target: ATXN1; (+) strand; PAM type: YTN; PAM sequence: CTG
aagtccagtaattcttcaac

SEQ ID NO: 256471 - DNA, 20 bp, Artificial Sequence
  Description of Artificial Sequence: Synthetic oligonucleotide
  Target: ATXN1; (+) strand; PAM type: YTN; PAM sequence: TTC
ttcaaccttcttagcagctt

SEQ ID NO: 256472 - DNA, 20 bp, Artificial Sequence
  Description of Artificial Sequence: Synthetic oligonucleotide
  Target: ATXN1; (+) strand; PAM type: YTN; PAM sequence: CTT
caaccttcttagcagcttgc

SEQ ID NO: 256473 - DNA, 20 bp, Artificial Sequence
  Description of Artificial Sequence: Synthetic oligonucleotide
  Target: ATXN1; (+) strand; PAM type: YTN; PAM sequence: TTC
aaccttcttagcagcttgct

SEQ ID NO: 256474 - DNA, 20 bp, Artificial Sequence
  Description of Artificial Sequence: Synthetic oligonucleotide
  Target: ATXN1; (+) strand; PAM type: YTN; PAM sequence: CTT
cttagcagcttgctgtgtga

SEQ ID NO: 256475 - DNA, 20 bp, Artificial Sequence
  Description of Artificial Sequence: Synthetic oligonucleotide
  Target: ATXN1; (+) strand; PAM type: YTN; PAM sequence: TTC
ttagcagcttgctgtgtgag

SEQ ID NO: 256476 - DNA, 20 bp, Artificial Sequence
  Description of Artificial Sequence: Synthetic oligonucleotide
  Target: ATXN1; (+) strand; PAM type: YTN; PAM sequence: CTT
agcagcttgctgtgtgagga

SEQ ID NO: 256477 - DNA, 20 bp, Artificial Sequence
  Description of Artificial Sequence: Synthetic oligonucleotide
  Target: ATXN1; (+) strand; PAM type: YTN; PAM sequence: TTA
gcagcttgctgtgtgaggaa

SEQ ID NO: 256478 - DNA, 20 bp, Artificial Sequence
  Description of Artificial Sequence: Synthetic oligonucleotide
  Target: ATXN1; (+) strand; PAM type: YTN; PAM sequence: CTT
gctgtgtgaggaaggaactg

SEQ ID NO: 256479 - DNA, 20 bp, Artificial Sequence
  Description of Artificial Sequence: Synthetic oligonucleotide
  Target: ATXN1; (+) strand; PAM type: YTN; PAM sequence: TTG
ctgtgtgaggaaggaactga

SEQ ID NO: 256480 - DNA, 20 bp, Artificial Sequence
  Description of Artificial Sequence: Synthetic oligonucleotide
  Target: ATXN1; (+) strand; PAM type: YTN; PAM sequence: CTG
tgtgaggaaggaactgaccc

SEQ ID NO: 256481 - DNA, 20 bp, Artificial Sequence
  Description of Artificial Sequence: Synthetic oligonucleotide
  Target: ATXN1; (+) strand; PAM type: YTN; PAM sequence: CTG
acccagagtggttgggttaa

SEQ ID NO: 256482 - DNA, 20 bp, Artificial Sequence
  Description of Artificial Sequence: Synthetic oligonucleotide
  Target: ATXN1; (+) strand; PAM type: YTN; PAM sequence: TTG
ggttaaggtgcatctgctag

SEQ ID NO: 256483 - DNA, 20 bp, Artificial Sequence
  Description of Artificial Sequence: Synthetic oligonucleotide
  Target: ATXN1; (+) strand; PAM type: YTN; PAM sequence: TTA
aggtgcatctgctaggcatg

SEQ ID NO: 256484 - DNA, 20 bp, Artificial Sequence
  Description of Artificial Sequence: Synthetic oligonucleotide
  Target: ATXN1; (+) strand; PAM type: YTN; PAM sequence: CTG
ctaggcatgcgggattgggg

SEQ ID NO: 256485 - DNA, 20 bp, Artificial Sequence
  Description of Artificial Sequence: Synthetic oligonucleotide
  Target: ATXN1; (+) strand; PAM type: YTN; PAM sequence: CTA
ggcatgcgggattgggggca

SEQ ID NO: 256486 - DNA, 20 bp, Artificial Sequence
  Description of Artificial Sequence: Synthetic oligonucleotide
  Target: ATXN1; (+) strand; PAM type: YTN; PAM sequence: TTG
ggggcatgggggtgtcaaca

SEQ ID NO: 256487 - DNA, 20 bp, Artificial Sequence
  Description of Artificial Sequence: Synthetic oligonucleotide
  Target: ATXN1; (+) strand; PAM type: YTN; PAM sequence: TTA
ggaatatctaccaacccagc

SEQ ID NO: 256488 - DNA, 20 bp, Artificial Sequence
  Description of Artificial Sequence: Synthetic oligonucleotide
  Target: ATXN1; (+) strand; PAM type: YTN; PAM sequence: CTA
ccaacccagccccttgggga

SEQ ID NO: 256489 - DNA, 20 bp, Artificial Sequence
  Description of Artificial Sequence: Synthetic oligonucleotide
  Target: ATXN1; (+) strand; PAM type: YTN; PAM sequence: CTT
ggggaggggtgcaggaagag

SEQ ID NO: 256490 - DNA, 20 bp, Artificial Sequence
  Description of Artificial Sequence: Synthetic oligonucleotide
  Target: ATXN1; (+) strand; PAM type: YTN; PAM sequence: TTG
gggaggggtgcaggaagaga

SEQ ID NO: 256491 - DNA, 20 bp, Artificial Sequence
  Description of Artificial Sequence: Synthetic oligonucleotide
  Target: ATXN1; (+) strand; PAM type: YTN; PAM sequence: CTG
aggccaccatgttttgtggt

SEQ ID NO: 256492 - DNA, 20 bp, Artificial Sequence
  Description of Artificial Sequence: Synthetic oligonucleotide
  Target: ATXN1; (+) strand; PAM type: YTN; PAM sequence: TTT
tgtggtctcagaagagaact

SEQ ID NO: 256493 - DNA, 20 bp, Artificial Sequence
  Description of Artificial Sequence: Synthetic oligonucleotide
  Target: ATXN1; (+) strand; PAM type: YTN; PAM sequence: TTT
gtggtctcagaagagaactt

SEQ ID NO: 256494 - DNA, 20 bp, Artificial Sequence
  Description of Artificial Sequence: Synthetic oligonucleotide
  Target: ATXN1; (+) strand; PAM type: YTN; PAM sequence: TTG
tggtctcagaagagaacttt

SEQ ID NO: 256495 - DNA, 20 bp, Artificial Sequence
  Description of Artificial Sequence: Synthetic oligonucleotide
  Target: ATXN1; (+) strand; PAM type: YTN; PAM sequence: CTC
agaagagaactttcaccact

SEQ ID NO: 256496 - DNA, 20 bp, Artificial Sequence
  Description of Artificial Sequence: Synthetic oligonucleotide
  Target: ATXN1; (+) strand; PAM type: YTN; PAM sequence: CTT
tcaccactcaggaatagaga

SEQ ID NO: 256497 - DNA, 20 bp, Artificial Sequence
  Description of Artificial Sequence: Synthetic oligonucleotide
  Target: ATXN1; (+) strand; PAM type: YTN; PAM sequence: TTT
caccactcaggaatagagag

SEQ ID NO: 256498 - DNA, 20 bp, Artificial Sequence
  Description of Artificial Sequence: Synthetic oligonucleotide
  Target: ATXN1; (+) strand; PAM type: YTN; PAM sequence: TTC
accactcaggaatagagagg

SEQ ID NO: 256499 - DNA, 20 bp, Artificial Sequence
  Description of Artificial Sequence: Synthetic oligonucleotide
  Target: ATXN1; (+) strand; PAM type: YTN; PAM sequence: CTC
aggaatagagaggacacata

SEQ ID NO: 256500 - DNA, 20 bp, Artificial Sequence
  Description of Artificial Sequence: Synthetic oligonucleotide
  Target: ATXN1; (+) strand; PAM type: YTN; PAM sequence: CTG
ctgtacttggcaacaaaata

SEQ ID NO: 256501 - DNA, 20 bp, Artificial Sequence
  Description of Artificial Sequence: Synthetic oligonucleotide
  Target: ATXN1; (+) strand; PAM type: YTN; PAM sequence: CTG
tacttggcaacaaaataaaa

SEQ ID NO: 256502 - DNA, 20 bp, Artificial Sequence
  Description of Artificial Sequence: Synthetic oligonucleotide
  Target: ATXN1; (+) strand; PAM type: YTN; PAM sequence: CTT
ggcaacaaaataaaagaaga

SEQ ID NO: 256503 - DNA, 20 bp, Artificial Sequence
  Description of Artificial Sequence: Synthetic oligonucleotide
  Target: ATXN1; (+) strand; PAM type: YTN; PAM sequence: TTG
gcaacaaaataaaagaagaa

SEQ ID NO: 256504 - DNA, 20 bp, Artificial Sequence
  Description of Artificial Sequence: Synthetic oligonucleotide
  Target: ATXN1; (+) strand; PAM type: YTN; PAM sequence: CTC
atgacatcacagggcagaaa

SEQ ID NO: 256505 - DNA, 20 bp, Artificial Sequence
  Description of Artificial Sequence: Synthetic oligonucleotide
  Target: ATXN1; (+) strand; PAM type: YTN; PAM sequence: TTG
ataataacattcgagaaggg

SEQ ID NO: 256506 - DNA, 20 bp, Artificial Sequence
  Description of Artificial Sequence: Synthetic oligonucleotide
  Target: ATXN1; (+) strand; PAM type: YTN; PAM sequence: TTC
gagaagggggtctggggcct

SEQ ID NO: 256507 - DNA, 20 bp, Artificial Sequence
  Description of Artificial Sequence: Synthetic oligonucleotide
  Target: ATXN1; (+) strand; PAM type: YTN; PAM sequence: CTG
gggccttgtgaaatctcagt

SEQ ID NO: 256508 - DNA, 20 bp, Artificial Sequence
  Description of Artificial Sequence: Synthetic oligonucleotide
  Target: ATXN1; (+) strand; PAM type: YTN; PAM sequence: CTT
gtgaaatctcagttacttcg

SEQ ID NO: 256509 - DNA, 20 bp, Artificial Sequence
  Description of Artificial Sequence: Synthetic oligonucleotide
  Target: ATXN1; (+) strand; PAM type: YTN; PAM sequence: TTG
tgaaatctcagttacttcgt

SEQ ID NO: 256510 - DNA, 20 bp, Artificial Sequence
  Description of Artificial Sequence: Synthetic oligonucleotide
  Target: ATXN1; (+) strand; PAM type: YTN; PAM sequence: CTC
agttacttcgtgtctccttt

SEQ ID NO: 256511 - DNA, 20 bp, Artificial Sequence
  Description of Artificial Sequence: Synthetic oligonucleotide
  Target: ATXN1; (+) strand; PAM type: YTN; PAM sequence: TTA
cttcgtgtctcctttaaata

SEQ ID NO: 256512 - DNA, 20 bp, Artificial Sequence
  Description of Artificial Sequence: Synthetic oligonucleotide
  Target: ATXN1; (+) strand; PAM type: YTN; PAM sequence: CTT
cgtgtctcctttaaataaac

SEQ ID NO: 256513 - DNA, 20 bp, Artificial Sequence
  Description of Artificial Sequence: Synthetic oligonucleotide
  Target: ATXN1; (+) strand; PAM type: YTN; PAM sequence: TTC
gtgtctcctttaaataaact

SEQ ID NO: 256514 - DNA, 20 bp, Artificial Sequence
  Description of Artificial Sequence: Synthetic oligonucleotide
  Target: ATXN1; (+) strand; PAM type: YTN; PAM sequence: CTC
ctttaaataaactatagtta

SEQ ID NO: 256515 - DNA, 20 bp, Artificial Sequence
  Description of Artificial Sequence: Synthetic oligonucleotide
  Target: ATXN1; (+) strand; PAM type: YTN; PAM sequence: CTT
taaataaactatagttattt

SEQ ID NO: 256516 - DNA, 20 bp, Artificial Sequence
  Description of Artificial Sequence: Synthetic oligonucleotide
  Target: ATXN1; (+) strand; PAM type: YTN; PAM sequence: TTT
aaataaactatagttatttt

SEQ ID NO: 256517 - DNA, 20 bp, Artificial Sequence
  Description of Artificial Sequence: Synthetic oligonucleotide
  Target: ATXN1; (+) strand; PAM type: YTN; PAM sequence: TTA
aataaactatagttatttta

SEQ ID NO: 256518 - DNA, 20 bp, Artificial Sequence
  Description of Artificial Sequence: Synthetic oligonucleotide
  Target: ATXN1; (+) strand; PAM type: YTN; PAM sequence: CTA
tagttattttaaatagtggc

SEQ ID NO: 256519 - DNA, 20 bp, Artificial Sequence
  Description of Artificial Sequence: Synthetic oligonucleotide
  Target: ATXN1; (+) strand; PAM type: YTN; PAM sequence: TTA
ttttaaatagtggcctcacc

SEQ ID NO: 256520 - DNA, 20 bp, Artificial Sequence
  Description of Artificial Sequence: Synthetic oligonucleotide
  Target: ATXN1; (+) strand; PAM type: YTN; PAM sequence: TTT
taaatagtggcctcaccaaa

SEQ ID NO: 256521 - DNA, 20 bp, Artificial Sequence
  Description of Artificial Sequence: Synthetic oligonucleotide
  Target: ATXN1; (+) strand; PAM type: YTN; PAM sequence: TTT
aaatagtggcctcaccaaag

SEQ ID NO: 256522 - DNA, 20 bp, Artificial Sequence
  Description of Artificial Sequence: Synthetic oligonucleotide
  Target: ATXN1; (+) strand; PAM type: YTN; PAM sequence: TTA
aatagtggcctcaccaaagc

SEQ ID NO: 256523 - DNA, 20 bp, Artificial Sequence
  Description of Artificial Sequence: Synthetic oligonucleotide
  Target: ATXN1; (+) strand; PAM type: YTN; PAM sequence: CTC
accaaagcctgctttcacac

SEQ ID NO: 256524 - DNA, 20 bp, Artificial Sequence
  Description of Artificial Sequence: Synthetic oligonucleotide
  Target: ATXN1; (+) strand; PAM type: YTN; PAM sequence: CTG
ctttcacactgatttctccc

SEQ ID NO: 256525 - DNA, 20 bp, Artificial Sequence
  Description of Artificial Sequence: Synthetic oligonucleotide
  Target: ATXN1; (+) strand; PAM type: YTN; PAM sequence: CTT
tcacactgatttctcccatt

SEQ ID NO: 256526 - DNA, 20 bp, Artificial Sequence
  Description of Artificial Sequence: Synthetic oligonucleotide
  Target: ATXN1; (+) strand; PAM type: YTN; PAM sequence: TTT
cacactgatttctcccattt

SEQ ID NO: 256527 - DNA, 20 bp, Artificial Sequence
  Description of Artificial Sequence: Synthetic oligonucleotide
  Target: ATXN1; (+) strand; PAM type: YTN; PAM sequence: TTC
acactgatttctcccatttc

SEQ ID NO: 256528 - DNA, 20 bp, Artificial Sequence
  Description of Artificial Sequence: Synthetic oligonucleotide
  Target: ATXN1; (+) strand; PAM type: YTN; PAM sequence: CTG
atttctcccatttctatatc

SEQ ID NO: 256529 - DNA, 20 bp, Artificial Sequence
  Description of Artificial Sequence: Synthetic oligonucleotide
  Target: ATXN1; (+) strand; PAM type: YTN; PAM sequence: TTT
ctcccatttctatatccatt

SEQ ID NO: 256530 - DNA, 20 bp, Artificial Sequence
  Description of Artificial Sequence: Synthetic oligonucleotide
  Target: ATXN1; (+) strand; PAM type: YTN; PAM sequence: TTC
tcccatttctatatccattc

SEQ ID NO: 256531 - DNA, 20 bp, Artificial Sequence
  Description of Artificial Sequence: Synthetic oligonucleotide
  Target: ATXN1; (+) strand; PAM type: YTN; PAM sequence: CTC
ccatttctatatccattcca

SEQ ID NO: 256532 - DNA, 20 bp, Artificial Sequence
  Description of Artificial Sequence: Synthetic oligonucleotide
  Target: ATXN1; (+) strand; PAM type: YTN; PAM sequence: TTT
ctatatccattccattatta

SEQ ID NO: 256533 - DNA, 20 bp, Artificial Sequence
  Description of Artificial Sequence: Synthetic oligonucleotide
  Target: ATXN1; (+) strand; PAM type: YTN; PAM sequence: TTC
tatatccattccattattaa

SEQ ID NO: 256534 - DNA, 20 bp, Artificial Sequence
  Description of Artificial Sequence: Synthetic oligonucleotide
  Target: ATXN1; (+) strand; PAM type: YTN; PAM sequence: CTA
tatccattccattattaagt

SEQ ID NO: 256535 - DNA, 20 bp, Artificial Sequence
  Description of Artificial Sequence: Synthetic oligonucleotide
  Target: ATXN1; (+) strand; PAM type: YTN; PAM sequence: TTC
cattattaagtatgttaaag

SEQ ID NO: 256536 - DNA, 20 bp, Artificial Sequence
  Description of Artificial Sequence: Synthetic oligonucleotide
  Target: ATXN1; (+) strand; PAM type: YTN; PAM sequence: TTA
ttaagtatgttaaagaagta

SEQ ID NO: 256537 - DNA, 20 bp, Artificial Sequence
  Description of Artificial Sequence: Synthetic oligonucleotide
  Target: ATXN1; (+) strand; PAM type: YTN; PAM sequence: TTA
agtatgttaaagaagtattg

SEQ ID NO: 256538 - DNA, 20 bp, Artificial Sequence
  Description of Artificial Sequence: Synthetic oligonucleotide
  Target: ATXN1; (+) strand; PAM type: YTN; PAM sequence: TTA
aagaagtattgtcttaaata

SEQ ID NO: 256539 - DNA, 20 bp, Artificial Sequence
  Description of Artificial Sequence: Synthetic oligonucleotide
  Target: ATXN1; (+) strand; PAM type: YTN; PAM sequence: TTG
tcttaaatactttccttcat

SEQ ID NO: 256540 - DNA, 20 bp, Artificial Sequence
  Description of Artificial Sequence: Synthetic oligonucleotide
  Target: ATXN1; (+) strand; PAM type: YTN; PAM sequence: CTT
aaatactttccttcatcaag

SEQ ID NO: 256541 - DNA, 20 bp, Artificial Sequence
  Description of Artificial Sequence: Synthetic oligonucleotide
  Target: ATXN1; (+) strand; PAM type: YTN; PAM sequence: TTA
aatactttccttcatcaagt

SEQ ID NO: 256542 - DNA, 20 bp, Artificial Sequence
  Description of Artificial Sequence: Synthetic oligonucleotide
  Target: ATXN1; (+) strand; PAM type: YTN; PAM sequence: CTT
tccttcatcaagtgagaacc

SEQ ID NO: 256543 - DNA, 20 bp, Artificial Sequence
  Description of Artificial Sequence: Synthetic oligonucleotide
  Target: ATXN1; (+) strand; PAM type: YTN; PAM sequence: TTT
ccttcatcaagtgagaaccc

SEQ ID NO: 256544 - DNA, 20 bp, Artificial Sequence
  Description of Artificial Sequence: Synthetic oligonucleotide
  Target: ATXN1; (+) strand; PAM type: YTN; PAM sequence: TTC
cttcatcaagtgagaaccct

SEQ ID NO: 256545 - DNA, 20 bp, Artificial Sequence
  Description of Artificial Sequence: Synthetic oligonucleotide
  Target: ATXN1; (+) strand; PAM type: YTN; PAM sequence: CTT
catcaagtgagaaccctgga

SEQ ID NO: 256546 - DNA, 20 bp, Artificial Sequence
  Description of Artificial Sequence: Synthetic oligonucleotide
  Target: ATXN1; (+) strand; PAM type: YTN; PAM sequence: TTC
atcaagtgagaaccctggaa

SEQ ID NO: 256547 - DNA, 20 bp, Artificial Sequence
  Description of Artificial Sequence: Synthetic oligonucleotide
  Target: ATXN1; (+) strand; PAM type: YTN; PAM sequence: CTG
gaagaagatgagaatgagga

SEQ ID NO: 256548 - DNA, 20 bp, Artificial Sequence
  Description of Artificial Sequence: Synthetic oligonucleotide
  Target: ATXN1; (+) strand; PAM type: YTN; PAM sequence: TTA
acagtaactcaggcctatca

SEQ ID NO: 256549 - DNA, 20 bp, Artificial Sequence
  Description of Artificial Sequence: Synthetic oligonucleotide
  Target: ATXN1; (+) strand; PAM type: YTN; PAM sequence: CTC
aggcctatcatctgacaggc

SEQ ID NO: 256550 - DNA, 20 bp, Artificial Sequence
  Description of Artificial Sequence: Synthetic oligonucleotide
  Target: ATXN1; (+) strand; PAM type: YTN; PAM sequence: CTA
tcatctgacaggcactaagt

SEQ ID NO: 256551 - DNA, 20 bp, Artificial Sequence
  Description of Artificial Sequence: Synthetic oligonucleotide
  Target: ATXN1; (+) strand; PAM type: YTN; PAM sequence: CTG
acaggcactaagtgtgtatc

SEQ ID NO: 256552 - DNA, 20 bp, Artificial Sequence
  Description of Artificial Sequence: Synthetic oligonucleotide
  Target: ATXN1; (+) strand; PAM type: YTN; PAM sequence: CTA
agtgtgtatcacgtattttg

SEQ ID NO: 256553 - DNA, 20 bp, Artificial Sequence
  Description of Artificial Sequence: Synthetic oligonucleotide
  Target: ATXN1; (+) strand; PAM type: YTN; PAM sequence: TTT
tgtcacttacaaccttttca

SEQ ID NO: 256554 - DNA, 20 bp, Artificial Sequence
  Description of Artificial Sequence: Synthetic oligonucleotide
  Target: ATXN1; (+) strand; PAM type: YTN; PAM sequence: TTT
gtcacttacaaccttttcag

SEQ ID NO: 256555 - DNA, 20 bp, Artificial Sequence
  Description of Artificial Sequence: Synthetic oligonucleotide
  Target: ATXN1; (+) strand; PAM type: YTN; PAM sequence: TTG
tcacttacaaccttttcagg

SEQ ID NO: 256556 - DNA, 20 bp, Artificial Sequence
  Description of Artificial Sequence: Synthetic oligonucleotide
  Target: ATXN1; (+) strand; PAM type: YTN; PAM sequence: CTT
acaaccttttcagggtttta

SEQ ID NO: 256557 - DNA, 20 bp, Artificial Sequence
  Description of Artificial Sequence: Synthetic oligonucleotide
  Target: ATXN1; (+) strand; PAM type: YTN; PAM sequence: TTA
caaccttttcagggttttaa

SEQ ID NO: 256558 - DNA, 20 bp, Artificial Sequence
  Description of Artificial Sequence: Synthetic oligonucleotide
  Target: ATXN1; (+) strand; PAM type: YTN; PAM sequence: CTT
ttcagggttttaatgataag

SEQ ID NO: 256559 - DNA, 20 bp, Artificial Sequence
  Description of Artificial Sequence: Synthetic oligonucleotide
  Target: ATXN1; (+) strand; PAM type: YTN; PAM sequence: TTT
tcagggttttaatgataagg

SEQ ID NO: 256560 - DNA, 20 bp, Artificial Sequence
  Description of Artificial Sequence: Synthetic oligonucleotide
  Target: ATXN1; (+) strand; PAM type: YTN; PAM sequence: TTT
cagggttttaatgataagga

SEQ ID NO: 256561 - DNA, 20 bp, Artificial Sequence
  Description of Artificial Sequence: Synthetic oligonucleotide
  Target: ATXN1; (+) strand; PAM type: YTN; PAM sequence: TTC
agggttttaatgataaggaa

SEQ ID NO: 256562 - DNA, 20 bp, Artificial Sequence
  Description of Artificial Sequence: Synthetic oligonucleotide
  Target: ATXN1; (+) strand; PAM type: YTN; PAM sequence: TTT
taatgataaggaaagtaagg

SEQ ID NO: 256563 - DNA, 20 bp, Artificial Sequence
  Description of Artificial Sequence: Synthetic oligonucleotide
  Target: ATXN1; (+) strand; PAM type: YTN; PAM sequence: TTT
aatgataaggaaagtaagga

SEQ ID NO: 256564 - DNA, 20 bp, Artificial Sequence
  Description of Artificial Sequence: Synthetic oligonucleotide
  Target: ATXN1; (+) strand; PAM type: YTN; PAM sequence: TTA
atgataaggaaagtaaggat

SEQ ID NO: 256565 - DNA, 20 bp, Artificial Sequence
  Description of Artificial Sequence: Synthetic oligonucleotide
  Target: ATXN1; (+) strand; PAM type: YTN; PAM sequence: TTA
aataacttatgcaaattgaa

SEQ ID NO: 256566 - DNA, 20 bp, Artificial Sequence
  Description of Artificial Sequence: Synthetic oligonucleotide
  Target: ATXN1; (+) strand; PAM type: YTN; PAM sequence: CTT
atgcaaattgaaaaacattt

SEQ ID NO: 256567 - DNA, 20 bp, Artificial Sequence
  Description of Artificial Sequence: Synthetic oligonucleotide
  Target: ATXN1; (+) strand; PAM type: YTN; PAM sequence: TTA
tgcaaattgaaaaacatttg

SEQ ID NO: 256568 - DNA, 20 bp, Artificial Sequence
  Description of Artificial Sequence: Synthetic oligonucleotide
  Target: ATXN1; (+) strand; PAM type: YTN; PAM sequence: TTG
aaaaacatttgacatttatt

SEQ ID NO: 256569 - DNA, 20 bp, Artificial Sequence
  Description of Artificial Sequence: Synthetic oligonucleotide
  Target: ATXN1; (+) strand; PAM type: YTN; PAM sequence: TTT
gacatttattttctcacaac

SEQ ID NO: 256570 - DNA, 20 bp, Artificial Sequence
  Description of Artificial Sequence: Synthetic oligonucleotide
  Target: ATXN1; (+) strand; PAM type: YTN; PAM sequence: TTG
acatttattttctcacaact

SEQ ID NO: 256571 - DNA, 20 bp, Artificial Sequence
  Description of Artificial Sequence: Synthetic oligonucleotide
  Target: ATXN1; (+) strand; PAM type: YTN; PAM sequence: TTT
attttctcacaactaataag

SEQ ID NO: 256572 - DNA, 20 bp, Artificial Sequence
  Description of Artificial Sequence: Synthetic oligonucleotide
  Target: ATXN1; (+) strand; PAM type: YTN; PAM sequence: TTA
ttttctcacaactaataagt

SEQ ID NO: 256573 - DNA, 20 bp, Artificial Sequence
  Description of Artificial Sequence: Synthetic oligonucleotide
  Target: ATXN1; (+) strand; PAM type: YTN; PAM sequence: TTT
tctcacaactaataagtagc

SEQ ID NO: 256574 - DNA, 20 bp, Artificial Sequence
  Description of Artificial Sequence: Synthetic oligonucleotide
  Target: ATXN1; (+) strand; PAM type: YTN; PAM sequence: TTT
ctcacaactaataagtagct

SEQ ID NO: 256575 - DNA, 20 bp, Artificial Sequence
  Description of Artificial Sequence: Synthetic oligonucleotide
  Target: ATXN1; (+) strand; PAM type: YTN; PAM sequence: TTC
tcacaactaataagtagctg

SEQ ID NO: 256576 - DNA, 20 bp, Artificial Sequence
  Description of Artificial Sequence: Synthetic oligonucleotide
  Target: ATXN1; (+) strand; PAM type: YTN; PAM sequence: CTC
acaactaataagtagctgaa

SEQ ID NO: 256577 - DNA, 20 bp, Artificial Sequence
  Description of Artificial Sequence: Synthetic oligonucleotide
  Target: ATXN1; (+) strand; PAM type: YTN; PAM sequence: CTA
ataagtagctgaagtagaac

SEQ ID NO: 256578 - DNA, 20 bp, Artificial Sequence
  Description of Artificial Sequence: Synthetic oligonucleotide
  Target: ATXN1; (+) strand; PAM type: YTN; PAM sequence: CTG
aagtagaacttgaacccaag

SEQ ID NO: 256579 - DNA, 20 bp, Artificial Sequence
  Description of Artificial Sequence: Synthetic oligonucleotide
  Target: ATXN1; (+) strand; PAM type: YTN; PAM sequence: CTT
gaacccaagtgtgtttaatt

SEQ ID NO: 256580 - DNA, 20 bp, Artificial Sequence
  Description of Artificial Sequence: Synthetic oligonucleotide
  Target: ATXN1; (+) strand; PAM type: YTN; PAM sequence: TTG
aacccaagtgtgtttaattc

SEQ ID NO: 256581 - DNA, 20 bp, Artificial Sequence
  Description of Artificial Sequence: Synthetic oligonucleotide
  Target: ATXN1; (+) strand; PAM type: YTN; PAM sequence: TTT
aattccaattttaaaaaacc

SEQ ID NO: 256582 - DNA, 20 bp, Artificial Sequence
  Description of Artificial Sequence: Synthetic oligonucleotide
  Target: ATXN1; (+) strand; PAM type: YTN; PAM sequence: TTA
attccaattttaaaaaacct

SEQ ID NO: 256583 - DNA, 20 bp, Artificial Sequence
  Description of Artificial Sequence: Synthetic oligonucleotide
  Target: ATXN1; (+) strand; PAM type: YTN; PAM sequence: TTC
caattttaaaaaacctgttt

SEQ ID NO: 256584 - DNA, 20 bp, Artificial Sequence
  Description of Artificial Sequence: Synthetic oligonucleotide
  Target: ATXN1; (+) strand; PAM type: YTN; PAM sequence: TTT
taaaaaacctgttttttaga

SEQ ID NO: 256585 - DNA, 20 bp, Artificial Sequence
  Description of Artificial Sequence: Synthetic oligonucleotide
  Target: ATXN1; (+) strand; PAM type: YTN; PAM sequence: TTT
aaaaaacctgttttttagag

SEQ ID NO: 256586 - DNA, 20 bp, Artificial Sequence
  Description of Artificial Sequence: Synthetic oligonucleotide
  Target: ATXN1; (+) strand; PAM type: YTN; PAM sequence: TTA
aaaaacctgttttttagagt

SEQ ID NO: 256587 - DNA, 20 bp, Artificial Sequence
  Description of Artificial Sequence: Synthetic oligonucleotide
  Target: ATXN1; (+) strand; PAM type: YTN; PAM sequence: CTG
ttttttagagttgaggtctc

SEQ ID NO: 256588 - DNA, 20 bp, Artificial Sequence
  Description of Artificial Sequence: Synthetic oligonucleotide
  Target: ATXN1; (+) strand; PAM type: YTN; PAM sequence: TTT
tttagagttgaggtctctgt

SEQ ID NO: 256589 - DNA, 20 bp, Artificial Sequence
  Description of Artificial Sequence: Synthetic oligonucleotide
  Target: ATXN1; (+) strand; PAM type: YTN; PAM sequence: TTT
ttagagttgaggtctctgtc

SEQ ID NO: 256590 - DNA, 20 bp, Artificial Sequence
  Description of Artificial Sequence: Synthetic oligonucleotide
  Target: ATXN1; (+) strand; PAM type: YTN; PAM sequence: TTT
tagagttgaggtctctgtca

SEQ ID NO: 256591 - DNA, 20 bp, Artificial Sequence
  Description of Artificial Sequence: Synthetic oligonucleotide
  Target: ATXN1; (+) strand; PAM type: YTN; PAM sequence: TTT
agagttgaggtctctgtcat

SEQ ID NO: 256592 - DNA, 20 bp, Artificial Sequence
  Description of Artificial Sequence: Synthetic oligonucleotide
  Target: ATXN1; (+) strand; PAM type: YTN; PAM sequence: TTA
gagttgaggtctctgtcatc

SEQ ID NO: 256593 - DNA, 20 bp, Artificial Sequence
  Description of Artificial Sequence: Synthetic oligonucleotide
  Target: ATXN1; (+) strand; PAM type: YTN; PAM sequence: TTG
aggtctctgtcatccaggct

SEQ ID NO: 256594 - DNA, 20 bp, Artificial Sequence
  Description of Artificial Sequence: Synthetic oligonucleotide
  Target: ATXN1; (+) strand; PAM type: YTN; PAM sequence: CTC
tgtcatccaggctggagggt

SEQ ID NO: 256595 - DNA, 20 bp, Artificial Sequence
  Description of Artificial Sequence: Synthetic oligonucleotide
  Target: ATXN1; (+) strand; PAM type: YTN; PAM sequence: CTG
tcatccaggctggagggtag

SEQ ID NO: 256596 - DNA, 20 bp, Artificial Sequence
  Description of Artificial Sequence: Synthetic oligonucleotide
  Target: ATXN1; (+) strand; PAM type: YTN; PAM sequence: CTG
gagggtagtggcatgttctt

SEQ ID NO: 256597 - DNA, 20 bp, Artificial Sequence
  Description of Artificial Sequence: Synthetic oligonucleotide
  Target: ATXN1; (+) strand; PAM type: YTN; PAM sequence: TTC
ttagctcactgcagcctcaa

SEQ ID NO: 256598 - DNA, 20 bp, Artificial Sequence
  Description of Artificial Sequence: Synthetic oligonucleotide
  Target: ATXN1; (+) strand; PAM type: YTN; PAM sequence: CTT
agctcactgcagcctcaatc

SEQ ID NO: 256599 - DNA, 20 bp, Artificial Sequence
  Description of Artificial Sequence: Synthetic oligonucleotide
  Target: ATXN1; (+) strand; PAM type: YTN; PAM sequence: TTA
gctcactgcagcctcaatct

SEQ ID NO: 256600 - DNA, 20 bp, Artificial Sequence
  Description of Artificial Sequence: Synthetic oligonucleotide
  Target: ATXN1; (+) strand; PAM type: YTN; PAM sequence: CTC
actgcagcctcaatctcctg

SEQ ID NO: 256601 - DNA, 20 bp, Artificial Sequence
  Description of Artificial Sequence: Synthetic oligonucleotide
  Target: ATXN1; (+) strand; PAM type: YTN; PAM sequence: CTG
cagcctcaatctcctgggtt

SEQ ID NO: 256602 - DNA, 20 bp, Artificial Sequence
  Description of Artificial Sequence: Synthetic oligonucleotide
  Target: ATXN1; (+) strand; PAM type: YTN; PAM sequence: CTC
aatctcctgggttcaagcga

SEQ ID NO: 256603 - DNA, 20 bp, Artificial Sequence
  Description of Artificial Sequence: Synthetic oligonucleotide
  Target: ATXN1; (+) strand; PAM type: YTN; PAM sequence: CTC
ctgggttcaagcgatcctcc

SEQ ID NO: 256604 - DNA, 20 bp, Artificial Sequence
  Description of Artificial Sequence: Synthetic oligonucleotide
  Target: ATXN1; (+) strand; PAM type: YTN; PAM sequence: CTG
ggttcaagcgatcctcctgt

SEQ ID NO: 256605 - DNA, 20 bp, Artificial Sequence
  Description of Artificial Sequence: Synthetic oligonucleotide
  Target: ATXN1; (+) strand; PAM type: YTN; PAM sequence: TTC
aagcgatcctcctgtctcag

SEQ ID NO: 256606 - DNA, 20 bp, Artificial Sequence
  Description of Artificial Sequence: Synthetic oligonucleotide
  Target: ATXN1; (+) strand; PAM type: YTN; PAM sequence: CTC
ctgtctcagtctgctgagta

SEQ ID NO: 256607 - DNA, 20 bp, Artificial Sequence
  Description of Artificial Sequence: Synthetic oligonucleotide
  Target: ATXN1; (+) strand; PAM type: YTN; PAM sequence: CTG
tctcagtctgctgagtagct

SEQ ID NO: 256608 - DNA, 20 bp, Artificial Sequence
  Description of Artificial Sequence: Synthetic oligonucleotide
  Target: ATXN1; (+) strand; PAM type: YTN; PAM sequence: CTC
agtctgctgagtagctggga

SEQ ID NO: 256609 - DNA, 20 bp, Artificial Sequence
  Description of Artificial Sequence: Synthetic oligonucleotide
  Target: ATXN1; (+) strand; PAM type: YTN; PAM sequence: CTG
ctgagtagctgggactacat

SEQ ID NO: 256610 - DNA, 20 bp, Artificial Sequence
  Description of Artificial Sequence: Synthetic oligonucleotide
  Target: ATXN1; (+) strand; PAM type: YTN; PAM sequence: CTG
agtagctgggactacatgga

SEQ ID NO: 256611 - DNA, 20 bp, Artificial Sequence
  Description of Artificial Sequence: Synthetic oligonucleotide
  Target: ATXN1; (+) strand; PAM type: YTN; PAM sequence: CTG
ggactacatggatgagccat

SEQ ID NO: 256612 - DNA, 20 bp, Artificial Sequence
  Description of Artificial Sequence: Synthetic oligonucleotide
  Target: ATXN1; (+) strand; PAM type: YTN; PAM sequence: CTA
catggatgagccatcatgct

SEQ ID NO: 256613 - DNA, 20 bp, Artificial Sequence
  Description of Artificial Sequence: Synthetic oligonucleotide
  Target: ATXN1; (+) strand; PAM type: YTN; PAM sequence: CTT
tgcttaattccaaaatttaa

SEQ ID NO: 256614 - DNA, 20 bp, Artificial Sequence
  Description of Artificial Sequence: Synthetic oligonucleotide
  Target: ATXN1; (+) strand; PAM type: YTN; PAM sequence: TTT
gcttaattccaaaatttaat

SEQ ID NO: 256615 - DNA, 20 bp, Artificial Sequence
  Description of Artificial Sequence: Synthetic oligonucleotide
  Target: ATXN1; (+) strand; PAM type: YTN; PAM sequence: TTG
cttaattccaaaatttaatt

SEQ ID NO: 256616 - DNA, 20 bp, Artificial Sequence
  Description of Artificial Sequence: Synthetic oligonucleotide
  Target: ATXN1; (+) strand; PAM type: YTN; PAM sequence: CTT
aattccaaaatttaattctt

SEQ ID NO: 256617 - DNA, 20 bp, Artificial Sequence
  Description of Artificial Sequence: Synthetic oligonucleotide
  Target: ATXN1; (+) strand; PAM type: YTN; PAM sequence: TTA
attccaaaatttaattctta

SEQ ID NO: 256618 - DNA, 20 bp, Artificial Sequence
  Description of Artificial Sequence: Synthetic oligonucleotide
  Target: ATXN1; (+) strand; PAM type: YTN; PAM sequence: TTC
caaaatttaattcttacctt

SEQ ID NO: 256619 - DNA, 20 bp, Artificial Sequence
  Description of Artificial Sequence: Synthetic oligonucleotide
  Target: ATXN1; (+) strand; PAM type: YTN; PAM sequence: TTT
aattcttaccttggcaccca

SEQ ID NO: 256620 - DNA, 20 bp, Artificial Sequence
  Description of Artificial Sequence: Synthetic oligonucleotide
  Target: ATXN1; (+) strand; PAM type: YTN; PAM sequence: TTA
attcttaccttggcacccaa

SEQ ID NO: 256621 - DNA, 20 bp, Artificial Sequence
  Description of Artificial Sequence: Synthetic oligonucleotide
  Target: ATXN1; (+) strand; PAM type: YTN; PAM sequence: TTC
ttaccttggcacccaagagg

SEQ ID NO: 256622 - DNA, 20 bp, Artificial Sequence
  Description of Artificial Sequence: Synthetic oligonucleotide
  Target: ATXN1; (+) strand; PAM type: YTN; PAM sequence: CTT
accttggcacccaagagggt

SEQ ID NO: 256623 - DNA, 20 bp, Artificial Sequence
  Description of Artificial Sequence: Synthetic oligonucleotide
  Target: ATXN1; (+) strand; PAM type: YTN; PAM sequence: TTA
ccttggcacccaagagggtg

SEQ ID NO: 256624 - DNA, 20 bp, Artificial Sequence
  Description of Artificial Sequence: Synthetic oligonucleotide
  Target: ATXN1; (+) strand; PAM type: YTN; PAM sequence: CTT
ggcacccaagagggtgtttg

SEQ ID NO: 256625 - DNA, 20 bp, Artificial Sequence
  Description of Artificial Sequence: Synthetic oligonucleotide
  Target: ATXN1; (+) strand; PAM type: YTN; PAM sequence: TTG
gcacccaagagggtgtttgg

SEQ ID NO: 256626 - DNA, 20 bp, Artificial Sequence
  Description of Artificial Sequence: Synthetic oligonucleotide
  Target: ATXN1; (+) strand; PAM type: YTN; PAM sequence: TTT
ggcacacagtaggtgcttca

SEQ ID NO: 256627 - DNA, 20 bp, Artificial Sequence
  Description of Artificial Sequence: Synthetic oligonucleotide
  Target: ATXN1; (+) strand; PAM type: YTN; PAM sequence: TTG
gcacacagtaggtgcttcat

SEQ ID NO: 256628 - DNA, 20 bp, Artificial Sequence
  Description of Artificial Sequence: Synthetic oligonucleotide
  Target: ATXN1; (+) strand; PAM type: YTN; PAM sequence: CTT
cataaaaattggtgactgaa

SEQ ID NO: 256629 - DNA, 20 bp, Artificial Sequence
  Description of Artificial Sequence: Synthetic oligonucleotide
  Target: ATXN1; (+) strand; PAM type: YTN; PAM sequence: TTC
ataaaaattggtgactgaac

SEQ ID NO: 256630 - DNA, 20 bp, Artificial Sequence
  Description of Artificial Sequence: Synthetic oligonucleotide
  Target: ATXN1; (+) strand; PAM type: YTN; PAM sequence: TTG
gtgactgaacaaataaaaag

SEQ ID NO: 256631 - DNA, 20 bp, Artificial Sequence
  Description of Artificial Sequence: Synthetic oligonucleotide
  Target: ATXN1; (+) strand; PAM type: YTN; PAM sequence: CTG
aacaaataaaaagaatacat

SEQ ID NO: 256632 - DNA, 20 bp, Artificial Sequence
  Description of Artificial Sequence: Synthetic oligonucleotide
  Target: ATXN1; (+) strand; PAM type: YTN; PAM sequence: TTC
taaggtttagtcaatcaaat

SEQ ID NO: 256633 - DNA, 20 bp, Artificial Sequence
  Description of Artificial Sequence: Synthetic oligonucleotide
  Target: ATXN1; (+) strand; PAM type: YTN; PAM sequence: CTA
aggtttagtcaatcaaatgg

SEQ ID NO: 256634 - DNA, 20 bp, Artificial Sequence
  Description of Artificial Sequence: Synthetic oligonucleotide
  Target: ATXN1; (+) strand; PAM type: YTN; PAM sequence: TTT
agtcaatcaaatggtgcaat

SEQ ID NO: 256635 - DNA, 20 bp, Artificial Sequence
  Description of Artificial Sequence: Synthetic oligonucleotide
  Target: ATXN1; (+) strand; PAM type: YTN; PAM sequence: TTA
gtcaatcaaatggtgcaatg

SEQ ID NO: 256636 - DNA, 20 bp, Artificial Sequence
  Description of Artificial Sequence: Synthetic oligonucleotide
  Target: ATXN1; (+) strand; PAM type: YTN; PAM sequence: CTC
attcttcacctaaactggtt

SEQ ID NO: 256637 - DNA, 20 bp, Artificial Sequence
  Description of Artificial Sequence: Synthetic oligonucleotide
  Target: ATXN1; (+) strand; PAM type: YTN; PAM sequence: TTC
ttcacctaaactggttaagt

SEQ ID NO: 256638 - DNA, 20 bp, Artificial Sequence
  Description of Artificial Sequence: Synthetic oligonucleotide
  Target: ATXN1; (+) strand; PAM type: YTN; PAM sequence: CTT
cacctaaactggttaagtat

SEQ ID NO: 256639 - DNA, 20 bp, Artificial Sequence
  Description of Artificial Sequence: Synthetic oligonucleotide
  Target: ATXN1; (+) strand; PAM type: YTN; PAM sequence: TTC
acctaaactggttaagtata

SEQ ID NO: 256640 - DNA, 20 bp, Artificial Sequence
  Description of Artificial Sequence: Synthetic oligonucleotide
  Target: ATXN1; (+) strand; PAM type: YTN; PAM sequence: CTA
aactggttaagtatacctca

SEQ ID NO: 256641 - DNA, 20 bp, Artificial Sequence
  Description of Artificial Sequence: Synthetic oligonucleotide
  Target: ATXN1; (+) strand; PAM type: YTN; PAM sequence: CTG
gttaagtatacctcagtcat

SEQ ID NO: 256642 - DNA, 20 bp, Artificial Sequence
  Description of Artificial Sequence: Synthetic oligonucleotide
  Target: ATXN1; (+) strand; PAM type: YTN; PAM sequence: TTA
agtatacctcagtcatttaa

SEQ ID NO: 256643 - DNA, 20 bp, Artificial Sequence
  Description of Artificial Sequence: Synthetic oligonucleotide
  Target: ATXN1; (+) strand; PAM type: YTN; PAM sequence: CTC
agtcatttaacctaatagaa

SEQ ID NO: 256644 - DNA, 20 bp, Artificial Sequence
  Description of Artificial Sequence: Synthetic oligonucleotide
  Target: ATXN1; (+) strand; PAM type: YTN; PAM sequence: TTT
aacctaatagaaacagtcat

SEQ ID NO: 256645 - DNA, 20 bp, Artificial Sequence
  Description of Artificial Sequence: Synthetic oligonucleotide
  Target: ATXN1; (+) strand; PAM type: YTN; PAM sequence: TTA
acctaatagaaacagtcatt

SEQ ID NO: 256646 - DNA, 20 bp, Artificial Sequence
  Description of Artificial Sequence: Synthetic oligonucleotide
  Target: ATXN1; (+) strand; PAM type: YTN; PAM sequence: CTA
atagaaacagtcattataat

SEQ ID NO: 256647 - DNA, 20 bp, Artificial Sequence
  Description of Artificial Sequence: Synthetic oligonucleotide
  Target: ATXN1; (+) strand; PAM type: YTN; PAM sequence: TTA
taatcaaataatgtcacagg

SEQ ID NO: 256648 - DNA, 20 bp, Artificial Sequence
  Description of Artificial Sequence: Synthetic oligonucleotide
  Target: ATXN1; (+) strand; PAM type: YTN; PAM sequence: TTT
cctgctaaggaataaatgac

SEQ ID NO: 256649 - DNA, 20 bp, Artificial Sequence
  Description of Artificial Sequence: Synthetic oligonucleotide
  Target: ATXN1; (+) strand; PAM type: YTN; PAM sequence: TTC
ctgctaaggaataaatgact

SEQ ID NO: 256650 - DNA, 20 bp, Artificial Sequence
  Description of Artificial Sequence: Synthetic oligonucleotide
  Target: ATXN1; (+) strand; PAM type: YTN; PAM sequence: CTG
ctaaggaataaatgactcgg

SEQ ID NO: 256651 - DNA, 20 bp, Artificial Sequence
  Description of Artificial Sequence: Synthetic oligonucleotide
  Target: ATXN1; (+) strand; PAM type: YTN; PAM sequence: CTA
aggaataaatgactcggact

SEQ ID NO: 256652 - DNA, 20 bp, Artificial Sequence
  Description of Artificial Sequence: Synthetic oligonucleotide
  Target: ATXN1; (+) strand; PAM type: YTN; PAM sequence: CTC
ggacttgctttgacatttat

SEQ ID NO: 256653 - DNA, 20 bp, Artificial Sequence
  Description of Artificial Sequence: Synthetic oligonucleotide
  Target: ATXN1; (+) strand; PAM type: YTN; PAM sequence: CTT
gctttgacatttattttcta

SEQ ID NO: 256654 - DNA, 20 bp, Artificial Sequence
  Description of Artificial Sequence: Synthetic oligonucleotide
  Target: ATXN1; (+) strand; PAM type: YTN; PAM sequence: TTG
ctttgacatttattttctaa

SEQ ID NO: 256655 - DNA, 20 bp, Artificial Sequence
  Description of Artificial Sequence: Synthetic oligonucleotide
  Target: ATXN1; (+) strand; PAM type: YTN; PAM sequence: CTT
tgacatttattttctaaaac

SEQ ID NO: 256656 - DNA, 20 bp, Artificial Sequence
  Description of Artificial Sequence: Synthetic oligonucleotide
  Target: ATXN1; (+) strand; PAM type: YTN; PAM sequence: TTT
gacatttattttctaaaact

SEQ ID NO: 256657 - DNA, 20 bp, Artificial Sequence
  Description of Artificial Sequence: Synthetic oligonucleotide
  Target: ATXN1; (+) strand; PAM type: YTN; PAM sequence: TTG
acatttattttctaaaactt

SEQ ID NO: 256658 - DNA, 20 bp, Artificial Sequence
  Description of Artificial Sequence: Synthetic oligonucleotide
  Target: ATXN1; (+) strand; PAM type: YTN; PAM sequence: TTT
attttctaaaacttactcag

SEQ ID NO: 256659 - DNA, 20 bp, Artificial Sequence
  Description of Artificial Sequence: Synthetic oligonucleotide
  Target: ATXN1; (+) strand; PAM type: YTN; PAM sequence: TTA
ttttctaaaacttactcagt

SEQ ID NO: 256660 - DNA, 20 bp, Artificial Sequence
  Description of Artificial Sequence: Synthetic oligonucleotide
  Target: ATXN1; (+) strand; PAM type: YTN; PAM sequence: TTT
tctaaaacttactcagtttt

SEQ ID NO: 256661 - DNA, 20 bp, Artificial Sequence
  Description of Artificial Sequence: Synthetic oligonucleotide
  Target: ATXN1; (+) strand; PAM type: YTN; PAM sequence: TTT
ctaaaacttactcagttttg

SEQ ID NO: 256662 - DNA, 20 bp, Artificial Sequence
  Description of Artificial Sequence: Synthetic oligonucleotide
  Target: ATXN1; (+) strand; PAM type: YTN; PAM sequence: TTC
taaaacttactcagttttgc

SEQ ID NO: 256663 - DNA, 20 bp, Artificial Sequence
  Description of Artificial Sequence: Synthetic oligonucleotide
  Target: ATXN1; (+) strand; PAM type: YTN; PAM sequence: CTA
aaacttactcagttttgccc

SEQ ID NO: 256664 - DNA, 20 bp, Artificial Sequence
  Description of Artificial Sequence: Synthetic oligonucleotide
  Target: ATXN1; (+) strand; PAM type: YTN; PAM sequence: CTT
actcagttttgccccgatat

SEQ ID NO: 256665 - DNA, 20 bp, Artificial Sequence
  Description of Artificial Sequence: Synthetic oligonucleotide
  Target: ATXN1; (+) strand; PAM type: YTN; PAM sequence: TTA
ctcagttttgccccgatatt

SEQ ID NO: 256666 - DNA, 20 bp, Artificial Sequence
  Description of Artificial Sequence: Synthetic oligonucleotide
  Target: ATXN1; (+) strand; PAM type: YTN; PAM sequence: CTC
agttttgccccgatatttat

SEQ ID NO: 256667 - DNA, 20 bp, Artificial Sequence
  Description of Artificial Sequence: Synthetic oligonucleotide
  Target: ATXN1; (+) strand; PAM type: YTN; PAM sequence: TTT
tgccccgatatttatacatc

SEQ ID NO: 256668 - DNA, 20 bp, Artificial Sequence
  Description of Artificial Sequence: Synthetic oligonucleotide
  Target: ATXN1; (+) strand; PAM type: YTN; PAM sequence: TTT
gccccgatatttatacatca

SEQ ID NO: 256669 - DNA, 20 bp, Artificial Sequence
  Description of Artificial Sequence: Synthetic oligonucleotide
  Target: ATXN1; (+) strand; PAM type: YTN; PAM sequence: TTG
ccccgatatttatacatcag

SEQ ID NO: 256670 - DNA, 20 bp, Artificial Sequence
  Description of Artificial Sequence: Synthetic oligonucleotide
  Target: ATXN1; (+) strand; PAM type: YTN; PAM sequence: TTT
atacatcagcaggagatggt

SEQ ID NO: 256671 - DNA, 20 bp, Artificial Sequence
  Description of Artificial Sequence: Synthetic oligonucleotide
  Target: ATXN1; (+) strand; PAM type: YTN; PAM sequence: TTA
tacatcagcaggagatggtt

SEQ ID NO: 256672 - DNA, 20 bp, Artificial Sequence
  Description of Artificial Sequence: Synthetic oligonucleotide
  Target: ATXN1; (+) strand; PAM type: YTN; PAM sequence: TTA
ccccgagaagctgctctgtt

SEQ ID NO: 256673 - DNA, 20 bp, Artificial Sequence
  Description of Artificial Sequence: Synthetic oligonucleotide
  Target: ATXN1; (+) strand; PAM type: YTN; PAM sequence: CTG
ctctgttccacacaattgcc

SEQ ID NO: 256674 - DNA, 20 bp, Artificial Sequence
  Description of Artificial Sequence: Synthetic oligonucleotide
  Target: ATXN1; (+) strand; PAM type: YTN; PAM sequence: CTC
tgttccacacaattgcctta

SEQ ID NO: 256675 - DNA, 20 bp, Artificial Sequence
  Description of Artificial Sequence: Synthetic oligonucleotide
  Target: ATXN1; (+) strand; PAM type: YTN; PAM sequence: CTG
ttccacacaattgccttagc

SEQ ID NO: 256676 - DNA, 20 bp, Artificial Sequence
  Description of Artificial Sequence: Synthetic oligonucleotide
  Target: ATXN1; (+) strand; PAM type: YTN; PAM sequence: TTC
cacacaattgccttagcgtc

SEQ ID NO: 256677 - DNA, 20 bp, Artificial Sequence
  Description of Artificial Sequence: Synthetic oligonucleotide
  Target: ATXN1; (+) strand; PAM type: YTN; PAM sequence: TTG
ccttagcgtctgtcctcttt

SEQ ID NO: 256678 - DNA, 20 bp, Artificial Sequence
  Description of Artificial Sequence: Synthetic oligonucleotide
  Target: ATXN1; (+) strand; PAM type: YTN; PAM sequence: CTT
agcgtctgtcctctttatga

SEQ ID NO: 256679 - DNA, 20 bp, Artificial Sequence
  Description of Artificial Sequence: Synthetic oligonucleotide
  Target: ATXN1; (+) strand; PAM type: YTN; PAM sequence: TTA
gcgtctgtcctctttatgaa

SEQ ID NO: 256680 - DNA, 20 bp, Artificial Sequence
  Description of Artificial Sequence: Synthetic oligonucleotide
  Target: ATXN1; (+) strand; PAM type: YTN; PAM sequence: CTG
tcctctttatgaaactaaaa

SEQ ID NO: 256681 - DNA, 20 bp, Artificial Sequence
  Description of Artificial Sequence: Synthetic oligonucleotide
  Target: ATXN1; (+) strand; PAM type: YTN; PAM sequence: CTC
tttatgaaactaaaaaaaaa

SEQ ID NO: 256682 - DNA, 20 bp, Artificial Sequence
  Description of Artificial Sequence: Synthetic oligonucleotide
  Target: ATXN1; (+) strand; PAM type: YTN; PAM sequence: CTT
tatgaaactaaaaaaaaaaa

SEQ ID NO: 256683 - DNA, 20 bp, Artificial Sequence
  Description of Artificial Sequence: Synthetic oligonucleotide
  Target: ATXN1; (+) strand; PAM type: YTN; PAM sequence: TTT
atgaaactaaaaaaaaaaaa

SEQ ID NO: 256684 - DNA, 20 bp, Artificial Sequence
  Description of Artificial Sequence: Synthetic oligonucleotide
  Target: ATXN1; (+) strand; PAM type: YTN; PAM sequence: TTA
tgaaactaaaaaaaaaaaac

SEQ ID NO: 256685 - DNA, 20 bp, Artificial Sequence
  Description of Artificial Sequence: Synthetic oligonucleotide
  Target: ATXN1; (+) strand; PAM type: YTN; PAM sequence: CTA
aaaaaaaaaaaccacagtaa

SEQ ID NO: 256686 - DNA, 20 bp, Artificial Sequence
  Description of Artificial Sequence: Synthetic oligonucleotide
  Target: ATXN1; (+) strand; PAM type: YTN; PAM sequence: CTG
tagttgttatgagcaccaac

SEQ ID NO: 256687 - DNA, 20 bp, Artificial Sequence
  Description of Artificial Sequence: Synthetic oligonucleotide
  Target: ATXN1; (+) strand; PAM type: YTN; PAM sequence: TTG
ttatgagcaccaacatttta

SEQ ID NO: 256688 - DNA, 20 bp, Artificial Sequence
  Description of Artificial Sequence: Synthetic oligonucleotide
  Target: ATXN1; (+) strand; PAM type: YTN; PAM sequence: TTA
tgagcaccaacattttaagt

SEQ ID NO: 256689 - DNA, 20 bp, Artificial Sequence
  Description of Artificial Sequence: Synthetic oligonucleotide
  Target: ATXN1; (+) strand; PAM type: YTN; PAM sequence: TTT
taagtctaattaaaaatttg

SEQ ID NO: 256690 - DNA, 20 bp, Artificial Sequence
  Description of Artificial Sequence: Synthetic oligonucleotide
  Target: ATXN1; (+) strand; PAM type: YTN; PAM sequence: TTT
aagtctaattaaaaatttga

SEQ ID NO: 256691 - DNA, 20 bp, Artificial Sequence
  Description of Artificial Sequence: Synthetic oligonucleotide
  Target: ATXN1; (+) strand; PAM type: YTN; PAM sequence: TTA
agtctaattaaaaatttgac

SEQ ID NO: 256692 - DNA, 20 bp, Artificial Sequence
  Description of Artificial Sequence: Synthetic oligonucleotide
  Target: ATXN1; (+) strand; PAM type: YTN; PAM sequence: CTA
attaaaaatttgacttgctg

SEQ ID NO: 256693 - DNA, 20 bp, Artificial Sequence
  Description of Artificial Sequence: Synthetic oligonucleotide
  Target: ATXN1; (+) strand; PAM type: YTN; PAM sequence: TTA
aaaatttgacttgctggcca

SEQ ID NO: 256694 - DNA, 20 bp, Artificial Sequence
  Description of Artificial Sequence: Synthetic oligonucleotide
  Target: ATXN1; (+) strand; PAM type: YTN; PAM sequence: TTT
gacttgctggccaggcaccg

SEQ ID NO: 256695 - DNA, 20 bp, Artificial Sequence
  Description of Artificial Sequence: Synthetic oligonucleotide
  Target: ATXN1; (+) strand; PAM type: YTN; PAM sequence: TTG
acttgctggccaggcaccgt

SEQ ID NO: 256696 - DNA, 20 bp, Artificial Sequence
  Description of Artificial Sequence: Synthetic oligonucleotide
  Target: ATXN1; (+) strand; PAM type: YTN; PAM sequence: CTT
gctggccaggcaccgtggct

SEQ ID NO: 256697 - DNA, 20 bp, Artificial Sequence
  Description of Artificial Sequence: Synthetic oligonucleotide
  Target: ATXN1; (+) strand; PAM type: YTN; PAM sequence: TTG
ctggccaggcaccgtggctc

SEQ ID NO: 256698 - DNA, 20 bp, Artificial Sequence
  Description of Artificial Sequence: Synthetic oligonucleotide
  Target: ATXN1; (+) strand; PAM type: YTN; PAM sequence: CTG
gccaggcaccgtggctcatg

SEQ ID NO: 256699 - DNA, 20 bp, Artificial Sequence
  Description of Artificial Sequence: Synthetic oligonucleotide
  Target: ATXN1; (+) strand; PAM type: YTN; PAM sequence: CTC
atgcctctaatcaaagcact

SEQ ID NO: 256700 - DNA, 20 bp, Artificial Sequence
  Description of Artificial Sequence: Synthetic oligonucleotide
  Target: ATXN1; (+) strand; PAM type: YTN; PAM sequence: CTC
taatcaaagcactttgggag

SEQ ID NO: 256701 - DNA, 20 bp, Artificial Sequence
  Description of Artificial Sequence: Synthetic oligonucleotide
  Target: ATXN1; (+) strand; PAM type: YTN; PAM sequence: CTA
atcaaagcactttgggaggc

SEQ ID NO: 256702 - DNA, 20 bp, Artificial Sequence
  Description of Artificial Sequence: Synthetic oligonucleotide
  Target: ATXN1; (+) strand; PAM type: YTN; PAM sequence: CTT
tgggaggcagaggcaggtgg

SEQ ID NO: 256703 - DNA, 20 bp, Artificial Sequence
  Description of Artificial Sequence: Synthetic oligonucleotide
  Target: ATXN1; (+) strand; PAM type: YTN; PAM sequence: TTT
gggaggcagaggcaggtgga

SEQ ID NO: 256704 - DNA, 20 bp, Artificial Sequence
  Description of Artificial Sequence: Synthetic oligonucleotide
  Target: ATXN1; (+) strand; PAM type: YTN; PAM sequence: TTG
ggaggcagaggcaggtggat

SEQ ID NO: 256705 - DNA, 20 bp, Artificial Sequence
  Description of Artificial Sequence: Synthetic oligonucleotide
  Target: ATXN1; (+) strand; PAM type: YTN; PAM sequence: CTT
aaggtcaggagttcaagacc

SEQ ID NO: 256706 - DNA, 20 bp, Artificial Sequence
  Description of Artificial Sequence: Synthetic oligonucleotide
  Target: ATXN1; (+) strand; PAM type: YTN; PAM sequence: TTA
aggtcaggagttcaagacca

SEQ ID NO: 256707 - DNA, 20 bp, Artificial Sequence
  Description of Artificial Sequence: Synthetic oligonucleotide
  Target: ATXN1; (+) strand; PAM type: YTN; PAM sequence: TTC
aagaccagcctggccaacat

SEQ ID NO: 256708 - DNA, 20 bp, Artificial Sequence
  Description of Artificial Sequence: Synthetic oligonucleotide
  Target: ATXN1; (+) strand; PAM type: YTN; PAM sequence: CTG
gccaacatagtgaaacactg

SEQ ID NO: 256709 - DNA, 20 bp, Artificial Sequence
  Description of Artificial Sequence: Synthetic oligonucleotide
  Target: ATXN1; (+) strand; PAM type: YTN; PAM sequence: CTG
tctctactaaaaatacaaaa

SEQ ID NO: 256710 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 256711 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattaac

SEQ ID NO: 256712 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattaacctg

SEQ ID NO: 256713 - DNA, 20 bp, Artificial Sequence
  Description of Artificial Sequence: Synthetic oligonucleotide
  Target: ATXN1; (+) strand; PAM type: YTN; PAM sequence: TTA
acctggcgtggtggctcacg

SEQ ID NO: 256714 - DNA, 20 bp, Artificial Sequence
  Description of Artificial Sequence: Synthetic oligonucleotide
  Target: ATXN1; (+) strand; PAM type: YTN; PAM sequence: CTG
gcgtggtggctcacgcctgt

SEQ ID NO: 256715 - DNA, 20 bp, Artificial Sequence
  Description of Artificial Sequence: Synthetic oligonucleotide
  Target: ATXN1; (+) strand; PAM type: YTN; PAM sequence: CTC
acgcctgtagtctcagctac

SEQ ID NO: 256716 - DNA, 20 bp, Artificial Sequence
  Description of Artificial Sequence: Synthetic oligonucleotide
  Target: ATXN1; (+) strand; PAM type: YTN; PAM sequence: CTG
tagtctcagctactcgggag

SEQ ID NO: 256717 - DNA, 20 bp, Artificial Sequence
  Description of Artificial Sequence: Synthetic oligonucleotide
  Target: ATXN1; (+) strand; PAM type: YTN; PAM sequence: CTC
agctactcgggaggctgagg

SEQ ID NO: 256718 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggctgaggcaggg

SEQ ID NO: 256719 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcaggggaa

SEQ ID NO: 256720 - DNA, 20 bp, Artificial Sequence
  Description of Artificial Sequence: Synthetic oligonucleotide
  Target: ATXN1; (+) strand; PAM type: YTN; PAM sequence: CTG
aggcaggggaatagcttgaa

SEQ ID NO: 256721 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggtggaggct

SEQ ID NO: 256722 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggtggaggcta

SEQ ID NO: 256723 - DNA, 20 bp, Artificial Sequence
  Description of Artificial Sequence: Synthetic oligonucleotide
  Target: ATXN1; (+) strand; PAM type: YTN; PAM sequence: CTG
ggaggtggaggctacagtga

SEQ ID NO: 256724 - DNA, 20 bp, Artificial Sequence
  Description of Artificial Sequence: Synthetic oligonucleotide
  Target: ATXN1; (+) strand; PAM type: YTN; PAM sequence: CTA
cagtgagctaagatcgtgcc

SEQ ID NO: 256725 - DNA, 20 bp, Artificial Sequence
  Description of Artificial Sequence: Synthetic oligonucleotide
  Target: ATXN1; (+) strand; PAM type: YTN; PAM sequence: CTA
agatcgtgccactgcattcc

SEQ ID NO: 256726 - DNA, 20 bp, Artificial Sequence
  Description of Artificial Sequence: Synthetic oligonucleotide
  Target: ATXN1; (+) strand; PAM type: YTN; PAM sequence: CTG
cattccagcctgggcaatag

SEQ ID NO: 256727 - DNA, 20 bp, Artificial Sequence
  Description of Artificial Sequence: Synthetic oligonucleotide
  Target: ATXN1; (+) strand; PAM type: YTN; PAM sequence: TTC
cagcctgggcaatagagtaa

SEQ ID NO: 256728 - DNA, 20 bp, Artificial Sequence
  Description of Artificial Sequence: Synthetic oligonucleotide
  Target: ATXN1; (+) strand; PAM type: YTN; PAM sequence: CTG
ggcaatagagtaagactagg

SEQ ID NO: 256729 - DNA, 20 bp, Artificial Sequence
  Description of Artificial Sequence: Synthetic oligonucleotide
  Target: ATXN1; (+) strand; PAM type: YTN; PAM sequence: CTA
ggtctcaaaaaaaaaaaaaa

SEQ ID NO: 256730 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaaaga

SEQ ID NO: 256731 - DNA, 20 bp, Artificial Sequence
  Description of Artificial Sequence: Synthetic oligonucleotide
  Target: ATXN1; (+) strand; PAM type: YTN; PAM sequence: CTC
gacttgccgtttatgcaatt

SEQ ID NO: 256732 - DNA, 20 bp, Artificial Sequence
  Description of Artificial Sequence: Synthetic oligonucleotide
  Target: ATXN1; (+) strand; PAM type: YTN; PAM sequence: CTT
gccgtttatgcaatttcaaa

SEQ ID NO: 256733 - DNA, 20 bp, Artificial Sequence
  Description of Artificial Sequence: Synthetic oligonucleotide
  Target: ATXN1; (+) strand; PAM type: YTN; PAM sequence: TTG
ccgtttatgcaatttcaaaa

SEQ ID NO: 256734 - DNA, 20 bp, Artificial Sequence
  Description of Artificial Sequence: Synthetic oligonucleotide
  Target: ATXN1; (+) strand; PAM type: YTN; PAM sequence: TTT
atgcaatttcaaaagctggc

SEQ ID NO: 256735 - DNA, 20 bp, Artificial Sequence
  Description of Artificial Sequence: Synthetic oligonucleotide
  Target: ATXN1; (+) strand; PAM type: YTN; PAM sequence: TTA
tgcaatttcaaaagctggct

SEQ ID NO: 256736 - DNA, 20 bp, Artificial Sequence
  Description of Artificial Sequence: Synthetic oligonucleotide
  Target: ATXN1; (+) strand; PAM type: YTN; PAM sequence: TTT
caaaagctggcttttgtagg

SEQ ID NO: 256737 - DNA, 20 bp, Artificial Sequence
  Description of Artificial Sequence: Synthetic oligonucleotide
  Target: ATXN1; (+) strand; PAM type: YTN; PAM sequence: TTC
aaaagctggcttttgtaggt

SEQ ID NO: 256738 - DNA, 20 bp, Artificial Sequence
  Description of Artificial Sequence: Synthetic oligonucleotide
  Target: ATXN1; (+) strand; PAM type: YTN; PAM sequence: CTG
gcttttgtaggtctaaaatt

SEQ ID NO: 256739 - DNA, 20 bp, Artificial Sequence
  Description of Artificial Sequence: Synthetic oligonucleotide
  Target: ATXN1; (+) strand; PAM type: YTN; PAM sequence: CTT
ttgtaggtctaaaattgttg

SEQ ID NO: 256740 - DNA, 20 bp, Artificial Sequence
  Description of Artificial Sequence: Synthetic oligonucleotide
  Target: ATXN1; (+) strand; PAM type: YTN; PAM sequence: TTT
tgtaggtctaaaattgttgt

SEQ ID NO: 256741 - DNA, 20 bp, Artificial Sequence
  Description of Artificial Sequence: Synthetic oligonucleotide
  Target: ATXN1; (+) strand; PAM type: YTN; PAM sequence: TTT
gtaggtctaaaattgttgta

SEQ ID NO: 256742 - DNA, 20 bp, Artificial Sequence
  Description of Artificial Sequence: Synthetic oligonucleotide
  Target: ATXN1; (+) strand; PAM type: YTN; PAM sequence: TTG
taggtctaaaattgttgtaa

SEQ ID NO: 256743 - DNA, 20 bp, Artificial Sequence
  Description of Artificial Sequence: Synthetic oligonucleotide
  Target: ATXN1; (+) strand; PAM type: YTN; PAM sequence: CTA
aaattgttgtaagacaattt

SEQ ID NO: 256744 - DNA, 20 bp, Artificial Sequence
  Description of Artificial Sequence: Synthetic oligonucleotide
  Target: ATXN1; (+) strand; PAM type: YTN; PAM sequence: TTG
ttgtaagacaattttaaaag

SEQ ID NO: 256745 - DNA, 20 bp, Artificial Sequence
  Description of Artificial Sequence: Synthetic oligonucleotide
  Target: ATXN1; (+) strand; PAM type: YTN; PAM sequence: TTG
taagacaattttaaaagctt

SEQ ID NO: 256746 - DNA, 20 bp, Artificial Sequence
  Description of Artificial Sequence: Synthetic oligonucleotide
  Target: ATXN1; (+) strand; PAM type: YTN; PAM sequence: TTT
taaaagcttccagacgtgca

SEQ ID NO: 256747 - DNA, 20 bp, Artificial Sequence
  Description of Artificial Sequence: Synthetic oligonucleotide
  Target: ATXN1; (+) strand; PAM type: YTN; PAM sequence: TTT
aaaagcttccagacgtgcag

SEQ ID NO: 256748 - DNA, 20 bp, Artificial Sequence
  Description of Artificial Sequence: Synthetic oligonucleotide
  Target: ATXN1; (+) strand; PAM type: YTN; PAM sequence: TTA
aaagcttccagacgtgcaga

SEQ ID NO: 256749 - DNA, 20 bp, Artificial Sequence
  Description of Artificial Sequence: Synthetic oligonucleotide
  Target: ATXN1; (+) strand; PAM type: YTN; PAM sequence: CTT
ccagacgtgcagaatctggg

SEQ ID NO: 256750 - DNA, 20 bp, Artificial Sequence
  Description of Artificial Sequence: Synthetic oligonucleotide
  Target: ATXN1; (+) strand; PAM type: YTN; PAM sequence: TTC
cagacgtgcagaatctgggg

SEQ ID NO: 256751 - DNA, 20 bp, Artificial Sequence
  Description of Artificial Sequence: Synthetic oligonucleotide
  Target: ATXN1; (+) strand; PAM type: YTN; PAM sequence: CTG
gggctcttctttgcccccca

SEQ ID NO: 256752 - DNA, 20 bp, Artificial Sequence
  Description of Artificial Sequence: Synthetic oligonucleotide
  Target: ATXN1; (+) strand; PAM type: YTN; PAM sequence: CTC
ttctttgccccccaccccac

SEQ ID NO: 256753 - DNA, 20 bp, Artificial Sequence
  Description of Artificial Sequence: Synthetic oligonucleotide
  Target: ATXN1; (+) strand; PAM type: YTN; PAM sequence: CTT
ctttgccccccaccccacag

SEQ ID NO: 256754 - DNA, 20 bp, Artificial Sequence
  Description of Artificial Sequence: Synthetic oligonucleotide
  Target: ATXN1; (+) strand; PAM type: YTN; PAM sequence: TTC
tttgccccccaccccacagc

SEQ ID NO: 256755 - DNA, 20 bp, Artificial Sequence
  Description of Artificial Sequence: Synthetic oligonucleotide
  Target: ATXN1; (+) strand; PAM type: YTN; PAM sequence: CTT
tgccccccaccccacagcct

SEQ ID NO: 256756 - DNA, 20 bp, Artificial Sequence
  Description of Artificial Sequence: Synthetic oligonucleotide
  Target: ATXN1; (+) strand; PAM type: YTN; PAM sequence: TTT
gccccccaccccacagcctc

SEQ ID NO: 256757 - DNA, 20 bp, Artificial Sequence
  Description of Artificial Sequence: Synthetic oligonucleotide
  Target: ATXN1; (+) strand; PAM type: YTN; PAM sequence: TTG
ccccccaccccacagcctca

SEQ ID NO: 256758 - DNA, 20 bp, Artificial Sequence
  Description of Artificial Sequence: Synthetic oligonucleotide
  Target: ATXN1; (+) strand; PAM type: YTN; PAM sequence: CTC
acatgtcttggtttgcggct

SEQ ID NO: 256759 - DNA, 20 bp, Artificial Sequence
  Description of Artificial Sequence: Synthetic oligonucleotide
  Target: ATXN1; (+) strand; PAM type: YTN; PAM sequence: CTT
ggtttgcggcttttaaacag

SEQ ID NO: 256760 - DNA, 20 bp, Artificial Sequence
  Description of Artificial Sequence: Synthetic oligonucleotide
  Target: ATXN1; (+) strand; PAM type: YTN; PAM sequence: TTG
gtttgcggcttttaaacagc

SEQ ID NO: 256761 - DNA, 20 bp, Artificial Sequence
  Description of Artificial Sequence: Synthetic oligonucleotide
  Target: ATXN1; (+) strand; PAM type: YTN; PAM sequence: TTT
gcggcttttaaacagcgagt

SEQ ID NO: 256762 - DNA, 20 bp, Artificial Sequence
  Description of Artificial Sequence: Synthetic oligonucleotide
  Target: ATXN1; (+) strand; PAM type: YTN; PAM sequence: TTG
cggcttttaaacagcgagtt

SEQ ID NO: 256763 - DNA, 20 bp, Artificial Sequence
  Description of Artificial Sequence: Synthetic oligonucleotide
  Target: ATXN1; (+) strand; PAM type: YTN; PAM sequence: CTT
ttaaacagcgagttctagag

SEQ ID NO: 256764 - DNA, 20 bp, Artificial Sequence
  Description of Artificial Sequence: Synthetic oligonucleotide
  Target: ATXN1; (+) strand; PAM type: YTN; PAM sequence: TTT
taaacagcgagttctagaga

SEQ ID NO: 256765 - DNA, 20 bp, Artificial Sequence
  Description of Artificial Sequence: Synthetic oligonucleotide
  Target: ATXN1; (+) strand; PAM type: YTN; PAM sequence: TTT
aaacagcgagttctagagaa

SEQ ID NO: 256766 - DNA, 20 bp, Artificial Sequence
  Description of Artificial Sequence: Synthetic oligonucleotide
  Target: ATXN1; (+) strand; PAM type: YTN; PAM sequence: TTA
aacagcgagttctagagaag

SEQ ID NO: 256767 - DNA, 20 bp, Artificial Sequence
  Description of Artificial Sequence: Synthetic oligonucleotide
  Target: ATXN1; (+) strand; PAM type: YTN; PAM sequence: TTC
tagagaagttccacaaaact

SEQ ID NO: 256768 - DNA, 20 bp, Artificial Sequence
  Description of Artificial Sequence: Synthetic oligonucleotide
  Target: ATXN1; (+) strand; PAM type: YTN; PAM sequence: CTA
gagaagttccacaaaactgt

SEQ ID NO: 256769 - DNA, 20 bp, Artificial Sequence
  Description of Artificial Sequence: Synthetic oligonucleotide
  Target: ATXN1; (+) strand; PAM type: YTN; PAM sequence: TTC
cacaaaactgtgctccacct

SEQ ID NO: 256770 - DNA, 20 bp, Artificial Sequence
  Description of Artificial Sequence: Synthetic oligonucleotide
  Target: ATXN1; (+) strand; PAM type: YTN; PAM sequence: CTG
tgctccacctgctggccttc

SEQ ID NO: 256771 - DNA, 20 bp, Artificial Sequence
  Description of Artificial Sequence: Synthetic oligonucleotide
  Target: ATXN1; (+) strand; PAM type: YTN; PAM sequence: CTC
cacctgctggccttctgggg

SEQ ID NO: 256772 - DNA, 20 bp, Artificial Sequence
  Description of Artificial Sequence: Synthetic oligonucleotide
  Target: ATXN1; (+) strand; PAM type: YTN; PAM sequence: CTG
ctggccttctggggaagctg

SEQ ID NO: 256773 - DNA, 20 bp, Artificial Sequence
  Description of Artificial Sequence: Synthetic oligonucleotide
  Target: ATXN1; (+) strand; PAM type: YTN; PAM sequence: CTG
gccttctggggaagctgcgt

SEQ ID NO: 256774 - DNA, 20 bp, Artificial Sequence
  Description of Artificial Sequence: Synthetic oligonucleotide
  Target: ATXN1; (+) strand; PAM type: YTN; PAM sequence: CTT
ctggggaagctgcgtctggg

SEQ ID NO: 256775 - DNA, 20 bp, Artificial Sequence
  Description of Artificial Sequence: Synthetic oligonucleotide
  Target: ATXN1; (+) strand; PAM type: YTN; PAM sequence: TTC
tggggaagctgcgtctgggc

SEQ ID NO: 256776 - DNA, 20 bp, Artificial Sequence
  Description of Artificial Sequence: Synthetic oligonucleotide
  Target: ATXN1; (+) strand; PAM type: YTN; PAM sequence: CTG
gggaagctgcgtctgggctg

SEQ ID NO: 256777 - DNA, 20 bp, Artificial Sequence
  Description of Artificial Sequence: Synthetic oligonucleotide
  Target: ATXN1; (+) strand; PAM type: YTN; PAM sequence: CTG
cgtctgggctgatgatgctg

SEQ ID NO: 256778 - DNA, 20 bp, Artificial Sequence
  Description of Artificial Sequence: Synthetic oligonucleotide
  Target: ATXN1; (+) strand; PAM type: YTN; PAM sequence: CTG
ggctgatgatgctggttgcg

SEQ ID NO: 256779 - DNA, 20 bp, Artificial Sequence
  Description of Artificial Sequence: Synthetic oligonucleotide
  Target: ATXN1; (+) strand; PAM type: YTN; PAM sequence: CTG
atgatgctggttgcgggttg

SEQ ID NO: 256780 - DNA, 20 bp, Artificial Sequence
  Description of Artificial Sequence: Synthetic oligonucleotide
  Target: ATXN1; (+) strand; PAM type: YTN; PAM sequence: CTG
gttgcgggttgagcgaaaac

SEQ ID NO: 256781 - DNA, 20 bp, Artificial Sequence
  Description of Artificial Sequence: Synthetic oligonucleotide
  Target: ATXN1; (+) strand; PAM type: YTN; PAM sequence: TTG
cgggttgagcgaaaacaagg

SEQ ID NO: 256782 - DNA, 20 bp, Artificial Sequence
  Description of Artificial Sequence: Synthetic oligonucleotide
  Target: ATXN1; (+) strand; PAM type: YTN; PAM sequence: TTG
agcgaaaacaaggaacagat

SEQ ID NO: 256783 - DNA, 20 bp, Artificial Sequence
  Description of Artificial Sequence: Synthetic oligonucleotide
  Target: ATXN1; (+) strand; PAM type: YTN; PAM sequence: TTT
gagtttgtccaaagcatgct

SEQ ID NO: 256784 - DNA, 20 bp, Artificial Sequence
  Description of Artificial Sequence: Synthetic oligonucleotide
  Target: ATXN1; (+) strand; PAM type: YTN; PAM sequence: TTG
agtttgtccaaagcatgctt

SEQ ID NO: 256785 - DNA, 20 bp, Artificial Sequence
  Description of Artificial Sequence: Synthetic oligonucleotide
  Target: ATXN1; (+) strand; PAM type: YTN; PAM sequence: TTT
gtccaaagcatgcttggtac

SEQ ID NO: 256786 - DNA, 20 bp, Artificial Sequence
  Description of Artificial Sequence: Synthetic oligonucleotide
  Target: ATXN1; (+) strand; PAM type: YTN; PAM sequence: TTG
tccaaagcatgcttggtact

SEQ ID NO: 256787 - DNA, 20 bp, Artificial Sequence
  Description of Artificial Sequence: Synthetic oligonucleotide
  Target: ATXN1; (+) strand; PAM type: YTN; PAM sequence: CTT
ggtacttgaaaattaaccct

SEQ ID NO: 256788 - DNA, 20 bp, Artificial Sequence
  Description of Artificial Sequence: Synthetic oligonucleotide
  Target: ATXN1; (+) strand; PAM type: YTN; PAM sequence: TTG
gtacttgaaaattaaccctt

SEQ ID NO: 256789 - DNA, 20 bp, Artificial Sequence
  Description of Artificial Sequence: Synthetic oligonucleotide
  Target: ATXN1; (+) strand; PAM type: YTN; PAM sequence: CTT
gaaaattaacccttcaagac

SEQ ID NO: 256790 - DNA, 20 bp, Artificial Sequence
  Description of Artificial Sequence: Synthetic oligonucleotide
  Target: ATXN1; (+) strand; PAM type: YTN; PAM sequence: TTG
aaaattaacccttcaagact

SEQ ID NO: 256791 - DNA, 20 bp, Artificial Sequence
  Description of Artificial Sequence: Synthetic oligonucleotide
  Target: ATXN1; (+) strand; PAM type: YTN; PAM sequence: TTA
acccttcaagactgggcatg

SEQ ID NO: 256792 - DNA, 20 bp, Artificial Sequence
  Description of Artificial Sequence: Synthetic oligonucleotide
  Target: ATXN1; (+) strand; PAM type: YTN; PAM sequence: CTT
caagactgggcatgtgtcca

SEQ ID NO: 256793 - DNA, 20 bp, Artificial Sequence
  Description of Artificial Sequence: Synthetic oligonucleotide
  Target: ATXN1; (+) strand; PAM type: YTN; PAM sequence: TTC
aagactgggcatgtgtccag

SEQ ID NO: 256794 - DNA, 20 bp, Artificial Sequence
  Description of Artificial Sequence: Synthetic oligonucleotide
  Target: ATXN1; (+) strand; PAM type: YTN; PAM sequence: CTG
ggcatgtgtccagtgatgct

SEQ ID NO: 256795 - DNA, 20 bp, Artificial Sequence
  Description of Artificial Sequence: Synthetic oligonucleotide
  Target: ATXN1; (+) strand; PAM type: YTN; PAM sequence: CTC
tgaagctggcaaagatgagc

SEQ ID NO: 256796 - DNA, 20 bp, Artificial Sequence
  Description of Artificial Sequence: Synthetic oligonucleotide
  Target: ATXN1; (+) strand; PAM type: YTN; PAM sequence: CTG
aagctggcaaagatgagcat

SEQ ID NO: 256797 - DNA, 20 bp, Artificial Sequence
  Description of Artificial Sequence: Synthetic oligonucleotide
  Target: ATXN1; (+) strand; PAM type: YTN; PAM sequence: CTG
gcaaagatgagcatcaaatc

SEQ ID NO: 256798 - DNA, 20 bp, Artificial Sequence
  Description of Artificial Sequence: Synthetic oligonucleotide
  Target: ATXN1; (+) strand; PAM type: YTN; PAM sequence: CTG
aacgaccgtcgtgataggct

SEQ ID NO: 256799 - DNA, 20 bp, Artificial Sequence
  Description of Artificial Sequence: Synthetic oligonucleotide
  Target: ATXN1; (+) strand; PAM type: YTN; PAM sequence: CTT
ggcagaggatgaagcagagg

SEQ ID NO: 256800 - DNA, 20 bp, Artificial Sequence
  Description of Artificial Sequence: Synthetic oligonucleotide
  Target: ATXN1; (+) strand; PAM type: YTN; PAM sequence: TTG
gcagaggatgaagcagaggg

SEQ ID NO: 256801 - DNA, 20 bp, Artificial Sequence
  Description of Artificial Sequence: Synthetic oligonucleotide
  Target: ATXN1; (+) strand; PAM type: YTN; PAM sequence: CTA
cctgggtgctggcactgcct

SEQ ID NO: 256802 - DNA, 20 bp, Artificial Sequence
  Description of Artificial Sequence: Synthetic oligonucleotide
  Target: ATXN1; (+) strand; PAM type: YTN; PAM sequence: CTG
ggtgctggcactgcctcggc

SEQ ID NO: 256803 - DNA, 20 bp, Artificial Sequence
  Description of Artificial Sequence: Synthetic oligonucleotide
  Target: ATXN1; (+) strand; PAM type: YTN; PAM sequence: CTG
gcactgcctcggcctcttgc

SEQ ID NO: 256804 - DNA, 20 bp, Artificial Sequence
  Description of Artificial Sequence: Synthetic oligonucleotide
  Target: ATXN1; (+) strand; PAM type: YTN; PAM sequence: CTG
cctcggcctcttgcttacta

SEQ ID NO: 256805 - DNA, 20 bp, Artificial Sequence
  Description of Artificial Sequence: Synthetic oligonucleotide
  Target: ATXN1; (+) strand; PAM type: YTN; PAM sequence: CTC
ggcctcttgcttactatgac

SEQ ID NO: 256806 - DNA, 20 bp, Artificial Sequence
  Description of Artificial Sequence: Synthetic oligonucleotide
  Target: ATXN1; (+) strand; PAM type: YTN; PAM sequence: CTC
ttgcttactatgacgccgtg

SEQ ID NO: 256807 - DNA, 20 bp, Artificial Sequence
  Description of Artificial Sequence: Synthetic oligonucleotide
  Target: ATXN1; (+) strand; PAM type: YTN; PAM sequence: CTT
gcttactatgacgccgtgtg

SEQ ID NO: 256808 - DNA, 20 bp, Artificial Sequence
  Description of Artificial Sequence: Synthetic oligonucleotide
  Target: ATXN1; (+) strand; PAM type: YTN; PAM sequence: TTG
cttactatgacgccgtgtga

SEQ ID NO: 256809 - DNA, 20 bp, Artificial Sequence
  Description of Artificial Sequence: Synthetic oligonucleotide
  Target: ATXN1; (+) strand; PAM type: YTN; PAM sequence: CTT
actatgacgccgtgtgaatc

SEQ ID NO: 256810 - DNA, 20 bp, Artificial Sequence
  Description of Artificial Sequence: Synthetic oligonucleotide
  Target: ATXN1; (+) strand; PAM type: YTN; PAM sequence: TTA
ctatgacgccgtgtgaatca

SEQ ID NO: 256811 - DNA, 20 bp, Artificial Sequence
  Description of Artificial Sequence: Synthetic oligonucleotide
  Target: ATXN1; (+) strand; PAM type: YTN; PAM sequence: CTA
tgacgccgtgtgaatcacag

SEQ ID NO: 256812 - DNA, 20 bp, Artificial Sequence
  Description of Artificial Sequence: Synthetic oligonucleotide
  Target: ATXN1; (+) strand; PAM type: YTN; PAM sequence: CTA
gcggccctccttccccctta

SEQ ID NO: 256813 - DNA, 20 bp, Artificial Sequence
  Description of Artificial Sequence: Synthetic oligonucleotide
  Target: ATXN1; (+) strand; PAM type: YTN; PAM sequence: CTC
cttcccccttactatgactt

SEQ ID NO: 256814 - DNA, 20 bp, Artificial Sequence
  Description of Artificial Sequence: Synthetic oligonucleotide
  Target: ATXN1; (+) strand; PAM type: YTN; PAM sequence: CTT
cccccttactatgacttcca

SEQ ID NO: 256815 - DNA, 20 bp, Artificial Sequence
  Description of Artificial Sequence: Synthetic oligonucleotide
  Target: ATXN1; (+) strand; PAM type: YTN; PAM sequence: TTC
ccccttactatgacttccaa

SEQ ID NO: 256816 - DNA, 20 bp, Artificial Sequence
  Description of Artificial Sequence: Synthetic oligonucleotide
  Target: ATXN1; (+) strand; PAM type: YTN; PAM sequence: CTT
actatgacttccaattttga

SEQ ID NO: 256817 - DNA, 20 bp, Artificial Sequence
  Description of Artificial Sequence: Synthetic oligonucleotide
  Target: ATXN1; (+) strand; PAM type: YTN; PAM sequence: TTA
ctatgacttccaattttgaa

SEQ ID NO: 256818 - DNA, 20 bp, Artificial Sequence
  Description of Artificial Sequence: Synthetic oligonucleotide
  Target: ATXN1; (+) strand; PAM type: YTN; PAM sequence: CTA
tgacttccaattttgaaata

SEQ ID NO: 256819 - DNA, 20 bp, Artificial Sequence
  Description of Artificial Sequence: Synthetic oligonucleotide
  Target: ATXN1; (+) strand; PAM type: YTN; PAM sequence: CTT
ccaattttgaaatactgtga

SEQ ID NO: 256820 - DNA, 20 bp, Artificial Sequence
  Description of Artificial Sequence: Synthetic oligonucleotide
  Target: ATXN1; (+) strand; PAM type: YTN; PAM sequence: TTC
caattttgaaatactgtgac

SEQ ID NO: 256821 - DNA, 20 bp, Artificial Sequence
  Description of Artificial Sequence: Synthetic oligonucleotide
  Target: ATXN1; (+) strand; PAM type: YTN; PAM sequence: TTT
tgaaatactgtgactctgct

SEQ ID NO: 256822 - DNA, 20 bp, Artificial Sequence
  Description of Artificial Sequence: Synthetic oligonucleotide
  Target: ATXN1; (+) strand; PAM type: YTN; PAM sequence: TTT
gaaatactgtgactctgctg

SEQ ID NO: 256823 - DNA, 20 bp, Artificial Sequence
  Description of Artificial Sequence: Synthetic oligonucleotide
  Target: ATXN1; (+) strand; PAM type: YTN; PAM sequence: TTG
aaatactgtgactctgctgt

SEQ ID NO: 256824 - DNA, 20 bp, Artificial Sequence
  Description of Artificial Sequence: Synthetic oligonucleotide
  Target: ATXN1; (+) strand; PAM type: YTN; PAM sequence: CTG
tgactctgctgtgtacttaa

SEQ ID NO: 256825 - DNA, 20 bp, Artificial Sequence
  Description of Artificial Sequence: Synthetic oligonucleotide
  Target: ATXN1; (+) strand; PAM type: YTN; PAM sequence: CTC
tgctgtgtacttaattgaca

SEQ ID NO: 256826 - DNA, 20 bp, Artificial Sequence
  Description of Artificial Sequence: Synthetic oligonucleotide
  Target: ATXN1; (+) strand; PAM type: YTN; PAM sequence: CTG
ctgtgtacttaattgacatc

SEQ ID NO: 256827 - DNA, 20 bp, Artificial Sequence
  Description of Artificial Sequence: Synthetic oligonucleotide
  Target: ATXN1; (+) strand; PAM type: YTN; PAM sequence: CTG
tgtacttaattgacatctct

SEQ ID NO: 256828 - DNA, 20 bp, Artificial Sequence
  Description of Artificial Sequence: Synthetic oligonucleotide
  Target: ATXN1; (+) strand; PAM type: YTN; PAM sequence: CTT
aattgacatctctttctgaa

SEQ ID NO: 256829 - DNA, 20 bp, Artificial Sequence
  Description of Artificial Sequence: Synthetic oligonucleotide
  Target: ATXN1; (+) strand; PAM type: YTN; PAM sequence: TTA
attgacatctctttctgaag

SEQ ID NO: 256830 - DNA, 20 bp, Artificial Sequence
  Description of Artificial Sequence: Synthetic oligonucleotide
  Target: ATXN1; (+) strand; PAM type: YTN; PAM sequence: TTG
acatctctttctgaaggaat

SEQ ID NO: 256831 - DNA, 20 bp, Artificial Sequence
  Description of Artificial Sequence: Synthetic oligonucleotide
  Target: ATXN1; (+) strand; PAM type: YTN; PAM sequence: CTC
tttctgaaggaatttacaat

SEQ ID NO: 256832 - DNA, 20 bp, Artificial Sequence
  Description of Artificial Sequence: Synthetic oligonucleotide
  Target: ATXN1; (+) strand; PAM type: YTN; PAM sequence: CTT
tctgaaggaatttacaatcc

SEQ ID NO: 256833 - DNA, 20 bp, Artificial Sequence
  Description of Artificial Sequence: Synthetic oligonucleotide
  Target: ATXN1; (+) strand; PAM type: YTN; PAM sequence: TTT
ctgaaggaatttacaatcca

SEQ ID NO: 256834 - DNA, 20 bp, Artificial Sequence
  Description of Artificial Sequence: Synthetic oligonucleotide
  Target: ATXN1; (+) strand; PAM type: YTN; PAM sequence: TTC
tgaaggaatttacaatccag

SEQ ID NO: 256835 - DNA, 20 bp, Artificial Sequence
  Description of Artificial Sequence: Synthetic oligonucleotide
  Target: ATXN1; (+) strand; PAM type: YTN; PAM sequence: CTG
aaggaatttacaatccagtt

SEQ ID NO: 256836 - DNA, 20 bp, Artificial Sequence
  Description of Artificial Sequence: Synthetic oligonucleotide
  Target: ATXN1; (+) strand; PAM type: YTN; PAM sequence: TTT
acaatccagttgatgatgta

SEQ ID NO: 256837 - DNA, 20 bp, Artificial Sequence
  Description of Artificial Sequence: Synthetic oligonucleotide
  Target: ATXN1; (+) strand; PAM type: YTN; PAM sequence: TTA
caatccagttgatgatgtaa

SEQ ID NO: 256838 - DNA, 20 bp, Artificial Sequence
  Description of Artificial Sequence: Synthetic oligonucleotide
  Target: ATXN1; (+) strand; PAM type: YTN; PAM sequence: TTG
atgatgtaagacccactatc

SEQ ID NO: 256839 - DNA, 20 bp, Artificial Sequence
  Description of Artificial Sequence: Synthetic oligonucleotide
  Target: ATXN1; (+) strand; PAM type: YTN; PAM sequence: CTA
tcataagccaattagagaac

SEQ ID NO: 256840 - DNA, 20 bp, Artificial Sequence
  Description of Artificial Sequence: Synthetic oligonucleotide
  Target: ATXN1; (+) strand; PAM type: YTN; PAM sequence: TTA
gagaaccaaacaagtgctga

SEQ ID NO: 256841 - DNA, 20 bp, Artificial Sequence
  Description of Artificial Sequence: Synthetic oligonucleotide
  Target: ATXN1; (+) strand; PAM type: YTN; PAM sequence: CTG
aagggacccctatggaggca

SEQ ID NO: 256842 - DNA, 20 bp, Artificial Sequence
  Description of Artificial Sequence: Synthetic oligonucleotide
  Target: ATXN1; (+) strand; PAM type: YTN; PAM sequence: CTA
tggaggcagagaacctgaaa

SEQ ID NO: 256843 - DNA, 20 bp, Artificial Sequence
  Description of Artificial Sequence: Synthetic oligonucleotide
  Target: ATXN1; (+) strand; PAM type: YTN; PAM sequence: CTG
aaatgaacagtgaagactaa

SEQ ID NO: 256844 - DNA, 20 bp, Artificial Sequence
  Description of Artificial Sequence: Synthetic oligonucleotide
  Target: ATXN1; (+) strand; PAM type: YTN; PAM sequence: CTA
aatctgacttacaaaggtga

SEQ ID NO: 256845 - DNA, 20 bp, Artificial Sequence
  Description of Artificial Sequence: Synthetic oligonucleotide
  Target: ATXN1; (+) strand; PAM type: YTN; PAM sequence: CTG
acttacaaaggtgaggagca

SEQ ID NO: 256846 - DNA, 20 bp, Artificial Sequence
  Description of Artificial Sequence: Synthetic oligonucleotide
  Target: ATXN1; (+) strand; PAM type: YTN; PAM sequence: CTT
acaaaggtgaggagcaggga

SEQ ID NO: 256847 - DNA, 20 bp, Artificial Sequence
  Description of Artificial Sequence: Synthetic oligonucleotide
  Target: ATXN1; (+) strand; PAM type: YTN; PAM sequence: TTA
caaaggtgaggagcagggag

SEQ ID NO: 256848 - DNA, 20 bp, Artificial Sequence
  Description of Artificial Sequence: Synthetic oligonucleotide
  Target: ATXN1; (+) strand; PAM type: YTN; PAM sequence: TTT
ctttcctaatgcttgcactg

SEQ ID NO: 256849 - DNA, 20 bp, Artificial Sequence
  Description of Artificial Sequence: Synthetic oligonucleotide
  Target: ATXN1; (+) strand; PAM type: YTN; PAM sequence: TTC
tttcctaatgcttgcactgg

SEQ ID NO: 256850 - DNA, 20 bp, Artificial Sequence
  Description of Artificial Sequence: Synthetic oligonucleotide
  Target: ATXN1; (+) strand; PAM type: YTN; PAM sequence: CTT
tcctaatgcttgcactggga

SEQ ID NO: 256851 - DNA, 20 bp, Artificial Sequence
  Description of Artificial Sequence: Synthetic oligonucleotide
  Target: ATXN1; (+) strand; PAM type: YTN; PAM sequence: TTT
cctaatgcttgcactgggat

SEQ ID NO: 256852 - DNA, 20 bp, Artificial Sequence
  Description of Artificial Sequence: Synthetic oligonucleotide
  Target: ATXN1; (+) strand; PAM type: YTN; PAM sequence: TTC
ctaatgcttgcactgggatt

SEQ ID NO: 256853 - DNA, 20 bp, Artificial Sequence
  Description of Artificial Sequence: Synthetic oligonucleotide
  Target: ATXN1; (+) strand; PAM type: YTN; PAM sequence: CTA
atgcttgcactgggatttct

SEQ ID NO: 256854 - DNA, 20 bp, Artificial Sequence
  Description of Artificial Sequence: Synthetic oligonucleotide
  Target: ATXN1; (+) strand; PAM type: YTN; PAM sequence: CTT
gcactgggatttctgacgaa

SEQ ID NO: 256855 - DNA, 20 bp, Artificial Sequence
  Description of Artificial Sequence: Synthetic oligonucleotide
  Target: ATXN1; (+) strand; PAM type: YTN; PAM sequence: TTG
cactgggatttctgacgaat

SEQ ID NO: 256856 - DNA, 20 bp, Artificial Sequence
  Description of Artificial Sequence: Synthetic oligonucleotide
  Target: ATXN1; (+) strand; PAM type: YTN; PAM sequence: CTG
ggatttctgacgaatacctc

SEQ ID NO: 256857 - DNA, 20 bp, Artificial Sequence
  Description of Artificial Sequence: Synthetic oligonucleotide
  Target: ATXN1; (+) strand; PAM type: YTN; PAM sequence: TTT
ctgacgaatacctcagaggc

SEQ ID NO: 256858 - DNA, 20 bp, Artificial Sequence
  Description of Artificial Sequence: Synthetic oligonucleotide
  Target: ATXN1; (+) strand; PAM type: YTN; PAM sequence: TTC
tgacgaatacctcagaggct

SEQ ID NO: 256859 - DNA, 20 bp, Artificial Sequence
  Description of Artificial Sequence: Synthetic oligonucleotide
  Target: ATXN1; (+) strand; PAM type: YTN; PAM sequence: CTG
acgaatacctcagaggctat

SEQ ID NO: 256860 - DNA, 20 bp, Artificial Sequence
  Description of Artificial Sequence: Synthetic oligonucleotide
  Target: ATXN1; (+) strand; PAM type: YTN; PAM sequence: CTC
agaggctatgttgggctttt

SEQ ID NO: 256861 - DNA, 20 bp, Artificial Sequence
  Description of Artificial Sequence: Synthetic oligonucleotide
  Target: ATXN1; (+) strand; PAM type: YTN; PAM sequence: CTA
tgttgggctttttctgatgt

SEQ ID NO: 256862 - DNA, 20 bp, Artificial Sequence
  Description of Artificial Sequence: Synthetic oligonucleotide
  Target: ATXN1; (+) strand; PAM type: YTN; PAM sequence: TTG
ggctttttctgatgtagcga

SEQ ID NO: 256863 - DNA, 20 bp, Artificial Sequence
  Description of Artificial Sequence: Synthetic oligonucleotide
  Target: ATXN1; (+) strand; PAM type: YTN; PAM sequence: CTT
tttctgatgtagcgatattt

SEQ ID NO: 256864 - DNA, 20 bp, Artificial Sequence
  Description of Artificial Sequence: Synthetic oligonucleotide
  Target: ATXN1; (+) strand; PAM type: YTN; PAM sequence: TTT
ttctgatgtagcgatatttt

SEQ ID NO: 256865 - DNA, 20 bp, Artificial Sequence
  Description of Artificial Sequence: Synthetic oligonucleotide
  Target: ATXN1; (+) strand; PAM type: YTN; PAM sequence: TTT
tctgatgtagcgatattttg

SEQ ID NO: 256866 - DNA, 20 bp, Artificial Sequence
  Description of Artificial Sequence: Synthetic oligonucleotide
  Target: ATXN1; (+) strand; PAM type: YTN; PAM sequence: TTT
ctgatgtagcgatattttgg

SEQ ID NO: 256867 - DNA, 20 bp, Artificial Sequence
  Description of Artificial Sequence: Synthetic oligonucleotide
  Target: ATXN1; (+) strand; PAM type: YTN; PAM sequence: TTC
tgatgtagcgatattttgga

SEQ ID NO: 256868 - DNA, 20 bp, Artificial Sequence
  Description of Artificial Sequence: Synthetic oligonucleotide
  Target: ATXN1; (+) strand; PAM type: YTN; PAM sequence: CTG
atgtagcgatattttggaga

SEQ ID NO: 256869 - DNA, 20 bp, Artificial Sequence
  Description of Artificial Sequence: Synthetic oligonucleotide
  Target: ATXN1; (+) strand; PAM type: YTN; PAM sequence: TTT
tggagattatggttcaacca

SEQ ID NO: 256870 - DNA, 20 bp, Artificial Sequence
  Description of Artificial Sequence: Synthetic oligonucleotide
  Target: ATXN1; (+) strand; PAM type: YTN; PAM sequence: TTT
ggagattatggttcaaccag

SEQ ID NO: 256871 - DNA, 20 bp, Artificial Sequence
  Description of Artificial Sequence: Synthetic oligonucleotide
  Target: ATXN1; (+) strand; PAM type: YTN; PAM sequence: TTG
gagattatggttcaaccagt

SEQ ID NO: 256872 - DNA, 20 bp, Artificial Sequence
  Description of Artificial Sequence: Synthetic oligonucleotide
  Target: ATXN1; (+) strand; PAM type: YTN; PAM sequence: TTA
tggttcaaccagtgatttgt

SEQ ID NO: 256873 - DNA, 20 bp, Artificial Sequence
  Description of Artificial Sequence: Synthetic oligonucleotide
  Target: ATXN1; (+) strand; PAM type: YTN; PAM sequence: TTC
aaccagtgatttgtctaaac

SEQ ID NO: 256874 - DNA, 20 bp, Artificial Sequence
  Description of Artificial Sequence: Synthetic oligonucleotide
  Target: ATXN1; (+) strand; PAM type: YTN; PAM sequence: TTT
gtctaaacctgtttgaggat

SEQ ID NO: 256875 - DNA, 20 bp, Artificial Sequence
  Description of Artificial Sequence: Synthetic oligonucleotide
  Target: ATXN1; (+) strand; PAM type: YTN; PAM sequence: TTG
tctaaacctgtttgaggatt

SEQ ID NO: 256876 - DNA, 20 bp, Artificial Sequence
  Description of Artificial Sequence: Synthetic oligonucleotide
  Target: ATXN1; (+) strand; PAM type: YTN; PAM sequence: CTA
aacctgtttgaggattcttt

SEQ ID NO: 256877 - DNA, 20 bp, Artificial Sequence
  Description of Artificial Sequence: Synthetic oligonucleotide
  Target: ATXN1; (+) strand; PAM type: YTN; PAM sequence: CTG
tttgaggattctttctaaca

SEQ ID NO: 256878 - DNA, 20 bp, Artificial Sequence
  Description of Artificial Sequence: Synthetic oligonucleotide
  Target: ATXN1; (+) strand; PAM type: YTN; PAM sequence: TTT
gaggattctttctaacatat

SEQ ID NO: 256879 - DNA, 20 bp, Artificial Sequence
  Description of Artificial Sequence: Synthetic oligonucleotide
  Target: ATXN1; (+) strand; PAM type: YTN; PAM sequence: TTG
aggattctttctaacatatc

SEQ ID NO: 256880 - DNA, 20 bp, Artificial Sequence
  Description of Artificial Sequence: Synthetic oligonucleotide
  Target: ATXN1; (+) strand; PAM type: YTN; PAM sequence: TTC
tttctaacatatcattccct

SEQ ID NO: 256881 - DNA, 20 bp, Artificial Sequence
  Description of Artificial Sequence: Synthetic oligonucleotide
  Target: ATXN1; (+) strand; PAM type: YTN; PAM sequence: CTT
tctaacatatcattcccttc

SEQ ID NO: 256882 - DNA, 20 bp, Artificial Sequence
  Description of Artificial Sequence: Synthetic oligonucleotide
  Target: ATXN1; (+) strand; PAM type: YTN; PAM sequence: TTT
ctaacatatcattcccttcc

SEQ ID NO: 256883 - DNA, 20 bp, Artificial Sequence
  Description of Artificial Sequence: Synthetic oligonucleotide
  Target: ATXN1; (+) strand; PAM type: YTN; PAM sequence: TTC
taacatatcattcccttccc

SEQ ID NO: 256884 - DNA, 20 bp, Artificial Sequence
  Description of Artificial Sequence: Synthetic oligonucleotide
  Target: ATXN1; (+) strand; PAM type: YTN; PAM sequence: CTA
acatatcattcccttcccta

SEQ ID NO: 256885 - DNA, 20 bp, Artificial Sequence
  Description of Artificial Sequence: Synthetic oligonucleotide
  Target: ATXN1; (+) strand; PAM type: YTN; PAM sequence: TTC
ccttccctacataaagataa

SEQ ID NO: 256886 - DNA, 20 bp, Artificial Sequence
  Description of Artificial Sequence: Synthetic oligonucleotide
  Target: ATXN1; (+) strand; PAM type: YTN; PAM sequence: CTT
ccctacataaagataatatg

SEQ ID NO: 256887 - DNA, 20 bp, Artificial Sequence
  Description of Artificial Sequence: Synthetic oligonucleotide
  Target: ATXN1; (+) strand; PAM type: YTN; PAM sequence: TTC
cctacataaagataatatgc

SEQ ID NO: 256888 - DNA, 20 bp, Artificial Sequence
  Description of Artificial Sequence: Synthetic oligonucleotide
  Target: ATXN1; (+) strand; PAM type: YTN; PAM sequence: CTA
cataaagataatatgcaaaa

SEQ ID NO: 256889 - DNA, 20 bp, Artificial Sequence
  Description of Artificial Sequence: Synthetic oligonucleotide
  Target: ATXN1; (+) strand; PAM type: YTN; PAM sequence: TTT
gttttactagaatcttcttt

SEQ ID NO: 256890 - DNA, 20 bp, Artificial Sequence
  Description of Artificial Sequence: Synthetic oligonucleotide
  Target: ATXN1; (+) strand; PAM type: YTN; PAM sequence: TTG
ttttactagaatcttcttta

SEQ ID NO: 256891 - DNA, 20 bp, Artificial Sequence
  Description of Artificial Sequence: Synthetic oligonucleotide
  Target: ATXN1; (+) strand; PAM type: YTN; PAM sequence: TTT
tactagaatcttctttatgt

SEQ ID NO: 256892 - DNA, 20 bp, Artificial Sequence
  Description of Artificial Sequence: Synthetic oligonucleotide
  Target: ATXN1; (+) strand; PAM type: YTN; PAM sequence: TTT
actagaatcttctttatgtt

SEQ ID NO: 256893 - DNA, 20 bp, Artificial Sequence
  Description of Artificial Sequence: Synthetic oligonucleotide
  Target: ATXN1; (+) strand; PAM type: YTN; PAM sequence: TTA
ctagaatcttctttatgttc

SEQ ID NO: 256894 - DNA, 20 bp, Artificial Sequence
  Description of Artificial Sequence: Synthetic oligonucleotide
  Target: ATXN1; (+) strand; PAM type: YTN; PAM sequence: CTA
gaatcttctttatgttctaa

SEQ ID NO: 256895 - DNA, 20 bp, Artificial Sequence
  Description of Artificial Sequence: Synthetic oligonucleotide
  Target: ATXN1; (+) strand; PAM type: YTN; PAM sequence: CTT
ctttatgttctaaagtctta

SEQ ID NO: 256896 - DNA, 20 bp, Artificial Sequence
  Description of Artificial Sequence: Synthetic oligonucleotide
  Target: ATXN1; (+) strand; PAM type: YTN; PAM sequence: TTC
tttatgttctaaagtcttaa

SEQ ID NO: 256897 - DNA, 20 bp, Artificial Sequence
  Description of Artificial Sequence: Synthetic oligonucleotide
  Target: ATXN1; (+) strand; PAM type: YTN; PAM sequence: CTT
tatgttctaaagtcttaatc

SEQ ID NO: 256898 - DNA, 20 bp, Artificial Sequence
  Description of Artificial Sequence: Synthetic oligonucleotide
  Target: ATXN1; (+) strand; PAM type: YTN; PAM sequence: TTT
atgttctaaagtcttaatca

SEQ ID NO: 256899 - DNA, 20 bp, Artificial Sequence
  Description of Artificial Sequence: Synthetic oligonucleotide
  Target: ATXN1; (+) strand; PAM type: YTN; PAM sequence: TTA
tgttctaaagtcttaatcat

SEQ ID NO: 256900 - DNA, 20 bp, Artificial Sequence
  Description of Artificial Sequence: Synthetic oligonucleotide
  Target: ATXN1; (+) strand; PAM type: YTN; PAM sequence: TTC
taaagtcttaatcatgcatt

SEQ ID NO: 256901 - DNA, 20 bp, Artificial Sequence
  Description of Artificial Sequence: Synthetic oligonucleotide
  Target: ATXN1; (+) strand; PAM type: YTN; PAM sequence: CTA
aagtcttaatcatgcatttc

SEQ ID NO: 256902 - DNA, 20 bp, Artificial Sequence
  Description of Artificial Sequence: Synthetic oligonucleotide
  Target: ATXN1; (+) strand; PAM type: YTN; PAM sequence: CTT
aatcatgcatttctttcaaa

SEQ ID NO: 256903 - DNA, 20 bp, Artificial Sequence
  Description of Artificial Sequence: Synthetic oligonucleotide
  Target: ATXN1; (+) strand; PAM type: YTN; PAM sequence: TTA
atcatgcatttctttcaaat

SEQ ID NO: 256904 - DNA, 20 bp, Artificial Sequence
  Description of Artificial Sequence: Synthetic oligonucleotide
  Target: ATXN1; (+) strand; PAM type: YTN; PAM sequence: TTT
ctttcaaattgtgagcctcc

SEQ ID NO: 256905 - DNA, 20 bp, Artificial Sequence
  Description of Artificial Sequence: Synthetic oligonucleotide
  Target: ATXN1; (+) strand; PAM type: YTN; PAM sequence: TTC
tttcaaattgtgagcctcca

SEQ ID NO: 256906 - DNA, 20 bp, Artificial Sequence
  Description of Artificial Sequence: Synthetic oligonucleotide
  Target: ATXN1; (+) strand; PAM type: YTN; PAM sequence: CTT
tcaaattgtgagcctccaat

SEQ ID NO: 256907 - DNA, 20 bp, Artificial Sequence
  Description of Artificial Sequence: Synthetic oligonucleotide
  Target: ATXN1; (+) strand; PAM type: YTN; PAM sequence: TTT
caaattgtgagcctccaatg

SEQ ID NO: 256908 - DNA, 20 bp, Artificial Sequence
  Description of Artificial Sequence: Synthetic oligonucleotide
  Target: ATXN1; (+) strand; PAM type: YTN; PAM sequence: TTC
aaattgtgagcctccaatga

SEQ ID NO: 256909 - DNA, 20 bp, Artificial Sequence
  Description of Artificial Sequence: Synthetic oligonucleotide
  Target: ATXN1; (+) strand; PAM type: YTN; PAM sequence: TTG
tgagcctccaatgaactaca

SEQ ID NO: 256910 - DNA, 20 bp, Artificial Sequence
  Description of Artificial Sequence: Synthetic oligonucleotide
  Target: ATXN1; (+) strand; PAM type: YTN; PAM sequence: CTC
caatgaactacaagcttgtc

SEQ ID NO: 256911 - DNA, 20 bp, Artificial Sequence
  Description of Artificial Sequence: Synthetic oligonucleotide
  Target: ATXN1; (+) strand; PAM type: YTN; PAM sequence: CTA
caagcttgtcagaattacat

SEQ ID NO: 256912 - DNA, 20 bp, Artificial Sequence
  Description of Artificial Sequence: Synthetic oligonucleotide
  Target: ATXN1; (+) strand; PAM type: YTN; PAM sequence: CTT
gtcagaattacatctattca

SEQ ID NO: 256913 - DNA, 20 bp, Artificial Sequence
  Description of Artificial Sequence: Synthetic oligonucleotide
  Target: ATXN1; (+) strand; PAM type: YTN; PAM sequence: TTG
tcagaattacatctattcag

SEQ ID NO: 256914 - DNA, 20 bp, Artificial Sequence
  Description of Artificial Sequence: Synthetic oligonucleotide
  Target: ATXN1; (+) strand; PAM type: YTN; PAM sequence: TTA
catctattcaggtcatatac

SEQ ID NO: 256915 - DNA, 20 bp, Artificial Sequence
  Description of Artificial Sequence: Synthetic oligonucleotide
  Target: ATXN1; (+) strand; PAM type: YTN; PAM sequence: CTA
ttcaggtcatatacaacatc

SEQ ID NO: 256916 - DNA, 20 bp, Artificial Sequence
  Description of Artificial Sequence: Synthetic oligonucleotide
  Target: ATXN1; (+) strand; PAM type: YTN; PAM sequence: TTC
aggtcatatacaacatccgt

SEQ ID NO: 256917 - DNA, 20 bp, Artificial Sequence
  Description of Artificial Sequence: Synthetic oligonucleotide
  Target: ATXN1; (+) strand; PAM type: YTN; PAM sequence: TTT
gaagttaagtctcctcttag

SEQ ID NO: 256918 - DNA, 20 bp, Artificial Sequence
  Description of Artificial Sequence: Synthetic oligonucleotide
  Target: ATXN1; (+) strand; PAM type: YTN; PAM sequence: TTG
aagttaagtctcctcttagt

SEQ ID NO: 256919 - DNA, 20 bp, Artificial Sequence
  Description of Artificial Sequence: Synthetic oligonucleotide
  Target: ATXN1; (+) strand; PAM type: YTN; PAM sequence: TTA
agtctcctcttagtgtagca

SEQ ID NO: 256920 - DNA, 20 bp, Artificial Sequence
  Description of Artificial Sequence: Synthetic oligonucleotide
  Target: ATXN1; (+) strand; PAM type: YTN; PAM sequence: CTC
ctcttagtgtagcagtacgt

SEQ ID NO: 256921 - DNA, 20 bp, Artificial Sequence
  Description of Artificial Sequence: Synthetic oligonucleotide
  Target: ATXN1; (+) strand; PAM type: YTN; PAM sequence: CTC
ttagtgtagcagtacgtatt

SEQ ID NO: 256922 - DNA, 20 bp, Artificial Sequence
  Description of Artificial Sequence: Synthetic oligonucleotide
  Target: ATXN1; (+) strand; PAM type: YTN; PAM sequence: CTT
agtgtagcagtacgtatttt

SEQ ID NO: 256923 - DNA, 20 bp, Artificial Sequence
  Description of Artificial Sequence: Synthetic oligonucleotide
  Target: ATXN1; (+) strand; PAM type: YTN; PAM sequence: TTA
gtgtagcagtacgtattttg

SEQ ID NO: 256924 - DNA, 20 bp, Artificial Sequence
  Description of Artificial Sequence: Synthetic oligonucleotide
  Target: ATXN1; (+) strand; PAM type: YTN; PAM sequence: TTT
tgaatgagaacggccagtgc

SEQ ID NO: 256925 - DNA, 20 bp, Artificial Sequence
  Description of Artificial Sequence: Synthetic oligonucleotide
  Target: ATXN1; (+) strand; PAM type: YTN; PAM sequence: TTT
gaatgagaacggccagtgct

SEQ ID NO: 256926 - DNA, 20 bp, Artificial Sequence
  Description of Artificial Sequence: Synthetic oligonucleotide
  Target: ATXN1; (+) strand; PAM type: YTN; PAM sequence: TTG
aatgagaacggccagtgcta

SEQ ID NO: 256927 - DNA, 20 bp, Artificial Sequence
  Description of Artificial Sequence: Synthetic oligonucleotide
  Target: ATXN1; (+) strand; PAM type: YTN; PAM sequence: CTA
aagatggaaaataggtgggt

SEQ ID NO: 256928 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagctct

SEQ ID NO: 256929 - DNA, 20 bp, Artificial Sequence
  Description of Artificial Sequence: Synthetic oligonucleotide
  Target: ATXN1; (+) strand; PAM type: YTN; PAM sequence: CTG
taatcccagctctttgggag

SEQ ID NO: 256930 - DNA, 20 bp, Artificial Sequence
  Description of Artificial Sequence: Synthetic oligonucleotide
  Target: ATXN1; (+) strand; PAM type: YTN; PAM sequence: CTC
tttgggaggccaatgcaggc

SEQ ID NO: 256931 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaatgcaggcgg

SEQ ID NO: 256932 - DNA, 20 bp, Artificial Sequence
  Description of Artificial Sequence: Synthetic oligonucleotide
  Target: ATXN1; (+) strand; PAM type: YTN; PAM sequence: TTT
gggaggccaatgcaggcgga

SEQ ID NO: 256933 - DNA, 20 bp, Artificial Sequence
  Description of Artificial Sequence: Synthetic oligonucleotide
  Target: ATXN1; (+) strand; PAM type: YTN; PAM sequence: TTG
ggaggccaatgcaggcggat

SEQ ID NO: 256934 - DNA, 20 bp, Artificial Sequence
  Description of Artificial Sequence: Synthetic oligonucleotide
  Target: ATXN1; (+) strand; PAM type: YTN; PAM sequence: CTT
gaggccaggagtttgagacc

SEQ ID NO: 256935 - DNA, 20 bp, Artificial Sequence
  Description of Artificial Sequence: Synthetic oligonucleotide
  Target: ATXN1; (+) strand; PAM type: YTN; PAM sequence: TTG
aggccaggagtttgagacca

SEQ ID NO: 256936 - DNA, 20 bp, Artificial Sequence
  Description of Artificial Sequence: Synthetic oligonucleotide
  Target: ATXN1; (+) strand; PAM type: YTN; PAM sequence: TTT
gagaccatcctggccaacat

SEQ ID NO: 256937 - DNA, 20 bp, Artificial Sequence
  Description of Artificial Sequence: Synthetic oligonucleotide
  Target: ATXN1; (+) strand; PAM type: YTN; PAM sequence: TTG
agaccatcctggccaacatg

SEQ ID NO: 256938 - DNA, 20 bp, Artificial Sequence
  Description of Artificial Sequence: Synthetic oligonucleotide
  Target: ATXN1; (+) strand; PAM type: YTN; PAM sequence: CTG
gccaacatgctgaaaccacg

SEQ ID NO: 256939 - DNA, 20 bp, Artificial Sequence
  Description of Artificial Sequence: Synthetic oligonucleotide
  Target: ATXN1; (+) strand; PAM type: YTN; PAM sequence: CTG
aaaccacgtctctaccaaaa

SEQ ID NO: 256940 - DNA, 20 bp, Artificial Sequence
  Description of Artificial Sequence: Synthetic oligonucleotide
  Target: ATXN1; (+) strand; PAM type: YTN; PAM sequence: CTC
taccaaaaatacaaaaatta

SEQ ID NO: 256941 - DNA, 20 bp, Artificial Sequence
  Description of Artificial Sequence: Synthetic oligonucleotide
  Target: ATXN1; (+) strand; PAM type: YTN; PAM sequence: CTA
ccaaaaatacaaaaattagc

SEQ ID NO: 256942 - DNA, 20 bp, Artificial Sequence
  Description of Artificial Sequence: Synthetic oligonucleotide
  Target: ATXN1; (+) strand; PAM type: YTN; PAM sequence: TTA
gccgtgtgtagtagcacatg

SEQ ID NO: 256943 - DNA, 20 bp, Artificial Sequence
  Description of Artificial Sequence: Synthetic oligonucleotide
  Target: ATXN1; (+) strand; PAM type: YTN; PAM sequence: CTG
tagtttcagctacttgggag

SEQ ID NO: 256944 - DNA, 20 bp, Artificial Sequence
  Description of Artificial Sequence: Synthetic oligonucleotide
  Target: ATXN1; (+) strand; PAM type: YTN; PAM sequence: TTT
cagctacttgggaggctgag

SEQ ID NO: 256945 - DNA, 20 bp, Artificial Sequence
  Description of Artificial Sequence: Synthetic oligonucleotide
  Target: ATXN1; (+) strand; PAM type: YTN; PAM sequence: TTC
agctacttgggaggctgagg

SEQ ID NO: 256946 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcagga

SEQ ID NO: 256947 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcaggagaa

SEQ ID NO: 256948 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggagaat

SEQ ID NO: 256949 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaattgcttgaa

SEQ ID NO: 256950 - DNA, 20 bp, Artificial Sequence
  Description of Artificial Sequence: Synthetic oligonucleotide
  Target: ATXN1; (+) strand; PAM type: YTN; PAM sequence: TTG
cttgaacctgggaggcggag

SEQ ID NO: 256951 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggcggaggtt

SEQ ID NO: 256952 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggcggaggttg

SEQ ID NO: 256953 - DNA, 20 bp, Artificial Sequence
  Description of Artificial Sequence: Synthetic oligonucleotide
  Target: ATXN1; (+) strand; PAM type: YTN; PAM sequence: CTG
ggaggcggaggttgcagtga

SEQ ID NO: 256954 - DNA, 20 bp, Artificial Sequence
  Description of Artificial Sequence: Synthetic oligonucleotide
  Target: ATXN1; (+) strand; PAM type: YTN; PAM sequence: TTG
cagtgagctgagatcacacc

SEQ ID NO: 256955 - DNA, 20 bp, Artificial Sequence
  Description of Artificial Sequence: Synthetic oligonucleotide
  Target: ATXN1; (+) strand; PAM type: YTN; PAM sequence: CTG
agatcacaccacggcactcc

SEQ ID NO: 256956 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacagagtga

SEQ ID NO: 256957 - DNA, 20 bp, Artificial Sequence
  Description of Artificial Sequence: Synthetic oligonucleotide
  Target: ATXN1; (+) strand; PAM type: YTN; PAM sequence: CTG
ggtgacagagtgagacctct

SEQ ID NO: 256958 - DNA, 20 bp, Artificial Sequence
  Description of Artificial Sequence: Synthetic oligonucleotide
  Target: ATXN1; (+) strand; PAM type: YTN; PAM sequence: CTC
tgtgtcaaaaaaaaaaaaaa

SEQ ID NO: 256959 - DNA, 20 bp, Artificial Sequence
  Description of Artificial Sequence: Synthetic oligonucleotide
  Target: ATXN1; (+) strand; PAM type: YTN; PAM sequence: CTG
tgtcaaaaaaaaaaaaaaaa

SEQ ID NO: 256960 - DNA, 20 bp, Artificial Sequence
  Description of Artificial Sequence: Synthetic oligonucleotide
  Target: ATXN1; (+) strand; PAM type: YTN; PAM sequence: TTT
gaaaacaaaagcctaaagat

SEQ ID NO: 256961 - DNA, 20 bp, Artificial Sequence
  Description of Artificial Sequence: Synthetic oligonucleotide
  Target: ATXN1; (+) strand; PAM type: YTN; PAM sequence: TTG
aaaacaaaagcctaaagatg

SEQ ID NO: 256962 - DNA, 20 bp, Artificial Sequence
  Description of Artificial Sequence: Synthetic oligonucleotide
  Target: ATXN1; (+) strand; PAM type: YTN; PAM sequence: CTA
aagatgcttgctgaaatcag

SEQ ID NO: 256963 - DNA, 20 bp, Artificial Sequence
  Description of Artificial Sequence: Synthetic oligonucleotide
  Target: ATXN1; (+) strand; PAM type: YTN; PAM sequence: CTT
gctgaaatcagctattagtc

SEQ ID NO: 256964 - DNA, 20 bp, Artificial Sequence
  Description of Artificial Sequence: Synthetic oligonucleotide
  Target: ATXN1; (+) strand; PAM type: YTN; PAM sequence: TTG
ctgaaatcagctattagtct

SEQ ID NO: 256965 - DNA, 20 bp, Artificial Sequence
  Description of Artificial Sequence: Synthetic oligonucleotide
  Target: ATXN1; (+) strand; PAM type: YTN; PAM sequence: CTG
aaatcagctattagtctgtt

SEQ ID NO: 256966 - DNA, 20 bp, Artificial Sequence
  Description of Artificial Sequence: Synthetic oligonucleotide
  Target: ATXN1; (+) strand; PAM type: YTN; PAM sequence: CTA
ttagtctgttctcttcagga

SEQ ID NO: 256967 - DNA, 20 bp, Artificial Sequence
  Description of Artificial Sequence: Synthetic oligonucleotide
  Target: ATXN1; (+) strand; PAM type: YTN; PAM sequence: TTA
gtctgttctcttcaggaaaa

SEQ ID NO: 256968 - DNA, 20 bp, Artificial Sequence
  Description of Artificial Sequence: Synthetic oligonucleotide
  Target: ATXN1; (+) strand; PAM type: YTN; PAM sequence: CTG
ttctcttcaggaaaatgaca

SEQ ID NO: 256969 - DNA, 20 bp, Artificial Sequence
  Description of Artificial Sequence: Synthetic oligonucleotide
  Target: ATXN1; (+) strand; PAM type: YTN; PAM sequence: TTC
tcttcaggaaaatgacatat

SEQ ID NO: 256970 - DNA, 20 bp, Artificial Sequence
  Description of Artificial Sequence: Synthetic oligonucleotide
  Target: ATXN1; (+) strand; PAM type: YTN; PAM sequence: CTC
ttcaggaaaatgacatatta

SEQ ID NO: 256971 - DNA, 20 bp, Artificial Sequence
  Description of Artificial Sequence: Synthetic oligonucleotide
  Target: ATXN1; (+) strand; PAM type: YTN; PAM sequence: CTT
caggaaaatgacatattatg

SEQ ID NO: 256972 - DNA, 20 bp, Artificial Sequence
  Description of Artificial Sequence: Synthetic oligonucleotide
  Target: ATXN1; (+) strand; PAM type: YTN; PAM sequence: TTC
aggaaaatgacatattatgc

SEQ ID NO: 256973 - DNA, 20 bp, Artificial Sequence
  Description of Artificial Sequence: Synthetic oligonucleotide
  Target: ATXN1; (+) strand; PAM type: YTN; PAM sequence: TTA
tgcataattaataataataa

SEQ ID NO: 256974 - DNA, 20 bp, Artificial Sequence
  Description of Artificial Sequence: Synthetic oligonucleotide
  Target: ATXN1; (+) strand; PAM type: YTN; PAM sequence: TTA
ataataataataacataact

SEQ ID NO: 256975 - DNA, 20 bp, Artificial Sequence
  Description of Artificial Sequence: Synthetic oligonucleotide
  Target: ATXN1; (+) strand; PAM type: YTN; PAM sequence: CTA
attttatgtcttattgactc

SEQ ID NO: 256976 - DNA, 20 bp, Artificial Sequence
  Description of Artificial Sequence: Synthetic oligonucleotide
  Target: ATXN1; (+) strand; PAM type: YTN; PAM sequence: TTT
tatgtcttattgactctaag

SEQ ID NO: 256977 - DNA, 20 bp, Artificial Sequence
  Description of Artificial Sequence: Synthetic oligonucleotide
  Target: ATXN1; (+) strand; PAM type: YTN; PAM sequence: TTT
atgtcttattgactctaagg

SEQ ID NO: 256978 - DNA, 20 bp, Artificial Sequence
  Description of Artificial Sequence: Synthetic oligonucleotide
  Target: ATXN1; (+) strand; PAM type: YTN; PAM sequence: TTA
tgtcttattgactctaaggt

SEQ ID NO: 256979 - DNA, 20 bp, Artificial Sequence
  Description of Artificial Sequence: Synthetic oligonucleotide
  Target: ATXN1; (+) strand; PAM type: YTN; PAM sequence: CTT
attgactctaaggtatggct

SEQ ID NO: 256980 - DNA, 20 bp, Artificial Sequence
  Description of Artificial Sequence: Synthetic oligonucleotide
  Target: ATXN1; (+) strand; PAM type: YTN; PAM sequence: TTA
ttgactctaaggtatggcta

SEQ ID NO: 256981 - DNA, 20 bp, Artificial Sequence
  Description of Artificial Sequence: Synthetic oligonucleotide
  Target: ATXN1; (+) strand; PAM type: YTN; PAM sequence: TTG
actctaaggtatggctatct

SEQ ID NO: 256982 - DNA, 20 bp, Artificial Sequence
  Description of Artificial Sequence: Synthetic oligonucleotide
  Target: ATXN1; (+) strand; PAM type: YTN; PAM sequence: CTC
taaggtatggctatctctat

SEQ ID NO: 256983 - DNA, 20 bp, Artificial Sequence
  Description of Artificial Sequence: Synthetic oligonucleotide
  Target: ATXN1; (+) strand; PAM type: YTN; PAM sequence: CTA
aggtatggctatctctattt

SEQ ID NO: 256984 - DNA, 20 bp, Artificial Sequence
  Description of Artificial Sequence: Synthetic oligonucleotide
  Target: ATXN1; (+) strand; PAM type: YTN; PAM sequence: CTA
tctctatttactactacctc

SEQ ID NO: 256985 - DNA, 20 bp, Artificial Sequence
  Description of Artificial Sequence: Synthetic oligonucleotide
  Target: ATXN1; (+) strand; PAM type: YTN; PAM sequence: CTC
tatttactactacctcatat

SEQ ID NO: 256986 - DNA, 20 bp, Artificial Sequence
  Description of Artificial Sequence: Synthetic oligonucleotide
  Target: ATXN1; (+) strand; PAM type: YTN; PAM sequence: CTA
tttactactacctcatatga

SEQ ID NO: 256987 - DNA, 20 bp, Artificial Sequence
  Description of Artificial Sequence: Synthetic oligonucleotide
  Target: ATXN1; (+) strand; PAM type: YTN; PAM sequence: TTT
actactacctcatatgactt

SEQ ID NO: 256988 - DNA, 20 bp, Artificial Sequence
  Description of Artificial Sequence: Synthetic oligonucleotide
  Target: ATXN1; (+) strand; PAM type: YTN; PAM sequence: TTA
ctactacctcatatgacttt

SEQ ID NO: 256989 - DNA, 20 bp, Artificial Sequence
  Description of Artificial Sequence: Synthetic oligonucleotide
  Target: ATXN1; (+) strand; PAM type: YTN; PAM sequence: CTA
ctacctcatatgactttaat

SEQ ID NO: 256990 - DNA, 20 bp, Artificial Sequence
  Description of Artificial Sequence: Synthetic oligonucleotide
  Target: ATXN1; (+) strand; PAM type: YTN; PAM sequence: CTA
cctcatatgactttaatatt

SEQ ID NO: 256991 - DNA, 20 bp, Artificial Sequence
  Description of Artificial Sequence: Synthetic oligonucleotide
  Target: ATXN1; (+) strand; PAM type: YTN; PAM sequence: CTC
atatgactttaatattgata

SEQ ID NO: 256992 - DNA, 20 bp, Artificial Sequence
  Description of Artificial Sequence: Synthetic oligonucleotide
  Target: ATXN1; (+) strand; PAM type: YTN; PAM sequence: CTT
taatattgatattgaattaa

SEQ ID NO: 256993 - DNA, 20 bp, Artificial Sequence
  Description of Artificial Sequence: Synthetic oligonucleotide
  Target: ATXN1; (+) strand; PAM type: YTN; PAM sequence: TTT
aatattgatattgaattaaa

SEQ ID NO: 256994 - DNA, 20 bp, Artificial Sequence
  Description of Artificial Sequence: Synthetic oligonucleotide
  Target: ATXN1; (+) strand; PAM type: YTN; PAM sequence: TTA
atattgatattgaattaaag

SEQ ID NO: 256995 - DNA, 20 bp, Artificial Sequence
  Description of Artificial Sequence: Synthetic oligonucleotide
  Target: ATXN1; (+) strand; PAM type: YTN; PAM sequence: TTG
atattgaattaaagtcagtg

SEQ ID NO: 256996 - DNA, 20 bp, Artificial Sequence
  Description of Artificial Sequence: Synthetic oligonucleotide
  Target: ATXN1; (+) strand; PAM type: YTN; PAM sequence: TTG
aattaaagtcagtgcaagat

SEQ ID NO: 256997 - DNA, 20 bp, Artificial Sequence
  Description of Artificial Sequence: Synthetic oligonucleotide
  Target: ATXN1; (+) strand; PAM type: YTN; PAM sequence: TTA
aagtcagtgcaagatctgta

SEQ ID NO: 256998 - DNA, 20 bp, Artificial Sequence
  Description of Artificial Sequence: Synthetic oligonucleotide
  Target: ATXN1; (+) strand; PAM type: YTN; PAM sequence: CTG
tagtacattagtaagtatgc

SEQ ID NO: 256999 - DNA, 20 bp, Artificial Sequence
  Description of Artificial Sequence: Synthetic oligonucleotide
  Target: ATXN1; (+) strand; PAM type: YTN; PAM sequence: TTA
gtaagtatgcaaaaatggga

SEQ ID NO: 257000 - DNA, 20 bp, Artificial Sequence
  Description of Artificial Sequence: Synthetic oligonucleotide
  Target: ATXN1; (+) strand; PAM type: YTN; PAM sequence: TTG
aagccctgtttataggtggt

SEQ ID NO: 257001 - DNA, 20 bp, Artificial Sequence
  Description of Artificial Sequence: Synthetic oligonucleotide
  Target: ATXN1; (+) strand; PAM type: YTN; PAM sequence: CTG
tttataggtggtactcagag

SEQ ID NO: 257002 - DNA, 20 bp, Artificial Sequence
  Description of Artificial Sequence: Synthetic oligonucleotide
  Target: ATXN1; (+) strand; PAM type: YTN; PAM sequence: TTT
ataggtggtactcagagaag

SEQ ID NO: 257003 - DNA, 20 bp, Artificial Sequence
  Description of Artificial Sequence: Synthetic oligonucleotide
  Target: ATXN1; (+) strand; PAM type: YTN; PAM sequence: TTA
taggtggtactcagagaagg

SEQ ID NO: 257004 - DNA, 20 bp, Artificial Sequence
  Description of Artificial Sequence: Synthetic oligonucleotide
  Target: ATXN1; (+) strand; PAM type: YTN; PAM sequence: CTC
agagaaggcccagggttgtt

SEQ ID NO: 257005 - DNA, 20 bp, Artificial Sequence
  Description of Artificial Sequence: Synthetic oligonucleotide
  Target: ATXN1; (+) strand; PAM type: YTN; PAM sequence: TTG
ttggtgccaactggaaaaag

SEQ ID NO: 257006 - DNA, 20 bp, Artificial Sequence
  Description of Artificial Sequence: Synthetic oligonucleotide
  Target: ATXN1; (+) strand; PAM type: YTN; PAM sequence: TTG
gtgccaactggaaaaagttt

SEQ ID NO: 257007 - DNA, 20 bp, Artificial Sequence
  Description of Artificial Sequence: Synthetic oligonucleotide
  Target: ATXN1; (+) strand; PAM type: YTN; PAM sequence: CTG
gaaaaagtttatatctgatt

SEQ ID NO: 257008 - DNA, 20 bp, Artificial Sequence
  Description of Artificial Sequence: Synthetic oligonucleotide
  Target: ATXN1; (+) strand; PAM type: YTN; PAM sequence: TTT
atatctgattatattaatag

SEQ ID NO: 257009 - DNA, 20 bp, Artificial Sequence
  Description of Artificial Sequence: Synthetic oligonucleotide
  Target: ATXN1; (+) strand; PAM type: YTN; PAM sequence: TTA
tatctgattatattaatagc

SEQ ID NO: 257010 - DNA, 20 bp, Artificial Sequence
  Description of Artificial Sequence: Synthetic oligonucleotide
  Target: ATXN1; (+) strand; PAM type: YTN; PAM sequence: CTG
attatattaatagcaacatt

SEQ ID NO: 257011 - DNA, 20 bp, Artificial Sequence
  Description of Artificial Sequence: Synthetic oligonucleotide
  Target: ATXN1; (+) strand; PAM type: YTN; PAM sequence: TTA
tattaatagcaacattgatc

SEQ ID NO: 257012 - DNA, 20 bp, Artificial Sequence
  Description of Artificial Sequence: Synthetic oligonucleotide
  Target: ATXN1; (+) strand; PAM type: YTN; PAM sequence: TTA
atagcaacattgatctggca

SEQ ID NO: 257013 - DNA, 20 bp, Artificial Sequence
  Description of Artificial Sequence: Synthetic oligonucleotide
  Target: ATXN1; (+) strand; PAM type: YTN; PAM sequence: TTG
atctggcattttgccctggc

SEQ ID NO: 257014 - DNA, 20 bp, Artificial Sequence
  Description of Artificial Sequence: Synthetic oligonucleotide
  Target: ATXN1; (+) strand; PAM type: YTN; PAM sequence: CTG
gcattttgccctggcatagt

SEQ ID NO: 257015 - DNA, 20 bp, Artificial Sequence
  Description of Artificial Sequence: Synthetic oligonucleotide
  Target: ATXN1; (+) strand; PAM type: YTN; PAM sequence: TTT
tgccctggcatagtttttta

SEQ ID NO: 257016 - DNA, 20 bp, Artificial Sequence
  Description of Artificial Sequence: Synthetic oligonucleotide
  Target: ATXN1; (+) strand; PAM type: YTN; PAM sequence: TTT
gccctggcatagttttttac

SEQ ID NO: 257017 - DNA, 20 bp, Artificial Sequence
  Description of Artificial Sequence: Synthetic oligonucleotide
  Target: ATXN1; (+) strand; PAM type: YTN; PAM sequence: TTG
ccctggcatagttttttacc

SEQ ID NO: 257018 - DNA, 20 bp, Artificial Sequence
  Description of Artificial Sequence: Synthetic oligonucleotide
  Target: ATXN1; (+) strand; PAM type: YTN; PAM sequence: CTG
gcatagttttttaccttctt

SEQ ID NO: 257019 - DNA, 20 bp, Artificial Sequence
  Description of Artificial Sequence: Synthetic oligonucleotide
  Target: ATXN1; (+) strand; PAM type: YTN; PAM sequence: TTT
tttaccttcttgaaggttaa

SEQ ID NO: 257020 - DNA, 20 bp, Artificial Sequence
  Description of Artificial Sequence: Synthetic oligonucleotide
  Target: ATXN1; (+) strand; PAM type: YTN; PAM sequence: TTT
ttaccttcttgaaggttaaa

SEQ ID NO: 257021 - DNA, 20 bp, Artificial Sequence
  Description of Artificial Sequence: Synthetic oligonucleotide
  Target: ATXN1; (+) strand; PAM type: YTN; PAM sequence: TTT
taccttcttgaaggttaaaa

SEQ ID NO: 257022 - DNA, 20 bp, Artificial Sequence
  Description of Artificial Sequence: Synthetic oligonucleotide
  Target: ATXN1; (+) strand; PAM type: YTN; PAM sequence: TTT
accttcttgaaggttaaaaa

SEQ ID NO: 257023 - DNA, 20 bp, Artificial Sequence
  Description of Artificial Sequence: Synthetic oligonucleotide
  Target: ATXN1; (+) strand; PAM type: YTN; PAM sequence: TTA
ccttcttgaaggttaaaaaa

SEQ ID NO: 257024 - DNA, 20 bp, Artificial Sequence
  Description of Artificial Sequence: Synthetic oligonucleotide
  Target: ATXN1; (+) strand; PAM type: YTN; PAM sequence: CTT
cttgaaggttaaaaaaaaaa

SEQ ID NO: 257025 - DNA, 20 bp, Artificial Sequence
  Description of Artificial Sequence: Synthetic oligonucleotide
  Target: ATXN1; (+) strand; PAM type: YTN; PAM sequence: TTC
ttgaaggttaaaaaaaaaaa

SEQ ID NO: 257026 - DNA, 20 bp, Artificial Sequence
  Description of Artificial Sequence: Synthetic oligonucleotide
  Target: ATXN1; (+) strand; PAM type: YTN; PAM sequence: CTT
gaaggttaaaaaaaaaaaat

SEQ ID NO: 257027 - DNA, 20 bp, Artificial Sequence
  Description of Artificial Sequence: Synthetic oligonucleotide
  Target: ATXN1; (+) strand; PAM type: YTN; PAM sequence: TTG
aaggttaaaaaaaaaaaatc

SEQ ID NO: 257028 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaaaatctccctgg

SEQ ID NO: 257029 - DNA, 20 bp, Artificial Sequence
  Description of Artificial Sequence: Synthetic oligonucleotide
  Target: ATXN1; (+) strand; PAM type: YTN; PAM sequence: CTC
cctggctgcatcaggattta

SEQ ID NO: 257030 - DNA, 20 bp, Artificial Sequence
  Description of Artificial Sequence: Synthetic oligonucleotide
  Target: ATXN1; (+) strand; PAM type: YTN; PAM sequence: CTG
gctgcatcaggatttaagac

SEQ ID NO: 257031 - DNA, 20 bp, Artificial Sequence
  Description of Artificial Sequence: Synthetic oligonucleotide
  Target: ATXN1; (+) strand; PAM type: YTN; PAM sequence: CTG
catcaggatttaagacattg

SEQ ID NO: 257032 - DNA, 20 bp, Artificial Sequence
  Description of Artificial Sequence: Synthetic oligonucleotide
  Target: ATXN1; (+) strand; PAM type: YTN; PAM sequence: TTT
aagacattggggagaaagaa

SEQ ID NO: 257033 - DNA, 20 bp, Artificial Sequence
  Description of Artificial Sequence: Synthetic oligonucleotide
  Target: ATXN1; (+) strand; PAM type: YTN; PAM sequence: TTA
agacattggggagaaagaaa

SEQ ID NO: 257034 - DNA, 20 bp, Artificial Sequence
  Description of Artificial Sequence: Synthetic oligonucleotide
  Target: ATXN1; (+) strand; PAM type: YTN; PAM sequence: TTG
gggagaaagaaaggataaag

SEQ ID NO: 257035 - DNA, 20 bp, Artificial Sequence
  Description of Artificial Sequence: Synthetic oligonucleotide
  Target: ATXN1; (+) strand; PAM type: YTN; PAM sequence: TTG
aagacgttcaaggataatta

SEQ ID NO: 257036 - DNA, 20 bp, Artificial Sequence
  Description of Artificial Sequence: Synthetic oligonucleotide
  Target: ATXN1; (+) strand; PAM type: YTN; PAM sequence: TTC
aaggataattaaacttctgc

SEQ ID NO: 257037 - DNA, 20 bp, Artificial Sequence
  Description of Artificial Sequence: Synthetic oligonucleotide
  Target: ATXN1; (+) strand; PAM type: YTN; PAM sequence: TTA
aacttctgcccatagctggc

SEQ ID NO: 257038 - DNA, 20 bp, Artificial Sequence
  Description of Artificial Sequence: Synthetic oligonucleotide
  Target: ATXN1; (+) strand; PAM type: YTN; PAM sequence: CTT
ctgcccatagctggcctggg

SEQ ID NO: 257039 - DNA, 20 bp, Artificial Sequence
  Description of Artificial Sequence: Synthetic oligonucleotide
  Target: ATXN1; (+) strand; PAM type: YTN; PAM sequence: TTC
tgcccatagctggcctgggg

SEQ ID NO: 257040 - DNA, 20 bp, Artificial Sequence
  Description of Artificial Sequence: Synthetic oligonucleotide
  Target: ATXN1; (+) strand; PAM type: YTN; PAM sequence: CTG
cccatagctggcctggggga

SEQ ID NO: 257041 - DNA, 20 bp, Artificial Sequence
  Description of Artificial Sequence: Synthetic oligonucleotide
  Target: ATXN1; (+) strand; PAM type: YTN; PAM sequence: CTG
gcctgggggagaaatgaatg

SEQ ID NO: 257042 - DNA, 20 bp, Artificial Sequence
  Description of Artificial Sequence: Synthetic oligonucleotide
  Target: ATXN1; (+) strand; PAM type: YTN; PAM sequence: CTG
ggggagaaatgaatgtcacc

SEQ ID NO: 257043 - DNA, 20 bp, Artificial Sequence
  Description of Artificial Sequence: Synthetic oligonucleotide
  Target: ATXN1; (+) strand; PAM type: YTN; PAM sequence: CTG
gctcacagtgtgaagagaga

SEQ ID NO: 257044 - DNA, 20 bp, Artificial Sequence
  Description of Artificial Sequence: Synthetic oligonucleotide
  Target: ATXN1; (+) strand; PAM type: YTN; PAM sequence: CTC
acagtgtgaagagagaagac

SEQ ID NO: 257045 - DNA, 20 bp, Artificial Sequence
  Description of Artificial Sequence: Synthetic oligonucleotide
  Target: ATXN1; (+) strand; PAM type: YTN; PAM sequence: CTT
gtttccagtcattcacagcc

SEQ ID NO: 257046 - DNA, 20 bp, Artificial Sequence
  Description of Artificial Sequence: Synthetic oligonucleotide
  Target: ATXN1; (+) strand; PAM type: YTN; PAM sequence: TTG
tttccagtcattcacagccc

SEQ ID NO: 257047 - DNA, 20 bp, Artificial Sequence
  Description of Artificial Sequence: Synthetic oligonucleotide
  Target: ATXN1; (+) strand; PAM type: YTN; PAM sequence: TTT
ccagtcattcacagccctgt

SEQ ID NO: 257048 - DNA, 20 bp, Artificial Sequence
  Description of Artificial Sequence: Synthetic oligonucleotide
  Target: ATXN1; (+) strand; PAM type: YTN; PAM sequence: TTC
cagtcattcacagccctgtt

SEQ ID NO: 257049 - DNA, 20 bp, Artificial Sequence
  Description of Artificial Sequence: Synthetic oligonucleotide
  Target: ATXN1; (+) strand; PAM type: YTN; PAM sequence: TTC
acagccctgttgagatatac

SEQ ID NO: 257050 - DNA, 20 bp, Artificial Sequence
  Description of Artificial Sequence: Synthetic oligonucleotide
  Target: ATXN1; (+) strand; PAM type: YTN; PAM sequence: CTG
ttgagatataccttcatgcc

SEQ ID NO: 257051 - DNA, 20 bp, Artificial Sequence
  Description of Artificial Sequence: Synthetic oligonucleotide
  Target: ATXN1; (+) strand; PAM type: YTN; PAM sequence: TTG
agatataccttcatgcctaa

SEQ ID NO: 257052 - DNA, 20 bp, Artificial Sequence
  Description of Artificial Sequence: Synthetic oligonucleotide
  Target: ATXN1; (+) strand; PAM type: YTN; PAM sequence: CTT
catgcctaattccttcaccc

SEQ ID NO: 257053 - DNA, 20 bp, Artificial Sequence
  Description of Artificial Sequence: Synthetic oligonucleotide
  Target: ATXN1; (+) strand; PAM type: YTN; PAM sequence: TTC
atgcctaattccttcaccct

SEQ ID NO: 257054 - DNA, 20 bp, Artificial Sequence
  Description of Artificial Sequence: Synthetic oligonucleotide
  Target: ATXN1; (+) strand; PAM type: YTN; PAM sequence: CTA
attccttcaccctctgaagt

SEQ ID NO: 257055 - DNA, 20 bp, Artificial Sequence
  Description of Artificial Sequence: Synthetic oligonucleotide
  Target: ATXN1; (+) strand; PAM type: YTN; PAM sequence: TTC
cttcaccctctgaagtccaa

SEQ ID NO: 257056 - DNA, 20 bp, Artificial Sequence
  Description of Artificial Sequence: Synthetic oligonucleotide
  Target: ATXN1; (+) strand; PAM type: YTN; PAM sequence: CTT
caccctctgaagtccaacat

SEQ ID NO: 257057 - DNA, 20 bp, Artificial Sequence
  Description of Artificial Sequence: Synthetic oligonucleotide
  Target: ATXN1; (+) strand; PAM type: YTN; PAM sequence: TTC
accctctgaagtccaacatt

SEQ ID NO: 257058 - DNA, 20 bp, Artificial Sequence
  Description of Artificial Sequence: Synthetic oligonucleotide
  Target: ATXN1; (+) strand; PAM type: YTN; PAM sequence: CTC
tgaagtccaacattatttaa

SEQ ID NO: 257059 - DNA, 20 bp, Artificial Sequence
  Description of Artificial Sequence: Synthetic oligonucleotide
  Target: ATXN1; (+) strand; PAM type: YTN; PAM sequence: CTG
aagtccaacattatttaatt

SEQ ID NO: 257060 - DNA, 20 bp, Artificial Sequence
  Description of Artificial Sequence: Synthetic oligonucleotide
  Target: ATXN1; (+) strand; PAM type: YTN; PAM sequence: TTA
tttaattgataagatatgcc

SEQ ID NO: 257061 - DNA, 20 bp, Artificial Sequence
  Description of Artificial Sequence: Synthetic oligonucleotide
  Target: ATXN1; (+) strand; PAM type: YTN; PAM sequence: TTT
aattgataagatatgccaca

SEQ ID NO: 257062 - DNA, 20 bp, Artificial Sequence
  Description of Artificial Sequence: Synthetic oligonucleotide
  Target: ATXN1; (+) strand; PAM type: YTN; PAM sequence: TTA
attgataagatatgccacat

SEQ ID NO: 257063 - DNA, 20 bp, Artificial Sequence
  Description of Artificial Sequence: Synthetic oligonucleotide
  Target: ATXN1; (+) strand; PAM type: YTN; PAM sequence: TTG
ataagatatgccacatatca

SEQ ID NO: 257064 - DNA, 20 bp, Artificial Sequence
  Description of Artificial Sequence: Synthetic oligonucleotide
  Target: ATXN1; (+) strand; PAM type: YTN; PAM sequence: CTT
gtcctttgtgtttaagttgt

SEQ ID NO: 257065 - DNA, 20 bp, Artificial Sequence
  Description of Artificial Sequence: Synthetic oligonucleotide
  Target: ATXN1; (+) strand; PAM type: YTN; PAM sequence: TTG
tcctttgtgtttaagttgtt

SEQ ID NO: 257066 - DNA, 20 bp, Artificial Sequence
  Description of Artificial Sequence: Synthetic oligonucleotide
  Target: ATXN1; (+) strand; PAM type: YTN; PAM sequence: CTT
tgtgtttaagttgttcttat

SEQ ID NO: 257067 - DNA, 20 bp, Artificial Sequence
  Description of Artificial Sequence: Synthetic oligonucleotide
  Target: ATXN1; (+) strand; PAM type: YTN; PAM sequence: TTT
gtgtttaagttgttcttatt

SEQ ID NO: 257068 - DNA, 20 bp, Artificial Sequence
  Description of Artificial Sequence: Synthetic oligonucleotide
  Target: ATXN1; (+) strand; PAM type: YTN; PAM sequence: TTG
tgtttaagttgttcttatta

SEQ ID NO: 257069 - DNA, 20 bp, Artificial Sequence
  Description of Artificial Sequence: Synthetic oligonucleotide
  Target: ATXN1; (+) strand; PAM type: YTN; PAM sequence: TTT
aagttgttcttattaatatg

SEQ ID NO: 257070 - DNA, 20 bp, Artificial Sequence
  Description of Artificial Sequence: Synthetic oligonucleotide
  Target: ATXN1; (+) strand; PAM type: YTN; PAM sequence: TTA
agttgttcttattaatatgt

SEQ ID NO: 257071 - DNA, 20 bp, Artificial Sequence
  Description of Artificial Sequence: Synthetic oligonucleotide
  Target: ATXN1; (+) strand; PAM type: YTN; PAM sequence: TTG
ttcttattaatatgtatgtc

SEQ ID NO: 257072 - DNA, 20 bp, Artificial Sequence
  Description of Artificial Sequence: Synthetic oligonucleotide
  Target: ATXN1; (+) strand; PAM type: YTN; PAM sequence: TTC
ttattaatatgtatgtctta

SEQ ID NO: 257073 - DNA, 20 bp, Artificial Sequence
  Description of Artificial Sequence: Synthetic oligonucleotide
  Target: ATXN1; (+) strand; PAM type: YTN; PAM sequence: CTT
attaatatgtatgtcttatc

SEQ ID NO: 257074 - DNA, 20 bp, Artificial Sequence
  Description of Artificial Sequence: Synthetic oligonucleotide
  Target: ATXN1; (+) strand; PAM type: YTN; PAM sequence: TTA
ttaatatgtatgtcttatct

SEQ ID NO: 257075 - DNA, 20 bp, Artificial Sequence
  Description of Artificial Sequence: Synthetic oligonucleotide
  Target: ATXN1; (+) strand; PAM type: YTN; PAM sequence: TTA
atatgtatgtcttatctccc

SEQ ID NO: 257076 - DNA, 20 bp, Artificial Sequence
  Description of Artificial Sequence: Synthetic oligonucleotide
  Target: ATXN1; (+) strand; PAM type: YTN; PAM sequence: CTT
atctcccttagtagattgtc

SEQ ID NO: 257077 - DNA, 20 bp, Artificial Sequence
  Description of Artificial Sequence: Synthetic oligonucleotide
  Target: ATXN1; (+) strand; PAM type: YTN; PAM sequence: TTA
tctcccttagtagattgtca

SEQ ID NO: 257078 - DNA, 20 bp, Artificial Sequence
  Description of Artificial Sequence: Synthetic oligonucleotide
  Target: ATXN1; (+) strand; PAM type: YTN; PAM sequence: CTC
ccttagtagattgtcagctt

SEQ ID NO: 257079 - DNA, 20 bp, Artificial Sequence
  Description of Artificial Sequence: Synthetic oligonucleotide
  Target: ATXN1; (+) strand; PAM type: YTN; PAM sequence: CTT
agtagattgtcagcttcttg

SEQ ID NO: 257080 - DNA, 20 bp, Artificial Sequence
  Description of Artificial Sequence: Synthetic oligonucleotide
  Target: ATXN1; (+) strand; PAM type: YTN; PAM sequence: TTA
gtagattgtcagcttcttga

SEQ ID NO: 257081 - DNA, 20 bp, Artificial Sequence
  Description of Artificial Sequence: Synthetic oligonucleotide
  Target: ATXN1; (+) strand; PAM type: YTN; PAM sequence: TTG
tcagcttcttgaggttatct

SEQ ID NO: 257082 - DNA, 20 bp, Artificial Sequence
  Description of Artificial Sequence: Synthetic oligonucleotide
  Target: ATXN1; (+) strand; PAM type: YTN; PAM sequence: CTT
cttgaggttatcttgaatgt

SEQ ID NO: 257083 - DNA, 20 bp, Artificial Sequence
  Description of Artificial Sequence: Synthetic oligonucleotide
  Target: ATXN1; (+) strand; PAM type: YTN; PAM sequence: TTC
ttgaggttatcttgaatgtt

SEQ ID NO: 257084 - DNA, 20 bp, Artificial Sequence
  Description of Artificial Sequence: Synthetic oligonucleotide
  Target: ATXN1; (+) strand; PAM type: YTN; PAM sequence: CTT
gaggttatcttgaatgtttt

SEQ ID NO: 257085 - DNA, 20 bp, Artificial Sequence
  Description of Artificial Sequence: Synthetic oligonucleotide
  Target: ATXN1; (+) strand; PAM type: YTN; PAM sequence: TTG
aggttatcttgaatgtttta

SEQ ID NO: 257086 - DNA, 20 bp, Artificial Sequence
  Description of Artificial Sequence: Synthetic oligonucleotide
  Target: ATXN1; (+) strand; PAM type: YTN; PAM sequence: TTA
tcttgaatgttttaactcag

SEQ ID NO: 257087 - DNA, 20 bp, Artificial Sequence
  Description of Artificial Sequence: Synthetic oligonucleotide
  Target: ATXN1; (+) strand; PAM type: YTN; PAM sequence: CTT
gaatgttttaactcagctct

SEQ ID NO: 257088 - DNA, 20 bp, Artificial Sequence
  Description of Artificial Sequence: Synthetic oligonucleotide
  Target: ATXN1; (+) strand; PAM type: YTN; PAM sequence: TTG
aatgttttaactcagctctc

SEQ ID NO: 257089 - DNA, 20 bp, Artificial Sequence
  Description of Artificial Sequence: Synthetic oligonucleotide
  Target: ATXN1; (+) strand; PAM type: YTN; PAM sequence: TTT
taactcagctctctctctcg

SEQ ID NO: 257090 - DNA, 20 bp, Artificial Sequence
  Description of Artificial Sequence: Synthetic oligonucleotide
  Target: ATXN1; (+) strand; PAM type: YTN; PAM sequence: TTT
aactcagctctctctctcgc

SEQ ID NO: 257091 - DNA, 20 bp, Artificial Sequence
  Description of Artificial Sequence: Synthetic oligonucleotide
  Target: ATXN1; (+) strand; PAM type: YTN; PAM sequence: TTA
actcagctctctctctcgca

SEQ ID NO: 257092 - DNA, 20 bp, Artificial Sequence
  Description of Artificial Sequence: Synthetic oligonucleotide
  Target: ATXN1; (+) strand; PAM type: YTN; PAM sequence: CTC
agctctctctctcgcactat

SEQ ID NO: 257093 - DNA, 20 bp, Artificial Sequence
  Description of Artificial Sequence: Synthetic oligonucleotide
  Target: ATXN1; (+) strand; PAM type: YTN; PAM sequence: CTC
tctctctcgcactatcttgc

SEQ ID NO: 257094 - DNA, 20 bp, Artificial Sequence
  Description of Artificial Sequence: Synthetic oligonucleotide
  Target: ATXN1; (+) strand; PAM type: YTN; PAM sequence: CTC
tctctcgcactatcttgctt

SEQ ID NO: 257095 - DNA, 20 bp, Artificial Sequence
  Description of Artificial Sequence: Synthetic oligonucleotide
  Target: ATXN1; (+) strand; PAM type: YTN; PAM sequence: CTC
tctcgcactatcttgcttag

SEQ ID NO: 257096 - DNA, 20 bp, Artificial Sequence
  Description of Artificial Sequence: Synthetic oligonucleotide
  Target: ATXN1; (+) strand; PAM type: YTN; PAM sequence: CTC
tcgcactatcttgcttaggg

SEQ ID NO: 257097 - DNA, 20 bp, Artificial Sequence
  Description of Artificial Sequence: Synthetic oligonucleotide
  Target: ATXN1; (+) strand; PAM type: YTN; PAM sequence: CTC
gcactatcttgcttagggaa

SEQ ID NO: 257098 - DNA, 20 bp, Artificial Sequence
  Description of Artificial Sequence: Synthetic oligonucleotide
  Target: ATXN1; (+) strand; PAM type: YTN; PAM sequence: CTA
tcttgcttagggaagacacc

SEQ ID NO: 257099 - DNA, 20 bp, Artificial Sequence
  Description of Artificial Sequence: Synthetic oligonucleotide
  Target: ATXN1; (+) strand; PAM type: YTN; PAM sequence: CTT
gcttagggaagacacccaat

SEQ ID NO: 257100 - DNA, 20 bp, Artificial Sequence
  Description of Artificial Sequence: Synthetic oligonucleotide
  Target: ATXN1; (+) strand; PAM type: YTN; PAM sequence: TTG
cttagggaagacacccaata

SEQ ID NO: 257101 - DNA, 20 bp, Artificial Sequence
  Description of Artificial Sequence: Synthetic oligonucleotide
  Target: ATXN1; (+) strand; PAM type: YTN; PAM sequence: CTT
agggaagacacccaataaat

SEQ ID NO: 257102 - DNA, 20 bp, Artificial Sequence
  Description of Artificial Sequence: Synthetic oligonucleotide
  Target: ATXN1; (+) strand; PAM type: YTN; PAM sequence: TTA
gggaagacacccaataaata

SEQ ID NO: 257103 - DNA, 20 bp, Artificial Sequence
  Description of Artificial Sequence: Synthetic oligonucleotide
  Target: ATXN1; (+) strand; PAM type: YTN; PAM sequence: TTA
gttgaagacatgaccaagtg

SEQ ID NO: 257104 - DNA, 20 bp, Artificial Sequence
  Description of Artificial Sequence: Synthetic oligonucleotide
  Target: ATXN1; (+) strand; PAM type: YTN; PAM sequence: TTG
aagacatgaccaagtgcatg

SEQ ID NO: 257105 - DNA, 20 bp, Artificial Sequence
  Description of Artificial Sequence: Synthetic oligonucleotide
  Target: ATXN1; (+) strand; PAM type: YTN; PAM sequence: CTG
tataggcttgctaaataagg

SEQ ID NO: 257106 - DNA, 20 bp, Artificial Sequence
  Description of Artificial Sequence: Synthetic oligonucleotide
  Target: ATXN1; (+) strand; PAM type: YTN; PAM sequence: CTT
gctaaataagggcagtaaaa

SEQ ID NO: 257107 - DNA, 20 bp, Artificial Sequence
  Description of Artificial Sequence: Synthetic oligonucleotide
  Target: ATXN1; (+) strand; PAM type: YTN; PAM sequence: TTG
ctaaataagggcagtaaaaa

SEQ ID NO: 257108 - DNA, 20 bp, Artificial Sequence
  Description of Artificial Sequence: Synthetic oligonucleotide
  Target: ATXN1; (+) strand; PAM type: YTN; PAM sequence: CTA
aataagggcagtaaaaatgc

SEQ ID NO: 257109 - DNA, 20 bp, Artificial Sequence
  Description of Artificial Sequence: Synthetic oligonucleotide
  Target: ATXN1; (+) strand; PAM type: YTN; PAM sequence: TTG
gatcttgtaggcaaattctg

SEQ ID NO: 257110 - DNA, 20 bp, Artificial Sequence
  Description of Artificial Sequence: Synthetic oligonucleotide
  Target: ATXN1; (+) strand; PAM type: YTN; PAM sequence: CTT
gtaggcaaattctgaggttg

SEQ ID NO: 257111 - DNA, 20 bp, Artificial Sequence
  Description of Artificial Sequence: Synthetic oligonucleotide
  Target: ATXN1; (+) strand; PAM type: YTN; PAM sequence: TTG
taggcaaattctgaggttgt

SEQ ID NO: 257112 - DNA, 20 bp, Artificial Sequence
  Description of Artificial Sequence: Synthetic oligonucleotide
  Target: ATXN1; (+) strand; PAM type: YTN; PAM sequence: TTC
tgaggttgtaacggatgaaa

SEQ ID NO: 257113 - DNA, 20 bp, Artificial Sequence
  Description of Artificial Sequence: Synthetic oligonucleotide
  Target: ATXN1; (+) strand; PAM type: YTN; PAM sequence: CTG
aggttgtaacggatgaaatt

SEQ ID NO: 257114 - DNA, 20 bp, Artificial Sequence
  Description of Artificial Sequence: Synthetic oligonucleotide
  Target: ATXN1; (+) strand; PAM type: YTN; PAM sequence: TTG
taacggatgaaattaatata

SEQ ID NO: 257115 - DNA, 20 bp, Artificial Sequence
  Description of Artificial Sequence: Synthetic oligonucleotide
  Target: ATXN1; (+) strand; PAM type: YTN; PAM sequence: TTA
atataaatgttgattcactg

SEQ ID NO: 257116 - DNA, 20 bp, Artificial Sequence
  Description of Artificial Sequence: Synthetic oligonucleotide
  Target: ATXN1; (+) strand; PAM type: YTN; PAM sequence: TTG
attcactgaattgtgaacta

SEQ ID NO: 257117 - DNA, 20 bp, Artificial Sequence
  Description of Artificial Sequence: Synthetic oligonucleotide
  Target: ATXN1; (+) strand; PAM type: YTN; PAM sequence: TTC
actgaattgtgaactataga

SEQ ID NO: 257118 - DNA, 20 bp, Artificial Sequence
  Description of Artificial Sequence: Synthetic oligonucleotide
  Target: ATXN1; (+) strand; PAM type: YTN; PAM sequence: CTG
aattgtgaactatagaatat

SEQ ID NO: 257119 - DNA, 20 bp, Artificial Sequence
  Description of Artificial Sequence: Synthetic oligonucleotide
  Target: ATXN1; (+) strand; PAM type: YTN; PAM sequence: TTG
tgaactatagaatatgaacc

SEQ ID NO: 257120 - DNA, 20 bp, Artificial Sequence
  Description of Artificial Sequence: Synthetic oligonucleotide
  Target: ATXN1; (+) strand; PAM type: YTN; PAM sequence: CTA
tagaatatgaaccctgtcaa

SEQ ID NO: 257121 - DNA, 20 bp, Artificial Sequence
  Description of Artificial Sequence: Synthetic oligonucleotide
  Target: ATXN1; (+) strand; PAM type: YTN; PAM sequence: CTG
tcaataggagaaacctttct

SEQ ID NO: 257122 - DNA, 20 bp, Artificial Sequence
  Description of Artificial Sequence: Synthetic oligonucleotide
  Target: ATXN1; (+) strand; PAM type: YTN; PAM sequence: CTT
tctaaaagccttcttctttg

SEQ ID NO: 257123 - DNA, 20 bp, Artificial Sequence
  Description of Artificial Sequence: Synthetic oligonucleotide
  Target: ATXN1; (+) strand; PAM type: YTN; PAM sequence: TTT
ctaaaagccttcttctttgt

SEQ ID NO: 257124 - DNA, 20 bp, Artificial Sequence
  Description of Artificial Sequence: Synthetic oligonucleotide
  Target: ATXN1; (+) strand; PAM type: YTN; PAM sequence: TTC
taaaagccttcttctttgtt

SEQ ID NO: 257125 - DNA, 20 bp, Artificial Sequence
  Description of Artificial Sequence: Synthetic oligonucleotide
  Target: ATXN1; (+) strand; PAM type: YTN; PAM sequence: CTA
aaagccttcttctttgttgt

SEQ ID NO: 257126 - DNA, 20 bp, Artificial Sequence
  Description of Artificial Sequence: Synthetic oligonucleotide
  Target: ATXN1; (+) strand; PAM type: YTN; PAM sequence: CTT
cttctttgttgtgcatgttt

SEQ ID NO: 257127 - DNA, 20 bp, Artificial Sequence
  Description of Artificial Sequence: Synthetic oligonucleotide
  Target: ATXN1; (+) strand; PAM type: YTN; PAM sequence: TTC
ttctttgttgtgcatgtttt

SEQ ID NO: 257128 - DNA, 20 bp, Artificial Sequence
  Description of Artificial Sequence: Synthetic oligonucleotide
  Target: ATXN1; (+) strand; PAM type: YTN; PAM sequence: CTT
ctttgttgtgcatgttttta

SEQ ID NO: 257129 - DNA, 20 bp, Artificial Sequence
  Description of Artificial Sequence: Synthetic oligonucleotide
  Target: ATXN1; (+) strand; PAM type: YTN; PAM sequence: TTC
tttgttgtgcatgtttttag

SEQ ID NO: 257130 - DNA, 20 bp, Artificial Sequence
  Description of Artificial Sequence: Synthetic oligonucleotide
  Target: ATXN1; (+) strand; PAM type: YTN; PAM sequence: CTT
tgttgtgcatgtttttaggg

SEQ ID NO: 257131 - DNA, 20 bp, Artificial Sequence
  Description of Artificial Sequence: Synthetic oligonucleotide
  Target: ATXN1; (+) strand; PAM type: YTN; PAM sequence: TTT
gttgtgcatgtttttaggga

SEQ ID NO: 257132 - DNA, 20 bp, Artificial Sequence
  Description of Artificial Sequence: Synthetic oligonucleotide
  Target: ATXN1; (+) strand; PAM type: YTN; PAM sequence: TTG
ttgtgcatgtttttagggat

SEQ ID NO: 257133 - DNA, 20 bp, Artificial Sequence
  Description of Artificial Sequence: Synthetic oligonucleotide
  Target: ATXN1; (+) strand; PAM type: YTN; PAM sequence: TTG
tgcatgtttttagggattca

SEQ ID NO: 257134 - DNA, 20 bp, Artificial Sequence
  Description of Artificial Sequence: Synthetic oligonucleotide
  Target: ATXN1; (+) strand; PAM type: YTN; PAM sequence: TTT
ttagggattcagtccagaac

SEQ ID NO: 257135 - DNA, 20 bp, Artificial Sequence
  Description of Artificial Sequence: Synthetic oligonucleotide
  Target: ATXN1; (+) strand; PAM type: YTN; PAM sequence: TTT
tagggattcagtccagaact

SEQ ID NO: 257136 - DNA, 20 bp, Artificial Sequence
  Description of Artificial Sequence: Synthetic oligonucleotide
  Target: ATXN1; (+) strand; PAM type: YTN; PAM sequence: TTT
agggattcagtccagaactt

SEQ ID NO: 257137 - DNA, 20 bp, Artificial Sequence
  Description of Artificial Sequence: Synthetic oligonucleotide
  Target: ATXN1; (+) strand; PAM type: YTN; PAM sequence: TTA
gggattcagtccagaacttt

SEQ ID NO: 257138 - DNA, 20 bp, Artificial Sequence
  Description of Artificial Sequence: Synthetic oligonucleotide
  Target: ATXN1; (+) strand; PAM type: YTN; PAM sequence: TTC
agtccagaactttcacccgg

SEQ ID NO: 257139 - DNA, 20 bp, Artificial Sequence
  Description of Artificial Sequence: Synthetic oligonucleotide
  Target: ATXN1; (+) strand; PAM type: YTN; PAM sequence: CTT
tcacccggaaactcaaaaca

SEQ ID NO: 257140 - DNA, 20 bp, Artificial Sequence
  Description of Artificial Sequence: Synthetic oligonucleotide
  Target: ATXN1; (+) strand; PAM type: YTN; PAM sequence: TTT
cacccggaaactcaaaacaa

SEQ ID NO: 257141 - DNA, 20 bp, Artificial Sequence
  Description of Artificial Sequence: Synthetic oligonucleotide
  Target: ATXN1; (+) strand; PAM type: YTN; PAM sequence: TTC
acccggaaactcaaaacaag

SEQ ID NO: 257142 - DNA, 20 bp, Artificial Sequence
  Description of Artificial Sequence: Synthetic oligonucleotide
  Target: ATXN1; (+) strand; PAM type: YTN; PAM sequence: CTC
aaaacaagaaatttagtttg

SEQ ID NO: 257143 - DNA, 20 bp, Artificial Sequence
  Description of Artificial Sequence: Synthetic oligonucleotide
  Target: ATXN1; (+) strand; PAM type: YTN; PAM sequence: TTT
agtttgaaataaatcaggtc

SEQ ID NO: 257144 - DNA, 20 bp, Artificial Sequence
  Description of Artificial Sequence: Synthetic oligonucleotide
  Target: ATXN1; (+) strand; PAM type: YTN; PAM sequence: TTA
gtttgaaataaatcaggtct

SEQ ID NO: 257145 - DNA, 20 bp, Artificial Sequence
  Description of Artificial Sequence: Synthetic oligonucleotide
  Target: ATXN1; (+) strand; PAM type: YTN; PAM sequence: TTT
gaaataaatcaggtcttaac

SEQ ID NO: 257146 - DNA, 20 bp, Artificial Sequence
  Description of Artificial Sequence: Synthetic oligonucleotide
  Target: ATXN1; (+) strand; PAM type: YTN; PAM sequence: TTG
aaataaatcaggtcttaaca

SEQ ID NO: 257147 - DNA, 20 bp, Artificial Sequence
  Description of Artificial Sequence: Synthetic oligonucleotide
  Target: ATXN1; (+) strand; PAM type: YTN; PAM sequence: CTT
aacaagtgagagactattaa

SEQ ID NO: 257148 - DNA, 20 bp, Artificial Sequence
  Description of Artificial Sequence: Synthetic oligonucleotide
  Target: ATXN1; (+) strand; PAM type: YTN; PAM sequence: TTA
acaagtgagagactattaag

SEQ ID NO: 257149 - DNA, 20 bp, Artificial Sequence
  Description of Artificial Sequence: Synthetic oligonucleotide
  Target: ATXN1; (+) strand; PAM type: YTN; PAM sequence: CTA
ttaagattaacagactgtct

SEQ ID NO: 257150 - DNA, 20 bp, Artificial Sequence
  Description of Artificial Sequence: Synthetic oligonucleotide
  Target: ATXN1; (+) strand; PAM type: YTN; PAM sequence: TTA
agattaacagactgtcttgg

SEQ ID NO: 257151 - DNA, 20 bp, Artificial Sequence
  Description of Artificial Sequence: Synthetic oligonucleotide
  Target: ATXN1; (+) strand; PAM type: YTN; PAM sequence: TTA
acagactgtcttggacagcc

SEQ ID NO: 257152 - DNA, 20 bp, Artificial Sequence
  Description of Artificial Sequence: Synthetic oligonucleotide
  Target: ATXN1; (+) strand; PAM type: YTN; PAM sequence: CTG
tcttggacagcctcctgcgt

SEQ ID NO: 257153 - DNA, 20 bp, Artificial Sequence
  Description of Artificial Sequence: Synthetic oligonucleotide
  Target: ATXN1; (+) strand; PAM type: YTN; PAM sequence: CTT
ggacagcctcctgcgtgtcc

SEQ ID NO: 257154 - DNA, 20 bp, Artificial Sequence
  Description of Artificial Sequence: Synthetic oligonucleotide
  Target: ATXN1; (+) strand; PAM type: YTN; PAM sequence: TTG
gacagcctcctgcgtgtccc

SEQ ID NO: 257155 - DNA, 20 bp, Artificial Sequence
  Description of Artificial Sequence: Synthetic oligonucleotide
  Target: ATXN1; (+) strand; PAM type: YTN; PAM sequence: CTC
ctgcgtgtcccttatcatct

SEQ ID NO: 257156 - DNA, 20 bp, Artificial Sequence
  Description of Artificial Sequence: Synthetic oligonucleotide
  Target: ATXN1; (+) strand; PAM type: YTN; PAM sequence: CTG
cgtgtcccttatcatctaaa

SEQ ID NO: 257157 - DNA, 20 bp, Artificial Sequence
  Description of Artificial Sequence: Synthetic oligonucleotide
  Target: ATXN1; (+) strand; PAM type: YTN; PAM sequence: CTT
atcatctaaagggttactac

SEQ ID NO: 257158 - DNA, 20 bp, Artificial Sequence
  Description of Artificial Sequence: Synthetic oligonucleotide
  Target: ATXN1; (+) strand; PAM type: YTN; PAM sequence: TTA
tcatctaaagggttactact

SEQ ID NO: 257159 - DNA, 20 bp, Artificial Sequence
  Description of Artificial Sequence: Synthetic oligonucleotide
  Target: ATXN1; (+) strand; PAM type: YTN; PAM sequence: CTA
aagggttactactagactac

SEQ ID NO: 257160 - DNA, 20 bp, Artificial Sequence
  Description of Artificial Sequence: Synthetic oligonucleotide
  Target: ATXN1; (+) strand; PAM type: YTN; PAM sequence: TTA
ctactagactacatcctttt

SEQ ID NO: 257161 - DNA, 20 bp, Artificial Sequence
  Description of Artificial Sequence: Synthetic oligonucleotide
  Target: ATXN1; (+) strand; PAM type: YTN; PAM sequence: CTA
ctagactacatccttttctg

SEQ ID NO: 257162 - DNA, 20 bp, Artificial Sequence
  Description of Artificial Sequence: Synthetic oligonucleotide
  Target: ATXN1; (+) strand; PAM type: YTN; PAM sequence: CTA
gactacatccttttctgctt

SEQ ID NO: 257163 - DNA, 20 bp, Artificial Sequence
  Description of Artificial Sequence: Synthetic oligonucleotide
  Target: ATXN1; (+) strand; PAM type: YTN; PAM sequence: CTA
catccttttctgctttatct

SEQ ID NO: 257164 - DNA, 20 bp, Artificial Sequence
  Description of Artificial Sequence: Synthetic oligonucleotide
  Target: ATXN1; (+) strand; PAM type: YTN; PAM sequence: CTT
ttctgctttatctcagaggc

SEQ ID NO: 257165 - DNA, 20 bp, Artificial Sequence
  Description of Artificial Sequence: Synthetic oligonucleotide
  Target: ATXN1; (+) strand; PAM type: YTN; PAM sequence: TTT
tctgctttatctcagaggcc

SEQ ID NO: 257166 - DNA, 20 bp, Artificial Sequence
  Description of Artificial Sequence: Synthetic oligonucleotide
  Target: ATXN1; (+) strand; PAM type: YTN; PAM sequence: TTT
ctgctttatctcagaggccc

SEQ ID NO: 257167 - DNA, 20 bp, Artificial Sequence
  Description of Artificial Sequence: Synthetic oligonucleotide
  Target: ATXN1; (+) strand; PAM type: YTN; PAM sequence: TTC
tgctttatctcagaggccca

SEQ ID NO: 257168 - DNA, 20 bp, Artificial Sequence
  Description of Artificial Sequence: Synthetic oligonucleotide
  Target: ATXN1; (+) strand; PAM type: YTN; PAM sequence: CTG
ctttatctcagaggcccatt

SEQ ID NO: 257169 - DNA, 20 bp, Artificial Sequence
  Description of Artificial Sequence: Synthetic oligonucleotide
  Target: ATXN1; (+) strand; PAM type: YTN; PAM sequence: CTT
tatctcagaggcccattaaa

SEQ ID NO: 257170 - DNA, 20 bp, Artificial Sequence
  Description of Artificial Sequence: Synthetic oligonucleotide
  Target: ATXN1; (+) strand; PAM type: YTN; PAM sequence: TTT
atctcagaggcccattaaag

SEQ ID NO: 257171 - DNA, 20 bp, Artificial Sequence
  Description of Artificial Sequence: Synthetic oligonucleotide
  Target: ATXN1; (+) strand; PAM type: YTN; PAM sequence: TTA
tctcagaggcccattaaagc

SEQ ID NO: 257172 - DNA, 20 bp, Artificial Sequence
  Description of Artificial Sequence: Synthetic oligonucleotide
  Target: ATXN1; (+) strand; PAM type: YTN; PAM sequence: CTC
agaggcccattaaagcatgt

SEQ ID NO: 257173 - DNA, 20 bp, Artificial Sequence
  Description of Artificial Sequence: Synthetic oligonucleotide
  Target: ATXN1; (+) strand; PAM type: YTN; PAM sequence: TTA
aagcatgtaaccagactgct

SEQ ID NO: 257174 - DNA, 20 bp, Artificial Sequence
  Description of Artificial Sequence: Synthetic oligonucleotide
  Target: ATXN1; (+) strand; PAM type: YTN; PAM sequence: CTG
ctcagattcatactatacta

SEQ ID NO: 257175 - DNA, 20 bp, Artificial Sequence
  Description of Artificial Sequence: Synthetic oligonucleotide
  Target: ATXN1; (+) strand; PAM type: YTN; PAM sequence: CTC
agattcatactatactaatt

SEQ ID NO: 257176 - DNA, 20 bp, Artificial Sequence
  Description of Artificial Sequence: Synthetic oligonucleotide
  Target: ATXN1; (+) strand; PAM type: YTN; PAM sequence: TTC
atactatactaattttctct

SEQ ID NO: 257177 - DNA, 20 bp, Artificial Sequence
  Description of Artificial Sequence: Synthetic oligonucleotide
  Target: ATXN1; (+) strand; PAM type: YTN; PAM sequence: CTA
tactaattttctctttccaa

SEQ ID NO: 257178 - DNA, 20 bp, Artificial Sequence
  Description of Artificial Sequence: Synthetic oligonucleotide
  Target: ATXN1; (+) strand; PAM type: YTN; PAM sequence: CTA
attttctctttccaaaagaa

SEQ ID NO: 257179 - DNA, 20 bp, Artificial Sequence
  Description of Artificial Sequence: Synthetic oligonucleotide
  Target: ATXN1; (+) strand; PAM type: YTN; PAM sequence: TTT
tctctttccaaaagaaacca

SEQ ID NO: 257180 - DNA, 20 bp, Artificial Sequence
  Description of Artificial Sequence: Synthetic oligonucleotide
  Target: ATXN1; (+) strand; PAM type: YTN; PAM sequence: TTT
ctctttccaaaagaaaccaa

SEQ ID NO: 257181 - DNA, 20 bp, Artificial Sequence
  Description of Artificial Sequence: Synthetic oligonucleotide
  Target: ATXN1; (+) strand; PAM type: YTN; PAM sequence: TTC
tctttccaaaagaaaccaaa

SEQ ID NO: 257182 - DNA, 20 bp, Artificial Sequence
  Description of Artificial Sequence: Synthetic oligonucleotide
  Target: ATXN1; (+) strand; PAM type: YTN; PAM sequence: CTC
tttccaaaagaaaccaaaca

SEQ ID NO: 257183 - DNA, 20 bp, Artificial Sequence
  Description of Artificial Sequence: Synthetic oligonucleotide
  Target: ATXN1; (+) strand; PAM type: YTN; PAM sequence: CTT
tccaaaagaaaccaaacaac

SEQ ID NO: 257184 - DNA, 20 bp, Artificial Sequence
  Description of Artificial Sequence: Synthetic oligonucleotide
  Target: ATXN1; (+) strand; PAM type: YTN; PAM sequence: TTT
ccaaaagaaaccaaacaaca

SEQ ID NO: 257185 - DNA, 20 bp, Artificial Sequence
  Description of Artificial Sequence: Synthetic oligonucleotide
  Target: ATXN1; (+) strand; PAM type: YTN; PAM sequence: TTC
caaaagaaaccaaacaacaa

SEQ ID NO: 257186 - DNA, 20 bp, Artificial Sequence
  Description of Artificial Sequence: Synthetic oligonucleotide
  Target: ATXN1; (+) strand; PAM type: YTN; PAM sequence: CTC
caccaagtgactaaactaaa

SEQ ID NO: 257187 - DNA, 20 bp, Artificial Sequence
  Description of Artificial Sequence: Synthetic oligonucleotide
  Target: ATXN1; (+) strand; PAM type: YTN; PAM sequence: CTA
aactaaattcaaatatccat

SEQ ID NO: 257188 - DNA, 20 bp, Artificial Sequence
  Description of Artificial Sequence: Synthetic oligonucleotide
  Target: ATXN1; (+) strand; PAM type: YTN; PAM sequence: CTA
aattcaaatatccatacaat

SEQ ID NO: 257189 - DNA, 20 bp, Artificial Sequence
  Description of Artificial Sequence: Synthetic oligonucleotide
  Target: ATXN1; (+) strand; PAM type: YTN; PAM sequence: TTC
aaatatccatacaattctat

SEQ ID NO: 257190 - DNA, 20 bp, Artificial Sequence
  Description of Artificial Sequence: Synthetic oligonucleotide
  Target: ATXN1; (+) strand; PAM type: YTN; PAM sequence: TTC
tatccacggcaacagcgtca

SEQ ID NO: 257191 - DNA, 20 bp, Artificial Sequence
  Description of Artificial Sequence: Synthetic oligonucleotide
  Target: ATXN1; (+) strand; PAM type: YTN; PAM sequence: CTA
tccacggcaacagcgtcagt

SEQ ID NO: 257192 - DNA, 20 bp, Artificial Sequence
  Description of Artificial Sequence: Synthetic oligonucleotide
  Target: ATXN1; (+) strand; PAM type: YTN; PAM sequence: TTT
ctcagaaatttcattgccag

SEQ ID NO: 257193 - DNA, 20 bp, Artificial Sequence
  Description of Artificial Sequence: Synthetic oligonucleotide
  Target: ATXN1; (+) strand; PAM type: YTN; PAM sequence: TTC
tcagaaatttcattgccagg

SEQ ID NO: 257194 - DNA, 20 bp, Artificial Sequence
  Description of Artificial Sequence: Synthetic oligonucleotide
  Target: ATXN1; (+) strand; PAM type: YTN; PAM sequence: CTC
agaaatttcattgccaggct

SEQ ID NO: 257195 - DNA, 20 bp, Artificial Sequence
  Description of Artificial Sequence: Synthetic oligonucleotide
  Target: ATXN1; (+) strand; PAM type: YTN; PAM sequence: TTT
cattgccaggctcccccact

SEQ ID NO: 257196 - DNA, 20 bp, Artificial Sequence
  Description of Artificial Sequence: Synthetic oligonucleotide
  Target: ATXN1; (+) strand; PAM type: YTN; PAM sequence: TTC
attgccaggctcccccactt

SEQ ID NO: 257197 - DNA, 20 bp, Artificial Sequence
  Description of Artificial Sequence: Synthetic oligonucleotide
  Target: ATXN1; (+) strand; PAM type: YTN; PAM sequence: TTG
ccaggctcccccacttcaat

SEQ ID NO: 257198 - DNA, 20 bp, Artificial Sequence
  Description of Artificial Sequence: Synthetic oligonucleotide
  Target: ATXN1; (+) strand; PAM type: YTN; PAM sequence: CTC
ccccacttcaatggacaata

SEQ ID NO: 257199 - DNA, 20 bp, Artificial Sequence
  Description of Artificial Sequence: Synthetic oligonucleotide
  Target: ATXN1; (+) strand; PAM type: YTN; PAM sequence: CTT
caatggacaatagaagaaaa

SEQ ID NO: 257200 - DNA, 20 bp, Artificial Sequence
  Description of Artificial Sequence: Synthetic oligonucleotide
  Target: ATXN1; (+) strand; PAM type: YTN; PAM sequence: TTC
aatggacaatagaagaaaat

SEQ ID NO: 257201 - DNA, 20 bp, Artificial Sequence
  Description of Artificial Sequence: Synthetic oligonucleotide
  Target: ATXN1; (+) strand; PAM type: YTN; PAM sequence: CTC
aatgtcgcaaacttcagtgc

SEQ ID NO: 257202 - DNA, 20 bp, Artificial Sequence
  Description of Artificial Sequence: Synthetic oligonucleotide
  Target: ATXN1; (+) strand; PAM type: YTN; PAM sequence: CTT
cagtgccgctcaaggagcta

SEQ ID NO: 257203 - DNA, 20 bp, Artificial Sequence
  Description of Artificial Sequence: Synthetic oligonucleotide
  Target: ATXN1; (+) strand; PAM type: YTN; PAM sequence: TTC
agtgccgctcaaggagctaa

SEQ ID NO: 257204 - DNA, 20 bp, Artificial Sequence
  Description of Artificial Sequence: Synthetic oligonucleotide
  Target: ATXN1; (+) strand; PAM type: YTN; PAM sequence: CTC
aaggagctaattaaatctcc

SEQ ID NO: 257205 - DNA, 20 bp, Artificial Sequence
  Description of Artificial Sequence: Synthetic oligonucleotide
  Target: ATXN1; (+) strand; PAM type: YTN; PAM sequence: CTA
attaaatctcctaggatgcc

SEQ ID NO: 257206 - DNA, 20 bp, Artificial Sequence
  Description of Artificial Sequence: Synthetic oligonucleotide
  Target: ATXN1; (+) strand; PAM type: YTN; PAM sequence: TTA
aatctcctaggatgccctca

SEQ ID NO: 257207 - DNA, 20 bp, Artificial Sequence
  Description of Artificial Sequence: Synthetic oligonucleotide
  Target: ATXN1; (+) strand; PAM type: YTN; PAM sequence: CTC
ctaggatgccctcacccaca

SEQ ID NO: 257208 - DNA, 20 bp, Artificial Sequence
  Description of Artificial Sequence: Synthetic oligonucleotide
  Target: ATXN1; (+) strand; PAM type: YTN; PAM sequence: CTA
ggatgccctcacccacaccc

SEQ ID NO: 257209 - DNA, 20 bp, Artificial Sequence
  Description of Artificial Sequence: Synthetic oligonucleotide
  Target: ATXN1; (+) strand; PAM type: YTN; PAM sequence: CTC
acccacaccctaagaaattt

SEQ ID NO: 257210 - DNA, 20 bp, Artificial Sequence
  Description of Artificial Sequence: Synthetic oligonucleotide
  Target: ATXN1; (+) strand; PAM type: YTN; PAM sequence: CTA
agaaatttgaagggtacgca

SEQ ID NO: 257211 - DNA, 20 bp, Artificial Sequence
  Description of Artificial Sequence: Synthetic oligonucleotide
  Target: ATXN1; (+) strand; PAM type: YTN; PAM sequence: TTT
gaagggtacgcaaaatccaa

SEQ ID NO: 257212 - DNA, 20 bp, Artificial Sequence
  Description of Artificial Sequence: Synthetic oligonucleotide
  Target: ATXN1; (+) strand; PAM type: YTN; PAM sequence: TTG
aagggtacgcaaaatccaaa

SEQ ID NO: 257213 - DNA, 20 bp, Artificial Sequence
  Description of Artificial Sequence: Synthetic oligonucleotide
  Target: ATXN1; (+) strand; PAM type: YTN; PAM sequence: CTC
aattcaacaccattaaaata

SEQ ID NO: 257214 - DNA, 20 bp, Artificial Sequence
  Description of Artificial Sequence: Synthetic oligonucleotide
  Target: ATXN1; (+) strand; PAM type: YTN; PAM sequence: TTC
aacaccattaaaataaaagg

SEQ ID NO: 257215 - DNA, 20 bp, Artificial Sequence
  Description of Artificial Sequence: Synthetic oligonucleotide
  Target: ATXN1; (+) strand; PAM type: YTN; PAM sequence: TTA
aaataaaaggcctttacata

SEQ ID NO: 257216 - DNA, 20 bp, Artificial Sequence
  Description of Artificial Sequence: Synthetic oligonucleotide
  Target: ATXN1; (+) strand; PAM type: YTN; PAM sequence: CTT
tacatataaagcttaatctt

SEQ ID NO: 257217 - DNA, 20 bp, Artificial Sequence
  Description of Artificial Sequence: Synthetic oligonucleotide
  Target: ATXN1; (+) strand; PAM type: YTN; PAM sequence: TTT
acatataaagcttaatcttg

SEQ ID NO: 257218 - DNA, 20 bp, Artificial Sequence
  Description of Artificial Sequence: Synthetic oligonucleotide
  Target: ATXN1; (+) strand; PAM type: YTN; PAM sequence: TTA
catataaagcttaatcttga

SEQ ID NO: 257219 - DNA, 20 bp, Artificial Sequence
  Description of Artificial Sequence: Synthetic oligonucleotide
  Target: ATXN1; (+) strand; PAM type: YTN; PAM sequence: CTT
aatcttgactttctttgtcc

SEQ ID NO: 257220 - DNA, 20 bp, Artificial Sequence
  Description of Artificial Sequence: Synthetic oligonucleotide
  Target: ATXN1; (+) strand; PAM type: YTN; PAM sequence: TTA
atcttgactttctttgtcct

SEQ ID NO: 257221 - DNA, 20 bp, Artificial Sequence
  Description of Artificial Sequence: Synthetic oligonucleotide
  Target: ATXN1; (+) strand; PAM type: YTN; PAM sequence: CTT
gactttctttgtccttttct

SEQ ID NO: 257222 - DNA, 20 bp, Artificial Sequence
  Description of Artificial Sequence: Synthetic oligonucleotide
  Target: ATXN1; (+) strand; PAM type: YTN; PAM sequence: TTG
actttctttgtccttttctc

SEQ ID NO: 257223 - DNA, 20 bp, Artificial Sequence
  Description of Artificial Sequence: Synthetic oligonucleotide
  Target: ATXN1; (+) strand; PAM type: YTN; PAM sequence: CTT
tctttgtccttttctcccca

SEQ ID NO: 257224 - DNA, 20 bp, Artificial Sequence
  Description of Artificial Sequence: Synthetic oligonucleotide
  Target: ATXN1; (+) strand; PAM type: YTN; PAM sequence: TTT
ctttgtccttttctccccac

SEQ ID NO: 257225 - DNA, 20 bp, Artificial Sequence
  Description of Artificial Sequence: Synthetic oligonucleotide
  Target: ATXN1; (+) strand; PAM type: YTN; PAM sequence: TTC
tttgtccttttctccccaca

SEQ ID NO: 257226 - DNA, 20 bp, Artificial Sequence
  Description of Artificial Sequence: Synthetic oligonucleotide
  Target: ATXN1; (+) strand; PAM type: YTN; PAM sequence: CTT
tgtccttttctccccacaaa

SEQ ID NO: 257227 - DNA, 20 bp, Artificial Sequence
  Description of Artificial Sequence: Synthetic oligonucleotide
  Target: ATXN1; (+) strand; PAM type: YTN; PAM sequence: TTT
gtccttttctccccacaaag

SEQ ID NO: 257228 - DNA, 20 bp, Artificial Sequence
  Description of Artificial Sequence: Synthetic oligonucleotide
  Target: ATXN1; (+) strand; PAM type: YTN; PAM sequence: TTG
tccttttctccccacaaagt

SEQ ID NO: 257229 - DNA, 20 bp, Artificial Sequence
  Description of Artificial Sequence: Synthetic oligonucleotide
  Target: ATXN1; (+) strand; PAM type: YTN; PAM sequence: CTT
ttctccccacaaagtagtag

SEQ ID NO: 257230 - DNA, 20 bp, Artificial Sequence
  Description of Artificial Sequence: Synthetic oligonucleotide
  Target: ATXN1; (+) strand; PAM type: YTN; PAM sequence: TTT
tctccccacaaagtagtaga

SEQ ID NO: 257231 - DNA, 20 bp, Artificial Sequence
  Description of Artificial Sequence: Synthetic oligonucleotide
  Target: ATXN1; (+) strand; PAM type: YTN; PAM sequence: TTT
ctccccacaaagtagtagat

SEQ ID NO: 257232 - DNA, 20 bp, Artificial Sequence
  Description of Artificial Sequence: Synthetic oligonucleotide
  Target: ATXN1; (+) strand; PAM type: YTN; PAM sequence: TTC
tccccacaaagtagtagatt

SEQ ID NO: 257233 - DNA, 20 bp, Artificial Sequence
  Description of Artificial Sequence: Synthetic oligonucleotide
  Target: ATXN1; (+) strand; PAM type: YTN; PAM sequence: CTC
cccacaaagtagtagatttc

SEQ ID NO: 257234 - DNA, 20 bp, Artificial Sequence
  Description of Artificial Sequence: Synthetic oligonucleotide
  Target: ATXN1; (+) strand; PAM type: YTN; PAM sequence: TTT
ccaaattccccaaaggtcat

SEQ ID NO: 257235 - DNA, 20 bp, Artificial Sequence
  Description of Artificial Sequence: Synthetic oligonucleotide
  Target: ATXN1; (+) strand; PAM type: YTN; PAM sequence: TTC
caaattccccaaaggtcatg

SEQ ID NO: 257236 - DNA, 20 bp, Artificial Sequence
  Description of Artificial Sequence: Synthetic oligonucleotide
  Target: ATXN1; (+) strand; PAM type: YTN; PAM sequence: TTC
cccaaaggtcatgagtttgg

SEQ ID NO: 257237 - DNA, 20 bp, Artificial Sequence
  Description of Artificial Sequence: Synthetic oligonucleotide
  Target: ATXN1; (+) strand; PAM type: YTN; PAM sequence: TTT
ggcaatggaacaatggcatc

SEQ ID NO: 257238 - DNA, 20 bp, Artificial Sequence
  Description of Artificial Sequence: Synthetic oligonucleotide
  Target: ATXN1; (+) strand; PAM type: YTN; PAM sequence: TTG
gcaatggaacaatggcatcc

SEQ ID NO: 257239 - DNA, 20 bp, Artificial Sequence
  Description of Artificial Sequence: Synthetic oligonucleotide
  Target: ATXN1; (+) strand; PAM type: YTN; PAM sequence: CTG
ccttggggagagagtttgct

SEQ ID NO: 257240 - DNA, 20 bp, Artificial Sequence
  Description of Artificial Sequence: Synthetic oligonucleotide
  Target: ATXN1; (+) strand; PAM type: YTN; PAM sequence: CTT
ggggagagagtttgctcctc

SEQ ID NO: 257241 - DNA, 20 bp, Artificial Sequence
  Description of Artificial Sequence: Synthetic oligonucleotide
  Target: ATXN1; (+) strand; PAM type: YTN; PAM sequence: TTG
gggagagagtttgctcctct

SEQ ID NO: 257242 - DNA, 20 bp, Artificial Sequence
  Description of Artificial Sequence: Synthetic oligonucleotide
  Target: ATXN1; (+) strand; PAM type: YTN; PAM sequence: TTT
gctcctctcttggccatgcc

SEQ ID NO: 257243 - DNA, 20 bp, Artificial Sequence
  Description of Artificial Sequence: Synthetic oligonucleotide
  Target: ATXN1; (+) strand; PAM type: YTN; PAM sequence: TTG
ctcctctcttggccatgccg

SEQ ID NO: 257244 - DNA, 20 bp, Artificial Sequence
  Description of Artificial Sequence: Synthetic oligonucleotide
  Target: ATXN1; (+) strand; PAM type: YTN; PAM sequence: CTC
ctctcttggccatgccgtgg

SEQ ID NO: 257245 - DNA, 20 bp, Artificial Sequence
  Description of Artificial Sequence: Synthetic oligonucleotide
  Target: ATXN1; (+) strand; PAM type: YTN; PAM sequence: CTC
tcttggccatgccgtggggg

SEQ ID NO: 257246 - DNA, 20 bp, Artificial Sequence
  Description of Artificial Sequence: Synthetic oligonucleotide
  Target: ATXN1; (+) strand; PAM type: YTN; PAM sequence: CTC
ttggccatgccgtgggggct

SEQ ID NO: 257247 - DNA, 20 bp, Artificial Sequence
  Description of Artificial Sequence: Synthetic oligonucleotide
  Target: ATXN1; (+) strand; PAM type: YTN; PAM sequence: CTT
ggccatgccgtgggggctgt

SEQ ID NO: 257248 - DNA, 20 bp, Artificial Sequence
  Description of Artificial Sequence: Synthetic oligonucleotide
  Target: ATXN1; (+) strand; PAM type: YTN; PAM sequence: TTG
gccatgccgtgggggctgtt

SEQ ID NO: 257249 - DNA, 20 bp, Artificial Sequence
  Description of Artificial Sequence: Synthetic oligonucleotide
  Target: ATXN1; (+) strand; PAM type: YTN; PAM sequence: CTG
ttgtctctcttgggagctgc

SEQ ID NO: 257250 - DNA, 20 bp, Artificial Sequence
  Description of Artificial Sequence: Synthetic oligonucleotide
  Target: ATXN1; (+) strand; PAM type: YTN; PAM sequence: TTG
tctctcttgggagctgcaag

SEQ ID NO: 257251 - DNA, 20 bp, Artificial Sequence
  Description of Artificial Sequence: Synthetic oligonucleotide
  Target: ATXN1; (+) strand; PAM type: YTN; PAM sequence: CTC
tcttgggagctgcaagcatc

SEQ ID NO: 257252 - DNA, 20 bp, Artificial Sequence
  Description of Artificial Sequence: Synthetic oligonucleotide
  Target: ATXN1; (+) strand; PAM type: YTN; PAM sequence: CTC
ttgggagctgcaagcatcat

SEQ ID NO: 257253 - DNA, 20 bp, Artificial Sequence
  Description of Artificial Sequence: Synthetic oligonucleotide
  Target: ATXN1; (+) strand; PAM type: YTN; PAM sequence: CTT
gggagctgcaagcatcatca

SEQ ID NO: 257254 - DNA, 20 bp, Artificial Sequence
  Description of Artificial Sequence: Synthetic oligonucleotide
  Target: ATXN1; (+) strand; PAM type: YTN; PAM sequence: TTG
ggagctgcaagcatcatcaa

SEQ ID NO: 257255 - DNA, 20 bp, Artificial Sequence
  Description of Artificial Sequence: Synthetic oligonucleotide
  Target: ATXN1; (+) strand; PAM type: YTN; PAM sequence: CTG
caagcatcatcaaagtggat

SEQ ID NO: 257256 - DNA, 20 bp, Artificial Sequence
  Description of Artificial Sequence: Synthetic oligonucleotide
  Target: ATXN1; (+) strand; PAM type: YTN; PAM sequence: CTG
gccacagcaagaagtatggt

SEQ ID NO: 257257 - DNA, 20 bp, Artificial Sequence
  Description of Artificial Sequence: Synthetic oligonucleotide
  Target: ATXN1; (+) strand; PAM type: YTN; PAM sequence: CTC
tgtcctatagttttctagtg

SEQ ID NO: 257258 - DNA, 20 bp, Artificial Sequence
  Description of Artificial Sequence: Synthetic oligonucleotide
  Target: ATXN1; (+) strand; PAM type: YTN; PAM sequence: CTG
tcctatagttttctagtgtt

SEQ ID NO: 257259 - DNA, 20 bp, Artificial Sequence
  Description of Artificial Sequence: Synthetic oligonucleotide
  Target: ATXN1; (+) strand; PAM type: YTN; PAM sequence: CTA
tagttttctagtgttagggt

SEQ ID NO: 257260 - DNA, 20 bp, Artificial Sequence
  Description of Artificial Sequence: Synthetic oligonucleotide
  Target: ATXN1; (+) strand; PAM type: YTN; PAM sequence: TTT
tctagtgttagggtgatgag

SEQ ID NO: 257261 - DNA, 20 bp, Artificial Sequence
  Description of Artificial Sequence: Synthetic oligonucleotide
  Target: ATXN1; (+) strand; PAM type: YTN; PAM sequence: TTT
ctagtgttagggtgatgagg

SEQ ID NO: 257262 - DNA, 20 bp, Artificial Sequence
  Description of Artificial Sequence: Synthetic oligonucleotide
  Target: ATXN1; (+) strand; PAM type: YTN; PAM sequence: TTC
tagtgttagggtgatgaggt

SEQ ID NO: 257263 - DNA, 20 bp, Artificial Sequence
  Description of Artificial Sequence: Synthetic oligonucleotide
  Target: ATXN1; (+) strand; PAM type: YTN; PAM sequence: CTA
gtgttagggtgatgaggtct

SEQ ID NO: 257264 - DNA, 20 bp, Artificial Sequence
  Description of Artificial Sequence: Synthetic oligonucleotide
  Target: ATXN1; (+) strand; PAM type: YTN; PAM sequence: TTA
gggtgatgaggtctctatct

SEQ ID NO: 257265 - DNA, 20 bp, Artificial Sequence
  Description of Artificial Sequence: Synthetic oligonucleotide
  Target: ATXN1; (+) strand; PAM type: YTN; PAM sequence: CTC
tatctattcacaagaagaaa

SEQ ID NO: 257266 - DNA, 20 bp, Artificial Sequence
  Description of Artificial Sequence: Synthetic oligonucleotide
  Target: ATXN1; (+) strand; PAM type: YTN; PAM sequence: CTA
tctattcacaagaagaaaaa

SEQ ID NO: 257267 - DNA, 20 bp, Artificial Sequence
  Description of Artificial Sequence: Synthetic oligonucleotide
  Target: ATXN1; (+) strand; PAM type: YTN; PAM sequence: CTA
ttcacaagaagaaaaagagt

SEQ ID NO: 257268 - DNA, 20 bp, Artificial Sequence
  Description of Artificial Sequence: Synthetic oligonucleotide
  Target: ATXN1; (+) strand; PAM type: YTN; PAM sequence: TTC
acaagaagaaaaagagtcat

SEQ ID NO: 257269 - DNA, 20 bp, Artificial Sequence
  Description of Artificial Sequence: Synthetic oligonucleotide
  Target: ATXN1; (+) strand; PAM type: YTN; PAM sequence: CTA
aaccattcccaaactatgtt

SEQ ID NO: 257270 - DNA, 20 bp, Artificial Sequence
  Description of Artificial Sequence: Synthetic oligonucleotide
  Target: ATXN1; (+) strand; PAM type: YTN; PAM sequence: TTC
ccaaactatgttagaaatga

SEQ ID NO: 257271 - DNA, 20 bp, Artificial Sequence
  Description of Artificial Sequence: Synthetic oligonucleotide
  Target: ATXN1; (+) strand; PAM type: YTN; PAM sequence: CTA
tgttagaaatgaagaaaggg

SEQ ID NO: 257272 - DNA, 20 bp, Artificial Sequence
  Description of Artificial Sequence: Synthetic oligonucleotide
  Target: ATXN1; (+) strand; PAM type: YTN; PAM sequence: TTA
gaaatgaagaaaggggaagg

SEQ ID NO: 257273 - DNA, 20 bp, Artificial Sequence
  Description of Artificial Sequence: Synthetic oligonucleotide
  Target: ATXN1; (+) strand; PAM type: YTN; PAM sequence: CTT
gctgagcacttcgtttaaat

SEQ ID NO: 257274 - DNA, 20 bp, Artificial Sequence
  Description of Artificial Sequence: Synthetic oligonucleotide
  Target: ATXN1; (+) strand; PAM type: YTN; PAM sequence: TTG
ctgagcacttcgtttaaatg

SEQ ID NO: 257275 - DNA, 20 bp, Artificial Sequence
  Description of Artificial Sequence: Synthetic oligonucleotide
  Target: ATXN1; (+) strand; PAM type: YTN; PAM sequence: CTG
agcacttcgtttaaatgtgc

SEQ ID NO: 257276 - DNA, 20 bp, Artificial Sequence
  Description of Artificial Sequence: Synthetic oligonucleotide
  Target: ATXN1; (+) strand; PAM type: YTN; PAM sequence: CTT
cgtttaaatgtgccagtcat

SEQ ID NO: 257277 - DNA, 20 bp, Artificial Sequence
  Description of Artificial Sequence: Synthetic oligonucleotide
  Target: ATXN1; (+) strand; PAM type: YTN; PAM sequence: TTC
gtttaaatgtgccagtcatt

SEQ ID NO: 257278 - DNA, 20 bp, Artificial Sequence
  Description of Artificial Sequence: Synthetic oligonucleotide
  Target: ATXN1; (+) strand; PAM type: YTN; PAM sequence: TTT
aaatgtgccagtcattatgc

SEQ ID NO: 257279 - DNA, 20 bp, Artificial Sequence
  Description of Artificial Sequence: Synthetic oligonucleotide
  Target: ATXN1; (+) strand; PAM type: YTN; PAM sequence: TTA
aatgtgccagtcattatgct

SEQ ID NO: 257280 - DNA, 20 bp, Artificial Sequence
  Description of Artificial Sequence: Synthetic oligonucleotide
  Target: ATXN1; (+) strand; PAM type: YTN; PAM sequence: TTA
tgctgcatattttatattta

SEQ ID NO: 257281 - DNA, 20 bp, Artificial Sequence
  Description of Artificial Sequence: Synthetic oligonucleotide
  Target: ATXN1; (+) strand; PAM type: YTN; PAM sequence: CTG
catattttatatttaatcct

SEQ ID NO: 257282 - DNA, 20 bp, Artificial Sequence
  Description of Artificial Sequence: Synthetic oligonucleotide
  Target: ATXN1; (+) strand; PAM type: YTN; PAM sequence: TTT
tatatttaatcctcacacaa

SEQ ID NO: 257283 - DNA, 20 bp, Artificial Sequence
  Description of Artificial Sequence: Synthetic oligonucleotide
  Target: ATXN1; (+) strand; PAM type: YTN; PAM sequence: TTT
atatttaatcctcacacaac

SEQ ID NO: 257284 - DNA, 20 bp, Artificial Sequence
  Description of Artificial Sequence: Synthetic oligonucleotide
  Target: ATXN1; (+) strand; PAM type: YTN; PAM sequence: TTA
tatttaatcctcacacaacc

SEQ ID NO: 257285 - DNA, 20 bp, Artificial Sequence
  Description of Artificial Sequence: Synthetic oligonucleotide
  Target: ATXN1; (+) strand; PAM type: YTN; PAM sequence: TTT
aatcctcacacaaccctaca

SEQ ID NO: 257286 - DNA, 20 bp, Artificial Sequence
  Description of Artificial Sequence: Synthetic oligonucleotide
  Target: ATXN1; (+) strand; PAM type: YTN; PAM sequence: TTA
atcctcacacaaccctacaa

SEQ ID NO: 257287 - DNA, 20 bp, Artificial Sequence
  Description of Artificial Sequence: Synthetic oligonucleotide
  Target: ATXN1; (+) strand; PAM type: YTN; PAM sequence: CTC
acacaaccctacaaagtaga

SEQ ID NO: 257288 - DNA, 20 bp, Artificial Sequence
  Description of Artificial Sequence: Synthetic oligonucleotide
  Target: ATXN1; (+) strand; PAM type: YTN; PAM sequence: CTA
caaagtagaaatgatgactc

SEQ ID NO: 257289 - DNA, 20 bp, Artificial Sequence
  Description of Artificial Sequence: Synthetic oligonucleotide
  Target: ATXN1; (+) strand; PAM type: YTN; PAM sequence: CTC
tatttaaagacaaactgaaa

SEQ ID NO: 257290 - DNA, 20 bp, Artificial Sequence
  Description of Artificial Sequence: Synthetic oligonucleotide
  Target: ATXN1; (+) strand; PAM type: YTN; PAM sequence: CTA
tttaaagacaaactgaaact

SEQ ID NO: 257291 - DNA, 20 bp, Artificial Sequence
  Description of Artificial Sequence: Synthetic oligonucleotide
  Target: ATXN1; (+) strand; PAM type: YTN; PAM sequence: TTT
aaagacaaactgaaactcaa

SEQ ID NO: 257292 - DNA, 20 bp, Artificial Sequence
  Description of Artificial Sequence: Synthetic oligonucleotide
  Target: ATXN1; (+) strand; PAM type: YTN; PAM sequence: TTA
aagacaaactgaaactcaaa

SEQ ID NO: 257293 - DNA, 20 bp, Artificial Sequence
  Description of Artificial Sequence: Synthetic oligonucleotide
  Target: ATXN1; (+) strand; PAM type: YTN; PAM sequence: CTG
aaactcaaaagaacttcctc

SEQ ID NO: 257294 - DNA, 20 bp, Artificial Sequence
  Description of Artificial Sequence: Synthetic oligonucleotide
  Target: ATXN1; (+) strand; PAM type: YTN; PAM sequence: CTC
aaaagaacttcctcgaaatg

SEQ ID NO: 257295 - DNA, 20 bp, Artificial Sequence
  Description of Artificial Sequence: Synthetic oligonucleotide
  Target: ATXN1; (+) strand; PAM type: YTN; PAM sequence: CTT
cctcgaaatgatacagttag

SEQ ID NO: 257296 - DNA, 20 bp, Artificial Sequence
  Description of Artificial Sequence: Synthetic oligonucleotide
  Target: ATXN1; (+) strand; PAM type: YTN; PAM sequence: TTC
ctcgaaatgatacagttagc

SEQ ID NO: 257297 - DNA, 20 bp, Artificial Sequence
  Description of Artificial Sequence: Synthetic oligonucleotide
  Target: ATXN1; (+) strand; PAM type: YTN; PAM sequence: CTC
gaaatgatacagttagcaca

SEQ ID NO: 257298 - DNA, 20 bp, Artificial Sequence
  Description of Artificial Sequence: Synthetic oligonucleotide
  Target: ATXN1; (+) strand; PAM type: YTN; PAM sequence: TTA
gcacattatggatgcagaat

SEQ ID NO: 257299 - DNA, 20 bp, Artificial Sequence
  Description of Artificial Sequence: Synthetic oligonucleotide
  Target: ATXN1; (+) strand; PAM type: YTN; PAM sequence: TTA
tggatgcagaattcaaaccc

SEQ ID NO: 257300 - DNA, 20 bp, Artificial Sequence
  Description of Artificial Sequence: Synthetic oligonucleotide
  Target: ATXN1; (+) strand; PAM type: YTN; PAM sequence: TTC
aaacccaggcctgtctagtt

SEQ ID NO: 257301 - DNA, 20 bp, Artificial Sequence
  Description of Artificial Sequence: Synthetic oligonucleotide
  Target: ATXN1; (+) strand; PAM type: YTN; PAM sequence: CTG
tctagttcttaaatccgtgt

SEQ ID NO: 257302 - DNA, 20 bp, Artificial Sequence
  Description of Artificial Sequence: Synthetic oligonucleotide
  Target: ATXN1; (+) strand; PAM type: YTN; PAM sequence: CTA
gttcttaaatccgtgttctt

SEQ ID NO: 257303 - DNA, 20 bp, Artificial Sequence
  Description of Artificial Sequence: Synthetic oligonucleotide
  Target: ATXN1; (+) strand; PAM type: YTN; PAM sequence: TTC
ttaaatccgtgttcttccca

SEQ ID NO: 257304 - DNA, 20 bp, Artificial Sequence
  Description of Artificial Sequence: Synthetic oligonucleotide
  Target: ATXN1; (+) strand; PAM type: YTN; PAM sequence: CTT
aaatccgtgttcttcccata

SEQ ID NO: 257305 - DNA, 20 bp, Artificial Sequence
  Description of Artificial Sequence: Synthetic oligonucleotide
  Target: ATXN1; (+) strand; PAM type: YTN; PAM sequence: TTA
aatccgtgttcttcccatat

SEQ ID NO: 257306 - DNA, 20 bp, Artificial Sequence
  Description of Artificial Sequence: Synthetic oligonucleotide
  Target: ATXN1; (+) strand; PAM type: YTN; PAM sequence: TTC
ttcccatataccatgctgcc

SEQ ID NO: 257307 - DNA, 20 bp, Artificial Sequence
  Description of Artificial Sequence: Synthetic oligonucleotide
  Target: ATXN1; (+) strand; PAM type: YTN; PAM sequence: CTT
cccatataccatgctgcctc

SEQ ID NO: 257308 - DNA, 20 bp, Artificial Sequence
  Description of Artificial Sequence: Synthetic oligonucleotide
  Target: ATXN1; (+) strand; PAM type: YTN; PAM sequence: TTC
ccatataccatgctgcctct

SEQ ID NO: 257309 - DNA, 20 bp, Artificial Sequence
  Description of Artificial Sequence: Synthetic oligonucleotide
  Target: ATXN1; (+) strand; PAM type: YTN; PAM sequence: CTG
cctctcaaaaggaaacactg

SEQ ID NO: 257310 - DNA, 20 bp, Artificial Sequence
  Description of Artificial Sequence: Synthetic oligonucleotide
  Target: ATXN1; (+) strand; PAM type: YTN; PAM sequence: CTC
tcaaaaggaaacactgtttt

SEQ ID NO: 257311 - DNA, 20 bp, Artificial Sequence
  Description of Artificial Sequence: Synthetic oligonucleotide
  Target: ATXN1; (+) strand; PAM type: YTN; PAM sequence: CTC
aaaaggaaacactgtttttg

SEQ ID NO: 257312 - DNA, 20 bp, Artificial Sequence
  Description of Artificial Sequence: Synthetic oligonucleotide
  Target: ATXN1; (+) strand; PAM type: YTN; PAM sequence: CTG
tttttgttttttttttaagg

SEQ ID NO: 257313 - DNA, 20 bp, Artificial Sequence
  Description of Artificial Sequence: Synthetic oligonucleotide
  Target: ATXN1; (+) strand; PAM type: YTN; PAM sequence: TTT
ttgttttttttttaaggtac

SEQ ID NO: 257314 - DNA, 20 bp, Artificial Sequence
  Description of Artificial Sequence: Synthetic oligonucleotide
  Target: ATXN1; (+) strand; PAM type: YTN; PAM sequence: TTT
tgttttttttttaaggtaca

SEQ ID NO: 257315 - DNA, 20 bp, Artificial Sequence
  Description of Artificial Sequence: Synthetic oligonucleotide
  Target: ATXN1; (+) strand; PAM type: YTN; PAM sequence: TTT
gttttttttttaaggtacaa

SEQ ID NO: 257316 - DNA, 20 bp, Artificial Sequence
  Description of Artificial Sequence: Synthetic oligonucleotide
  Target: ATXN1; (+) strand; PAM type: YTN; PAM sequence: TTG
ttttttttttaaggtacaaa

SEQ ID NO: 257317 - DNA, 20 bp, Artificial Sequence
  Description of Artificial Sequence: Synthetic oligonucleotide
  Target: ATXN1; (+) strand; PAM type: YTN; PAM sequence: TTT
tttttttaaggtacaaatat

SEQ ID NO: 257318 - DNA, 20 bp, Artificial Sequence
  Description of Artificial Sequence: Synthetic oligonucleotide
  Target: ATXN1; (+) strand; PAM type: YTN; PAM sequence: TTT
ttttttaaggtacaaatata

SEQ ID NO: 257319 - DNA, 20 bp, Artificial Sequence
  Description of Artificial Sequence: Synthetic oligonucleotide
  Target: ATXN1; (+) strand; PAM type: YTN; PAM sequence: TTT
tttttaaggtacaaatatag

SEQ ID NO: 257320 - DNA, 20 bp, Artificial Sequence
  Description of Artificial Sequence: Synthetic oligonucleotide
  Target: ATXN1; (+) strand; PAM type: YTN; PAM sequence: TTT
ttttaaggtacaaatatagt

SEQ ID NO: 257321 - DNA, 20 bp, Artificial Sequence
  Description of Artificial Sequence: Synthetic oligonucleotide
  Target: ATXN1; (+) strand; PAM type: YTN; PAM sequence: TTT
tttaaggtacaaatatagtt

SEQ ID NO: 257322 - DNA, 20 bp, Artificial Sequence
  Description of Artificial Sequence: Synthetic oligonucleotide
  Target: ATXN1; (+) strand; PAM type: YTN; PAM sequence: TTT
ttaaggtacaaatatagttt

SEQ ID NO: 257323 - DNA, 20 bp, Artificial Sequence
  Description of Artificial Sequence: Synthetic oligonucleotide
  Target: ATXN1; (+) strand; PAM type: YTN; PAM sequence: TTT
taaggtacaaatatagtttg

SEQ ID NO: 257324 - DNA, 20 bp, Artificial Sequence
  Description of Artificial Sequence: Synthetic oligonucleotide
  Target: ATXN1; (+) strand; PAM type: YTN; PAM sequence: TTT
aaggtacaaatatagtttgt

SEQ ID NO: 257325 - DNA, 20 bp, Artificial Sequence
  Description of Artificial Sequence: Synthetic oligonucleotide
  Target: ATXN1; (+) strand; PAM type: YTN; PAM sequence: TTA
aggtacaaatatagtttgtg

SEQ ID NO: 257326 - DNA, 20 bp, Artificial Sequence
  Description of Artificial Sequence: Synthetic oligonucleotide
  Target: ATXN1; (+) strand; PAM type: YTN; PAM sequence: TTT
gtgcatttggaagaagatgc

SEQ ID NO: 257327 - DNA, 20 bp, Artificial Sequence
  Description of Artificial Sequence: Synthetic oligonucleotide
  Target: ATXN1; (+) strand; PAM type: YTN; PAM sequence: TTG
tgcatttggaagaagatgcg

SEQ ID NO: 257328 - DNA, 20 bp, Artificial Sequence
  Description of Artificial Sequence: Synthetic oligonucleotide
  Target: ATXN1; (+) strand; PAM type: YTN; PAM sequence: TTT
ggaagaagatgcggctcggg

SEQ ID NO: 257329 - DNA, 20 bp, Artificial Sequence
  Description of Artificial Sequence: Synthetic oligonucleotide
  Target: ATXN1; (+) strand; PAM type: YTN; PAM sequence: TTG
gaagaagatgcggctcggga

SEQ ID NO: 257330 - DNA, 20 bp, Artificial Sequence
  Description of Artificial Sequence: Synthetic oligonucleotide
  Target: ATXN1; (+) strand; PAM type: YTN; PAM sequence: CTC
gggacccattctttttgtta

SEQ ID NO: 257331 - DNA, 20 bp, Artificial Sequence
  Description of Artificial Sequence: Synthetic oligonucleotide
  Target: ATXN1; (+) strand; PAM type: YTN; PAM sequence: TTC
tttttgttataggcttgtgc

SEQ ID NO: 257332 - DNA, 20 bp, Artificial Sequence
  Description of Artificial Sequence: Synthetic oligonucleotide
  Target: ATXN1; (+) strand; PAM type: YTN; PAM sequence: CTT
tttgttataggcttgtgcta

SEQ ID NO: 257333 - DNA, 20 bp, Artificial Sequence
  Description of Artificial Sequence: Synthetic oligonucleotide
  Target: ATXN1; (+) strand; PAM type: YTN; PAM sequence: TTT
ttgttataggcttgtgctat

SEQ ID NO: 257334 - DNA, 20 bp, Artificial Sequence
  Description of Artificial Sequence: Synthetic oligonucleotide
  Target: ATXN1; (+) strand; PAM type: YTN; PAM sequence: TTT
tgttataggcttgtgctata

SEQ ID NO: 257335 - DNA, 20 bp, Artificial Sequence
  Description of Artificial Sequence: Synthetic oligonucleotide
  Target: ATXN1; (+) strand; PAM type: YTN; PAM sequence: TTT
gttataggcttgtgctataa

SEQ ID NO: 257336 - DNA, 20 bp, Artificial Sequence
  Description of Artificial Sequence: Synthetic oligonucleotide
  Target: ATXN1; (+) strand; PAM type: YTN; PAM sequence: TTG
ttataggcttgtgctataaa

SEQ ID NO: 257337 - DNA, 20 bp, Artificial Sequence
  Description of Artificial Sequence: Synthetic oligonucleotide
  Target: ATXN1; (+) strand; PAM type: YTN; PAM sequence: TTA
taggcttgtgctataaacat

SEQ ID NO: 257338 - DNA, 20 bp, Artificial Sequence
  Description of Artificial Sequence: Synthetic oligonucleotide
  Target: ATXN1; (+) strand; PAM type: YTN; PAM sequence: CTT
gtgctataaacatccatctt

SEQ ID NO: 257339 - DNA, 20 bp, Artificial Sequence
  Description of Artificial Sequence: Synthetic oligonucleotide
  Target: ATXN1; (+) strand; PAM type: YTN; PAM sequence: TTG
tgctataaacatccatctta

SEQ ID NO: 257340 - DNA, 20 bp, Artificial Sequence
  Description of Artificial Sequence: Synthetic oligonucleotide
  Target: ATXN1; (+) strand; PAM type: YTN; PAM sequence: CTA
taaacatccatcttactctt

SEQ ID NO: 257341 - DNA, 20 bp, Artificial Sequence
  Description of Artificial Sequence: Synthetic oligonucleotide
  Target: ATXN1; (+) strand; PAM type: YTN; PAM sequence: CTT
actcttagtttgacctttgt

SEQ ID NO: 257342 - DNA, 20 bp, Artificial Sequence
  Description of Artificial Sequence: Synthetic oligonucleotide
  Target: ATXN1; (+) strand; PAM type: YTN; PAM sequence: TTA
ctcttagtttgacctttgtg

SEQ ID NO: 257343 - DNA, 20 bp, Artificial Sequence
  Description of Artificial Sequence: Synthetic oligonucleotide
  Target: ATXN1; (+) strand; PAM type: YTN; PAM sequence: CTC
ttagtttgacctttgtgccg

SEQ ID NO: 257344 - DNA, 20 bp, Artificial Sequence
  Description of Artificial Sequence: Synthetic oligonucleotide
  Target: ATXN1; (+) strand; PAM type: YTN; PAM sequence: CTT
agtttgacctttgtgccgtg

SEQ ID NO: 257345 - DNA, 20 bp, Artificial Sequence
  Description of Artificial Sequence: Synthetic oligonucleotide
  Target: ATXN1; (+) strand; PAM type: YTN; PAM sequence: TTA
gtttgacctttgtgccgtgg

SEQ ID NO: 257346 - DNA, 20 bp, Artificial Sequence
  Description of Artificial Sequence: Synthetic oligonucleotide
  Target: ATXN1; (+) strand; PAM type: YTN; PAM sequence: TTT
gacctttgtgccgtgggctc

SEQ ID NO: 257347 - DNA, 20 bp, Artificial Sequence
  Description of Artificial Sequence: Synthetic oligonucleotide
  Target: ATXN1; (+) strand; PAM type: YTN; PAM sequence: TTG
acctttgtgccgtgggctca

SEQ ID NO: 257348 - DNA, 20 bp, Artificial Sequence
  Description of Artificial Sequence: Synthetic oligonucleotide
  Target: ATXN1; (+) strand; PAM type: YTN; PAM sequence: CTT
tgtgccgtgggctcatgtct

SEQ ID NO: 257349 - DNA, 20 bp, Artificial Sequence
  Description of Artificial Sequence: Synthetic oligonucleotide
  Target: ATXN1; (+) strand; PAM type: YTN; PAM sequence: TTT
gtgccgtgggctcatgtctg

SEQ ID NO: 257350 - DNA, 20 bp, Artificial Sequence
  Description of Artificial Sequence: Synthetic oligonucleotide
  Target: ATXN1; (+) strand; PAM type: YTN; PAM sequence: TTG
tgccgtgggctcatgtctgt

SEQ ID NO: 257351 - DNA, 20 bp, Artificial Sequence
  Description of Artificial Sequence: Synthetic oligonucleotide
  Target: ATXN1; (+) strand; PAM type: YTN; PAM sequence: CTC
atgtctgtaatacaggaacc

SEQ ID NO: 257352 - DNA, 20 bp, Artificial Sequence
  Description of Artificial Sequence: Synthetic oligonucleotide
  Target: ATXN1; (+) strand; PAM type: YTN; PAM sequence: CTG
taatacaggaacccaatcat

SEQ ID NO: 257353 - DNA, 20 bp, Artificial Sequence
  Description of Artificial Sequence: Synthetic oligonucleotide
  Target: ATXN1; (+) strand; PAM type: YTN; PAM sequence: TTT
ctgaaagtctgtctaacagt

SEQ ID NO: 257354 - DNA, 20 bp, Artificial Sequence
  Description of Artificial Sequence: Synthetic oligonucleotide
  Target: ATXN1; (+) strand; PAM type: YTN; PAM sequence: TTC
tgaaagtctgtctaacagtg

SEQ ID NO: 257355 - DNA, 20 bp, Artificial Sequence
  Description of Artificial Sequence: Synthetic oligonucleotide
  Target: ATXN1; (+) strand; PAM type: YTN; PAM sequence: CTG
aaagtctgtctaacagtgat

SEQ ID NO: 257356 - DNA, 20 bp, Artificial Sequence
  Description of Artificial Sequence: Synthetic oligonucleotide
  Target: ATXN1; (+) strand; PAM type: YTN; PAM sequence: CTG
tctaacagtgatattgtgtg

SEQ ID NO: 257357 - DNA, 20 bp, Artificial Sequence
  Description of Artificial Sequence: Synthetic oligonucleotide
  Target: ATXN1; (+) strand; PAM type: YTN; PAM sequence: CTA
acagtgatattgtgtgcagc

SEQ ID NO: 257358 - DNA, 20 bp, Artificial Sequence
  Description of Artificial Sequence: Synthetic oligonucleotide
  Target: ATXN1; (+) strand; PAM type: YTN; PAM sequence: TTG
tgtgcagcaaatgtttaatg

SEQ ID NO: 257359 - DNA, 20 bp, Artificial Sequence
  Description of Artificial Sequence: Synthetic oligonucleotide
  Target: ATXN1; (+) strand; PAM type: YTN; PAM sequence: TTT
aatgaatggatgagtgaatg

SEQ ID NO: 257360 - DNA, 20 bp, Artificial Sequence
  Description of Artificial Sequence: Synthetic oligonucleotide
  Target: ATXN1; (+) strand; PAM type: YTN; PAM sequence: TTA
atgaatggatgagtgaatgt

SEQ ID NO: 257361 - DNA, 20 bp, Artificial Sequence
  Description of Artificial Sequence: Synthetic oligonucleotide
  Target: ATXN1; (+) strand; PAM type: YTN; PAM sequence: CTG
acgagcccatactgggactg

SEQ ID NO: 257362 - DNA, 20 bp, Artificial Sequence
  Description of Artificial Sequence: Synthetic oligonucleotide
  Target: ATXN1; (+) strand; PAM type: YTN; PAM sequence: CTG
ggactgaatcggcaatgtgg

SEQ ID NO: 257363 - DNA, 20 bp, Artificial Sequence
  Description of Artificial Sequence: Synthetic oligonucleotide
  Target: ATXN1; (+) strand; PAM type: YTN; PAM sequence: CTG
aatcggcaatgtgggcctcc

SEQ ID NO: 257364 - DNA, 20 bp, Artificial Sequence
  Description of Artificial Sequence: Synthetic oligonucleotide
  Target: ATXN1; (+) strand; PAM type: YTN; PAM sequence: CTC
ctgaaagcactgcatgttaa

SEQ ID NO: 257365 - DNA, 20 bp, Artificial Sequence
  Description of Artificial Sequence: Synthetic oligonucleotide
  Target: ATXN1; (+) strand; PAM type: YTN; PAM sequence: CTG
aaagcactgcatgttaatca

SEQ ID NO: 257366 - DNA, 20 bp, Artificial Sequence
  Description of Artificial Sequence: Synthetic oligonucleotide
  Target: ATXN1; (+) strand; PAM type: YTN; PAM sequence: CTG
catgttaatcactacttttt

SEQ ID NO: 257367 - DNA, 20 bp, Artificial Sequence
  Description of Artificial Sequence: Synthetic oligonucleotide
  Target: ATXN1; (+) strand; PAM type: YTN; PAM sequence: TTA
atcactacttttttgagctt

SEQ ID NO: 257368 - DNA, 20 bp, Artificial Sequence
  Description of Artificial Sequence: Synthetic oligonucleotide
  Target: ATXN1; (+) strand; PAM type: YTN; PAM sequence: CTA
cttttttgagctttgtgaca

SEQ ID NO: 257369 - DNA, 20 bp, Artificial Sequence
  Description of Artificial Sequence: Synthetic oligonucleotide
  Target: ATXN1; (+) strand; PAM type: YTN; PAM sequence: CTT
ttttgagctttgtgacatga

SEQ ID NO: 257370 - DNA, 20 bp, Artificial Sequence
  Description of Artificial Sequence: Synthetic oligonucleotide
  Target: ATXN1; (+) strand; PAM type: YTN; PAM sequence: TTT
tttgagctttgtgacatgat

SEQ ID NO: 257371 - DNA, 20 bp, Artificial Sequence
  Description of Artificial Sequence: Synthetic oligonucleotide
  Target: ATXN1; (+) strand; PAM type: YTN; PAM sequence: TTT
ttgagctttgtgacatgatg

SEQ ID NO: 257372 - DNA, 20 bp, Artificial Sequence
  Description of Artificial Sequence: Synthetic oligonucleotide
  Target: ATXN1; (+) strand; PAM type: YTN; PAM sequence: TTT
tgagctttgtgacatgatgt

SEQ ID NO: 257373 - DNA, 20 bp, Artificial Sequence
  Description of Artificial Sequence: Synthetic oligonucleotide
  Target: ATXN1; (+) strand; PAM type: YTN; PAM sequence: TTT
gagctttgtgacatgatgtt

SEQ ID NO: 257374 - DNA, 20 bp, Artificial Sequence
  Description of Artificial Sequence: Synthetic oligonucleotide
  Target: ATXN1; (+) strand; PAM type: YTN; PAM sequence: TTG
agctttgtgacatgatgttt

SEQ ID NO: 257375 - DNA, 20 bp, Artificial Sequence
  Description of Artificial Sequence: Synthetic oligonucleotide
  Target: ATXN1; (+) strand; PAM type: YTN; PAM sequence: CTT
tgtgacatgatgtttgggtg

SEQ ID NO: 257376 - DNA, 20 bp, Artificial Sequence
  Description of Artificial Sequence: Synthetic oligonucleotide
  Target: ATXN1; (+) strand; PAM type: YTN; PAM sequence: TTT
gtgacatgatgtttgggtgt

SEQ ID NO: 257377 - DNA, 20 bp, Artificial Sequence
  Description of Artificial Sequence: Synthetic oligonucleotide
  Target: ATXN1; (+) strand; PAM type: YTN; PAM sequence: TTG
tgacatgatgtttgggtgtc

SEQ ID NO: 257378 - DNA, 20 bp, Artificial Sequence
  Description of Artificial Sequence: Synthetic oligonucleotide
  Target: ATXN1; (+) strand; PAM type: YTN; PAM sequence: TTT
gggtgtctggagaaaaatcc

SEQ ID NO: 257379 - DNA, 20 bp, Artificial Sequence
  Description of Artificial Sequence: Synthetic oligonucleotide
  Target: ATXN1; (+) strand; PAM type: YTN; PAM sequence: TTG
ggtgtctggagaaaaatcct

SEQ ID NO: 257380 - DNA, 20 bp, Artificial Sequence
  Description of Artificial Sequence: Synthetic oligonucleotide
  Target: ATXN1; (+) strand; PAM type: YTN; PAM sequence: CTG
gagaaaaatcctgtgtggtg

SEQ ID NO: 257381 - DNA, 20 bp, Artificial Sequence
  Description of Artificial Sequence: Synthetic oligonucleotide
  Target: ATXN1; (+) strand; PAM type: YTN; PAM sequence: CTG
tgtggtggtggtctgggctt

SEQ ID NO: 257382 - DNA, 20 bp, Artificial Sequence
  Description of Artificial Sequence: Synthetic oligonucleotide
  Target: ATXN1; (+) strand; PAM type: YTN; PAM sequence: CTG
ggcttttttactgacgcaat

SEQ ID NO: 257383 - DNA, 20 bp, Artificial Sequence
  Description of Artificial Sequence: Synthetic oligonucleotide
  Target: ATXN1; (+) strand; PAM type: YTN; PAM sequence: CTT
ttttactgacgcaatggccc

SEQ ID NO: 257384 - DNA, 20 bp, Artificial Sequence
  Description of Artificial Sequence: Synthetic oligonucleotide
  Target: ATXN1; (+) strand; PAM type: YTN; PAM sequence: TTT
tttactgacgcaatggccca

SEQ ID NO: 257385 - DNA, 20 bp, Artificial Sequence
  Description of Artificial Sequence: Synthetic oligonucleotide
  Target: ATXN1; (+) strand; PAM type: YTN; PAM sequence: TTT
ttactgacgcaatggcccac

SEQ ID NO: 257386 - DNA, 20 bp, Artificial Sequence
  Description of Artificial Sequence: Synthetic oligonucleotide
  Target: ATXN1; (+) strand; PAM type: YTN; PAM sequence: TTT
tactgacgcaatggcccacc

SEQ ID NO: 257387 - DNA, 20 bp, Artificial Sequence
  Description of Artificial Sequence: Synthetic oligonucleotide
  Target: ATXN1; (+) strand; PAM type: YTN; PAM sequence: TTT
actgacgcaatggcccacct

SEQ ID NO: 257388 - DNA, 20 bp, Artificial Sequence
  Description of Artificial Sequence: Synthetic oligonucleotide
  Target: ATXN1; (+) strand; PAM type: YTN; PAM sequence: TTA
ctgacgcaatggcccacctg

SEQ ID NO: 257389 - DNA, 20 bp, Artificial Sequence
  Description of Artificial Sequence: Synthetic oligonucleotide
  Target: ATXN1; (+) strand; PAM type: YTN; PAM sequence: CTG
acgcaatggcccacctgata

SEQ ID NO: 257390 - DNA, 20 bp, Artificial Sequence
  Description of Artificial Sequence: Synthetic oligonucleotide
  Target: ATXN1; (+) strand; PAM type: YTN; PAM sequence: CTG
atataattttgatttccatc

SEQ ID NO: 257391 - DNA, 20 bp, Artificial Sequence
  Description of Artificial Sequence: Synthetic oligonucleotide
  Target: ATXN1; (+) strand; PAM type: YTN; PAM sequence: TTT
tgatttccatcagccactaa

SEQ ID NO: 257392 - DNA, 20 bp, Artificial Sequence
  Description of Artificial Sequence: Synthetic oligonucleotide
  Target: ATXN1; (+) strand; PAM type: YTN; PAM sequence: TTT
gatttccatcagccactaaa

SEQ ID NO: 257393 - DNA, 20 bp, Artificial Sequence
  Description of Artificial Sequence: Synthetic oligonucleotide
  Target: ATXN1; (+) strand; PAM type: YTN; PAM sequence: TTG
atttccatcagccactaaac

SEQ ID NO: 257394 - DNA, 20 bp, Artificial Sequence
  Description of Artificial Sequence: Synthetic oligonucleotide
  Target: ATXN1; (+) strand; PAM type: YTN; PAM sequence: TTT
ccatcagccactaaacttag

SEQ ID NO: 257395 - DNA, 20 bp, Artificial Sequence
  Description of Artificial Sequence: Synthetic oligonucleotide
  Target: ATXN1; (+) strand; PAM type: YTN; PAM sequence: TTC
catcagccactaaacttagc

SEQ ID NO: 257396 - DNA, 20 bp, Artificial Sequence
  Description of Artificial Sequence: Synthetic oligonucleotide
  Target: ATXN1; (+) strand; PAM type: YTN; PAM sequence: CTA
aacttagcctgaagacaaaa

SEQ ID NO: 257397 - DNA, 20 bp, Artificial Sequence
  Description of Artificial Sequence: Synthetic oligonucleotide
  Target: ATXN1; (+) strand; PAM type: YTN; PAM sequence: CTT
agcctgaagacaaaatttcc

SEQ ID NO: 257398 - DNA, 20 bp, Artificial Sequence
  Description of Artificial Sequence: Synthetic oligonucleotide
  Target: ATXN1; (+) strand; PAM type: YTN; PAM sequence: TTA
gcctgaagacaaaatttcct

SEQ ID NO: 257399 - DNA, 20 bp, Artificial Sequence
  Description of Artificial Sequence: Synthetic oligonucleotide
  Target: ATXN1; (+) strand; PAM type: YTN; PAM sequence: CTG
aagacaaaatttcctttgaa

SEQ ID NO: 257400 - DNA, 20 bp, Artificial Sequence
  Description of Artificial Sequence: Synthetic oligonucleotide
  Target: ATXN1; (+) strand; PAM type: YTN; PAM sequence: TTT
cctttgaaaggattcagctt

SEQ ID NO: 257401 - DNA, 20 bp, Artificial Sequence
  Description of Artificial Sequence: Synthetic oligonucleotide
  Target: ATXN1; (+) strand; PAM type: YTN; PAM sequence: TTC
ctttgaaaggattcagctta

SEQ ID NO: 257402 - DNA, 20 bp, Artificial Sequence
  Description of Artificial Sequence: Synthetic oligonucleotide
  Target: ATXN1; (+) strand; PAM type: YTN; PAM sequence: CTT
tgaaaggattcagcttaggg

SEQ ID NO: 257403 - DNA, 20 bp, Artificial Sequence
  Description of Artificial Sequence: Synthetic oligonucleotide
  Target: ATXN1; (+) strand; PAM type: YTN; PAM sequence: TTT
gaaaggattcagcttagggg

SEQ ID NO: 257404 - DNA, 20 bp, Artificial Sequence
  Description of Artificial Sequence: Synthetic oligonucleotide
  Target: ATXN1; (+) strand; PAM type: YTN; PAM sequence: TTG
aaaggattcagcttagggga

SEQ ID NO: 257405 - DNA, 20 bp, Artificial Sequence
  Description of Artificial Sequence: Synthetic oligonucleotide
  Target: ATXN1; (+) strand; PAM type: YTN; PAM sequence: TTC
agcttaggggaacagataat

SEQ ID NO: 257406 - DNA, 20 bp, Artificial Sequence
  Description of Artificial Sequence: Synthetic oligonucleotide
  Target: ATXN1; (+) strand; PAM type: YTN; PAM sequence: CTT
aggggaacagataataagga

SEQ ID NO: 257407 - DNA, 20 bp, Artificial Sequence
  Description of Artificial Sequence: Synthetic oligonucleotide
  Target: ATXN1; (+) strand; PAM type: YTN; PAM sequence: TTA
ggggaacagataataaggag

SEQ ID NO: 257408 - DNA, 20 bp, Artificial Sequence
  Description of Artificial Sequence: Synthetic oligonucleotide
  Target: ATXN1; (+) strand; PAM type: YTN; PAM sequence: TTA
tttggggaaacaagagttac

SEQ ID NO: 257409 - DNA, 20 bp, Artificial Sequence
  Description of Artificial Sequence: Synthetic oligonucleotide
  Target: ATXN1; (+) strand; PAM type: YTN; PAM sequence: TTT
ggggaaacaagagttacttt

SEQ ID NO: 257410 - DNA, 20 bp, Artificial Sequence
  Description of Artificial Sequence: Synthetic oligonucleotide
  Target: ATXN1; (+) strand; PAM type: YTN; PAM sequence: TTG
gggaaacaagagttacttta

SEQ ID NO: 257411 - DNA, 20 bp, Artificial Sequence
  Description of Artificial Sequence: Synthetic oligonucleotide
  Target: ATXN1; (+) strand; PAM type: YTN; PAM sequence: TTA
ctttacattcctataacata

SEQ ID NO: 257412 - DNA, 20 bp, Artificial Sequence
  Description of Artificial Sequence: Synthetic oligonucleotide
  Target: ATXN1; (+) strand; PAM type: YTN; PAM sequence: CTT
tacattcctataacatattt

SEQ ID NO: 257413 - DNA, 20 bp, Artificial Sequence
  Description of Artificial Sequence: Synthetic oligonucleotide
  Target: ATXN1; (+) strand; PAM type: YTN; PAM sequence: TTT
acattcctataacatatttc

SEQ ID NO: 257414 - DNA, 20 bp, Artificial Sequence
  Description of Artificial Sequence: Synthetic oligonucleotide
  Target: ATXN1; (+) strand; PAM type: YTN; PAM sequence: TTA
cattcctataacatatttct

SEQ ID NO: 257415 - DNA, 20 bp, Artificial Sequence
  Description of Artificial Sequence: Synthetic oligonucleotide
  Target: ATXN1; (+) strand; PAM type: YTN; PAM sequence: TTC
ctataacatatttctaaaaa

SEQ ID NO: 257416 - DNA, 20 bp, Artificial Sequence
  Description of Artificial Sequence: Synthetic oligonucleotide
  Target: ATXN1; (+) strand; PAM type: YTN; PAM sequence: CTA
taacatatttctaaaaatga

SEQ ID NO: 257417 - DNA, 20 bp, Artificial Sequence
  Description of Artificial Sequence: Synthetic oligonucleotide
  Target: ATXN1; (+) strand; PAM type: YTN; PAM sequence: TTT
ctaaaaatgaaacattctca

SEQ ID NO: 257418 - DNA, 20 bp, Artificial Sequence
  Description of Artificial Sequence: Synthetic oligonucleotide
  Target: ATXN1; (+) strand; PAM type: YTN; PAM sequence: TTC
taaaaatgaaacattctcaa

SEQ ID NO: 257419 - DNA, 20 bp, Artificial Sequence
  Description of Artificial Sequence: Synthetic oligonucleotide
  Target: ATXN1; (+) strand; PAM type: YTN; PAM sequence: CTA
aaaatgaaacattctcaaag

SEQ ID NO: 257420 - DNA, 20 bp, Artificial Sequence
  Description of Artificial Sequence: Synthetic oligonucleotide
  Target: ATXN1; (+) strand; PAM type: YTN; PAM sequence: TTC
tcaaagctggaaagtaagga

SEQ ID NO: 257421 - DNA, 20 bp, Artificial Sequence
  Description of Artificial Sequence: Synthetic oligonucleotide
  Target: ATXN1; (+) strand; PAM type: YTN; PAM sequence: CTC
aaagctggaaagtaaggaaa

SEQ ID NO: 257422 - DNA, 20 bp, Artificial Sequence
  Description of Artificial Sequence: Synthetic oligonucleotide
  Target: ATXN1; (+) strand; PAM type: YTN; PAM sequence: CTG
gaaagtaaggaaaatcaaac

SEQ ID NO: 257423 - DNA, 20 bp, Artificial Sequence
  Description of Artificial Sequence: Synthetic oligonucleotide
  Target: ATXN1; (+) strand; PAM type: YTN; PAM sequence: TTG
ctctacttggggttttgaaa

SEQ ID NO: 257424 - DNA, 20 bp, Artificial Sequence
  Description of Artificial Sequence: Synthetic oligonucleotide
  Target: ATXN1; (+) strand; PAM type: YTN; PAM sequence: CTC
tacttggggttttgaaaatg

SEQ ID NO: 257425 - DNA, 20 bp, Artificial Sequence
  Description of Artificial Sequence: Synthetic oligonucleotide
  Target: ATXN1; (+) strand; PAM type: YTN; PAM sequence: CTA
cttggggttttgaaaatgga

SEQ ID NO: 257426 - DNA, 20 bp, Artificial Sequence
  Description of Artificial Sequence: Synthetic oligonucleotide
  Target: ATXN1; (+) strand; PAM type: YTN; PAM sequence: CTT
ggggttttgaaaatggaaca

SEQ ID NO: 257427 - DNA, 20 bp, Artificial Sequence
  Description of Artificial Sequence: Synthetic oligonucleotide
  Target: ATXN1; (+) strand; PAM type: YTN; PAM sequence: TTG
gggttttgaaaatggaacat

SEQ ID NO: 257428 - DNA, 20 bp, Artificial Sequence
  Description of Artificial Sequence: Synthetic oligonucleotide
  Target: ATXN1; (+) strand; PAM type: YTN; PAM sequence: TTT
tgaaaatggaacattgattg

SEQ ID NO: 257429 - DNA, 20 bp, Artificial Sequence
  Description of Artificial Sequence: Synthetic oligonucleotide
  Target: ATXN1; (+) strand; PAM type: YTN; PAM sequence: TTT
gaaaatggaacattgattgt

SEQ ID NO: 257430 - DNA, 20 bp, Artificial Sequence
  Description of Artificial Sequence: Synthetic oligonucleotide
  Target: ATXN1; (+) strand; PAM type: YTN; PAM sequence: TTG
aaaatggaacattgattgtt

SEQ ID NO: 257431 - DNA, 20 bp, Artificial Sequence
  Description of Artificial Sequence: Synthetic oligonucleotide
  Target: ATXN1; (+) strand; PAM type: YTN; PAM sequence: TTG
attgtttgtaaaagtgatgc

SEQ ID NO: 257432 - DNA, 20 bp, Artificial Sequence
  Description of Artificial Sequence: Synthetic oligonucleotide
  Target: ATXN1; (+) strand; PAM type: YTN; PAM sequence: TTG
tttgtaaaagtgatgcttaa

SEQ ID NO: 257433 - DNA, 20 bp, Artificial Sequence
  Description of Artificial Sequence: Synthetic oligonucleotide
  Target: ATXN1; (+) strand; PAM type: YTN; PAM sequence: TTT
gtaaaagtgatgcttaattt

SEQ ID NO: 257434 - DNA, 20 bp, Artificial Sequence
  Description of Artificial Sequence: Synthetic oligonucleotide
  Target: ATXN1; (+) strand; PAM type: YTN; PAM sequence: TTG
taaaagtgatgcttaatttg

SEQ ID NO: 257435 - DNA, 20 bp, Artificial Sequence
  Description of Artificial Sequence: Synthetic oligonucleotide
  Target: ATXN1; (+) strand; PAM type: YTN; PAM sequence: CTT
aatttggaggataagaagcg

SEQ ID NO: 257436 - DNA, 20 bp, Artificial Sequence
  Description of Artificial Sequence: Synthetic oligonucleotide
  Target: ATXN1; (+) strand; PAM type: YTN; PAM sequence: TTA
atttggaggataagaagcga

SEQ ID NO: 257437 - DNA, 20 bp, Artificial Sequence
  Description of Artificial Sequence: Synthetic oligonucleotide
  Target: ATXN1; (+) strand; PAM type: YTN; PAM sequence: TTT
ggaggataagaagcgaactt

SEQ ID NO: 257438 - DNA, 20 bp, Artificial Sequence
  Description of Artificial Sequence: Synthetic oligonucleotide
  Target: ATXN1; (+) strand; PAM type: YTN; PAM sequence: TTG
gaggataagaagcgaacttc

SEQ ID NO: 257439 - DNA, 20 bp, Artificial Sequence
  Description of Artificial Sequence: Synthetic oligonucleotide
  Target: ATXN1; (+) strand; PAM type: YTN; PAM sequence: CTT
ctttctatagcctcaaggag

SEQ ID NO: 257440 - DNA, 20 bp, Artificial Sequence
  Description of Artificial Sequence: Synthetic oligonucleotide
  Target: ATXN1; (+) strand; PAM type: YTN; PAM sequence: TTC
tttctatagcctcaaggagc

SEQ ID NO: 257441 - DNA, 20 bp, Artificial Sequence
  Description of Artificial Sequence: Synthetic oligonucleotide
  Target: ATXN1; (+) strand; PAM type: YTN; PAM sequence: CTT
tctatagcctcaaggagcta

SEQ ID NO: 257442 - DNA, 20 bp, Artificial Sequence
  Description of Artificial Sequence: Synthetic oligonucleotide
  Target: ATXN1; (+) strand; PAM type: YTN; PAM sequence: TTT
ctatagcctcaaggagctaa

SEQ ID NO: 257443 - DNA, 20 bp, Artificial Sequence
  Description of Artificial Sequence: Synthetic oligonucleotide
  Target: ATXN1; (+) strand; PAM type: YTN; PAM sequence: TTC
tatagcctcaaggagctaat

SEQ ID NO: 257444 - DNA, 20 bp, Artificial Sequence
  Description of Artificial Sequence: Synthetic oligonucleotide
  Target: ATXN1; (+) strand; PAM type: YTN; PAM sequence: CTA
tagcctcaaggagctaatta

SEQ ID NO: 257445 - DNA, 20 bp, Artificial Sequence
  Description of Artificial Sequence: Synthetic oligonucleotide
  Target: ATXN1; (+) strand; PAM type: YTN; PAM sequence: CTC
aaggagctaattaaaatgtg

SEQ ID NO: 257446 - DNA, 20 bp, Artificial Sequence
  Description of Artificial Sequence: Synthetic oligonucleotide
  Target: ATXN1; (+) strand; PAM type: YTN; PAM sequence: CTA
attaaaatgtgacacggcag

SEQ ID NO: 257447 - DNA, 20 bp, Artificial Sequence
  Description of Artificial Sequence: Synthetic oligonucleotide
  Target: ATXN1; (+) strand; PAM type: YTN; PAM sequence: TTA
aaatgtgacacggcagtgat

SEQ ID NO: 257448 - DNA, 20 bp, Artificial Sequence
  Description of Artificial Sequence: Synthetic oligonucleotide
  Target: ATXN1; (+) strand; PAM type: YTN; PAM sequence: TTA
tatacttagaggtatcgata

SEQ ID NO: 257449 - DNA, 20 bp, Artificial Sequence
  Description of Artificial Sequence: Synthetic oligonucleotide
  Target: ATXN1; (+) strand; PAM type: YTN; PAM sequence: CTT
agaggtatcgataggtcctc

SEQ ID NO: 257450 - DNA, 20 bp, Artificial Sequence
  Description of Artificial Sequence: Synthetic oligonucleotide
  Target: ATXN1; (+) strand; PAM type: YTN; PAM sequence: TTA
gaggtatcgataggtcctca

SEQ ID NO: 257451 - DNA, 20 bp, Artificial Sequence
  Description of Artificial Sequence: Synthetic oligonucleotide
  Target: ATXN1; (+) strand; PAM type: YTN; PAM sequence: CTC
atttttccacagcacagata

SEQ ID NO: 257452 - DNA, 20 bp, Artificial Sequence
  Description of Artificial Sequence: Synthetic oligonucleotide
  Target: ATXN1; (+) strand; PAM type: YTN; PAM sequence: TTT
ttccacagcacagataatct

SEQ ID NO: 257453 - DNA, 20 bp, Artificial Sequence
  Description of Artificial Sequence: Synthetic oligonucleotide
  Target: ATXN1; (+) strand; PAM type: YTN; PAM sequence: TTT
tccacagcacagataatctc

SEQ ID NO: 257454 - DNA, 20 bp, Artificial Sequence
  Description of Artificial Sequence: Synthetic oligonucleotide
  Target: ATXN1; (+) strand; PAM type: YTN; PAM sequence: TTT
ccacagcacagataatctca

SEQ ID NO: 257455 - DNA, 20 bp, Artificial Sequence
  Description of Artificial Sequence: Synthetic oligonucleotide
  Target: ATXN1; (+) strand; PAM type: YTN; PAM sequence: TTC
cacagcacagataatctcac

SEQ ID NO: 257456 - DNA, 20 bp, Artificial Sequence
  Description of Artificial Sequence: Synthetic oligonucleotide
  Target: ATXN1; (+) strand; PAM type: YTN; PAM sequence: CTC
acgccagctctcacctatat

SEQ ID NO: 257457 - DNA, 20 bp, Artificial Sequence
  Description of Artificial Sequence: Synthetic oligonucleotide
  Target: ATXN1; (+) strand; PAM type: YTN; PAM sequence: CTC
tcacctatattaagtgttag

SEQ ID NO: 257458 - DNA, 20 bp, Artificial Sequence
  Description of Artificial Sequence: Synthetic oligonucleotide
  Target: ATXN1; (+) strand; PAM type: YTN; PAM sequence: CTC
acctatattaagtgttagac

SEQ ID NO: 257459 - DNA, 20 bp, Artificial Sequence
  Description of Artificial Sequence: Synthetic oligonucleotide
  Target: ATXN1; (+) strand; PAM type: YTN; PAM sequence: CTA
tattaagtgttagacacttg

SEQ ID NO: 257460 - DNA, 20 bp, Artificial Sequence
  Description of Artificial Sequence: Synthetic oligonucleotide
  Target: ATXN1; (+) strand; PAM type: YTN; PAM sequence: TTA
agtgttagacacttggtaca

SEQ ID NO: 257461 - DNA, 20 bp, Artificial Sequence
  Description of Artificial Sequence: Synthetic oligonucleotide
  Target: ATXN1; (+) strand; PAM type: YTN; PAM sequence: TTA
gacacttggtacaggaacgg

SEQ ID NO: 257462 - DNA, 20 bp, Artificial Sequence
  Description of Artificial Sequence: Synthetic oligonucleotide
  Target: ATXN1; (+) strand; PAM type: YTN; PAM sequence: CTT
ggtacaggaacggatttctg

SEQ ID NO: 257463 - DNA, 20 bp, Artificial Sequence
  Description of Artificial Sequence: Synthetic oligonucleotide
  Target: ATXN1; (+) strand; PAM type: YTN; PAM sequence: TTG
gtacaggaacggatttctgc

SEQ ID NO: 257464 - DNA, 20 bp, Artificial Sequence
  Description of Artificial Sequence: Synthetic oligonucleotide
  Target: ATXN1; (+) strand; PAM type: YTN; PAM sequence: TTT
ctgctcttccctatctctca

SEQ ID NO: 257465 - DNA, 20 bp, Artificial Sequence
  Description of Artificial Sequence: Synthetic oligonucleotide
  Target: ATXN1; (+) strand; PAM type: YTN; PAM sequence: TTC
tgctcttccctatctctcac

SEQ ID NO: 257466 - DNA, 20 bp, Artificial Sequence
  Description of Artificial Sequence: Synthetic oligonucleotide
  Target: ATXN1; (+) strand; PAM type: YTN; PAM sequence: CTG
ctcttccctatctctcactg

SEQ ID NO: 257467 - DNA, 20 bp, Artificial Sequence
  Description of Artificial Sequence: Synthetic oligonucleotide
  Target: ATXN1; (+) strand; PAM type: YTN; PAM sequence: CTC
ttccctatctctcactgttc

SEQ ID NO: 257468 - DNA, 20 bp, Artificial Sequence
  Description of Artificial Sequence: Synthetic oligonucleotide
  Target: ATXN1; (+) strand; PAM type: YTN; PAM sequence: CTT
ccctatctctcactgttcag

SEQ ID NO: 257469 - DNA, 20 bp, Artificial Sequence
  Description of Artificial Sequence: Synthetic oligonucleotide
  Target: ATXN1; (+) strand; PAM type: YTN; PAM sequence: TTC
cctatctctcactgttcagg

SEQ ID NO: 257470 - DNA, 20 bp, Artificial Sequence
  Description of Artificial Sequence: Synthetic oligonucleotide
  Target: ATXN1; (+) strand; PAM type: YTN; PAM sequence: CTA
tctctcactgttcagggacc

SEQ ID NO: 257471 - DNA, 20 bp, Artificial Sequence
  Description of Artificial Sequence: Synthetic oligonucleotide
  Target: ATXN1; (+) strand; PAM type: YTN; PAM sequence: CTC
tcactgttcagggacctttg

SEQ ID NO: 257472 - DNA, 20 bp, Artificial Sequence
  Description of Artificial Sequence: Synthetic oligonucleotide
  Target: ATXN1; (+) strand; PAM type: YTN; PAM sequence: CTC
actgttcagggacctttggt

SEQ ID NO: 257473 - DNA, 20 bp, Artificial Sequence
  Description of Artificial Sequence: Synthetic oligonucleotide
  Target: ATXN1; (+) strand; PAM type: YTN; PAM sequence: CTG
ttcagggacctttggtcagt

SEQ ID NO: 257474 - DNA, 20 bp, Artificial Sequence
  Description of Artificial Sequence: Synthetic oligonucleotide
  Target: ATXN1; (+) strand; PAM type: YTN; PAM sequence: TTC
agggacctttggtcagttcc

SEQ ID NO: 257475 - DNA, 20 bp, Artificial Sequence
  Description of Artificial Sequence: Synthetic oligonucleotide
  Target: ATXN1; (+) strand; PAM type: YTN; PAM sequence: CTT
tggtcagttcctcagcatat

SEQ ID NO: 257476 - DNA, 20 bp, Artificial Sequence
  Description of Artificial Sequence: Synthetic oligonucleotide
  Target: ATXN1; (+) strand; PAM type: YTN; PAM sequence: TTT
ggtcagttcctcagcatatt

SEQ ID NO: 257477 - DNA, 20 bp, Artificial Sequence
  Description of Artificial Sequence: Synthetic oligonucleotide
  Target: ATXN1; (+) strand; PAM type: YTN; PAM sequence: TTG
gtcagttcctcagcatattg

SEQ ID NO: 257478 - DNA, 20 bp, Artificial Sequence
  Description of Artificial Sequence: Synthetic oligonucleotide
  Target: ATXN1; (+) strand; PAM type: YTN; PAM sequence: TTC
ctcagcatattgtaccctaa

SEQ ID NO: 257479 - DNA, 20 bp, Artificial Sequence
  Description of Artificial Sequence: Synthetic oligonucleotide
  Target: ATXN1; (+) strand; PAM type: YTN; PAM sequence: CTC
agcatattgtaccctaaatg

SEQ ID NO: 257480 - DNA, 20 bp, Artificial Sequence
  Description of Artificial Sequence: Synthetic oligonucleotide
  Target: ATXN1; (+) strand; PAM type: YTN; PAM sequence: TTG
taccctaaatgaggtgatga

SEQ ID NO: 257481 - DNA, 20 bp, Artificial Sequence
  Description of Artificial Sequence: Synthetic oligonucleotide
  Target: ATXN1; (+) strand; PAM type: YTN; PAM sequence: CTA
aatgaggtgatgagacagca

SEQ ID NO: 257482 - DNA, 20 bp, Artificial Sequence
  Description of Artificial Sequence: Synthetic oligonucleotide
  Target: ATXN1; (+) strand; PAM type: YTN; PAM sequence: CTG
aactatcagagagtgaggtc

SEQ ID NO: 257483 - DNA, 20 bp, Artificial Sequence
  Description of Artificial Sequence: Synthetic oligonucleotide
  Target: ATXN1; (+) strand; PAM type: YTN; PAM sequence: CTA
tcagagagtgaggtcgtaat

SEQ ID NO: 257484 - DNA, 20 bp, Artificial Sequence
  Description of Artificial Sequence: Synthetic oligonucleotide
  Target: ATXN1; (+) strand; PAM type: YTN; PAM sequence: CTT
atcggtcactgttaaaaccc

SEQ ID NO: 257485 - DNA, 20 bp, Artificial Sequence
  Description of Artificial Sequence: Synthetic oligonucleotide
  Target: ATXN1; (+) strand; PAM type: YTN; PAM sequence: TTA
tcggtcactgttaaaaccca

SEQ ID NO: 257486 - DNA, 20 bp, Artificial Sequence
  Description of Artificial Sequence: Synthetic oligonucleotide
  Target: ATXN1; (+) strand; PAM type: YTN; PAM sequence: CTG
ttaaaacccatccaacccat

SEQ ID NO: 257487 - DNA, 20 bp, Artificial Sequence
  Description of Artificial Sequence: Synthetic oligonucleotide
  Target: ATXN1; (+) strand; PAM type: YTN; PAM sequence: TTA
aaacccatccaacccatttt

SEQ ID NO: 257488 - DNA, 20 bp, Artificial Sequence
  Description of Artificial Sequence: Synthetic oligonucleotide
  Target: ATXN1; (+) strand; PAM type: YTN; PAM sequence: TTT
tggtatgattcttgcagtta

SEQ ID NO: 257489 - DNA, 20 bp, Artificial Sequence
  Description of Artificial Sequence: Synthetic oligonucleotide
  Target: ATXN1; (+) strand; PAM type: YTN; PAM sequence: TTT
ggtatgattcttgcagttac

SEQ ID NO: 257490 - DNA, 20 bp, Artificial Sequence
  Description of Artificial Sequence: Synthetic oligonucleotide
  Target: ATXN1; (+) strand; PAM type: YTN; PAM sequence: TTG
gtatgattcttgcagttact

SEQ ID NO: 257491 - DNA, 20 bp, Artificial Sequence
  Description of Artificial Sequence: Synthetic oligonucleotide
  Target: ATXN1; (+) strand; PAM type: YTN; PAM sequence: TTC
ttgcagttactaaggcctgg

SEQ ID NO: 257492 - DNA, 20 bp, Artificial Sequence
  Description of Artificial Sequence: Synthetic oligonucleotide
  Target: ATXN1; (+) strand; PAM type: YTN; PAM sequence: CTT
gcagttactaaggcctggcc

SEQ ID NO: 257493 - DNA, 20 bp, Artificial Sequence
  Description of Artificial Sequence: Synthetic oligonucleotide
  Target: ATXN1; (+) strand; PAM type: YTN; PAM sequence: TTG
cagttactaaggcctggcct

SEQ ID NO: 257494 - DNA, 20 bp, Artificial Sequence
  Description of Artificial Sequence: Synthetic oligonucleotide
  Target: ATXN1; (+) strand; PAM type: YTN; PAM sequence: TTA
ctaaggcctggccttcattc

SEQ ID NO: 257495 - DNA, 20 bp, Artificial Sequence
  Description of Artificial Sequence: Synthetic oligonucleotide
  Target: ATXN1; (+) strand; PAM type: YTN; PAM sequence: CTA
aggcctggccttcattctct

SEQ ID NO: 257496 - DNA, 20 bp, Artificial Sequence
  Description of Artificial Sequence: Synthetic oligonucleotide
  Target: ATXN1; (+) strand; PAM type: YTN; PAM sequence: CTG
gccttcattctctctccact

SEQ ID NO: 257497 - DNA, 20 bp, Artificial Sequence
  Description of Artificial Sequence: Synthetic oligonucleotide
  Target: ATXN1; (+) strand; PAM type: YTN; PAM sequence: CTT
cattctctctccactcagaa

SEQ ID NO: 257498 - DNA, 20 bp, Artificial Sequence
  Description of Artificial Sequence: Synthetic oligonucleotide
  Target: ATXN1; (+) strand; PAM type: YTN; PAM sequence: TTC
attctctctccactcagaat

SEQ ID NO: 257499 - DNA, 20 bp, Artificial Sequence
  Description of Artificial Sequence: Synthetic oligonucleotide
  Target: ATXN1; (+) strand; PAM type: YTN; PAM sequence: TTC
tctctccactcagaattcac

SEQ ID NO: 257500 - DNA, 20 bp, Artificial Sequence
  Description of Artificial Sequence: Synthetic oligonucleotide
  Target: ATXN1; (+) strand; PAM type: YTN; PAM sequence: CTC
tctccactcagaattcactt

SEQ ID NO: 257501 - DNA, 20 bp, Artificial Sequence
  Description of Artificial Sequence: Synthetic oligonucleotide
  Target: ATXN1; (+) strand; PAM type: YTN; PAM sequence: CTC
tccactcagaattcacttta

SEQ ID NO: 257502 - DNA, 20 bp, Artificial Sequence
  Description of Artificial Sequence: Synthetic oligonucleotide
  Target: ATXN1; (+) strand; PAM type: YTN; PAM sequence: CTC
cactcagaattcactttaag

SEQ ID NO: 257503 - DNA, 20 bp, Artificial Sequence
  Description of Artificial Sequence: Synthetic oligonucleotide
  Target: ATXN1; (+) strand; PAM type: YTN; PAM sequence: CTC
agaattcactttaagctatt

SEQ ID NO: 257504 - DNA, 20 bp, Artificial Sequence
  Description of Artificial Sequence: Synthetic oligonucleotide
  Target: ATXN1; (+) strand; PAM type: YTN; PAM sequence: TTC
actttaagctattataagaa

SEQ ID NO: 257505 - DNA, 20 bp, Artificial Sequence
  Description of Artificial Sequence: Synthetic oligonucleotide
  Target: ATXN1; (+) strand; PAM type: YTN; PAM sequence: CTT
taagctattataagaaagct

SEQ ID NO: 257506 - DNA, 20 bp, Artificial Sequence
  Description of Artificial Sequence: Synthetic oligonucleotide
  Target: ATXN1; (+) strand; PAM type: YTN; PAM sequence: TTT
aagctattataagaaagcta

SEQ ID NO: 257507 - DNA, 20 bp, Artificial Sequence
  Description of Artificial Sequence: Synthetic oligonucleotide
  Target: ATXN1; (+) strand; PAM type: YTN; PAM sequence: TTA
agctattataagaaagctaa

SEQ ID NO: 257508 - DNA, 20 bp, Artificial Sequence
  Description of Artificial Sequence: Synthetic oligonucleotide
  Target: ATXN1; (+) strand; PAM type: YTN; PAM sequence: CTA
ttataagaaagctaaagata

SEQ ID NO: 257509 - DNA, 20 bp, Artificial Sequence
  Description of Artificial Sequence: Synthetic oligonucleotide
  Target: ATXN1; (+) strand; PAM type: YTN; PAM sequence: TTA
taagaaagctaaagataaaa

SEQ ID NO: 257510 - DNA, 20 bp, Artificial Sequence
  Description of Artificial Sequence: Synthetic oligonucleotide
  Target: ATXN1; (+) strand; PAM type: YTN; PAM sequence: CTA
aagataaaacagcttctgca

SEQ ID NO: 257511 - DNA, 20 bp, Artificial Sequence
  Description of Artificial Sequence: Synthetic oligonucleotide
  Target: ATXN1; (+) strand; PAM type: YTN; PAM sequence: CTT
ctgcataatgaaacactaat

SEQ ID NO: 257512 - DNA, 20 bp, Artificial Sequence
  Description of Artificial Sequence: Synthetic oligonucleotide
  Target: ATXN1; (+) strand; PAM type: YTN; PAM sequence: TTC
tgcataatgaaacactaatc

SEQ ID NO: 257513 - DNA, 20 bp, Artificial Sequence
  Description of Artificial Sequence: Synthetic oligonucleotide
  Target: ATXN1; (+) strand; PAM type: YTN; PAM sequence: CTG
cataatgaaacactaatccc

SEQ ID NO: 257514 - DNA, 20 bp, Artificial Sequence
  Description of Artificial Sequence: Synthetic oligonucleotide
  Target: ATXN1; (+) strand; PAM type: YTN; PAM sequence: CTA
atccccagagtgtgacgccc

SEQ ID NO: 257515 - DNA, 20 bp, Artificial Sequence
  Description of Artificial Sequence: Synthetic oligonucleotide
  Target: ATXN1; (+) strand; PAM type: YTN; PAM sequence: CTA
gacagaagataaccaaatgt

SEQ ID NO: 257516 - DNA, 20 bp, Artificial Sequence
  Description of Artificial Sequence: Synthetic oligonucleotide
  Target: ATXN1; (+) strand; PAM type: YTN; PAM sequence: CTA
gacttattcaaacctgcttc

SEQ ID NO: 257517 - DNA, 20 bp, Artificial Sequence
  Description of Artificial Sequence: Synthetic oligonucleotide
  Target: ATXN1; (+) strand; PAM type: YTN; PAM sequence: CTT
attcaaacctgcttctcata

SEQ ID NO: 257518 - DNA, 20 bp, Artificial Sequence
  Description of Artificial Sequence: Synthetic oligonucleotide
  Target: ATXN1; (+) strand; PAM type: YTN; PAM sequence: TTA
ttcaaacctgcttctcatag

SEQ ID NO: 257519 - DNA, 20 bp, Artificial Sequence
  Description of Artificial Sequence: Synthetic oligonucleotide
  Target: ATXN1; (+) strand; PAM type: YTN; PAM sequence: TTC
aaacctgcttctcatagttc

SEQ ID NO: 257520 - DNA, 20 bp, Artificial Sequence
  Description of Artificial Sequence: Synthetic oligonucleotide
  Target: ATXN1; (+) strand; PAM type: YTN; PAM sequence: CTG
cttctcatagttcaaacttg

SEQ ID NO: 257521 - DNA, 20 bp, Artificial Sequence
  Description of Artificial Sequence: Synthetic oligonucleotide
  Target: ATXN1; (+) strand; PAM type: YTN; PAM sequence: CTT
ctcatagttcaaacttgtac

SEQ ID NO: 257522 - DNA, 20 bp, Artificial Sequence
  Description of Artificial Sequence: Synthetic oligonucleotide
  Target: ATXN1; (+) strand; PAM type: YTN; PAM sequence: TTC
tcatagttcaaacttgtact

SEQ ID NO: 257523 - DNA, 20 bp, Artificial Sequence
  Description of Artificial Sequence: Synthetic oligonucleotide
  Target: ATXN1; (+) strand; PAM type: YTN; PAM sequence: CTC
atagttcaaacttgtactca

SEQ ID NO: 257524 - DNA, 20 bp, Artificial Sequence
  Description of Artificial Sequence: Synthetic oligonucleotide
  Target: ATXN1; (+) strand; PAM type: YTN; PAM sequence: TTC
aaacttgtactcactgcttc

SEQ ID NO: 257525 - DNA, 20 bp, Artificial Sequence
  Description of Artificial Sequence: Synthetic oligonucleotide
  Target: ATXN1; (+) strand; PAM type: YTN; PAM sequence: CTT
gtactcactgcttcatcagc

SEQ ID NO: 257526 - DNA, 20 bp, Artificial Sequence
  Description of Artificial Sequence: Synthetic oligonucleotide
  Target: ATXN1; (+) strand; PAM type: YTN; PAM sequence: TTG
tactcactgcttcatcagct

SEQ ID NO: 257527 - DNA, 20 bp, Artificial Sequence
  Description of Artificial Sequence: Synthetic oligonucleotide
  Target: ATXN1; (+) strand; PAM type: YTN; PAM sequence: CTC
actgcttcatcagcttatga

SEQ ID NO: 257528 - DNA, 20 bp, Artificial Sequence
  Description of Artificial Sequence: Synthetic oligonucleotide
  Target: ATXN1; (+) strand; PAM type: YTN; PAM sequence: CTG
cttcatcagcttatgaacca

SEQ ID NO: 257529 - DNA, 20 bp, Artificial Sequence
  Description of Artificial Sequence: Synthetic oligonucleotide
  Target: ATXN1; (+) strand; PAM type: YTN; PAM sequence: CTT
catcagcttatgaaccataa

SEQ ID NO: 257530 - DNA, 20 bp, Artificial Sequence
  Description of Artificial Sequence: Synthetic oligonucleotide
  Target: ATXN1; (+) strand; PAM type: YTN; PAM sequence: TTC
atcagcttatgaaccataaa

SEQ ID NO: 257531 - DNA, 20 bp, Artificial Sequence
  Description of Artificial Sequence: Synthetic oligonucleotide
  Target: ATXN1; (+) strand; PAM type: YTN; PAM sequence: CTT
atgaaccataaactgattta

SEQ ID NO: 257532 - DNA, 20 bp, Artificial Sequence
  Description of Artificial Sequence: Synthetic oligonucleotide
  Target: ATXN1; (+) strand; PAM type: YTN; PAM sequence: TTA
tgaaccataaactgatttaa

SEQ ID NO: 257533 - DNA, 20 bp, Artificial Sequence
  Description of Artificial Sequence: Synthetic oligonucleotide
  Target: ATXN1; (+) strand; PAM type: YTN; PAM sequence: CTG
atttaaaaacacacatgcaa

SEQ ID NO: 257534 - DNA, 20 bp, Artificial Sequence
  Description of Artificial Sequence: Synthetic oligonucleotide
  Target: ATXN1; (+) strand; PAM type: YTN; PAM sequence: TTT
aaaaacacacatgcaaaact

SEQ ID NO: 257535 - DNA, 20 bp, Artificial Sequence
  Description of Artificial Sequence: Synthetic oligonucleotide
  Target: ATXN1; (+) strand; PAM type: YTN; PAM sequence: TTA
aaaacacacatgcaaaactg

SEQ ID NO: 257536 - DNA, 20 bp, Artificial Sequence
  Description of Artificial Sequence: Synthetic oligonucleotide
  Target: ATXN1; (+) strand; PAM type: YTN; PAM sequence: CTG
aacaacaacaacaaaaaaac

SEQ ID NO: 257537 - DNA, 20 bp, Artificial Sequence
  Description of Artificial Sequence: Synthetic oligonucleotide
  Target: ATXN1; (+) strand; PAM type: YTN; PAM sequence: CTA
aacccagtagagcctcttca

SEQ ID NO: 257538 - DNA, 20 bp, Artificial Sequence
  Description of Artificial Sequence: Synthetic oligonucleotide
  Target: ATXN1; (+) strand; PAM type: YTN; PAM sequence: CTC
ttcactcaggcctttttatt

SEQ ID NO: 257539 - DNA, 20 bp, Artificial Sequence
  Description of Artificial Sequence: Synthetic oligonucleotide
  Target: ATXN1; (+) strand; PAM type: YTN; PAM sequence: CTT
cactcaggcctttttatttg

SEQ ID NO: 257540 - DNA, 20 bp, Artificial Sequence
  Description of Artificial Sequence: Synthetic oligonucleotide
  Target: ATXN1; (+) strand; PAM type: YTN; PAM sequence: TTC
actcaggcctttttatttga

SEQ ID NO: 257541 - DNA, 20 bp, Artificial Sequence
  Description of Artificial Sequence: Synthetic oligonucleotide
  Target: ATXN1; (+) strand; PAM type: YTN; PAM sequence: CTC
aggcctttttatttgagttt

SEQ ID NO: 257542 - DNA, 20 bp, Artificial Sequence
  Description of Artificial Sequence: Synthetic oligonucleotide
  Target: ATXN1; (+) strand; PAM type: YTN; PAM sequence: CTT
tttatttgagtttatctatc

SEQ ID NO: 257543 - DNA, 20 bp, Artificial Sequence
  Description of Artificial Sequence: Synthetic oligonucleotide
  Target: ATXN1; (+) strand; PAM type: YTN; PAM sequence: TTT
ttatttgagtttatctatcc

SEQ ID NO: 257544 - DNA, 20 bp, Artificial Sequence
  Description of Artificial Sequence: Synthetic oligonucleotide
  Target: ATXN1; (+) strand; PAM type: YTN; PAM sequence: TTT
tatttgagtttatctatccg

SEQ ID NO: 257545 - DNA, 20 bp, Artificial Sequence
  Description of Artificial Sequence: Synthetic oligonucleotide
  Target: ATXN1; (+) strand; PAM type: YTN; PAM sequence: TTT
atttgagtttatctatccga

SEQ ID NO: 257546 - DNA, 20 bp, Artificial Sequence
  Description of Artificial Sequence: Synthetic oligonucleotide
  Target: ATXN1; (+) strand; PAM type: YTN; PAM sequence: TTA
tttgagtttatctatccgaa

SEQ ID NO: 257547 - DNA, 20 bp, Artificial Sequence
  Description of Artificial Sequence: Synthetic oligonucleotide
  Target: ATXN1; (+) strand; PAM type: YTN; PAM sequence: TTT
gagtttatctatccgaatgc

SEQ ID NO: 257548 - DNA, 20 bp, Artificial Sequence
  Description of Artificial Sequence: Synthetic oligonucleotide
  Target: ATXN1; (+) strand; PAM type: YTN; PAM sequence: TTG
agtttatctatccgaatgca

SEQ ID NO: 257549 - DNA, 20 bp, Artificial Sequence
  Description of Artificial Sequence: Synthetic oligonucleotide
  Target: ATXN1; (+) strand; PAM type: YTN; PAM sequence: TTT
atctatccgaatgcagtaat

SEQ ID NO: 257550 - DNA, 20 bp, Artificial Sequence
  Description of Artificial Sequence: Synthetic oligonucleotide
  Target: ATXN1; (+) strand; PAM type: YTN; PAM sequence: TTA
tctatccgaatgcagtaatg

SEQ ID NO: 257551 - DNA, 20 bp, Artificial Sequence
  Description of Artificial Sequence: Synthetic oligonucleotide
  Target: ATXN1; (+) strand; PAM type: YTN; PAM sequence: CTA
tccgaatgcagtaatgcctc

SEQ ID NO: 257552 - DNA, 20 bp, Artificial Sequence
  Description of Artificial Sequence: Synthetic oligonucleotide
  Target: ATXN1; (+) strand; PAM type: YTN; PAM sequence: CTC
cttaagcagacacagcttac

SEQ ID NO: 257553 - DNA, 20 bp, Artificial Sequence
  Description of Artificial Sequence: Synthetic oligonucleotide
  Target: ATXN1; (+) strand; PAM type: YTN; PAM sequence: CTT
aagcagacacagcttactga

SEQ ID NO: 257554 - DNA, 20 bp, Artificial Sequence
  Description of Artificial Sequence: Synthetic oligonucleotide
  Target: ATXN1; (+) strand; PAM type: YTN; PAM sequence: TTA
agcagacacagcttactgaa

SEQ ID NO: 257555 - DNA, 20 bp, Artificial Sequence
  Description of Artificial Sequence: Synthetic oligonucleotide
  Target: ATXN1; (+) strand; PAM type: YTN; PAM sequence: CTT
actgaaaatatacacaattt

SEQ ID NO: 257556 - DNA, 20 bp, Artificial Sequence
  Description of Artificial Sequence: Synthetic oligonucleotide
  Target: ATXN1; (+) strand; PAM type: YTN; PAM sequence: TTA
ctgaaaatatacacaatttg

SEQ ID NO: 257557 - DNA, 20 bp, Artificial Sequence
  Description of Artificial Sequence: Synthetic oligonucleotide
  Target: ATXN1; (+) strand; PAM type: YTN; PAM sequence: CTG
aaaatatacacaatttgtag

SEQ ID NO: 257558 - DNA, 20 bp, Artificial Sequence
  Description of Artificial Sequence: Synthetic oligonucleotide
  Target: ATXN1; (+) strand; PAM type: YTN; PAM sequence: TTT
gtagcatctgaaagagaata

SEQ ID NO: 257559 - DNA, 20 bp, Artificial Sequence
  Description of Artificial Sequence: Synthetic oligonucleotide
  Target: ATXN1; (+) strand; PAM type: YTN; PAM sequence: TTG
tagcatctgaaagagaatat

SEQ ID NO: 257560 - DNA, 20 bp, Artificial Sequence
  Description of Artificial Sequence: Synthetic oligonucleotide
  Target: ATXN1; (+) strand; PAM type: YTN; PAM sequence: CTG
aaagagaatatggcctttgt

SEQ ID NO: 257561 - DNA, 20 bp, Artificial Sequence
  Description of Artificial Sequence: Synthetic oligonucleotide
  Target: ATXN1; (+) strand; PAM type: YTN; PAM sequence: CTT
tgtccttctttctactcaat

SEQ ID NO: 257562 - DNA, 20 bp, Artificial Sequence
  Description of Artificial Sequence: Synthetic oligonucleotide
  Target: ATXN1; (+) strand; PAM type: YTN; PAM sequence: TTT
gtccttctttctactcaata

SEQ ID NO: 257563 - DNA, 20 bp, Artificial Sequence
  Description of Artificial Sequence: Synthetic oligonucleotide
  Target: ATXN1; (+) strand; PAM type: YTN; PAM sequence: TTG
tccttctttctactcaatat

SEQ ID NO: 257564 - DNA, 20 bp, Artificial Sequence
  Description of Artificial Sequence: Synthetic oligonucleotide
  Target: ATXN1; (+) strand; PAM type: YTN; PAM sequence: CTT
ctttctactcaatatgttgg

SEQ ID NO: 257565 - DNA, 20 bp, Artificial Sequence
  Description of Artificial Sequence: Synthetic oligonucleotide
  Target: ATXN1; (+) strand; PAM type: YTN; PAM sequence: TTC
tttctactcaatatgttggt

SEQ ID NO: 257566 - DNA, 20 bp, Artificial Sequence
  Description of Artificial Sequence: Synthetic oligonucleotide
  Target: ATXN1; (+) strand; PAM type: YTN; PAM sequence: CTT
tctactcaatatgttggtgg

SEQ ID NO: 257567 - DNA, 20 bp, Artificial Sequence
  Description of Artificial Sequence: Synthetic oligonucleotide
  Target: ATXN1; (+) strand; PAM type: YTN; PAM sequence: TTT
ctactcaatatgttggtgga

SEQ ID NO: 257568 - DNA, 20 bp, Artificial Sequence
  Description of Artificial Sequence: Synthetic oligonucleotide
  Target: ATXN1; (+) strand; PAM type: YTN; PAM sequence: TTC
tactcaatatgttggtggac

SEQ ID NO: 257569 - DNA, 20 bp, Artificial Sequence
  Description of Artificial Sequence: Synthetic oligonucleotide
  Target: ATXN1; (+) strand; PAM type: YTN; PAM sequence: CTA
ctcaatatgttggtggactg

SEQ ID NO: 257570 - DNA, 20 bp, Artificial Sequence
  Description of Artificial Sequence: Synthetic oligonucleotide
  Target: ATXN1; (+) strand; PAM type: YTN; PAM sequence: CTC
aatatgttggtggactggaa

SEQ ID NO: 257571 - DNA, 20 bp, Artificial Sequence
  Description of Artificial Sequence: Synthetic oligonucleotide
  Target: ATXN1; (+) strand; PAM type: YTN; PAM sequence: TTG
gtggactggaatgtttccaa

SEQ ID NO: 257572 - DNA, 20 bp, Artificial Sequence
  Description of Artificial Sequence: Synthetic oligonucleotide
  Target: ATXN1; (+) strand; PAM type: YTN; PAM sequence: CTG
gaatgtttccaatgtagtca

SEQ ID NO: 257573 - DNA, 20 bp, Artificial Sequence
  Description of Artificial Sequence: Synthetic oligonucleotide
  Target: ATXN1; (+) strand; PAM type: YTN; PAM sequence: TTT
ccaatgtagtcaatttttct

SEQ ID NO: 257574 - DNA, 20 bp, Artificial Sequence
  Description of Artificial Sequence: Synthetic oligonucleotide
  Target: ATXN1; (+) strand; PAM type: YTN; PAM sequence: TTC
caatgtagtcaatttttctg

SEQ ID NO: 257575 - DNA, 20 bp, Artificial Sequence
  Description of Artificial Sequence: Synthetic oligonucleotide
  Target: ATXN1; (+) strand; PAM type: YTN; PAM sequence: TTT
ttctggctctttaaaattaa

SEQ ID NO: 257576 - DNA, 20 bp, Artificial Sequence
  Description of Artificial Sequence: Synthetic oligonucleotide
  Target: ATXN1; (+) strand; PAM type: YTN; PAM sequence: TTT
tctggctctttaaaattaaa

SEQ ID NO: 257577 - DNA, 20 bp, Artificial Sequence
  Description of Artificial Sequence: Synthetic oligonucleotide
  Target: ATXN1; (+) strand; PAM type: YTN; PAM sequence: TTT
ctggctctttaaaattaaat

SEQ ID NO: 257578 - DNA, 20 bp, Artificial Sequence
  Description of Artificial Sequence: Synthetic oligonucleotide
  Target: ATXN1; (+) strand; PAM type: YTN; PAM sequence: TTC
tggctctttaaaattaaatt

SEQ ID NO: 257579 - DNA, 20 bp, Artificial Sequence
  Description of Artificial Sequence: Synthetic oligonucleotide
  Target: ATXN1; (+) strand; PAM type: YTN; PAM sequence: CTG
gctctttaaaattaaattaa

SEQ ID NO: 257580 - DNA, 20 bp, Artificial Sequence
  Description of Artificial Sequence: Synthetic oligonucleotide
  Target: ATXN1; (+) strand; PAM type: YTN; PAM sequence: CTC
tttaaaattaaattaataaa

SEQ ID NO: 257581 - DNA, 20 bp, Artificial Sequence
  Description of Artificial Sequence: Synthetic oligonucleotide
  Target: ATXN1; (+) strand; PAM type: YTN; PAM sequence: CTT
taaaattaaattaataaaag

SEQ ID NO: 257582 - DNA, 20 bp, Artificial Sequence
  Description of Artificial Sequence: Synthetic oligonucleotide
  Target: ATXN1; (+) strand; PAM type: YTN; PAM sequence: TTT
aaaattaaattaataaaagt

SEQ ID NO: 257583 - DNA, 20 bp, Artificial Sequence
  Description of Artificial Sequence: Synthetic oligonucleotide
  Target: ATXN1; (+) strand; PAM type: YTN; PAM sequence: TTA
aaattaaattaataaaagta

SEQ ID NO: 257584 - DNA, 20 bp, Artificial Sequence
  Description of Artificial Sequence: Synthetic oligonucleotide
  Target: ATXN1; (+) strand; PAM type: YTN; PAM sequence: TTA
aattaataaaagtatacaat

SEQ ID NO: 257585 - DNA, 20 bp, Artificial Sequence
  Description of Artificial Sequence: Synthetic oligonucleotide
  Target: ATXN1; (+) strand; PAM type: YTN; PAM sequence: TTA
ataaaagtatacaatttaag

SEQ ID NO: 257586 - DNA, 20 bp, Artificial Sequence
  Description of Artificial Sequence: Synthetic oligonucleotide
  Target: ATXN1; (+) strand; PAM type: YTN; PAM sequence: TTT
aaggatctatagatttgtgt

SEQ ID NO: 257587 - DNA, 20 bp, Artificial Sequence
  Description of Artificial Sequence: Synthetic oligonucleotide
  Target: ATXN1; (+) strand; PAM type: YTN; PAM sequence: TTA
aggatctatagatttgtgtt

SEQ ID NO: 257588 - DNA, 20 bp, Artificial Sequence
  Description of Artificial Sequence: Synthetic oligonucleotide
  Target: ATXN1; (+) strand; PAM type: YTN; PAM sequence: CTA
tagatttgtgttcagcacaa

SEQ ID NO: 257589 - DNA, 20 bp, Artificial Sequence
  Description of Artificial Sequence: Synthetic oligonucleotide
  Target: ATXN1; (+) strand; PAM type: YTN; PAM sequence: TTT
gtgttcagcacaatggacta

SEQ ID NO: 257590 - DNA, 20 bp, Artificial Sequence
  Description of Artificial Sequence: Synthetic oligonucleotide
  Target: ATXN1; (+) strand; PAM type: YTN; PAM sequence: TTG
tgttcagcacaatggactaa

SEQ ID NO: 257591 - DNA, 20 bp, Artificial Sequence
  Description of Artificial Sequence: Synthetic oligonucleotide
  Target: ATXN1; (+) strand; PAM type: YTN; PAM sequence: TTC
agcacaatggactaaaagtt

SEQ ID NO: 257592 - DNA, 20 bp, Artificial Sequence
  Description of Artificial Sequence: Synthetic oligonucleotide
  Target: ATXN1; (+) strand; PAM type: YTN; PAM sequence: CTA
aaagttgagctactggattc

SEQ ID NO: 257593 - DNA, 20 bp, Artificial Sequence
  Description of Artificial Sequence: Synthetic oligonucleotide
  Target: ATXN1; (+) strand; PAM type: YTN; PAM sequence: TTG
agctactggattctagaaca

SEQ ID NO: 257594 - DNA, 20 bp, Artificial Sequence
  Description of Artificial Sequence: Synthetic oligonucleotide
  Target: ATXN1; (+) strand; PAM type: YTN; PAM sequence: CTA
ctggattctagaacaaaatg

SEQ ID NO: 257595 - DNA, 20 bp, Artificial Sequence
  Description of Artificial Sequence: Synthetic oligonucleotide
  Target: ATXN1; (+) strand; PAM type: YTN; PAM sequence: CTG
gattctagaacaaaatgtca

SEQ ID NO: 257596 - DNA, 20 bp, Artificial Sequence
  Description of Artificial Sequence: Synthetic oligonucleotide
  Target: ATXN1; (+) strand; PAM type: YTN; PAM sequence: TTC
tagaacaaaatgtcacttat

SEQ ID NO: 257597 - DNA, 20 bp, Artificial Sequence
  Description of Artificial Sequence: Synthetic oligonucleotide
  Target: ATXN1; (+) strand; PAM type: YTN; PAM sequence: CTA
gaacaaaatgtcacttataa

SEQ ID NO: 257598 - DNA, 20 bp, Artificial Sequence
  Description of Artificial Sequence: Synthetic oligonucleotide
  Target: ATXN1; (+) strand; PAM type: YTN; PAM sequence: CTT
ataattagctgagtatatat

SEQ ID NO: 257599 - DNA, 20 bp, Artificial Sequence
  Description of Artificial Sequence: Synthetic oligonucleotide
  Target: ATXN1; (+) strand; PAM type: YTN; PAM sequence: TTA
taattagctgagtatatatg

SEQ ID NO: 257600 - DNA, 20 bp, Artificial Sequence
  Description of Artificial Sequence: Synthetic oligonucleotide
  Target: ATXN1; (+) strand; PAM type: YTN; PAM sequence: TTA
gctgagtatatatgacatct

SEQ ID NO: 257601 - DNA, 20 bp, Artificial Sequence
  Description of Artificial Sequence: Synthetic oligonucleotide
  Target: ATXN1; (+) strand; PAM type: YTN; PAM sequence: CTG
agtatatatgacatctcagg

SEQ ID NO: 257602 - DNA, 20 bp, Artificial Sequence
  Description of Artificial Sequence: Synthetic oligonucleotide
  Target: ATXN1; (+) strand; PAM type: YTN; PAM sequence: CTC
aggcattgtaccaagggccc

SEQ ID NO: 257603 - DNA, 20 bp, Artificial Sequence
  Description of Artificial Sequence: Synthetic oligonucleotide
  Target: ATXN1; (+) strand; PAM type: YTN; PAM sequence: TTG
taccaagggcccagaaaatt

SEQ ID NO: 257604 - DNA, 20 bp, Artificial Sequence
  Description of Artificial Sequence: Synthetic oligonucleotide
  Target: ATXN1; (+) strand; PAM type: YTN; PAM sequence: TTA
cctcatttcatttttataat

SEQ ID NO: 257605 - DNA, 20 bp, Artificial Sequence
  Description of Artificial Sequence: Synthetic oligonucleotide
  Target: ATXN1; (+) strand; PAM type: YTN; PAM sequence: CTC
atttcatttttataattttc

SEQ ID NO: 257606 - DNA, 20 bp, Artificial Sequence
  Description of Artificial Sequence: Synthetic oligonucleotide
  Target: ATXN1; (+) strand; PAM type: YTN; PAM sequence: TTT
catttttataattttcagaa

SEQ ID NO: 257607 - DNA, 20 bp, Artificial Sequence
  Description of Artificial Sequence: Synthetic oligonucleotide
  Target: ATXN1; (+) strand; PAM type: YTN; PAM sequence: TTC
atttttataattttcagaag

SEQ ID NO: 257608 - DNA, 20 bp, Artificial Sequence
  Description of Artificial Sequence: Synthetic oligonucleotide
  Target: ATXN1; (+) strand; PAM type: YTN; PAM sequence: TTT
ttataattttcagaagcacc

SEQ ID NO: 257609 - DNA, 20 bp, Artificial Sequence
  Description of Artificial Sequence: Synthetic oligonucleotide
  Target: ATXN1; (+) strand; PAM type: YTN; PAM sequence: TTT
tataattttcagaagcaccc

SEQ ID NO: 257610 - DNA, 20 bp, Artificial Sequence
  Description of Artificial Sequence: Synthetic oligonucleotide
  Target: ATXN1; (+) strand; PAM type: YTN; PAM sequence: TTT
ataattttcagaagcaccca

SEQ ID NO: 257611 - DNA, 20 bp, Artificial Sequence
  Description of Artificial Sequence: Synthetic oligonucleotide
  Target: ATXN1; (+) strand; PAM type: YTN; PAM sequence: TTA
taattttcagaagcacccac

SEQ ID NO: 257612 - DNA, 20 bp, Artificial Sequence
  Description of Artificial Sequence: Synthetic oligonucleotide
  Target: ATXN1; (+) strand; PAM type: YTN; PAM sequence: TTT
tcagaagcacccactttcct

SEQ ID NO: 257613 - DNA, 20 bp, Artificial Sequence
  Description of Artificial Sequence: Synthetic oligonucleotide
  Target: ATXN1; (+) strand; PAM type: YTN; PAM sequence: TTT
cagaagcacccactttccta

SEQ ID NO: 257614 - DNA, 20 bp, Artificial Sequence
  Description of Artificial Sequence: Synthetic oligonucleotide
  Target: ATXN1; (+) strand; PAM type: YTN; PAM sequence: TTC
agaagcacccactttcctag

SEQ ID NO: 257615 - DNA, 20 bp, Artificial Sequence
  Description of Artificial Sequence: Synthetic oligonucleotide
  Target: ATXN1; (+) strand; PAM type: YTN; PAM sequence: CTT
tcctagctaggatacctacc

SEQ ID NO: 257616 - DNA, 20 bp, Artificial Sequence
  Description of Artificial Sequence: Synthetic oligonucleotide
  Target: ATXN1; (+) strand; PAM type: YTN; PAM sequence: TTT
cctagctaggatacctacca

SEQ ID NO: 257617 - DNA, 20 bp, Artificial Sequence
  Description of Artificial Sequence: Synthetic oligonucleotide
  Target: ATXN1; (+) strand; PAM type: YTN; PAM sequence: TTC
ctagctaggatacctaccaa

SEQ ID NO: 257618 - DNA, 20 bp, Artificial Sequence
  Description of Artificial Sequence: Synthetic oligonucleotide
  Target: ATXN1; (+) strand; PAM type: YTN; PAM sequence: CTA
gctaggatacctaccaattg

SEQ ID NO: 257619 - DNA, 20 bp, Artificial Sequence
  Description of Artificial Sequence: Synthetic oligonucleotide
  Target: ATXN1; (+) strand; PAM type: YTN; PAM sequence: CTA
ggatacctaccaattgtgtt

SEQ ID NO: 257620 - DNA, 20 bp, Artificial Sequence
  Description of Artificial Sequence: Synthetic oligonucleotide
  Target: ATXN1; (+) strand; PAM type: YTN; PAM sequence: CTA
ccaattgtgttcttgggcaa

SEQ ID NO: 257621 - DNA, 20 bp, Artificial Sequence
  Description of Artificial Sequence: Synthetic oligonucleotide
  Target: ATXN1; (+) strand; PAM type: YTN; PAM sequence: TTG
tgttcttgggcaaattatct

SEQ ID NO: 257622 - DNA, 20 bp, Artificial Sequence
  Description of Artificial Sequence: Synthetic oligonucleotide
  Target: ATXN1; (+) strand; PAM type: YTN; PAM sequence: TTC
ttgggcaaattatcttctat

SEQ ID NO: 257623 - DNA, 20 bp, Artificial Sequence
  Description of Artificial Sequence: Synthetic oligonucleotide
  Target: ATXN1; (+) strand; PAM type: YTN; PAM sequence: CTT
gggcaaattatcttctatct

SEQ ID NO: 257624 - DNA, 20 bp, Artificial Sequence
  Description of Artificial Sequence: Synthetic oligonucleotide
  Target: ATXN1; (+) strand; PAM type: YTN; PAM sequence: TTG
ggcaaattatcttctatctt

SEQ ID NO: 257625 - DNA, 20 bp, Artificial Sequence
  Description of Artificial Sequence: Synthetic oligonucleotide
  Target: ATXN1; (+) strand; PAM type: YTN; PAM sequence: TTA
tcttctatcttggtttgtac

SEQ ID NO: 257626 - DNA, 20 bp, Artificial Sequence
  Description of Artificial Sequence: Synthetic oligonucleotide
  Target: ATXN1; (+) strand; PAM type: YTN; PAM sequence: CTT
ctatcttggtttgtacaaca

SEQ ID NO: 257627 - DNA, 20 bp, Artificial Sequence
  Description of Artificial Sequence: Synthetic oligonucleotide
  Target: ATXN1; (+) strand; PAM type: YTN; PAM sequence: TTC
tatcttggtttgtacaacag

SEQ ID NO: 257628 - DNA, 20 bp, Artificial Sequence
  Description of Artificial Sequence: Synthetic oligonucleotide
  Target: ATXN1; (+) strand; PAM type: YTN; PAM sequence: CTA
tcttggtttgtacaacagaa

SEQ ID NO: 257629 - DNA, 20 bp, Artificial Sequence
  Description of Artificial Sequence: Synthetic oligonucleotide
  Target: ATXN1; (+) strand; PAM type: YTN; PAM sequence: CTT
ggtttgtacaacagaagaag

SEQ ID NO: 257630 - DNA, 20 bp, Artificial Sequence
  Description of Artificial Sequence: Synthetic oligonucleotide
  Target: ATXN1; (+) strand; PAM type: YTN; PAM sequence: TTG
gtttgtacaacagaagaaga

SEQ ID NO: 257631 - DNA, 20 bp, Artificial Sequence
  Description of Artificial Sequence: Synthetic oligonucleotide
  Target: ATXN1; (+) strand; PAM type: YTN; PAM sequence: TTT
gtacaacagaagaagaaatt

SEQ ID NO: 257632 - DNA, 20 bp, Artificial Sequence
  Description of Artificial Sequence: Synthetic oligonucleotide
  Target: ATXN1; (+) strand; PAM type: YTN; PAM sequence: TTG
tacaacagaagaagaaatta

SEQ ID NO: 257633 - DNA, 20 bp, Artificial Sequence
  Description of Artificial Sequence: Synthetic oligonucleotide
  Target: ATXN1; (+) strand; PAM type: YTN; PAM sequence: TTA
ttttaaaatatatggaatat

SEQ ID NO: 257634 - DNA, 20 bp, Artificial Sequence
  Description of Artificial Sequence: Synthetic oligonucleotide
  Target: ATXN1; (+) strand; PAM type: YTN; PAM sequence: TTT
taaaatatatggaatataat

SEQ ID NO: 257635 - DNA, 20 bp, Artificial Sequence
  Description of Artificial Sequence: Synthetic oligonucleotide
  Target: ATXN1; (+) strand; PAM type: YTN; PAM sequence: TTT
aaaatatatggaatataata

SEQ ID NO: 257636 - DNA, 20 bp, Artificial Sequence
  Description of Artificial Sequence: Synthetic oligonucleotide
  Target: ATXN1; (+) strand; PAM type: YTN; PAM sequence: TTA
aaatatatggaatataataa

SEQ ID NO: 257637 - DNA, 20 bp, Artificial Sequence
  Description of Artificial Sequence: Synthetic oligonucleotide
  Target: ATXN1; (+) strand; PAM type: YTN; PAM sequence: TTT
ggccaattaattaatattag

SEQ ID NO: 257638 - DNA, 20 bp, Artificial Sequence
  Description of Artificial Sequence: Synthetic oligonucleotide
  Target: ATXN1; (+) strand; PAM type: YTN; PAM sequence: TTG
gccaattaattaatattagg

SEQ ID NO: 257639 - DNA, 20 bp, Artificial Sequence
  Description of Artificial Sequence: Synthetic oligonucleotide
  Target: ATXN1; (+) strand; PAM type: YTN; PAM sequence: TTA
attaatattaggcagtgaaa

SEQ ID NO: 257640 - DNA, 20 bp, Artificial Sequence
  Description of Artificial Sequence: Synthetic oligonucleotide
  Target: ATXN1; (+) strand; PAM type: YTN; PAM sequence: TTA
atattaggcagtgaaacaat

SEQ ID NO: 257641 - DNA, 20 bp, Artificial Sequence
  Description of Artificial Sequence: Synthetic oligonucleotide
  Target: ATXN1; (+) strand; PAM type: YTN; PAM sequence: TTA
ggcagtgaaacaataagtgg

SEQ ID NO: 257642 - DNA, 20 bp, Artificial Sequence
  Description of Artificial Sequence: Synthetic oligonucleotide
  Target: ATXN1; (+) strand; PAM type: YTN; PAM sequence: TTT
ttttgtttgtttgtttttgg

SEQ ID NO: 257643 - DNA, 20 bp, Artificial Sequence
  Description of Artificial Sequence: Synthetic oligonucleotide
  Target: ATXN1; (+) strand; PAM type: YTN; PAM sequence: TTT
tttgtttgtttgtttttggt

SEQ ID NO: 257644 - DNA, 20 bp, Artificial Sequence
  Description of Artificial Sequence: Synthetic oligonucleotide
  Target: ATXN1; (+) strand; PAM type: YTN; PAM sequence: TTT
ttgtttgtttgtttttggtt

SEQ ID NO: 257645 - DNA, 20 bp, Artificial Sequence
  Description of Artificial Sequence: Synthetic oligonucleotide
  Target: ATXN1; (+) strand; PAM type: YTN; PAM sequence: TTT
tgtttgtttgtttttggttt

SEQ ID NO: 257646 - DNA, 20 bp, Artificial Sequence
  Description of Artificial Sequence: Synthetic oligonucleotide
  Target: ATXN1; (+) strand; PAM type: YTN; PAM sequence: TTT
gtttgtttgtttttggtttt

SEQ ID NO: 257647 - DNA, 20 bp, Artificial Sequence
  Description of Artificial Sequence: Synthetic oligonucleotide
  Target: ATXN1; (+) strand; PAM type: YTN; PAM sequence: TTG
tttgtttgtttttggttttt

SEQ ID NO: 257648 - DNA, 20 bp, Artificial Sequence
  Description of Artificial Sequence: Synthetic oligonucleotide
  Target: ATXN1; (+) strand; PAM type: YTN; PAM sequence: TTT
gtttgtttttggtttttttg

SEQ ID NO: 257649 - DNA, 20 bp, Artificial Sequence
  Description of Artificial Sequence: Synthetic oligonucleotide
  Target: ATXN1; (+) strand; PAM type: YTN; PAM sequence: TTG
tttgtttttggtttttttga

SEQ ID NO: 257650 - DNA, 20 bp, Artificial Sequence
  Description of Artificial Sequence: Synthetic oligonucleotide
  Target: ATXN1; (+) strand; PAM type: YTN; PAM sequence: TTT
gtttttggtttttttgagac

SEQ ID NO: 257651 - DNA, 20 bp, Artificial Sequence
  Description of Artificial Sequence: Synthetic oligonucleotide
  Target: ATXN1; (+) strand; PAM type: YTN; PAM sequence: TTG
tttttggtttttttgagaca

SEQ ID NO: 257652 - DNA, 20 bp, Artificial Sequence
  Description of Artificial Sequence: Synthetic oligonucleotide
  Target: ATXN1; (+) strand; PAM type: YTN; PAM sequence: TTT
ttggtttttttgagacaggg

SEQ ID NO: 257653 - DNA, 20 bp, Artificial Sequence
  Description of Artificial Sequence: Synthetic oligonucleotide
  Target: ATXN1; (+) strand; PAM type: YTN; PAM sequence: TTT
tggtttttttgagacagggt

SEQ ID NO: 257654 - DNA, 20 bp, Artificial Sequence
  Description of Artificial Sequence: Synthetic oligonucleotide
  Target: ATXN1; (+) strand; PAM type: YTN; PAM sequence: TTT
ggtttttttgagacagggtc

SEQ ID NO: 257655 - DNA, 20 bp, Artificial Sequence
  Description of Artificial Sequence: Synthetic oligonucleotide
  Target: ATXN1; (+) strand; PAM type: YTN; PAM sequence: TTG
gtttttttgagacagggtct

SEQ ID NO: 257656 - DNA, 20 bp, Artificial Sequence
  Description of Artificial Sequence: Synthetic oligonucleotide
  Target: ATXN1; (+) strand; PAM type: YTN; PAM sequence: TTT
ttttgagacagggtctcact

SEQ ID NO: 257657 - DNA, 20 bp, Artificial Sequence
  Description of Artificial Sequence: Synthetic oligonucleotide
  Target: ATXN1; (+) strand; PAM type: YTN; PAM sequence: TTT
tttgagacagggtctcactc

SEQ ID NO: 257658 - DNA, 20 bp, Artificial Sequence
  Description of Artificial Sequence: Synthetic oligonucleotide
  Target: ATXN1; (+) strand; PAM type: YTN; PAM sequence: TTT
ttgagacagggtctcactct

SEQ ID NO: 257659 - DNA, 20 bp, Artificial Sequence
  Description of Artificial Sequence: Synthetic oligonucleotide
  Target: ATXN1; (+) strand; PAM type: YTN; PAM sequence: TTT
tgagacagggtctcactctg

SEQ ID NO: 257660 - DNA, 20 bp, Artificial Sequence
  Description of Artificial Sequence: Synthetic oligonucleotide
  Target: ATXN1; (+) strand; PAM type: YTN; PAM sequence: TTT
gagacagggtctcactctgt

SEQ ID NO: 257661 - DNA, 20 bp, Artificial Sequence
  Description of Artificial Sequence: Synthetic oligonucleotide
  Target: ATXN1; (+) strand; PAM type: YTN; PAM sequence: TTG
agacagggtctcactctgtc

SEQ ID NO: 257662 - DNA, 20 bp, Artificial Sequence
  Description of Artificial Sequence: Synthetic oligonucleotide
  Target: ATXN1; (+) strand; PAM type: YTN; PAM sequence: CTC
actctgtcgcccagactgga

SEQ ID NO: 257663 - DNA, 20 bp, Artificial Sequence
  Description of Artificial Sequence: Synthetic oligonucleotide
  Target: ATXN1; (+) strand; PAM type: YTN; PAM sequence: CTC
tgtcgcccagactggagtga

SEQ ID NO: 257664 - DNA, 20 bp, Artificial Sequence
  Description of Artificial Sequence: Synthetic oligonucleotide
  Target: ATXN1; (+) strand; PAM type: YTN; PAM sequence: CTG
tcgcccagactggagtgaaa

SEQ ID NO: 257665 - DNA, 20 bp, Artificial Sequence
  Description of Artificial Sequence: Synthetic oligonucleotide
  Target: ATXN1; (+) strand; PAM type: YTN; PAM sequence: CTG
gagtgaaatggtgcgatctc

SEQ ID NO: 257666 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcaacctctgcc

SEQ ID NO: 257667 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctgcctcctg

SEQ ID NO: 257668 - DNA, 20 bp, Artificial Sequence
  Description of Artificial Sequence: Synthetic oligonucleotide
  Target: ATXN1; (+) strand; PAM type: YTN; PAM sequence: CTG
caacctctgcctcctgggtt

SEQ ID NO: 257669 - DNA, 20 bp, Artificial Sequence
  Description of Artificial Sequence: Synthetic oligonucleotide
  Target: ATXN1; (+) strand; PAM type: YTN; PAM sequence: CTC
tgcctcctgggttcaagaga

SEQ ID NO: 257670 - DNA, 20 bp, Artificial Sequence
  Description of Artificial Sequence: Synthetic oligonucleotide
  Target: ATXN1; (+) strand; PAM type: YTN; PAM sequence: CTG
cctcctgggttcaagagatt

SEQ ID NO: 257671 - DNA, 20 bp, Artificial Sequence
  Description of Artificial Sequence: Synthetic oligonucleotide
  Target: ATXN1; (+) strand; PAM type: YTN; PAM sequence: CTC
ctgggttcaagagattctcc

SEQ ID NO: 257672 - DNA, 20 bp, Artificial Sequence
  Description of Artificial Sequence: Synthetic oligonucleotide
  Target: ATXN1; (+) strand; PAM type: YTN; PAM sequence: CTG
ggttcaagagattctcctgc

SEQ ID NO: 257673 - DNA, 20 bp, Artificial Sequence
  Description of Artificial Sequence: Synthetic oligonucleotide
  Target: ATXN1; (+) strand; PAM type: YTN; PAM sequence: TTC
aagagattctcctgcctcag

SEQ ID NO: 257674 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccgag

SEQ ID NO: 257675 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccgagta

SEQ ID NO: 257676 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccgagtagct

SEQ ID NO: 257677 - DNA, 20 bp, Artificial Sequence
  Description of Artificial Sequence: Synthetic oligonucleotide
  Target: ATXN1; (+) strand; PAM type: YTN; PAM sequence: CTC
agcctcccgagtagctggaa

SEQ ID NO: 257678 - DNA, 20 bp, Artificial Sequence
  Description of Artificial Sequence: Synthetic oligonucleotide
  Target: ATXN1; (+) strand; PAM type: YTN; PAM sequence: CTC
ccgagtagctggaactacgg

SEQ ID NO: 257679 - DNA, 20 bp, Artificial Sequence
  Description of Artificial Sequence: Synthetic oligonucleotide
  Target: ATXN1; (+) strand; PAM type: YTN; PAM sequence: CTG
gaactacggcacctgccacc

SEQ ID NO: 257680 - DNA, 20 bp, Artificial Sequence
  Description of Artificial Sequence: Synthetic oligonucleotide
  Target: ATXN1; (+) strand; PAM type: YTN; PAM sequence: CTA
cggcacctgccaccatgccc

SEQ ID NO: 257681 - DNA, 20 bp, Artificial Sequence
  Description of Artificial Sequence: Synthetic oligonucleotide
  Target: ATXN1; (+) strand; PAM type: YTN; PAM sequence: CTG
ccaccatgcccggctaattt

SEQ ID NO: 257682 - DNA, 20 bp, Artificial Sequence
  Description of Artificial Sequence: Synthetic oligonucleotide
  Target: ATXN1; (+) strand; PAM type: YTN; PAM sequence: CTA
attttttgtatttttaggag

SEQ ID NO: 257683 - DNA, 20 bp, Artificial Sequence
  Description of Artificial Sequence: Synthetic oligonucleotide
  Target: ATXN1; (+) strand; PAM type: YTN; PAM sequence: TTT
tttgtatttttaggagagat

SEQ ID NO: 257684 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttaggagagatg

SEQ ID NO: 257685 - DNA, 20 bp, Artificial Sequence
  Description of Artificial Sequence: Synthetic oligonucleotide
  Target: ATXN1; (+) strand; PAM type: YTN; PAM sequence: TTT
tgtatttttaggagagatgg

SEQ ID NO: 257686 - DNA, 20 bp, Artificial Sequence
  Description of Artificial Sequence: Synthetic oligonucleotide
  Target: ATXN1; (+) strand; PAM type: YTN; PAM sequence: TTT
gtatttttaggagagatggg

SEQ ID NO: 257687 - DNA, 20 bp, Artificial Sequence
  Description of Artificial Sequence: Synthetic oligonucleotide
  Target: ATXN1; (+) strand; PAM type: YTN; PAM sequence: TTG
tatttttaggagagatgggg

SEQ ID NO: 257688 - DNA, 20 bp, Artificial Sequence
  Description of Artificial Sequence: Synthetic oligonucleotide
  Target: ATXN1; (+) strand; PAM type: YTN; PAM sequence: TTT
ttaggagagatggggtttgg

SEQ ID NO: 257689 - DNA, 20 bp, Artificial Sequence
  Description of Artificial Sequence: Synthetic oligonucleotide
  Target: ATXN1; (+) strand; PAM type: YTN; PAM sequence: TTT
taggagagatggggtttggc

SEQ ID NO: 257690 - DNA, 20 bp, Artificial Sequence
  Description of Artificial Sequence: Synthetic oligonucleotide
  Target: ATXN1; (+) strand; PAM type: YTN; PAM sequence: TTT
aggagagatggggtttggcc

SEQ ID NO: 257691 - DNA, 20 bp, Artificial Sequence
  Description of Artificial Sequence: Synthetic oligonucleotide
  Target: ATXN1; (+) strand; PAM type: YTN; PAM sequence: TTA
ggagagatggggtttggcca

SEQ ID NO: 257692 - DNA, 20 bp, Artificial Sequence
  Description of Artificial Sequence: Synthetic oligonucleotide
  Target: ATXN1; (+) strand; PAM type: YTN; PAM sequence: TTT
ggccatgttggccaggatgg

SEQ ID NO: 257693 - DNA, 20 bp, Artificial Sequence
  Description of Artificial Sequence: Synthetic oligonucleotide
  Target: ATXN1; (+) strand; PAM type: YTN; PAM sequence: TTG
gccatgttggccaggatggt

SEQ ID NO: 257694 - DNA, 20 bp, Artificial Sequence
  Description of Artificial Sequence: Synthetic oligonucleotide
  Target: ATXN1; (+) strand; PAM type: YTN; PAM sequence: TTG
gccaggatggtctcgaactc

SEQ ID NO: 257695 - DNA, 20 bp, Artificial Sequence
  Description of Artificial Sequence: Synthetic oligonucleotide
  Target: ATXN1; (+) strand; PAM type: YTN; PAM sequence: CTC
gaactcctgacctcagatgc

SEQ ID NO: 257696 - DNA, 20 bp, Artificial Sequence
  Description of Artificial Sequence: Synthetic oligonucleotide
  Target: ATXN1; (+) strand; PAM type: YTN; PAM sequence: CTC
ctgacctcagatgctccacc

SEQ ID NO: 257697 - DNA, 20 bp, Artificial Sequence
  Description of Artificial Sequence: Synthetic oligonucleotide
  Target: ATXN1; (+) strand; PAM type: YTN; PAM sequence: CTG
acctcagatgctccaccctc

SEQ ID NO: 257698 - DNA, 20 bp, Artificial Sequence
  Description of Artificial Sequence: Synthetic oligonucleotide
  Target: ATXN1; (+) strand; PAM type: YTN; PAM sequence: CTC
agatgctccaccctccttgg

SEQ ID NO: 257699 - DNA, 20 bp, Artificial Sequence
  Description of Artificial Sequence: Synthetic oligonucleotide
  Target: ATXN1; (+) strand; PAM type: YTN; PAM sequence: CTC
caccctccttggcctcccaa

SEQ ID NO: 257700 - DNA, 20 bp, Artificial Sequence
  Description of Artificial Sequence: Synthetic oligonucleotide
  Target: ATXN1; (+) strand; PAM type: YTN; PAM sequence: CTC
cttggcctcccaaagtgctg

SEQ ID NO: 257701 - DNA, 20 bp, Artificial Sequence
  Description of Artificial Sequence: Synthetic oligonucleotide
  Target: ATXN1; (+) strand; PAM type: YTN; PAM sequence: CTT
ggcctcccaaagtgctggga

SEQ ID NO: 257702 - DNA, 20 bp, Artificial Sequence
  Description of Artificial Sequence: Synthetic oligonucleotide
  Target: ATXN1; (+) strand; PAM type: YTN; PAM sequence: TTG
gcctcccaaagtgctgggat

SEQ ID NO: 257703 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 257704 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgtgagccac

SEQ ID NO: 257705 - DNA, 20 bp, Artificial Sequence
  Description of Artificial Sequence: Synthetic oligonucleotide
  Target: ATXN1; (+) strand; PAM type: YTN; PAM sequence: TTA
caggcgtgagccaccgcgcc

SEQ ID NO: 257706 - DNA, 20 bp, Artificial Sequence
  Description of Artificial Sequence: Synthetic oligonucleotide
  Target: ATXN1; (+) strand; PAM type: YTN; PAM sequence: TTA
ttatttcaacacagaagtcc

SEQ ID NO: 257707 - DNA, 20 bp, Artificial Sequence
  Description of Artificial Sequence: Synthetic oligonucleotide
  Target: ATXN1; (+) strand; PAM type: YTN; PAM sequence: TTA
tttcaacacagaagtccttg

SEQ ID NO: 257708 - DNA, 20 bp, Artificial Sequence
  Description of Artificial Sequence: Synthetic oligonucleotide
  Target: ATXN1; (+) strand; PAM type: YTN; PAM sequence: TTT
caacacagaagtccttgttt

SEQ ID NO: 257709 - DNA, 20 bp, Artificial Sequence
  Description of Artificial Sequence: Synthetic oligonucleotide
  Target: ATXN1; (+) strand; PAM type: YTN; PAM sequence: TTC
aacacagaagtccttgttta

SEQ ID NO: 257710 - DNA, 20 bp, Artificial Sequence
  Description of Artificial Sequence: Synthetic oligonucleotide
  Target: ATXN1; (+) strand; PAM type: YTN; PAM sequence: CTT
gtttacccgaagcagctggg

SEQ ID NO: 257711 - DNA, 20 bp, Artificial Sequence
  Description of Artificial Sequence: Synthetic oligonucleotide
  Target: ATXN1; (+) strand; PAM type: YTN; PAM sequence: TTG
tttacccgaagcagctggga

SEQ ID NO: 257712 - DNA, 20 bp, Artificial Sequence
  Description of Artificial Sequence: Synthetic oligonucleotide
  Target: ATXN1; (+) strand; PAM type: YTN; PAM sequence: TTT
acccgaagcagctgggaaat

SEQ ID NO: 257713 - DNA, 20 bp, Artificial Sequence
  Description of Artificial Sequence: Synthetic oligonucleotide
  Target: ATXN1; (+) strand; PAM type: YTN; PAM sequence: TTA
cccgaagcagctgggaaata

SEQ ID NO: 257714 - DNA, 20 bp, Artificial Sequence
  Description of Artificial Sequence: Synthetic oligonucleotide
  Target: ATXN1; (+) strand; PAM type: YTN; PAM sequence: CTG
ggaaatagggcttcgcataa

SEQ ID NO: 257715 - DNA, 20 bp, Artificial Sequence
  Description of Artificial Sequence: Synthetic oligonucleotide
  Target: ATXN1; (+) strand; PAM type: YTN; PAM sequence: CTT
cgcataaaaccagagcagaa

SEQ ID NO: 257716 - DNA, 20 bp, Artificial Sequence
  Description of Artificial Sequence: Synthetic oligonucleotide
  Target: ATXN1; (+) strand; PAM type: YTN; PAM sequence: TTC
gcataaaaccagagcagaag

SEQ ID NO: 257717 - DNA, 20 bp, Artificial Sequence
  Description of Artificial Sequence: Synthetic oligonucleotide
  Target: ATXN1; (+) strand; PAM type: YTN; PAM sequence: CTG
tgagtgagtcctgcctggtt

SEQ ID NO: 257718 - DNA, 20 bp, Artificial Sequence
  Description of Artificial Sequence: Synthetic oligonucleotide
  Target: ATXN1; (+) strand; PAM type: YTN; PAM sequence: CTG
cctggttctcggctcacact

SEQ ID NO: 257719 - DNA, 20 bp, Artificial Sequence
  Description of Artificial Sequence: Synthetic oligonucleotide
  Target: ATXN1; (+) strand; PAM type: YTN; PAM sequence: CTG
gttctcggctcacactagtc

SEQ ID NO: 257720 - DNA, 20 bp, Artificial Sequence
  Description of Artificial Sequence: Synthetic oligonucleotide
  Target: ATXN1; (+) strand; PAM type: YTN; PAM sequence: TTC
tcggctcacactagtccagc

SEQ ID NO: 257721 - DNA, 20 bp, Artificial Sequence
  Description of Artificial Sequence: Synthetic oligonucleotide
  Target: ATXN1; (+) strand; PAM type: YTN; PAM sequence: CTC
ggctcacactagtccagcct

SEQ ID NO: 257722 - DNA, 20 bp, Artificial Sequence
  Description of Artificial Sequence: Synthetic oligonucleotide
  Target: ATXN1; (+) strand; PAM type: YTN; PAM sequence: CTC
acactagtccagccttggga

SEQ ID NO: 257723 - DNA, 20 bp, Artificial Sequence
  Description of Artificial Sequence: Synthetic oligonucleotide
  Target: ATXN1; (+) strand; PAM type: YTN; PAM sequence: CTA
gtccagccttgggaaagagc

SEQ ID NO: 257724 - DNA, 20 bp, Artificial Sequence
  Description of Artificial Sequence: Synthetic oligonucleotide
  Target: ATXN1; (+) strand; PAM type: YTN; PAM sequence: CTT
gggaaagagctgggacacca

SEQ ID NO: 257725 - DNA, 20 bp, Artificial Sequence
  Description of Artificial Sequence: Synthetic oligonucleotide
  Target: ATXN1; (+) strand; PAM type: YTN; PAM sequence: TTG
ggaaagagctgggacaccac

SEQ ID NO: 257726 - DNA, 20 bp, Artificial Sequence
  Description of Artificial Sequence: Synthetic oligonucleotide
  Target: ATXN1; (+) strand; PAM type: YTN; PAM sequence: CTG
ggacaccacaggtaaccacc

SEQ ID NO: 257727 - DNA, 20 bp, Artificial Sequence
  Description of Artificial Sequence: Synthetic oligonucleotide
  Target: ATXN1; (+) strand; PAM type: YTN; PAM sequence: CTT
aatttaccctttgcctgtct

SEQ ID NO: 257728 - DNA, 20 bp, Artificial Sequence
  Description of Artificial Sequence: Synthetic oligonucleotide
  Target: ATXN1; (+) strand; PAM type: YTN; PAM sequence: TTA
atttaccctttgcctgtctg

SEQ ID NO: 257729 - DNA, 20 bp, Artificial Sequence
  Description of Artificial Sequence: Synthetic oligonucleotide
  Target: ATXN1; (+) strand; PAM type: YTN; PAM sequence: TTT
accctttgcctgtctggcga

SEQ ID NO: 257730 - DNA, 20 bp, Artificial Sequence
  Description of Artificial Sequence: Synthetic oligonucleotide
  Target: ATXN1; (+) strand; PAM type: YTN; PAM sequence: TTA
ccctttgcctgtctggcgaa

SEQ ID NO: 257731 - DNA, 20 bp, Artificial Sequence
  Description of Artificial Sequence: Synthetic oligonucleotide
  Target: ATXN1; (+) strand; PAM type: YTN; PAM sequence: CTT
tgcctgtctggcgaagacaa

SEQ ID NO: 257732 - DNA, 20 bp, Artificial Sequence
  Description of Artificial Sequence: Synthetic oligonucleotide
  Target: ATXN1; (+) strand; PAM type: YTN; PAM sequence: TTT
gcctgtctggcgaagacaaa

SEQ ID NO: 257733 - DNA, 20 bp, Artificial Sequence
  Description of Artificial Sequence: Synthetic oligonucleotide
  Target: ATXN1; (+) strand; PAM type: YTN; PAM sequence: TTG
cctgtctggcgaagacaaag

SEQ ID NO: 257734 - DNA, 20 bp, Artificial Sequence
  Description of Artificial Sequence: Synthetic oligonucleotide
  Target: ATXN1; (+) strand; PAM type: YTN; PAM sequence: CTG
tctggcgaagacaaagtaaa

SEQ ID NO: 257735 - DNA, 20 bp, Artificial Sequence
  Description of Artificial Sequence: Synthetic oligonucleotide
  Target: ATXN1; (+) strand; PAM type: YTN; PAM sequence: CTG
gcgaagacaaagtaaactga

SEQ ID NO: 257736 - DNA, 20 bp, Artificial Sequence
  Description of Artificial Sequence: Synthetic oligonucleotide
  Target: ATXN1; (+) strand; PAM type: YTN; PAM sequence: CTG
agtgccacttttattaatgg

SEQ ID NO: 257737 - DNA, 20 bp, Artificial Sequence
  Description of Artificial Sequence: Synthetic oligonucleotide
  Target: ATXN1; (+) strand; PAM type: YTN; PAM sequence: CTT
ttattaatgggaaaccatct

SEQ ID NO: 257738 - DNA, 20 bp, Artificial Sequence
  Description of Artificial Sequence: Synthetic oligonucleotide
  Target: ATXN1; (+) strand; PAM type: YTN; PAM sequence: TTT
tattaatgggaaaccatctt

SEQ ID NO: 257739 - DNA, 20 bp, Artificial Sequence
  Description of Artificial Sequence: Synthetic oligonucleotide
  Target: ATXN1; (+) strand; PAM type: YTN; PAM sequence: TTT
attaatgggaaaccatctta

SEQ ID NO: 257740 - DNA, 20 bp, Artificial Sequence
  Description of Artificial Sequence: Synthetic oligonucleotide
  Target: ATXN1; (+) strand; PAM type: YTN; PAM sequence: TTA
ttaatgggaaaccatcttac

SEQ ID NO: 257741 - DNA, 20 bp, Artificial Sequence
  Description of Artificial Sequence: Synthetic oligonucleotide
  Target: ATXN1; (+) strand; PAM type: YTN; PAM sequence: TTA
atgggaaaccatcttactta

SEQ ID NO: 257742 - DNA, 20 bp, Artificial Sequence
  Description of Artificial Sequence: Synthetic oligonucleotide
  Target: ATXN1; (+) strand; PAM type: YTN; PAM sequence: CTT
acttatagcaaaaacaaatg

SEQ ID NO: 257743 - DNA, 20 bp, Artificial Sequence
  Description of Artificial Sequence: Synthetic oligonucleotide
  Target: ATXN1; (+) strand; PAM type: YTN; PAM sequence: TTA
cttatagcaaaaacaaatgc

SEQ ID NO: 257744 - DNA, 20 bp, Artificial Sequence
  Description of Artificial Sequence: Synthetic oligonucleotide
  Target: ATXN1; (+) strand; PAM type: YTN; PAM sequence: CTT
atagcaaaaacaaatgctca

SEQ ID NO: 257745 - DNA, 20 bp, Artificial Sequence
  Description of Artificial Sequence: Synthetic oligonucleotide
  Target: ATXN1; (+) strand; PAM type: YTN; PAM sequence: TTA
tagcaaaaacaaatgctcaa

SEQ ID NO: 257746 - DNA, 20 bp, Artificial Sequence
  Description of Artificial Sequence: Synthetic oligonucleotide
  Target: ATXN1; (+) strand; PAM type: YTN; PAM sequence: CTC
aaacctcattcattctgcgg

SEQ ID NO: 257747 - DNA, 20 bp, Artificial Sequence
  Description of Artificial Sequence: Synthetic oligonucleotide
  Target: ATXN1; (+) strand; PAM type: YTN; PAM sequence: CTC
attcattctgcggttatctg

SEQ ID NO: 257748 - DNA, 20 bp, Artificial Sequence
  Description of Artificial Sequence: Synthetic oligonucleotide
  Target: ATXN1; (+) strand; PAM type: YTN; PAM sequence: TTC
attctgcggttatctggatc

SEQ ID NO: 257749 - DNA, 20 bp, Artificial Sequence
  Description of Artificial Sequence: Synthetic oligonucleotide
  Target: ATXN1; (+) strand; PAM type: YTN; PAM sequence: TTC
tgcggttatctggatccttc

SEQ ID NO: 257750 - DNA, 20 bp, Artificial Sequence
  Description of Artificial Sequence: Synthetic oligonucleotide
  Target: ATXN1; (+) strand; PAM type: YTN; PAM sequence: CTG
cggttatctggatccttcat

SEQ ID NO: 257751 - DNA, 20 bp, Artificial Sequence
  Description of Artificial Sequence: Synthetic oligonucleotide
  Target: ATXN1; (+) strand; PAM type: YTN; PAM sequence: TTA
tctggatccttcatgctgta

SEQ ID NO: 257752 - DNA, 20 bp, Artificial Sequence
  Description of Artificial Sequence: Synthetic oligonucleotide
  Target: ATXN1; (+) strand; PAM type: YTN; PAM sequence: CTG
gatccttcatgctgtaggta

SEQ ID NO: 257753 - DNA, 20 bp, Artificial Sequence
  Description of Artificial Sequence: Synthetic oligonucleotide
  Target: ATXN1; (+) strand; PAM type: YTN; PAM sequence: CTT
catgctgtaggtagggaaca

SEQ ID NO: 257754 - DNA, 20 bp, Artificial Sequence
  Description of Artificial Sequence: Synthetic oligonucleotide
  Target: ATXN1; (+) strand; PAM type: YTN; PAM sequence: TTC
atgctgtaggtagggaacag

SEQ ID NO: 257755 - DNA, 20 bp, Artificial Sequence
  Description of Artificial Sequence: Synthetic oligonucleotide
  Target: ATXN1; (+) strand; PAM type: YTN; PAM sequence: CTG
taggtagggaacagaatggg

SEQ ID NO: 257756 - DNA, 20 bp, Artificial Sequence
  Description of Artificial Sequence: Synthetic oligonucleotide
  Target: ATXN1; (+) strand; PAM type: YTN; PAM sequence: CTC
tgagagctccctcctccgcg

SEQ ID NO: 257757 - DNA, 20 bp, Artificial Sequence
  Description of Artificial Sequence: Synthetic oligonucleotide
  Target: ATXN1; (+) strand; PAM type: YTN; PAM sequence: CTG
agagctccctcctccgcgcc

SEQ ID NO: 257758 - DNA, 20 bp, Artificial Sequence
  Description of Artificial Sequence: Synthetic oligonucleotide
  Target: ATXN1; (+) strand; PAM type: YTN; PAM sequence: CTC
cctcctccgcgcctctgctg

SEQ ID NO: 257759 - DNA, 20 bp, Artificial Sequence
  Description of Artificial Sequence: Synthetic oligonucleotide
  Target: ATXN1; (+) strand; PAM type: YTN; PAM sequence: CTC
ctccgcgcctctgctgggag

SEQ ID NO: 257760 - DNA, 20 bp, Artificial Sequence
  Description of Artificial Sequence: Synthetic oligonucleotide
  Target: ATXN1; (+) strand; PAM type: YTN; PAM sequence: CTC
cgcgcctctgctgggagcaa

SEQ ID NO: 257761 - DNA, 20 bp, Artificial Sequence
  Description of Artificial Sequence: Synthetic oligonucleotide
  Target: ATXN1; (+) strand; PAM type: YTN; PAM sequence: CTC
tgctgggagcaaaaataatc

SEQ ID NO: 257762 - DNA, 20 bp, Artificial Sequence
  Description of Artificial Sequence: Synthetic oligonucleotide
  Target: ATXN1; (+) strand; PAM type: YTN; PAM sequence: CTG
ctgggagcaaaaataatctc

SEQ ID NO: 257763 - DNA, 20 bp, Artificial Sequence
  Description of Artificial Sequence: Synthetic oligonucleotide
  Target: ATXN1; (+) strand; PAM type: YTN; PAM sequence: CTG
ggagcaaaaataatctcaaa

SEQ ID NO: 257764 - DNA, 20 bp, Artificial Sequence
  Description of Artificial Sequence: Synthetic oligonucleotide
  Target: ATXN1; (+) strand; PAM type: YTN; PAM sequence: CTC
aaaacaggaaaaagaaggag

SEQ ID NO: 257765 - DNA, 20 bp, Artificial Sequence
  Description of Artificial Sequence: Synthetic oligonucleotide
  Target: ATXN1; (+) strand; PAM type: YTN; PAM sequence: TTT
ttaatcgtttttttccctcc

SEQ ID NO: 257766 - DNA, 20 bp, Artificial Sequence
  Description of Artificial Sequence: Synthetic oligonucleotide
  Target: ATXN1; (+) strand; PAM type: YTN; PAM sequence: TTT
taatcgtttttttccctccc

SEQ ID NO: 257767 - DNA, 20 bp, Artificial Sequence
  Description of Artificial Sequence: Synthetic oligonucleotide
  Target: ATXN1; (+) strand; PAM type: YTN; PAM sequence: TTT
aatcgtttttttccctccct

SEQ ID NO: 257768 - DNA, 20 bp, Artificial Sequence
  Description of Artificial Sequence: Synthetic oligonucleotide
  Target: ATXN1; (+) strand; PAM type: YTN; PAM sequence: TTA
atcgtttttttccctccctt

SEQ ID NO: 257769 - DNA, 20 bp, Artificial Sequence
  Description of Artificial Sequence: Synthetic oligonucleotide
  Target: ATXN1; (+) strand; PAM type: YTN; PAM sequence: TTT
ttttccctcccttcagaatg

SEQ ID NO: 257770 - DNA, 20 bp, Artificial Sequence
  Description of Artificial Sequence: Synthetic oligonucleotide
  Target: ATXN1; (+) strand; PAM type: YTN; PAM sequence: TTT
tttccctcccttcagaatga

SEQ ID NO: 257771 - DNA, 20 bp, Artificial Sequence
  Description of Artificial Sequence: Synthetic oligonucleotide
  Target: ATXN1; (+) strand; PAM type: YTN; PAM sequence: TTT
ttccctcccttcagaatgag

SEQ ID NO: 257772 - DNA, 20 bp, Artificial Sequence
  Description of Artificial Sequence: Synthetic oligonucleotide
  Target: ATXN1; (+) strand; PAM type: YTN; PAM sequence: TTT
tccctcccttcagaatgagt

SEQ ID NO: 257773 - DNA, 20 bp, Artificial Sequence
  Description of Artificial Sequence: Synthetic oligonucleotide
  Target: ATXN1; (+) strand; PAM type: YTN; PAM sequence: TTT
ccctcccttcagaatgagtg

SEQ ID NO: 257774 - DNA, 20 bp, Artificial Sequence
  Description of Artificial Sequence: Synthetic oligonucleotide
  Target: ATXN1; (+) strand; PAM type: YTN; PAM sequence: TTC
cctcccttcagaatgagtgg

SEQ ID NO: 257775 - DNA, 20 bp, Artificial Sequence
  Description of Artificial Sequence: Synthetic oligonucleotide
  Target: ATXN1; (+) strand; PAM type: YTN; PAM sequence: CTC
ccttcagaatgagtggggag

SEQ ID NO: 257776 - DNA, 20 bp, Artificial Sequence
  Description of Artificial Sequence: Synthetic oligonucleotide
  Target: ATXN1; (+) strand; PAM type: YTN; PAM sequence: CTT
cagaatgagtggggagaatt

SEQ ID NO: 257777 - DNA, 20 bp, Artificial Sequence
  Description of Artificial Sequence: Synthetic oligonucleotide
  Target: ATXN1; (+) strand; PAM type: YTN; PAM sequence: TTC
agaatgagtggggagaatta

SEQ ID NO: 257778 - DNA, 20 bp, Artificial Sequence
  Description of Artificial Sequence: Synthetic oligonucleotide
  Target: ATXN1; (+) strand; PAM type: YTN; PAM sequence: TTA
tacatgggcagctacatatg

SEQ ID NO: 257779 - DNA, 20 bp, Artificial Sequence
  Description of Artificial Sequence: Synthetic oligonucleotide
  Target: ATXN1; (+) strand; PAM type: YTN; PAM sequence: CTA
catatgagccagtacatata

SEQ ID NO: 257780 - DNA, 20 bp, Artificial Sequence
  Description of Artificial Sequence: Synthetic oligonucleotide
  Target: ATXN1; (+) strand; PAM type: YTN; PAM sequence: TTT
aatttattcacaagaagaac

SEQ ID NO: 257781 - DNA, 20 bp, Artificial Sequence
  Description of Artificial Sequence: Synthetic oligonucleotide
  Target: ATXN1; (+) strand; PAM type: YTN; PAM sequence: TTA
atttattcacaagaagaact

SEQ ID NO: 257782 - DNA, 20 bp, Artificial Sequence
  Description of Artificial Sequence: Synthetic oligonucleotide
  Target: ATXN1; (+) strand; PAM type: YTN; PAM sequence: TTT
attcacaagaagaactacca

SEQ ID NO: 257783 - DNA, 20 bp, Artificial Sequence
  Description of Artificial Sequence: Synthetic oligonucleotide
  Target: ATXN1; (+) strand; PAM type: YTN; PAM sequence: TTA
ttcacaagaagaactaccaa

SEQ ID NO: 257784 - DNA, 20 bp, Artificial Sequence
  Description of Artificial Sequence: Synthetic oligonucleotide
  Target: ATXN1; (+) strand; PAM type: YTN; PAM sequence: TTC
acaagaagaactaccaagct

SEQ ID NO: 257785 - DNA, 20 bp, Artificial Sequence
  Description of Artificial Sequence: Synthetic oligonucleotide
  Target: ATXN1; (+) strand; PAM type: YTN; PAM sequence: CTA
ccaagctttcaaaaaaaaaa

SEQ ID NO: 257786 - DNA, 20 bp, Artificial Sequence
  Description of Artificial Sequence: Synthetic oligonucleotide
  Target: ATXN1; (+) strand; PAM type: YTN; PAM sequence: CTT
tcaaaaaaaaaaaaaaaaaa

SEQ ID NO: 257787 - DNA, 20 bp, Artificial Sequence
  Description of Artificial Sequence: Synthetic oligonucleotide
  Target: ATXN1; (+) strand; PAM type: YTN; PAM sequence: TTT
caaaaaaaaaaaaaaaaaac

SEQ ID NO: 257788 - DNA, 20 bp, Artificial Sequence
  Description of Artificial Sequence: Synthetic oligonucleotide
  Target: ATXN1; (+) strand; PAM type: YTN; PAM sequence: TTC
aaaaaaaaaaaaaaaaaacc

SEQ ID NO: 257789 - DNA, 20 bp, Artificial Sequence
  Description of Artificial Sequence: Synthetic oligonucleotide
  Target: ATXN1; (+) strand; PAM type: YTN; PAM sequence: CTT
tcttcatcatccattttgca

SEQ ID NO: 257790 - DNA, 20 bp, Artificial Sequence
  Description of Artificial Sequence: Synthetic oligonucleotide
  Target: ATXN1; (+) strand; PAM type: YTN; PAM sequence: TTT
cttcatcatccattttgcag

SEQ ID NO: 257791 - DNA, 20 bp, Artificial Sequence
  Description of Artificial Sequence: Synthetic oligonucleotide
  Target: ATXN1; (+) strand; PAM type: YTN; PAM sequence: TTC
ttcatcatccattttgcagt

SEQ ID NO: 257792 - DNA, 20 bp, Artificial Sequence
  Description of Artificial Sequence: Synthetic oligonucleotide
  Target: ATXN1; (+) strand; PAM type: YTN; PAM sequence: CTT
catcatccattttgcagtca

SEQ ID NO: 257793 - DNA, 20 bp, Artificial Sequence
  Description of Artificial Sequence: Synthetic oligonucleotide
  Target: ATXN1; (+) strand; PAM type: YTN; PAM sequence: TTC
atcatccattttgcagtcag

SEQ ID NO: 257794 - DNA, 20 bp, Artificial Sequence
  Description of Artificial Sequence: Synthetic oligonucleotide
  Target: ATXN1; (+) strand; PAM type: YTN; PAM sequence: TTT
tgcagtcagtgtgctgataa

SEQ ID NO: 257795 - DNA, 20 bp, Artificial Sequence
  Description of Artificial Sequence: Synthetic oligonucleotide
  Target: ATXN1; (+) strand; PAM type: YTN; PAM sequence: TTT
gcagtcagtgtgctgataac

SEQ ID NO: 257796 - DNA, 20 bp, Artificial Sequence
  Description of Artificial Sequence: Synthetic oligonucleotide
  Target: ATXN1; (+) strand; PAM type: YTN; PAM sequence: TTG
cagtcagtgtgctgataaca

SEQ ID NO: 257797 - DNA, 20 bp, Artificial Sequence
  Description of Artificial Sequence: Synthetic oligonucleotide
  Target: ATXN1; (+) strand; PAM type: YTN; PAM sequence: CTG
ataacaaatggtcattatct

SEQ ID NO: 257798 - DNA, 20 bp, Artificial Sequence
  Description of Artificial Sequence: Synthetic oligonucleotide
  Target: ATXN1; (+) strand; PAM type: YTN; PAM sequence: TTA
tctagtttctggaaagtaat

SEQ ID NO: 257799 - DNA, 20 bp, Artificial Sequence
  Description of Artificial Sequence: Synthetic oligonucleotide
  Target: ATXN1; (+) strand; PAM type: YTN; PAM sequence: CTA
gtttctggaaagtaatgtct

SEQ ID NO: 257800 - DNA, 20 bp, Artificial Sequence
  Description of Artificial Sequence: Synthetic oligonucleotide
  Target: ATXN1; (+) strand; PAM type: YTN; PAM sequence: TTT
ctggaaagtaatgtctatga

SEQ ID NO: 257801 - DNA, 20 bp, Artificial Sequence
  Description of Artificial Sequence: Synthetic oligonucleotide
  Target: ATXN1; (+) strand; PAM type: YTN; PAM sequence: TTC
tggaaagtaatgtctatgaa

SEQ ID NO: 257802 - DNA, 20 bp, Artificial Sequence
  Description of Artificial Sequence: Synthetic oligonucleotide
  Target: ATXN1; (+) strand; PAM type: YTN; PAM sequence: CTG
gaaagtaatgtctatgaatt

SEQ ID NO: 257803 - DNA, 20 bp, Artificial Sequence
  Description of Artificial Sequence: Synthetic oligonucleotide
  Target: ATXN1; (+) strand; PAM type: YTN; PAM sequence: CTA
tgaattggaaaaaaaaaatt

SEQ ID NO: 257804 - DNA, 20 bp, Artificial Sequence
  Description of Artificial Sequence: Synthetic oligonucleotide
  Target: ATXN1; (+) strand; PAM type: YTN; PAM sequence: TTG
gaaaaaaaaaattggtcaat

SEQ ID NO: 257805 - DNA, 20 bp, Artificial Sequence
  Description of Artificial Sequence: Synthetic oligonucleotide
  Target: ATXN1; (+) strand; PAM type: YTN; PAM sequence: TTG
gtcaataatttatatggcta

SEQ ID NO: 257806 - DNA, 20 bp, Artificial Sequence
  Description of Artificial Sequence: Synthetic oligonucleotide
  Target: ATXN1; (+) strand; PAM type: YTN; PAM sequence: TTT
atatggctatgtatacttga

SEQ ID NO: 257807 - DNA, 20 bp, Artificial Sequence
  Description of Artificial Sequence: Synthetic oligonucleotide
  Target: ATXN1; (+) strand; PAM type: YTN; PAM sequence: TTA
tatggctatgtatacttgaa

SEQ ID NO: 257808 - DNA, 20 bp, Artificial Sequence
  Description of Artificial Sequence: Synthetic oligonucleotide
  Target: ATXN1; (+) strand; PAM type: YTN; PAM sequence: CTA
tgtatacttgaagtaatgca

SEQ ID NO: 257809 - DNA, 20 bp, Artificial Sequence
  Description of Artificial Sequence: Synthetic oligonucleotide
  Target: ATXN1; (+) strand; PAM type: YTN; PAM sequence: CTT
gaagtaatgcaacttatttt

SEQ ID NO: 257810 - DNA, 20 bp, Artificial Sequence
  Description of Artificial Sequence: Synthetic oligonucleotide
  Target: ATXN1; (+) strand; PAM type: YTN; PAM sequence: TTG
aagtaatgcaacttattttc

SEQ ID NO: 257811 - DNA, 20 bp, Artificial Sequence
  Description of Artificial Sequence: Synthetic oligonucleotide
  Target: ATXN1; (+) strand; PAM type: YTN; PAM sequence: CTT
attttcttagaaggatctct

SEQ ID NO: 257812 - DNA, 20 bp, Artificial Sequence
  Description of Artificial Sequence: Synthetic oligonucleotide
  Target: ATXN1; (+) strand; PAM type: YTN; PAM sequence: TTA
ttttcttagaaggatctctc

SEQ ID NO: 257813 - DNA, 20 bp, Artificial Sequence
  Description of Artificial Sequence: Synthetic oligonucleotide
  Target: ATXN1; (+) strand; PAM type: YTN; PAM sequence: TTT
tcttagaaggatctctcaat

SEQ ID NO: 257814 - DNA, 20 bp, Artificial Sequence
  Description of Artificial Sequence: Synthetic oligonucleotide
  Target: ATXN1; (+) strand; PAM type: YTN; PAM sequence: TTT
cttagaaggatctctcaata

SEQ ID NO: 257815 - DNA, 20 bp, Artificial Sequence
  Description of Artificial Sequence: Synthetic oligonucleotide
  Target: ATXN1; (+) strand; PAM type: YTN; PAM sequence: TTC
ttagaaggatctctcaatat

SEQ ID NO: 257816 - DNA, 20 bp, Artificial Sequence
  Description of Artificial Sequence: Synthetic oligonucleotide
  Target: ATXN1; (+) strand; PAM type: YTN; PAM sequence: CTT
agaaggatctctcaatatag

SEQ ID NO: 257817 - DNA, 20 bp, Artificial Sequence
  Description of Artificial Sequence: Synthetic oligonucleotide
  Target: ATXN1; (+) strand; PAM type: YTN; PAM sequence: TTA
gaaggatctctcaatataga

SEQ ID NO: 257818 - DNA, 20 bp, Artificial Sequence
  Description of Artificial Sequence: Synthetic oligonucleotide
  Target: ATXN1; (+) strand; PAM type: YTN; PAM sequence: CTC
tcaatatagattaaattaat

SEQ ID NO: 257819 - DNA, 20 bp, Artificial Sequence
  Description of Artificial Sequence: Synthetic oligonucleotide
  Target: ATXN1; (+) strand; PAM type: YTN; PAM sequence: CTC
aatatagattaaattaatgt

SEQ ID NO: 257820 - DNA, 20 bp, Artificial Sequence
  Description of Artificial Sequence: Synthetic oligonucleotide
  Target: ATXN1; (+) strand; PAM type: YTN; PAM sequence: TTA
aattaatgtaaaatgtaaaa

SEQ ID NO: 257821 - DNA, 20 bp, Artificial Sequence
  Description of Artificial Sequence: Synthetic oligonucleotide
  Target: ATXN1; (+) strand; PAM type: YTN; PAM sequence: TTA
atgtaaaatgtaaaatgact

SEQ ID NO: 257822 - DNA, 20 bp, Artificial Sequence
  Description of Artificial Sequence: Synthetic oligonucleotide
  Target: ATXN1; (+) strand; PAM type: YTN; PAM sequence: CTT
cctcctaaaaaatctaaatt

SEQ ID NO: 257823 - DNA, 20 bp, Artificial Sequence
  Description of Artificial Sequence: Synthetic oligonucleotide
  Target: ATXN1; (+) strand; PAM type: YTN; PAM sequence: TTC
ctcctaaaaaatctaaatta

SEQ ID NO: 257824 - DNA, 20 bp, Artificial Sequence
  Description of Artificial Sequence: Synthetic oligonucleotide
  Target: ATXN1; (+) strand; PAM type: YTN; PAM sequence: CTC
ctaaaaaatctaaattagag

SEQ ID NO: 257825 - DNA, 20 bp, Artificial Sequence
  Description of Artificial Sequence: Synthetic oligonucleotide
  Target: ATXN1; (+) strand; PAM type: YTN; PAM sequence: CTA
aaaaatctaaattagagaga

SEQ ID NO: 257826 - DNA, 20 bp, Artificial Sequence
  Description of Artificial Sequence: Synthetic oligonucleotide
  Target: ATXN1; (+) strand; PAM type: YTN; PAM sequence: CTA
aattagagagattttattgg

SEQ ID NO: 257827 - DNA, 20 bp, Artificial Sequence
  Description of Artificial Sequence: Synthetic oligonucleotide
  Target: ATXN1; (+) strand; PAM type: YTN; PAM sequence: TTA
gagagattttattggctcaa

SEQ ID NO: 257828 - DNA, 20 bp, Artificial Sequence
  Description of Artificial Sequence: Synthetic oligonucleotide
  Target: ATXN1; (+) strand; PAM type: YTN; PAM sequence: TTT
tattggctcaataattaata

SEQ ID NO: 257829 - DNA, 20 bp, Artificial Sequence
  Description of Artificial Sequence: Synthetic oligonucleotide
  Target: ATXN1; (+) strand; PAM type: YTN; PAM sequence: TTT
attggctcaataattaatac

SEQ ID NO: 257830 - DNA, 20 bp, Artificial Sequence
  Description of Artificial Sequence: Synthetic oligonucleotide
  Target: ATXN1; (+) strand; PAM type: YTN; PAM sequence: TTA
ttggctcaataattaatact

SEQ ID NO: 257831 - DNA, 20 bp, Artificial Sequence
  Description of Artificial Sequence: Synthetic oligonucleotide
  Target: ATXN1; (+) strand; PAM type: YTN; PAM sequence: TTG
gctcaataattaatactgca

SEQ ID NO: 257832 - DNA, 20 bp, Artificial Sequence
  Description of Artificial Sequence: Synthetic oligonucleotide
  Target: ATXN1; (+) strand; PAM type: YTN; PAM sequence: CTC
aataattaatactgcatcac

SEQ ID NO: 257833 - DNA, 20 bp, Artificial Sequence
  Description of Artificial Sequence: Synthetic oligonucleotide
  Target: ATXN1; (+) strand; PAM type: YTN; PAM sequence: TTA
atactgcatcacacatctac

SEQ ID NO: 257834 - DNA, 20 bp, Artificial Sequence
  Description of Artificial Sequence: Synthetic oligonucleotide
  Target: ATXN1; (+) strand; PAM type: YTN; PAM sequence: CTG
catcacacatctactttcct

SEQ ID NO: 257835 - DNA, 20 bp, Artificial Sequence
  Description of Artificial Sequence: Synthetic oligonucleotide
  Target: ATXN1; (+) strand; PAM type: YTN; PAM sequence: CTA
ctttcctctctgccttctat

SEQ ID NO: 257836 - DNA, 20 bp, Artificial Sequence
  Description of Artificial Sequence: Synthetic oligonucleotide
  Target: ATXN1; (+) strand; PAM type: YTN; PAM sequence: CTT
tcctctctgccttctatccc

SEQ ID NO: 257837 - DNA, 20 bp, Artificial Sequence
  Description of Artificial Sequence: Synthetic oligonucleotide
  Target: ATXN1; (+) strand; PAM type: YTN; PAM sequence: TTT
cctctctgccttctatccct

SEQ ID NO: 257838 - DNA, 20 bp, Artificial Sequence
  Description of Artificial Sequence: Synthetic oligonucleotide
  Target: ATXN1; (+) strand; PAM type: YTN; PAM sequence: TTC
ctctctgccttctatccctg

SEQ ID NO: 257839 - DNA, 20 bp, Artificial Sequence
  Description of Artificial Sequence: Synthetic oligonucleotide
  Target: ATXN1; (+) strand; PAM type: YTN; PAM sequence: CTC
tctgccttctatccctgtgg

SEQ ID NO: 257840 - DNA, 20 bp, Artificial Sequence
  Description of Artificial Sequence: Synthetic oligonucleotide
  Target: ATXN1; (+) strand; PAM type: YTN; PAM sequence: CTC
tgccttctatccctgtggcc

SEQ ID NO: 257841 - DNA, 20 bp, Artificial Sequence
  Description of Artificial Sequence: Synthetic oligonucleotide
  Target: ATXN1; (+) strand; PAM type: YTN; PAM sequence: CTG
ccttctatccctgtggcctt

SEQ ID NO: 257842 - DNA, 20 bp, Artificial Sequence
  Description of Artificial Sequence: Synthetic oligonucleotide
  Target: ATXN1; (+) strand; PAM type: YTN; PAM sequence: CTT
ctatccctgtggccttttac

SEQ ID NO: 257843 - DNA, 20 bp, Artificial Sequence
  Description of Artificial Sequence: Synthetic oligonucleotide
  Target: ATXN1; (+) strand; PAM type: YTN; PAM sequence: TTC
tatccctgtggccttttaca

SEQ ID NO: 257844 - DNA, 20 bp, Artificial Sequence
  Description of Artificial Sequence: Synthetic oligonucleotide
  Target: ATXN1; (+) strand; PAM type: YTN; PAM sequence: CTA
tccctgtggccttttacaga

SEQ ID NO: 257845 - DNA, 20 bp, Artificial Sequence
  Description of Artificial Sequence: Synthetic oligonucleotide
  Target: ATXN1; (+) strand; PAM type: YTN; PAM sequence: CTG
tggccttttacagacaaagc

SEQ ID NO: 257846 - DNA, 20 bp, Artificial Sequence
  Description of Artificial Sequence: Synthetic oligonucleotide
  Target: ATXN1; (+) strand; PAM type: YTN; PAM sequence: CTT
ttacagacaaagcttttgct

SEQ ID NO: 257847 - DNA, 20 bp, Artificial Sequence
  Description of Artificial Sequence: Synthetic oligonucleotide
  Target: ATXN1; (+) strand; PAM type: YTN; PAM sequence: TTT
tacagacaaagcttttgcta

SEQ ID NO: 257848 - DNA, 20 bp, Artificial Sequence
  Description of Artificial Sequence: Synthetic oligonucleotide
  Target: ATXN1; (+) strand; PAM type: YTN; PAM sequence: TTT
acagacaaagcttttgctat

SEQ ID NO: 257849 - DNA, 20 bp, Artificial Sequence
  Description of Artificial Sequence: Synthetic oligonucleotide
  Target: ATXN1; (+) strand; PAM type: YTN; PAM sequence: TTA
cagacaaagcttttgctata

SEQ ID NO: 257850 - DNA, 20 bp, Artificial Sequence
  Description of Artificial Sequence: Synthetic oligonucleotide
  Target: ATXN1; (+) strand; PAM type: YTN; PAM sequence: CTT
ttgctataaccatggagcac

SEQ ID NO: 257851 - DNA, 20 bp, Artificial Sequence
  Description of Artificial Sequence: Synthetic oligonucleotide
  Target: ATXN1; (+) strand; PAM type: YTN; PAM sequence: TTT
tgctataaccatggagcaca

SEQ ID NO: 257852 - DNA, 20 bp, Artificial Sequence
  Description of Artificial Sequence: Synthetic oligonucleotide
  Target: ATXN1; (+) strand; PAM type: YTN; PAM sequence: TTT
gctataaccatggagcacac

SEQ ID NO: 257853 - DNA, 20 bp, Artificial Sequence
  Description of Artificial Sequence: Synthetic oligonucleotide
  Target: ATXN1; (+) strand; PAM type: YTN; PAM sequence: TTG
ctataaccatggagcacaca

SEQ ID NO: 257854 - DNA, 20 bp, Artificial Sequence
  Description of Artificial Sequence: Synthetic oligonucleotide
  Target: ATXN1; (+) strand; PAM type: YTN; PAM sequence: CTA
taaccatggagcacacaata

SEQ ID NO: 257855 - DNA, 20 bp, Artificial Sequence
  Description of Artificial Sequence: Synthetic oligonucleotide
  Target: ATXN1; (+) strand; PAM type: YTN; PAM sequence: CTA
taaaatataagaaagtacaa

SEQ ID NO: 257856 - DNA, 20 bp, Artificial Sequence
  Description of Artificial Sequence: Synthetic oligonucleotide
  Target: ATXN1; (+) strand; PAM type: YTN; PAM sequence: CTG
ccttacagggctgttgtgag

SEQ ID NO: 257857 - DNA, 20 bp, Artificial Sequence
  Description of Artificial Sequence: Synthetic oligonucleotide
  Target: ATXN1; (+) strand; PAM type: YTN; PAM sequence: CTT
acagggctgttgtgaggacc

SEQ ID NO: 257858 - DNA, 20 bp, Artificial Sequence
  Description of Artificial Sequence: Synthetic oligonucleotide
  Target: ATXN1; (+) strand; PAM type: YTN; PAM sequence: TTA
cagggctgttgtgaggacct

SEQ ID NO: 257859 - DNA, 20 bp, Artificial Sequence
  Description of Artificial Sequence: Synthetic oligonucleotide
  Target: ATXN1; (+) strand; PAM type: YTN; PAM sequence: CTG
ttgtgaggacctaatcagac

SEQ ID NO: 257860 - DNA, 20 bp, Artificial Sequence
  Description of Artificial Sequence: Synthetic oligonucleotide
  Target: ATXN1; (+) strand; PAM type: YTN; PAM sequence: TTG
tgaggacctaatcagacaat

SEQ ID NO: 257861 - DNA, 20 bp, Artificial Sequence
  Description of Artificial Sequence: Synthetic oligonucleotide
  Target: ATXN1; (+) strand; PAM type: YTN; PAM sequence: CTA
atcagacaatgcatgaaaag

SEQ ID NO: 257862 - DNA, 20 bp, Artificial Sequence
  Description of Artificial Sequence: Synthetic oligonucleotide
  Target: ATXN1; (+) strand; PAM type: YTN; PAM sequence: CTA
agtatagtccctggcccaga

SEQ ID NO: 257863 - DNA, 20 bp, Artificial Sequence
  Description of Artificial Sequence: Synthetic oligonucleotide
  Target: ATXN1; (+) strand; PAM type: YTN; PAM sequence: CTG
gcccagattaagtattcata

SEQ ID NO: 257864 - DNA, 20 bp, Artificial Sequence
  Description of Artificial Sequence: Synthetic oligonucleotide
  Target: ATXN1; (+) strand; PAM type: YTN; PAM sequence: TTA
agtattcataaatatcaact

SEQ ID NO: 257865 - DNA, 20 bp, Artificial Sequence
  Description of Artificial Sequence: Synthetic oligonucleotide
  Target: ATXN1; (+) strand; PAM type: YTN; PAM sequence: TTC
ataaatatcaactgtaatta

SEQ ID NO: 257866 - DNA, 20 bp, Artificial Sequence
  Description of Artificial Sequence: Synthetic oligonucleotide
  Target: ATXN1; (+) strand; PAM type: YTN; PAM sequence: CTG
taattattattccttttata

SEQ ID NO: 257867 - DNA, 20 bp, Artificial Sequence
  Description of Artificial Sequence: Synthetic oligonucleotide
  Target: ATXN1; (+) strand; PAM type: YTN; PAM sequence: TTA
ttattccttttatataaact

SEQ ID NO: 257868 - DNA, 20 bp, Artificial Sequence
  Description of Artificial Sequence: Synthetic oligonucleotide
  Target: ATXN1; (+) strand; PAM type: YTN; PAM sequence: TTA
ttccttttatataaactttt

SEQ ID NO: 257869 - DNA, 20 bp, Artificial Sequence
  Description of Artificial Sequence: Synthetic oligonucleotide
  Target: ATXN1; (+) strand; PAM type: YTN; PAM sequence: TTC
cttttatataaacttttatt

SEQ ID NO: 257870 - DNA, 20 bp, Artificial Sequence
  Description of Artificial Sequence: Synthetic oligonucleotide
  Target: ATXN1; (+) strand; PAM type: YTN; PAM sequence: CTT
ttatataaacttttatttca

SEQ ID NO: 257871 - DNA, 20 bp, Artificial Sequence
  Description of Artificial Sequence: Synthetic oligonucleotide
  Target: ATXN1; (+) strand; PAM type: YTN; PAM sequence: TTT
tatataaacttttatttcat

SEQ ID NO: 257872 - DNA, 20 bp, Artificial Sequence
  Description of Artificial Sequence: Synthetic oligonucleotide
  Target: ATXN1; (+) strand; PAM type: YTN; PAM sequence: TTT
atataaacttttatttcata

SEQ ID NO: 257873 - DNA, 20 bp, Artificial Sequence
  Description of Artificial Sequence: Synthetic oligonucleotide
  Target: ATXN1; (+) strand; PAM type: YTN; PAM sequence: TTA
tataaacttttatttcatag

SEQ ID NO: 257874 - DNA, 20 bp, Artificial Sequence
  Description of Artificial Sequence: Synthetic oligonucleotide
  Target: ATXN1; (+) strand; PAM type: YTN; PAM sequence: CTT
ttatttcatagggagatgtt

SEQ ID NO: 257875 - DNA, 20 bp, Artificial Sequence
  Description of Artificial Sequence: Synthetic oligonucleotide
  Target: ATXN1; (+) strand; PAM type: YTN; PAM sequence: TTT
tatttcatagggagatgttt

SEQ ID NO: 257876 - DNA, 20 bp, Artificial Sequence
  Description of Artificial Sequence: Synthetic oligonucleotide
  Target: ATXN1; (+) strand; PAM type: YTN; PAM sequence: TTT
atttcatagggagatgtttc

SEQ ID NO: 257877 - DNA, 20 bp, Artificial Sequence
  Description of Artificial Sequence: Synthetic oligonucleotide
  Target: ATXN1; (+) strand; PAM type: YTN; PAM sequence: TTA
tttcatagggagatgtttcc

SEQ ID NO: 257878 - DNA, 20 bp, Artificial Sequence
  Description of Artificial Sequence: Synthetic oligonucleotide
  Target: ATXN1; (+) strand; PAM type: YTN; PAM sequence: TTT
catagggagatgtttcctaa

SEQ ID NO: 257879 - DNA, 20 bp, Artificial Sequence
  Description of Artificial Sequence: Synthetic oligonucleotide
  Target: ATXN1; (+) strand; PAM type: YTN; PAM sequence: TTC
atagggagatgtttcctaaa

SEQ ID NO: 257880 - DNA, 20 bp, Artificial Sequence
  Description of Artificial Sequence: Synthetic oligonucleotide
  Target: ATXN1; (+) strand; PAM type: YTN; PAM sequence: TTT
cctaaagaaatctcctactc

SEQ ID NO: 257881 - DNA, 20 bp, Artificial Sequence
  Description of Artificial Sequence: Synthetic oligonucleotide
  Target: ATXN1; (+) strand; PAM type: YTN; PAM sequence: TTC
ctaaagaaatctcctactca

SEQ ID NO: 257882 - DNA, 20 bp, Artificial Sequence
  Description of Artificial Sequence: Synthetic oligonucleotide
  Target: ATXN1; (+) strand; PAM type: YTN; PAM sequence: CTA
aagaaatctcctactcatct

SEQ ID NO: 257883 - DNA, 20 bp, Artificial Sequence
  Description of Artificial Sequence: Synthetic oligonucleotide
  Target: ATXN1; (+) strand; PAM type: YTN; PAM sequence: CTC
ctactcatcttgctcgtaca

SEQ ID NO: 257884 - DNA, 20 bp, Artificial Sequence
  Description of Artificial Sequence: Synthetic oligonucleotide
  Target: ATXN1; (+) strand; PAM type: YTN; PAM sequence: CTA
ctcatcttgctcgtacaccc

SEQ ID NO: 257885 - DNA, 20 bp, Artificial Sequence
  Description of Artificial Sequence: Synthetic oligonucleotide
  Target: ATXN1; (+) strand; PAM type: YTN; PAM sequence: CTC
atcttgctcgtacaccctaa

SEQ ID NO: 257886 - DNA, 20 bp, Artificial Sequence
  Description of Artificial Sequence: Synthetic oligonucleotide
  Target: ATXN1; (+) strand; PAM type: YTN; PAM sequence: CTT
gctcgtacaccctaaacgtt

SEQ ID NO: 257887 - DNA, 20 bp, Artificial Sequence
  Description of Artificial Sequence: Synthetic oligonucleotide
  Target: ATXN1; (+) strand; PAM type: YTN; PAM sequence: TTG
ctcgtacaccctaaacgttt

SEQ ID NO: 257888 - DNA, 20 bp, Artificial Sequence
  Description of Artificial Sequence: Synthetic oligonucleotide
  Target: ATXN1; (+) strand; PAM type: YTN; PAM sequence: CTC
gtacaccctaaacgtttaaa

SEQ ID NO: 257889 - DNA, 20 bp, Artificial Sequence
  Description of Artificial Sequence: Synthetic oligonucleotide
  Target: ATXN1; (+) strand; PAM type: YTN; PAM sequence: CTA
aacgtttaaaataatctcac

SEQ ID NO: 257890 - DNA, 20 bp, Artificial Sequence
  Description of Artificial Sequence: Synthetic oligonucleotide
  Target: ATXN1; (+) strand; PAM type: YTN; PAM sequence: TTT
aaaataatctcactgtatcc

SEQ ID NO: 257891 - DNA, 20 bp, Artificial Sequence
  Description of Artificial Sequence: Synthetic oligonucleotide
  Target: ATXN1; (+) strand; PAM type: YTN; PAM sequence: TTA
aaataatctcactgtatcca

SEQ ID NO: 257892 - DNA, 20 bp, Artificial Sequence
  Description of Artificial Sequence: Synthetic oligonucleotide
  Target: ATXN1; (+) strand; PAM type: YTN; PAM sequence: CTC
actgtatccaatacctctga

SEQ ID NO: 257893 - DNA, 20 bp, Artificial Sequence
  Description of Artificial Sequence: Synthetic oligonucleotide
  Target: ATXN1; (+) strand; PAM type: YTN; PAM sequence: CTG
tatccaatacctctgacccc

SEQ ID NO: 257894 - DNA, 20 bp, Artificial Sequence
  Description of Artificial Sequence: Synthetic oligonucleotide
  Target: ATXN1; (+) strand; PAM type: YTN; PAM sequence: CTC
tgacccctctgaatcccatc

SEQ ID NO: 257895 - DNA, 20 bp, Artificial Sequence
  Description of Artificial Sequence: Synthetic oligonucleotide
  Target: ATXN1; (+) strand; PAM type: YTN; PAM sequence: CTG
acccctctgaatcccatcac

SEQ ID NO: 257896 - DNA, 20 bp, Artificial Sequence
  Description of Artificial Sequence: Synthetic oligonucleotide
  Target: ATXN1; (+) strand; PAM type: YTN; PAM sequence: CTC
tgaatcccatcacattttca

SEQ ID NO: 257897 - DNA, 20 bp, Artificial Sequence
  Description of Artificial Sequence: Synthetic oligonucleotide
  Target: ATXN1; (+) strand; PAM type: YTN; PAM sequence: CTG
aatcccatcacattttcacc

SEQ ID NO: 257898 - DNA, 20 bp, Artificial Sequence
  Description of Artificial Sequence: Synthetic oligonucleotide
  Target: ATXN1; (+) strand; PAM type: YTN; PAM sequence: TTT
tcaccgcttagttcatggtt

SEQ ID NO: 257899 - DNA, 20 bp, Artificial Sequence
  Description of Artificial Sequence: Synthetic oligonucleotide
  Target: ATXN1; (+) strand; PAM type: YTN; PAM sequence: TTT
caccgcttagttcatggttc

SEQ ID NO: 257900 - DNA, 20 bp, Artificial Sequence
  Description of Artificial Sequence: Synthetic oligonucleotide
  Target: ATXN1; (+) strand; PAM type: YTN; PAM sequence: TTC
accgcttagttcatggttcc

SEQ ID NO: 257901 - DNA, 20 bp, Artificial Sequence
  Description of Artificial Sequence: Synthetic oligonucleotide
  Target: ATXN1; (+) strand; PAM type: YTN; PAM sequence: CTT
agttcatggttcctatctct

SEQ ID NO: 257902 - DNA, 20 bp, Artificial Sequence
  Description of Artificial Sequence: Synthetic oligonucleotide
  Target: ATXN1; (+) strand; PAM type: YTN; PAM sequence: TTA
gttcatggttcctatctctt

SEQ ID NO: 257903 - DNA, 20 bp, Artificial Sequence
  Description of Artificial Sequence: Synthetic oligonucleotide
  Target: ATXN1; (+) strand; PAM type: YTN; PAM sequence: TTC
atggttcctatctcttcctc

SEQ ID NO: 257904 - DNA, 20 bp, Artificial Sequence
  Description of Artificial Sequence: Synthetic oligonucleotide
  Target: ATXN1; (+) strand; PAM type: YTN; PAM sequence: TTC
ctatctcttcctcactgtgt

SEQ ID NO: 257905 - DNA, 20 bp, Artificial Sequence
  Description of Artificial Sequence: Synthetic oligonucleotide
  Target: ATXN1; (+) strand; PAM type: YTN; PAM sequence: CTA
tctcttcctcactgtgttac

SEQ ID NO: 257906 - DNA, 20 bp, Artificial Sequence
  Description of Artificial Sequence: Synthetic oligonucleotide
  Target: ATXN1; (+) strand; PAM type: YTN; PAM sequence: CTC
ttcctcactgtgttacagcc

SEQ ID NO: 257907 - DNA, 20 bp, Artificial Sequence
  Description of Artificial Sequence: Synthetic oligonucleotide
  Target: ATXN1; (+) strand; PAM type: YTN; PAM sequence: CTT
cctcactgtgttacagccga

SEQ ID NO: 257908 - DNA, 20 bp, Artificial Sequence
  Description of Artificial Sequence: Synthetic oligonucleotide
  Target: ATXN1; (+) strand; PAM type: YTN; PAM sequence: TTC
ctcactgtgttacagccgag

SEQ ID NO: 257909 - DNA, 20 bp, Artificial Sequence
  Description of Artificial Sequence: Synthetic oligonucleotide
  Target: ATXN1; (+) strand; PAM type: YTN; PAM sequence: CTC
actgtgttacagccgagctg

SEQ ID NO: 257910 - DNA, 20 bp, Artificial Sequence
  Description of Artificial Sequence: Synthetic oligonucleotide
  Target: ATXN1; (+) strand; PAM type: YTN; PAM sequence: CTG
tgttacagccgagctggtac

SEQ ID NO: 257911 - DNA, 20 bp, Artificial Sequence
  Description of Artificial Sequence: Synthetic oligonucleotide
  Target: ATXN1; (+) strand; PAM type: YTN; PAM sequence: TTA
cagccgagctggtacacact

SEQ ID NO: 257912 - DNA, 20 bp, Artificial Sequence
  Description of Artificial Sequence: Synthetic oligonucleotide
  Target: ATXN1; (+) strand; PAM type: YTN; PAM sequence: CTG
gtacacactggaattcctga

SEQ ID NO: 257913 - DNA, 20 bp, Artificial Sequence
  Description of Artificial Sequence: Synthetic oligonucleotide
  Target: ATXN1; (+) strand; PAM type: YTN; PAM sequence: CTG
gaattcctgaattcctctag

SEQ ID NO: 257914 - DNA, 20 bp, Artificial Sequence
  Description of Artificial Sequence: Synthetic oligonucleotide
  Target: ATXN1; (+) strand; PAM type: YTN; PAM sequence: TTC
ctgaattcctctagtaggcc

SEQ ID NO: 257915 - DNA, 20 bp, Artificial Sequence
  Description of Artificial Sequence: Synthetic oligonucleotide
  Target: ATXN1; (+) strand; PAM type: YTN; PAM sequence: CTG
aattcctctagtaggccttt

SEQ ID NO: 257916 - DNA, 20 bp, Artificial Sequence
  Description of Artificial Sequence: Synthetic oligonucleotide
  Target: ATXN1; (+) strand; PAM type: YTN; PAM sequence: TTC
ctctagtaggcctttagttt

SEQ ID NO: 257917 - DNA, 20 bp, Artificial Sequence
  Description of Artificial Sequence: Synthetic oligonucleotide
  Target: ATXN1; (+) strand; PAM type: YTN; PAM sequence: CTC
tagtaggcctttagtttcca

SEQ ID NO: 257918 - DNA, 20 bp, Artificial Sequence
  Description of Artificial Sequence: Synthetic oligonucleotide
  Target: ATXN1; (+) strand; PAM type: YTN; PAM sequence: CTA
gtaggcctttagtttccata

SEQ ID NO: 257919 - DNA, 20 bp, Artificial Sequence
  Description of Artificial Sequence: Synthetic oligonucleotide
  Target: ATXN1; (+) strand; PAM type: YTN; PAM sequence: CTT
tagtttccataaagcagaaa

SEQ ID NO: 257920 - DNA, 20 bp, Artificial Sequence
  Description of Artificial Sequence: Synthetic oligonucleotide
  Target: ATXN1; (+) strand; PAM type: YTN; PAM sequence: TTT
agtttccataaagcagaaac

SEQ ID NO: 257921 - DNA, 20 bp, Artificial Sequence
  Description of Artificial Sequence: Synthetic oligonucleotide
  Target: ATXN1; (+) strand; PAM type: YTN; PAM sequence: TTA
gtttccataaagcagaaacc

SEQ ID NO: 257922 - DNA, 20 bp, Artificial Sequence
  Description of Artificial Sequence: Synthetic oligonucleotide
  Target: ATXN1; (+) strand; PAM type: YTN; PAM sequence: TTT
ccataaagcagaaaccccat

SEQ ID NO: 257923 - DNA, 20 bp, Artificial Sequence
  Description of Artificial Sequence: Synthetic oligonucleotide
  Target: ATXN1; (+) strand; PAM type: YTN; PAM sequence: TTC
cataaagcagaaaccccata

SEQ ID NO: 257924 - DNA, 20 bp, Artificial Sequence
  Description of Artificial Sequence: Synthetic oligonucleotide
  Target: ATXN1; (+) strand; PAM type: YTN; PAM sequence: TTG
catactcagtagaatgtggc

SEQ ID NO: 257925 - DNA, 20 bp, Artificial Sequence
  Description of Artificial Sequence: Synthetic oligonucleotide
  Target: ATXN1; (+) strand; PAM type: YTN; PAM sequence: CTC
agtagaatgtggcttttatc

SEQ ID NO: 257926 - DNA, 20 bp, Artificial Sequence
  Description of Artificial Sequence: Synthetic oligonucleotide
  Target: ATXN1; (+) strand; PAM type: YTN; PAM sequence: CTT
ttatcttgcatggtgtaggc

SEQ ID NO: 257927 - DNA, 20 bp, Artificial Sequence
  Description of Artificial Sequence: Synthetic oligonucleotide
  Target: ATXN1; (+) strand; PAM type: YTN; PAM sequence: TTT
tatcttgcatggtgtaggct

SEQ ID NO: 257928 - DNA, 20 bp, Artificial Sequence
  Description of Artificial Sequence: Synthetic oligonucleotide
  Target: ATXN1; (+) strand; PAM type: YTN; PAM sequence: TTT
atcttgcatggtgtaggctt

SEQ ID NO: 257929 - DNA, 20 bp, Artificial Sequence
  Description of Artificial Sequence: Synthetic oligonucleotide
  Target: ATXN1; (+) strand; PAM type: YTN; PAM sequence: TTA
tcttgcatggtgtaggcttt

SEQ ID NO: 257930 - DNA, 20 bp, Artificial Sequence
  Description of Artificial Sequence: Synthetic oligonucleotide
  Target: ATXN1; (+) strand; PAM type: YTN; PAM sequence: CTT
gcatggtgtaggcttttaat

SEQ ID NO: 257931 - DNA, 20 bp, Artificial Sequence
  Description of Artificial Sequence: Synthetic oligonucleotide
  Target: ATXN1; (+) strand; PAM type: YTN; PAM sequence: TTG
catggtgtaggcttttaata

SEQ ID NO: 257932 - DNA, 20 bp, Artificial Sequence
  Description of Artificial Sequence: Synthetic oligonucleotide
  Target: ATXN1; (+) strand; PAM type: YTN; PAM sequence: CTT
ttaataagtatttattgaat

SEQ ID NO: 257933 - DNA, 20 bp, Artificial Sequence
  Description of Artificial Sequence: Synthetic oligonucleotide
  Target: ATXN1; (+) strand; PAM type: YTN; PAM sequence: TTT
taataagtatttattgaatg

SEQ ID NO: 257934 - DNA, 20 bp, Artificial Sequence
  Description of Artificial Sequence: Synthetic oligonucleotide
  Target: ATXN1; (+) strand; PAM type: YTN; PAM sequence: TTT
aataagtatttattgaatgg

SEQ ID NO: 257935 - DNA, 20 bp, Artificial Sequence
  Description of Artificial Sequence: Synthetic oligonucleotide
  Target: ATXN1; (+) strand; PAM type: YTN; PAM sequence: TTA
ataagtatttattgaatgga

SEQ ID NO: 257936 - DNA, 20 bp, Artificial Sequence
  Description of Artificial Sequence: Synthetic oligonucleotide
  Target: ATXN1; (+) strand; PAM type: YTN; PAM sequence: TTT
attgaatggatacatgaaga

SEQ ID NO: 257937 - DNA, 20 bp, Artificial Sequence
  Description of Artificial Sequence: Synthetic oligonucleotide
  Target: ATXN1; (+) strand; PAM type: YTN; PAM sequence: TTA
ttgaatggatacatgaagat

SEQ ID NO: 257938 - DNA, 20 bp, Artificial Sequence
  Description of Artificial Sequence: Synthetic oligonucleotide
  Target: ATXN1; (+) strand; PAM type: YTN; PAM sequence: TTG
aatggatacatgaagatatg

SEQ ID NO: 257939 - DNA, 20 bp, Artificial Sequence
  Description of Artificial Sequence: Synthetic oligonucleotide
  Target: ATXN1; (+) strand; PAM type: YTN; PAM sequence: CTG
gggctcaacaggcacctaac

SEQ ID NO: 257940 - DNA, 20 bp, Artificial Sequence
  Description of Artificial Sequence: Synthetic oligonucleotide
  Target: ATXN1; (+) strand; PAM type: YTN; PAM sequence: CTC
aacaggcacctaaccctaca

SEQ ID NO: 257941 - DNA, 20 bp, Artificial Sequence
  Description of Artificial Sequence: Synthetic oligonucleotide
  Target: ATXN1; (+) strand; PAM type: YTN; PAM sequence: CTA
accctacaatatttctaatg

SEQ ID NO: 257942 - DNA, 20 bp, Artificial Sequence
  Description of Artificial Sequence: Synthetic oligonucleotide
  Target: ATXN1; (+) strand; PAM type: YTN; PAM sequence: CTA
caatatttctaatgttttgt

SEQ ID NO: 257943 - DNA, 20 bp, Artificial Sequence
  Description of Artificial Sequence: Synthetic oligonucleotide
  Target: ATXN1; (+) strand; PAM type: YTN; PAM sequence: TTT
ctaatgttttgtcaacttcc

SEQ ID NO: 257944 - DNA, 20 bp, Artificial Sequence
  Description of Artificial Sequence: Synthetic oligonucleotide
  Target: ATXN1; (+) strand; PAM type: YTN; PAM sequence: TTC
taatgttttgtcaacttccc

SEQ ID NO: 257945 - DNA, 20 bp, Artificial Sequence
  Description of Artificial Sequence: Synthetic oligonucleotide
  Target: ATXN1; (+) strand; PAM type: YTN; PAM sequence: CTA
atgttttgtcaacttcccct

SEQ ID NO: 257946 - DNA, 20 bp, Artificial Sequence
  Description of Artificial Sequence: Synthetic oligonucleotide
  Target: ATXN1; (+) strand; PAM type: YTN; PAM sequence: TTT
tgtcaacttcccctaagata

SEQ ID NO: 257947 - DNA, 20 bp, Artificial Sequence
  Description of Artificial Sequence: Synthetic oligonucleotide
  Target: ATXN1; (+) strand; PAM type: YTN; PAM sequence: TTT
gtcaacttcccctaagatat

SEQ ID NO: 257948 - DNA, 20 bp, Artificial Sequence
  Description of Artificial Sequence: Synthetic oligonucleotide
  Target: ATXN1; (+) strand; PAM type: YTN; PAM sequence: TTG
tcaacttcccctaagatatt

SEQ ID NO: 257949 - DNA, 20 bp, Artificial Sequence
  Description of Artificial Sequence: Synthetic oligonucleotide
  Target: ATXN1; (+) strand; PAM type: YTN; PAM sequence: CTT
cccctaagatattattttat

SEQ ID NO: 257950 - DNA, 20 bp, Artificial Sequence
  Description of Artificial Sequence: Synthetic oligonucleotide
  Target: ATXN1; (+) strand; PAM type: YTN; PAM sequence: TTC
ccctaagatattattttatt

SEQ ID NO: 257951 - DNA, 20 bp, Artificial Sequence
  Description of Artificial Sequence: Synthetic oligonucleotide
  Target: ATXN1; (+) strand; PAM type: YTN; PAM sequence: CTA
agatattattttatttattt

SEQ ID NO: 257952 - DNA, 20 bp, Artificial Sequence
  Description of Artificial Sequence: Synthetic oligonucleotide
  Target: ATXN1; (+) strand; PAM type: YTN; PAM sequence: TTA
ttttatttattttttagaga

SEQ ID NO: 257953 - DNA, 20 bp, Artificial Sequence
  Description of Artificial Sequence: Synthetic oligonucleotide
  Target: ATXN1; (+) strand; PAM type: YTN; PAM sequence: TTT
tatttattttttagagatga

SEQ ID NO: 257954 - DNA, 20 bp, Artificial Sequence
  Description of Artificial Sequence: Synthetic oligonucleotide
  Target: ATXN1; (+) strand; PAM type: YTN; PAM sequence: TTT
atttattttttagagatgag

SEQ ID NO: 257955 - DNA, 20 bp, Artificial Sequence
  Description of Artificial Sequence: Synthetic oligonucleotide
  Target: ATXN1; (+) strand; PAM type: YTN; PAM sequence: TTA
tttattttttagagatgagg

SEQ ID NO: 257956 - DNA, 20 bp, Artificial Sequence
  Description of Artificial Sequence: Synthetic oligonucleotide
  Target: ATXN1; (+) strand; PAM type: YTN; PAM sequence: TTT
attttttagagatgaggttt

SEQ ID NO: 257957 - DNA, 20 bp, Artificial Sequence
  Description of Artificial Sequence: Synthetic oligonucleotide
  Target: ATXN1; (+) strand; PAM type: YTN; PAM sequence: TTA
ttttttagagatgaggtttt

SEQ ID NO: 257958 - DNA, 20 bp, Artificial Sequence
  Description of Artificial Sequence: Synthetic oligonucleotide
  Target: ATXN1; (+) strand; PAM type: YTN; PAM sequence: TTT
tttagagatgaggttttgct

SEQ ID NO: 257959 - DNA, 20 bp, Artificial Sequence
  Description of Artificial Sequence: Synthetic oligonucleotide
  Target: ATXN1; (+) strand; PAM type: YTN; PAM sequence: TTT
ttagagatgaggttttgctc

SEQ ID NO: 257960 - DNA, 20 bp, Artificial Sequence
  Description of Artificial Sequence: Synthetic oligonucleotide
  Target: ATXN1; (+) strand; PAM type: YTN; PAM sequence: TTT
tagagatgaggttttgctct

SEQ ID NO: 257961 - DNA, 20 bp, Artificial Sequence
  Description of Artificial Sequence: Synthetic oligonucleotide
  Target: ATXN1; (+) strand; PAM type: YTN; PAM sequence: TTT
agagatgaggttttgctctg

SEQ ID NO: 257962 - DNA, 20 bp, Artificial Sequence
  Description of Artificial Sequence: Synthetic oligonucleotide
  Target: ATXN1; (+) strand; PAM type: YTN; PAM sequence: TTA
gagatgaggttttgctctgt

SEQ ID NO: 257963 - DNA, 20 bp, Artificial Sequence
  Description of Artificial Sequence: Synthetic oligonucleotide
  Target: ATXN1; (+) strand; PAM type: YTN; PAM sequence: TTT
tgctctgttgccgaggctgg

SEQ ID NO: 257964 - DNA, 20 bp, Artificial Sequence
  Description of Artificial Sequence: Synthetic oligonucleotide
  Target: ATXN1; (+) strand; PAM type: YTN; PAM sequence: TTT
gctctgttgccgaggctgga

SEQ ID NO: 257965 - DNA, 20 bp, Artificial Sequence
  Description of Artificial Sequence: Synthetic oligonucleotide
  Target: ATXN1; (+) strand; PAM type: YTN; PAM sequence: TTG
ctctgttgccgaggctggag

SEQ ID NO: 257966 - DNA, 20 bp, Artificial Sequence
  Description of Artificial Sequence: Synthetic oligonucleotide
  Target: ATXN1; (+) strand; PAM type: YTN; PAM sequence: CTC
tgttgccgaggctggagggc

SEQ ID NO: 257967 - DNA, 20 bp, Artificial Sequence
  Description of Artificial Sequence: Synthetic oligonucleotide
  Target: ATXN1; (+) strand; PAM type: YTN; PAM sequence: CTG
ttgccgaggctggagggcag

SEQ ID NO: 257968 - DNA, 20 bp, Artificial Sequence
  Description of Artificial Sequence: Synthetic oligonucleotide
  Target: ATXN1; (+) strand; PAM type: YTN; PAM sequence: TTG
ccgaggctggagggcagtgg

SEQ ID NO: 257969 - DNA, 20 bp, Artificial Sequence
  Description of Artificial Sequence: Synthetic oligonucleotide
  Target: ATXN1; (+) strand; PAM type: YTN; PAM sequence: CTG
gagggcagtggtgtaatcat

SEQ ID NO: 257970 - DNA, 20 bp, Artificial Sequence
  Description of Artificial Sequence: Synthetic oligonucleotide
  Target: ATXN1; (+) strand; PAM type: YTN; PAM sequence: CTG
cagccttgaactgctgggct

SEQ ID NO: 257971 - DNA, 20 bp, Artificial Sequence
  Description of Artificial Sequence: Synthetic oligonucleotide
  Target: ATXN1; (+) strand; PAM type: YTN; PAM sequence: CTT
gaactgctgggctcaagtga

SEQ ID NO: 257972 - DNA, 20 bp, Artificial Sequence
  Description of Artificial Sequence: Synthetic oligonucleotide
  Target: ATXN1; (+) strand; PAM type: YTN; PAM sequence: TTG
aactgctgggctcaagtgat

SEQ ID NO: 257973 - DNA, 20 bp, Artificial Sequence
  Description of Artificial Sequence: Synthetic oligonucleotide
  Target: ATXN1; (+) strand; PAM type: YTN; PAM sequence: CTG
ctgggctcaagtgattctcc

SEQ ID NO: 257974 - DNA, 20 bp, Artificial Sequence
  Description of Artificial Sequence: Synthetic oligonucleotide
  Target: ATXN1; (+) strand; PAM type: YTN; PAM sequence: CTG
ggctcaagtgattctcccac

SEQ ID NO: 257975 - DNA, 20 bp, Artificial Sequence
  Description of Artificial Sequence: Synthetic oligonucleotide
  Target: ATXN1; (+) strand; PAM type: YTN; PAM sequence: CTC
aagtgattctcccacctcag

SEQ ID NO: 257976 - DNA, 20 bp, Artificial Sequence
  Description of Artificial Sequence: Synthetic oligonucleotide
  Target: ATXN1; (+) strand; PAM type: YTN; PAM sequence: TTC
tcccacctcagcttccccag

SEQ ID NO: 257977 - DNA, 20 bp, Artificial Sequence
  Description of Artificial Sequence: Synthetic oligonucleotide
  Target: ATXN1; (+) strand; PAM type: YTN; PAM sequence: CTC
ccacctcagcttccccagta

SEQ ID NO: 257978 - DNA, 20 bp, Artificial Sequence
  Description of Artificial Sequence: Synthetic oligonucleotide
  Target: ATXN1; (+) strand; PAM type: YTN; PAM sequence: CTC
agcttccccagtacctggga

SEQ ID NO: 257979 - DNA, 20 bp, Artificial Sequence
  Description of Artificial Sequence: Synthetic oligonucleotide
  Target: ATXN1; (+) strand; PAM type: YTN; PAM sequence: CTT
ccccagtacctgggactaca

SEQ ID NO: 257980 - DNA, 20 bp, Artificial Sequence
  Description of Artificial Sequence: Synthetic oligonucleotide
  Target: ATXN1; (+) strand; PAM type: YTN; PAM sequence: TTC
cccagtacctgggactacag

SEQ ID NO: 257981 - DNA, 20 bp, Artificial Sequence
  Description of Artificial Sequence: Synthetic oligonucleotide
  Target: ATXN1; (+) strand; PAM type: YTN; PAM sequence: CTG
ggactacaggtatgcatcac

SEQ ID NO: 257982 - DNA, 20 bp, Artificial Sequence
  Description of Artificial Sequence: Synthetic oligonucleotide
  Target: ATXN1; (+) strand; PAM type: YTN; PAM sequence: CTA
caggtatgcatcaccatgct

SEQ ID NO: 257983 - DNA, 20 bp, Artificial Sequence
  Description of Artificial Sequence: Synthetic oligonucleotide
  Target: ATXN1; (+) strand; PAM type: YTN; PAM sequence: CTA
ggctacttaaaaaaaaattt

SEQ ID NO: 257984 - DNA, 20 bp, Artificial Sequence
  Description of Artificial Sequence: Synthetic oligonucleotide
  Target: ATXN1; (+) strand; PAM type: YTN; PAM sequence: CTA
cttaaaaaaaaattttcttt

SEQ ID NO: 257985 - DNA, 20 bp, Artificial Sequence
  Description of Artificial Sequence: Synthetic oligonucleotide
  Target: ATXN1; (+) strand; PAM type: YTN; PAM sequence: CTT
aaaaaaaaattttcttttga

SEQ ID NO: 257986 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaattttcttttgag

SEQ ID NO: 257987 - DNA, 20 bp, Artificial Sequence
  Description of Artificial Sequence: Synthetic oligonucleotide
  Target: ATXN1; (+) strand; PAM type: YTN; PAM sequence: TTT
tcttttgagacagggtctca

SEQ ID NO: 257988 - DNA, 20 bp, Artificial Sequence
  Description of Artificial Sequence: Synthetic oligonucleotide
  Target: ATXN1; (+) strand; PAM type: YTN; PAM sequence: TTT
cttttgagacagggtctcac

SEQ ID NO: 257989 - DNA, 20 bp, Artificial Sequence
  Description of Artificial Sequence: Synthetic oligonucleotide
  Target: ATXN1; (+) strand; PAM type: YTN; PAM sequence: TTC
ttttgagacagggtctcact

SEQ ID NO: 257990 - DNA, 20 bp, Artificial Sequence
  Description of Artificial Sequence: Synthetic oligonucleotide
  Target: ATXN1; (+) strand; PAM type: YTN; PAM sequence: CTT
ttgagacagggtctcactat

SEQ ID NO: 257991 - DNA, 20 bp, Artificial Sequence
  Description of Artificial Sequence: Synthetic oligonucleotide
  Target: ATXN1; (+) strand; PAM type: YTN; PAM sequence: TTT
tgagacagggtctcactatg

SEQ ID NO: 257992 - DNA, 20 bp, Artificial Sequence
  Description of Artificial Sequence: Synthetic oligonucleotide
  Target: ATXN1; (+) strand; PAM type: YTN; PAM sequence: TTT
gagacagggtctcactatgt

SEQ ID NO: 257993 - DNA, 20 bp, Artificial Sequence
  Description of Artificial Sequence: Synthetic oligonucleotide
  Target: ATXN1; (+) strand; PAM type: YTN; PAM sequence: TTG
agacagggtctcactatgtt

SEQ ID NO: 257994 - DNA, 20 bp, Artificial Sequence
  Description of Artificial Sequence: Synthetic oligonucleotide
  Target: ATXN1; (+) strand; PAM type: YTN; PAM sequence: CTC
actatgttgcccaggctggt

SEQ ID NO: 257995 - DNA, 20 bp, Artificial Sequence
  Description of Artificial Sequence: Synthetic oligonucleotide
  Target: ATXN1; (+) strand; PAM type: YTN; PAM sequence: CTA
tgttgcccaggctggtcttt

SEQ ID NO: 257996 - DNA, 20 bp, Artificial Sequence
  Description of Artificial Sequence: Synthetic oligonucleotide
  Target: ATXN1; (+) strand; PAM type: YTN; PAM sequence: TTG
cccaggctggtctttaactt

SEQ ID NO: 257997 - DNA, 20 bp, Artificial Sequence
  Description of Artificial Sequence: Synthetic oligonucleotide
  Target: ATXN1; (+) strand; PAM type: YTN; PAM sequence: CTG
gtctttaacttctgacctta

SEQ ID NO: 257998 - DNA, 20 bp, Artificial Sequence
  Description of Artificial Sequence: Synthetic oligonucleotide
  Target: ATXN1; (+) strand; PAM type: YTN; PAM sequence: CTT
taacttctgaccttaggcaa

SEQ ID NO: 257999 - DNA, 20 bp, Artificial Sequence
  Description of Artificial Sequence: Synthetic oligonucleotide
  Target: ATXN1; (+) strand; PAM type: YTN; PAM sequence: TTT
aacttctgaccttaggcaat

SEQ ID NO: 258000 - DNA, 20 bp, Artificial Sequence
  Description of Artificial Sequence: Synthetic oligonucleotide
  Target: ATXN1; (+) strand; PAM type: YTN; PAM sequence: TTA
acttctgaccttaggcaatc

SEQ ID NO: 258001 - DNA, 20 bp, Artificial Sequence
  Description of Artificial Sequence: Synthetic oligonucleotide
  Target: ATXN1; (+) strand; PAM type: YTN; PAM sequence: CTT
ctgaccttaggcaatcctcc

SEQ ID NO: 258002 - DNA, 20 bp, Artificial Sequence
  Description of Artificial Sequence: Synthetic oligonucleotide
  Target: ATXN1; (+) strand; PAM type: YTN; PAM sequence: TTC
tgaccttaggcaatcctcct

SEQ ID NO: 258003 - DNA, 20 bp, Artificial Sequence
  Description of Artificial Sequence: Synthetic oligonucleotide
  Target: ATXN1; (+) strand; PAM type: YTN; PAM sequence: CTG
accttaggcaatcctcctgc

SEQ ID NO: 258004 - DNA, 20 bp, Artificial Sequence
  Description of Artificial Sequence: Synthetic oligonucleotide
  Target: ATXN1; (+) strand; PAM type: YTN; PAM sequence: CTT
aggcaatcctcctgcctcag

SEQ ID NO: 258005 - DNA, 20 bp, Artificial Sequence
  Description of Artificial Sequence: Synthetic oligonucleotide
  Target: ATXN1; (+) strand; PAM type: YTN; PAM sequence: TTA
ggcaatcctcctgcctcagc

SEQ ID NO: 258006 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccaagtc

SEQ ID NO: 258007 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaagtcact

SEQ ID NO: 258008 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtcactggga

SEQ ID NO: 258009 - DNA, 20 bp, Artificial Sequence
  Description of Artificial Sequence: Synthetic oligonucleotide
  Target: ATXN1; (+) strand; PAM type: YTN; PAM sequence: CTC
ccaagtcactgggattacag

SEQ ID NO: 258010 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgcaagccac

SEQ ID NO: 258011 - DNA, 20 bp, Artificial Sequence
  Description of Artificial Sequence: Synthetic oligonucleotide
  Target: ATXN1; (+) strand; PAM type: YTN; PAM sequence: TTA
caggcgcaagccaccacacc

SEQ ID NO: 258012 - DNA, 20 bp, Artificial Sequence
  Description of Artificial Sequence: Synthetic oligonucleotide
  Target: ATXN1; (+) strand; PAM type: YTN; PAM sequence: TTT
ccaagttatggcttttaatg

SEQ ID NO: 258013 - DNA, 20 bp, Artificial Sequence
  Description of Artificial Sequence: Synthetic oligonucleotide
  Target: ATXN1; (+) strand; PAM type: YTN; PAM sequence: TTC
caagttatggcttttaatgg

SEQ ID NO: 258014 - DNA, 20 bp, Artificial Sequence
  Description of Artificial Sequence: Synthetic oligonucleotide
  Target: ATXN1; (+) strand; PAM type: YTN; PAM sequence: TTA
tggcttttaatggaaagcag

SEQ ID NO: 258015 - DNA, 20 bp, Artificial Sequence
  Description of Artificial Sequence: Synthetic oligonucleotide
  Target: ATXN1; (+) strand; PAM type: YTN; PAM sequence: CTT
ttaatggaaagcagaataag

SEQ ID NO: 258016 - DNA, 20 bp, Artificial Sequence
  Description of Artificial Sequence: Synthetic oligonucleotide
  Target: ATXN1; (+) strand; PAM type: YTN; PAM sequence: TTT
taatggaaagcagaataaga

SEQ ID NO: 258017 - DNA, 20 bp, Artificial Sequence
  Description of Artificial Sequence: Synthetic oligonucleotide
  Target: ATXN1; (+) strand; PAM type: YTN; PAM sequence: TTT
aatggaaagcagaataagaa

SEQ ID NO: 258018 - DNA, 20 bp, Artificial Sequence
  Description of Artificial Sequence: Synthetic oligonucleotide
  Target: ATXN1; (+) strand; PAM type: YTN; PAM sequence: TTA
atggaaagcagaataagaaa

SEQ ID NO: 258019 - DNA, 20 bp, Artificial Sequence
  Description of Artificial Sequence: Synthetic oligonucleotide
  Target: ATXN1; (+) strand; PAM type: YTN; PAM sequence: CTT
tcctgatgtctacttcatca

SEQ ID NO: 258020 - DNA, 20 bp, Artificial Sequence
  Description of Artificial Sequence: Synthetic oligonucleotide
  Target: ATXN1; (+) strand; PAM type: YTN; PAM sequence: TTT
cctgatgtctacttcatcaa

SEQ ID NO: 258021 - DNA, 20 bp, Artificial Sequence
  Description of Artificial Sequence: Synthetic oligonucleotide
  Target: ATXN1; (+) strand; PAM type: YTN; PAM sequence: TTC
ctgatgtctacttcatcaag

SEQ ID NO: 258022 - DNA, 20 bp, Artificial Sequence
  Description of Artificial Sequence: Synthetic oligonucleotide
  Target: ATXN1; (+) strand; PAM type: YTN; PAM sequence: CTG
atgtctacttcatcaagtag

SEQ ID NO: 258023 - DNA, 20 bp, Artificial Sequence
  Description of Artificial Sequence: Synthetic oligonucleotide
  Target: ATXN1; (+) strand; PAM type: YTN; PAM sequence: CTA
cttcatcaagtagagagagg

SEQ ID NO: 258024 - DNA, 20 bp, Artificial Sequence
  Description of Artificial Sequence: Synthetic oligonucleotide
  Target: ATXN1; (+) strand; PAM type: YTN; PAM sequence: CTT
catcaagtagagagagggag

SEQ ID NO: 258025 - DNA, 20 bp, Artificial Sequence
  Description of Artificial Sequence: Synthetic oligonucleotide
  Target: ATXN1; (+) strand; PAM type: YTN; PAM sequence: TTC
atcaagtagagagagggagt

SEQ ID NO: 258026 - DNA, 20 bp, Artificial Sequence
  Description of Artificial Sequence: Synthetic oligonucleotide
  Target: ATXN1; (+) strand; PAM type: YTN; PAM sequence: TTA
caagtttcttattttttttt

SEQ ID NO: 258027 - DNA, 20 bp, Artificial Sequence
  Description of Artificial Sequence: Synthetic oligonucleotide
  Target: ATXN1; (+) strand; PAM type: YTN; PAM sequence: TTT
cttattttttttttttcttg

SEQ ID NO: 258028 - DNA, 20 bp, Artificial Sequence
  Description of Artificial Sequence: Synthetic oligonucleotide
  Target: ATXN1; (+) strand; PAM type: YTN; PAM sequence: TTC
ttattttttttttttcttga

SEQ ID NO: 258029 - DNA, 20 bp, Artificial Sequence
  Description of Artificial Sequence: Synthetic oligonucleotide
  Target: ATXN1; (+) strand; PAM type: YTN; PAM sequence: CTT
attttttttttttcttgaga

SEQ ID NO: 258030 - DNA, 20 bp, Artificial Sequence
  Description of Artificial Sequence: Synthetic oligonucleotide
  Target: ATXN1; (+) strand; PAM type: YTN; PAM sequence: TTA
ttttttttttttcttgagac

SEQ ID NO: 258031 - DNA, 20 bp, Artificial Sequence
  Description of Artificial Sequence: Synthetic oligonucleotide
  Target: ATXN1; (+) strand; PAM type: YTN; PAM sequence: TTT
tttttttttcttgagacgga

SEQ ID NO: 258032 - DNA, 20 bp, Artificial Sequence
  Description of Artificial Sequence: Synthetic oligonucleotide
  Target: ATXN1; (+) strand; PAM type: YTN; PAM sequence: TTT
ttttttttcttgagacggag

SEQ ID NO: 258033 - DNA, 20 bp, Artificial Sequence
  Description of Artificial Sequence: Synthetic oligonucleotide
  Target: ATXN1; (+) strand; PAM type: YTN; PAM sequence: TTT
tttttttcttgagacggagt

SEQ ID NO: 258034 - DNA, 20 bp, Artificial Sequence
  Description of Artificial Sequence: Synthetic oligonucleotide
  Target: ATXN1; (+) strand; PAM type: YTN; PAM sequence: TTT
ttttttcttgagacggagtc

SEQ ID NO: 258035 - DNA, 20 bp, Artificial Sequence
  Description of Artificial Sequence: Synthetic oligonucleotide
  Target: ATXN1; (+) strand; PAM type: YTN; PAM sequence: TTT
tttttcttgagacggagtct

SEQ ID NO: 258036 - DNA, 20 bp, Artificial Sequence
  Description of Artificial Sequence: Synthetic oligonucleotide
  Target: ATXN1; (+) strand; PAM type: YTN; PAM sequence: TTT
ttttcttgagacggagtctt

SEQ ID NO: 258037 - DNA, 20 bp, Artificial Sequence
  Description of Artificial Sequence: Synthetic oligonucleotide
  Target: ATXN1; (+) strand; PAM type: YTN; PAM sequence: TTT
tttcttgagacggagtcttg

SEQ ID NO: 258038 - DNA, 20 bp, Artificial Sequence
  Description of Artificial Sequence: Synthetic oligonucleotide
  Target: ATXN1; (+) strand; PAM type: YTN; PAM sequence: TTT
ttcttgagacggagtcttgc

SEQ ID NO: 258039 - DNA, 20 bp, Artificial Sequence
  Description of Artificial Sequence: Synthetic oligonucleotide
  Target: ATXN1; (+) strand; PAM type: YTN; PAM sequence: TTT
tcttgagacggagtcttgct

SEQ ID NO: 258040 - DNA, 20 bp, Artificial Sequence
  Description of Artificial Sequence: Synthetic oligonucleotide
  Target: ATXN1; (+) strand; PAM type: YTN; PAM sequence: TTT
cttgagacggagtcttgctc

SEQ ID NO: 258041 - DNA, 20 bp, Artificial Sequence
  Description of Artificial Sequence: Synthetic oligonucleotide
  Target: ATXN1; (+) strand; PAM type: YTN; PAM sequence: TTC
ttgagacggagtcttgctct

SEQ ID NO: 258042 - DNA, 20 bp, Artificial Sequence
  Description of Artificial Sequence: Synthetic oligonucleotide
  Target: ATXN1; (+) strand; PAM type: YTN; PAM sequence: CTT
gagacggagtcttgctctgt

SEQ ID NO: 258043 - DNA, 20 bp, Artificial Sequence
  Description of Artificial Sequence: Synthetic oligonucleotide
  Target: ATXN1; (+) strand; PAM type: YTN; PAM sequence: TTG
agacggagtcttgctctgtc

SEQ ID NO: 258044 - DNA, 20 bp, Artificial Sequence
  Description of Artificial Sequence: Synthetic oligonucleotide
  Target: ATXN1; (+) strand; PAM type: YTN; PAM sequence: CTT
gctctgtcacccaggctgga

SEQ ID NO: 258045 - DNA, 20 bp, Artificial Sequence
  Description of Artificial Sequence: Synthetic oligonucleotide
  Target: ATXN1; (+) strand; PAM type: YTN; PAM sequence: TTG
ctctgtcacccaggctggag

SEQ ID NO: 258046 - DNA, 20 bp, Artificial Sequence
  Description of Artificial Sequence: Synthetic oligonucleotide
  Target: ATXN1; (+) strand; PAM type: YTN; PAM sequence: CTC
tgtcacccaggctggagagc

SEQ ID NO: 258047 - DNA, 20 bp, Artificial Sequence
  Description of Artificial Sequence: Synthetic oligonucleotide
  Target: ATXN1; (+) strand; PAM type: YTN; PAM sequence: CTG
tcacccaggctggagagcag

SEQ ID NO: 258048 - DNA, 20 bp, Artificial Sequence
  Description of Artificial Sequence: Synthetic oligonucleotide
  Target: ATXN1; (+) strand; PAM type: YTN; PAM sequence: CTG
gagagcagtggcacgatctc

SEQ ID NO: 258049 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcaagctccgcc

SEQ ID NO: 258050 - DNA, 20 bp, Artificial Sequence
  Description of Artificial Sequence: Synthetic oligonucleotide
  Target: ATXN1; (+) strand; PAM type: YTN; PAM sequence: CTC
actgcaagctccgcctccca

SEQ ID NO: 258051 - DNA, 20 bp, Artificial Sequence
  Description of Artificial Sequence: Synthetic oligonucleotide
  Target: ATXN1; (+) strand; PAM type: YTN; PAM sequence: CTG
caagctccgcctcccaggtt

SEQ ID NO: 258052 - DNA, 20 bp, Artificial Sequence
  Description of Artificial Sequence: Synthetic oligonucleotide
  Target: ATXN1; (+) strand; PAM type: YTN; PAM sequence: CTC
cgcctcccaggttcaagcga

SEQ ID NO: 258053 - DNA, 20 bp, Artificial Sequence
  Description of Artificial Sequence: Synthetic oligonucleotide
  Target: ATXN1; (+) strand; PAM type: YTN; PAM sequence: CTC
ccaggttcaagcgattgtcc

SEQ ID NO: 258054 - DNA, 20 bp, Artificial Sequence
  Description of Artificial Sequence: Synthetic oligonucleotide
  Target: ATXN1; (+) strand; PAM type: YTN; PAM sequence: TTC
aagcgattgtcctgcctcag

SEQ ID NO: 258055 - DNA, 20 bp, Artificial Sequence
  Description of Artificial Sequence: Synthetic oligonucleotide
  Target: ATXN1; (+) strand; PAM type: YTN; PAM sequence: TTG
tcctgcctcagcctcccgag

SEQ ID NO: 258056 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccgagtagct

SEQ ID NO: 258057 - DNA, 20 bp, Artificial Sequence
  Description of Artificial Sequence: Synthetic oligonucleotide
  Target: ATXN1; (+) strand; PAM type: YTN; PAM sequence: CTC
agcctcccgagtagctagga

SEQ ID NO: 258058 - DNA, 20 bp, Artificial Sequence
  Description of Artificial Sequence: Synthetic oligonucleotide
  Target: ATXN1; (+) strand; PAM type: YTN; PAM sequence: CTC
ccgagtagctaggactacag

SEQ ID NO: 258059 - DNA, 20 bp, Artificial Sequence
  Description of Artificial Sequence: Synthetic oligonucleotide
  Target: ATXN1; (+) strand; PAM type: YTN; PAM sequence: CTA
ggactacaggcgcccaccac

SEQ ID NO: 258060 - DNA, 20 bp, Artificial Sequence
  Description of Artificial Sequence: Synthetic oligonucleotide
  Target: ATXN1; (+) strand; PAM type: YTN; PAM sequence: CTA
caggcgcccaccaccatacc

SEQ ID NO: 258061 - DNA, 20 bp, Artificial Sequence
  Description of Artificial Sequence: Synthetic oligonucleotide
  Target: ATXN1; (+) strand; PAM type: YTN; PAM sequence: CTG
gctaattttttgtatattta

SEQ ID NO: 258062 - DNA, 20 bp, Artificial Sequence
  Description of Artificial Sequence: Synthetic oligonucleotide
  Target: ATXN1; (+) strand; PAM type: YTN; PAM sequence: CTA
attttttgtatatttactag

SEQ ID NO: 258063 - DNA, 20 bp, Artificial Sequence
  Description of Artificial Sequence: Synthetic oligonucleotide
  Target: ATXN1; (+) strand; PAM type: YTN; PAM sequence: TTT
tttgtatatttactagagac

SEQ ID NO: 258064 - DNA, 20 bp, Artificial Sequence
  Description of Artificial Sequence: Synthetic oligonucleotide
  Target: ATXN1; (+) strand; PAM type: YTN; PAM sequence: TTT
ttgtatatttactagagacg

SEQ ID NO: 258065 - DNA, 20 bp, Artificial Sequence
  Description of Artificial Sequence: Synthetic oligonucleotide
  Target: ATXN1; (+) strand; PAM type: YTN; PAM sequence: TTT
tgtatatttactagagacgg

SEQ ID NO: 258066 - DNA, 20 bp, Artificial Sequence
  Description of Artificial Sequence: Synthetic oligonucleotide
  Target: ATXN1; (+) strand; PAM type: YTN; PAM sequence: TTT
gtatatttactagagacggg

SEQ ID NO: 258067 - DNA, 20 bp, Artificial Sequence
  Description of Artificial Sequence: Synthetic oligonucleotide
  Target: ATXN1; (+) strand; PAM type: YTN; PAM sequence: TTG
tatatttactagagacgggg

SEQ ID NO: 258068 - DNA, 20 bp, Artificial Sequence
  Description of Artificial Sequence: Synthetic oligonucleotide
  Target: ATXN1; (+) strand; PAM type: YTN; PAM sequence: TTT
actagagacggggtttcgcc

SEQ ID NO: 258069 - DNA, 20 bp, Artificial Sequence
  Description of Artificial Sequence: Synthetic oligonucleotide
  Target: ATXN1; (+) strand; PAM type: YTN; PAM sequence: TTA
ctagagacggggtttcgcca

SEQ ID NO: 258070 - DNA, 20 bp, Artificial Sequence
  Description of Artificial Sequence: Synthetic oligonucleotide
  Target: ATXN1; (+) strand; PAM type: YTN; PAM sequence: CTA
gagacggggtttcgccatat

SEQ ID NO: 258071 - DNA, 20 bp, Artificial Sequence
  Description of Artificial Sequence: Synthetic oligonucleotide
  Target: ATXN1; (+) strand; PAM type: YTN; PAM sequence: TTT
cgccatattagccaggatgg

SEQ ID NO: 258072 - DNA, 20 bp, Artificial Sequence
  Description of Artificial Sequence: Synthetic oligonucleotide
  Target: ATXN1; (+) strand; PAM type: YTN; PAM sequence: TTC
gccatattagccaggatggt

SEQ ID NO: 258073 - DNA, 20 bp, Artificial Sequence
  Description of Artificial Sequence: Synthetic oligonucleotide
  Target: ATXN1; (+) strand; PAM type: YTN; PAM sequence: TTA
gccaggatggtctcgatctc

SEQ ID NO: 258074 - DNA, 20 bp, Artificial Sequence
  Description of Artificial Sequence: Synthetic oligonucleotide
  Target: ATXN1; (+) strand; PAM type: YTN; PAM sequence: CTC
gatctcctgacctcgtgatc

SEQ ID NO: 258075 - DNA, 20 bp, Artificial Sequence
  Description of Artificial Sequence: Synthetic oligonucleotide
  Target: ATXN1; (+) strand; PAM type: YTN; PAM sequence: CTC
ctgacctcgtgatccccctg

SEQ ID NO: 258076 - DNA, 20 bp, Artificial Sequence
  Description of Artificial Sequence: Synthetic oligonucleotide
  Target: ATXN1; (+) strand; PAM type: YTN; PAM sequence: CTG
acctcgtgatccccctgcct

SEQ ID NO: 258077 - DNA, 20 bp, Artificial Sequence
  Description of Artificial Sequence: Synthetic oligonucleotide
  Target: ATXN1; (+) strand; PAM type: YTN; PAM sequence: CTC
gtgatccccctgcctcggcc

SEQ ID NO: 258078 - DNA, 20 bp, Artificial Sequence
  Description of Artificial Sequence: Synthetic oligonucleotide
  Target: ATXN1; (+) strand; PAM type: YTN; PAM sequence: CTG
cctcggcctcccaaagtgct

SEQ ID NO: 258079 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaagtgctggga

SEQ ID NO: 258080 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggactatag

SEQ ID NO: 258081 - DNA, 20 bp, Artificial Sequence
  Description of Artificial Sequence: Synthetic oligonucleotide
  Target: ATXN1; (+) strand; PAM type: YTN; PAM sequence: CTG
ggactataggcgtgagccac

SEQ ID NO: 258082 - DNA, 20 bp, Artificial Sequence
  Description of Artificial Sequence: Synthetic oligonucleotide
  Target: ATXN1; (+) strand; PAM type: YTN; PAM sequence: CTA
taggcgtgagccaccacacg

SEQ ID NO: 258083 - DNA, 20 bp, Artificial Sequence
  Description of Artificial Sequence: Synthetic oligonucleotide
  Target: ATXN1; (+) strand; PAM type: YTN; PAM sequence: CTT
tttttttaatggcctaatct

SEQ ID NO: 258084 - DNA, 20 bp, Artificial Sequence
  Description of Artificial Sequence: Synthetic oligonucleotide
  Target: ATXN1; (+) strand; PAM type: YTN; PAM sequence: TTT
ttttttaatggcctaatctg

SEQ ID NO: 258085 - DNA, 20 bp, Artificial Sequence
  Description of Artificial Sequence: Synthetic oligonucleotide
  Target: ATXN1; (+) strand; PAM type: YTN; PAM sequence: TTT
tttttaatggcctaatctgt

SEQ ID NO: 258086 - DNA, 20 bp, Artificial Sequence
  Description of Artificial Sequence: Synthetic oligonucleotide
  Target: ATXN1; (+) strand; PAM type: YTN; PAM sequence: TTT
ttttaatggcctaatctgtt

SEQ ID NO: 258087 - DNA, 20 bp, Artificial Sequence
  Description of Artificial Sequence: Synthetic oligonucleotide
  Target: ATXN1; (+) strand; PAM type: YTN; PAM sequence: TTT
tttaatggcctaatctgttt

SEQ ID NO: 258088 - DNA, 20 bp, Artificial Sequence
  Description of Artificial Sequence: Synthetic oligonucleotide
  Target: ATXN1; (+) strand; PAM type: YTN; PAM sequence: TTT
ttaatggcctaatctgtttc

SEQ ID NO: 258089 - DNA, 20 bp, Artificial Sequence
  Description of Artificial Sequence: Synthetic oligonucleotide
  Target: ATXN1; (+) strand; PAM type: YTN; PAM sequence: TTT
taatggcctaatctgtttct

SEQ ID NO: 258090 - DNA, 20 bp, Artificial Sequence
  Description of Artificial Sequence: Synthetic oligonucleotide
  Target: ATXN1; (+) strand; PAM type: YTN; PAM sequence: TTT
aatggcctaatctgtttctc

SEQ ID NO: 258091 - DNA, 20 bp, Artificial Sequence
  Description of Artificial Sequence: Synthetic oligonucleotide
  Target: ATXN1; (+) strand; PAM type: YTN; PAM sequence: TTA
atggcctaatctgtttctca

SEQ ID NO: 258092 - DNA, 20 bp, Artificial Sequence
  Description of Artificial Sequence: Synthetic oligonucleotide
  Target: ATXN1; (+) strand; PAM type: YTN; PAM sequence: CTA
atctgtttctcagcatacga

SEQ ID NO: 258093 - DNA, 20 bp, Artificial Sequence
  Description of Artificial Sequence: Synthetic oligonucleotide
  Target: ATXN1; (+) strand; PAM type: YTN; PAM sequence: CTG
tttctcagcatacgaacact

SEQ ID NO: 258094 - DNA, 20 bp, Artificial Sequence
  Description of Artificial Sequence: Synthetic oligonucleotide
  Target: ATXN1; (+) strand; PAM type: YTN; PAM sequence: TTT
ctcagcatacgaacactgta

SEQ ID NO: 258095 - DNA, 20 bp, Artificial Sequence
  Description of Artificial Sequence: Synthetic oligonucleotide
  Target: ATXN1; (+) strand; PAM type: YTN; PAM sequence: TTC
tcagcatacgaacactgtat

SEQ ID NO: 258096 - DNA, 20 bp, Artificial Sequence
  Description of Artificial Sequence: Synthetic oligonucleotide
  Target: ATXN1; (+) strand; PAM type: YTN; PAM sequence: CTC
agcatacgaacactgtatct

SEQ ID NO: 258097 - DNA, 20 bp, Artificial Sequence
  Description of Artificial Sequence: Synthetic oligonucleotide
  Target: ATXN1; (+) strand; PAM type: YTN; PAM sequence: CTG
tatctcactcccagacaact

SEQ ID NO: 258098 - DNA, 20 bp, Artificial Sequence
  Description of Artificial Sequence: Synthetic oligonucleotide
  Target: ATXN1; (+) strand; PAM type: YTN; PAM sequence: CTC
actcccagacaactgatgcc

SEQ ID NO: 258099 - DNA, 20 bp, Artificial Sequence
  Description of Artificial Sequence: Synthetic oligonucleotide
  Target: ATXN1; (+) strand; PAM type: YTN; PAM sequence: CTC
ccagacaactgatgccattc

SEQ ID NO: 258100 - DNA, 20 bp, Artificial Sequence
  Description of Artificial Sequence: Synthetic oligonucleotide
  Target: ATXN1; (+) strand; PAM type: YTN; PAM sequence: CTG
atgccattcatgcttgaaga

SEQ ID NO: 258101 - DNA, 20 bp, Artificial Sequence
  Description of Artificial Sequence: Synthetic oligonucleotide
  Target: ATXN1; (+) strand; PAM type: YTN; PAM sequence: TTC
atgcttgaagaagaaatcca

SEQ ID NO: 258102 - DNA, 20 bp, Artificial Sequence
  Description of Artificial Sequence: Synthetic oligonucleotide
  Target: ATXN1; (+) strand; PAM type: YTN; PAM sequence: CTT
gaagaagaaatccatgacca

SEQ ID NO: 258103 - DNA, 20 bp, Artificial Sequence
  Description of Artificial Sequence: Synthetic oligonucleotide
  Target: ATXN1; (+) strand; PAM type: YTN; PAM sequence: TTG
aagaagaaatccatgaccag

SEQ ID NO: 258104 - DNA, 20 bp, Artificial Sequence
  Description of Artificial Sequence: Synthetic oligonucleotide
  Target: ATXN1; (+) strand; PAM type: YTN; PAM sequence: CTA
aatataaaggcagttttcta

SEQ ID NO: 258105 - DNA, 20 bp, Artificial Sequence
  Description of Artificial Sequence: Synthetic oligonucleotide
  Target: ATXN1; (+) strand; PAM type: YTN; PAM sequence: TTT
tctacctgccactaccctag

SEQ ID NO: 258106 - DNA, 20 bp, Artificial Sequence
  Description of Artificial Sequence: Synthetic oligonucleotide
  Target: ATXN1; (+) strand; PAM type: YTN; PAM sequence: TTT
ctacctgccactaccctagt

SEQ ID NO: 258107 - DNA, 20 bp, Artificial Sequence
  Description of Artificial Sequence: Synthetic oligonucleotide
  Target: ATXN1; (+) strand; PAM type: YTN; PAM sequence: TTC
tacctgccactaccctagtt

SEQ ID NO: 258108 - DNA, 20 bp, Artificial Sequence
  Description of Artificial Sequence: Synthetic oligonucleotide
  Target: ATXN1; (+) strand; PAM type: YTN; PAM sequence: CTA
cctgccactaccctagttca

SEQ ID NO: 258109 - DNA, 20 bp, Artificial Sequence
  Description of Artificial Sequence: Synthetic oligonucleotide
  Target: ATXN1; (+) strand; PAM type: YTN; PAM sequence: CTG
ccactaccctagttcatcct

SEQ ID NO: 258110 - DNA, 20 bp, Artificial Sequence
  Description of Artificial Sequence: Synthetic oligonucleotide
  Target: ATXN1; (+) strand; PAM type: YTN; PAM sequence: CTA
ccctagttcatcctcgaaga

SEQ ID NO: 258111 - DNA, 20 bp, Artificial Sequence
  Description of Artificial Sequence: Synthetic oligonucleotide
  Target: ATXN1; (+) strand; PAM type: YTN; PAM sequence: CTA
gttcatcctcgaagatttgg

SEQ ID NO: 258112 - DNA, 20 bp, Artificial Sequence
  Description of Artificial Sequence: Synthetic oligonucleotide
  Target: ATXN1; (+) strand; PAM type: YTN; PAM sequence: TTC
atcctcgaagatttggttca

SEQ ID NO: 258113 - DNA, 20 bp, Artificial Sequence
  Description of Artificial Sequence: Synthetic oligonucleotide
  Target: ATXN1; (+) strand; PAM type: YTN; PAM sequence: CTC
gaagatttggttcaaaagtt

SEQ ID NO: 258114 - DNA, 20 bp, Artificial Sequence
  Description of Artificial Sequence: Synthetic oligonucleotide
  Target: ATXN1; (+) strand; PAM type: YTN; PAM sequence: TTT
ggttcaaaagttagcctctc

SEQ ID NO: 258115 - DNA, 20 bp, Artificial Sequence
  Description of Artificial Sequence: Synthetic oligonucleotide
  Target: ATXN1; (+) strand; PAM type: YTN; PAM sequence: TTG
gttcaaaagttagcctctca

SEQ ID NO: 258116 - DNA, 20 bp, Artificial Sequence
  Description of Artificial Sequence: Synthetic oligonucleotide
  Target: ATXN1; (+) strand; PAM type: YTN; PAM sequence: TTC
aaaagttagcctctcaaagg

SEQ ID NO: 258117 - DNA, 20 bp, Artificial Sequence
  Description of Artificial Sequence: Synthetic oligonucleotide
  Target: ATXN1; (+) strand; PAM type: YTN; PAM sequence: TTA
gcctctcaaaggccctccat

SEQ ID NO: 258118 - DNA, 20 bp, Artificial Sequence
  Description of Artificial Sequence: Synthetic oligonucleotide
  Target: ATXN1; (+) strand; PAM type: YTN; PAM sequence: CTC
tcaaaggccctccatattat

SEQ ID NO: 258119 - DNA, 20 bp, Artificial Sequence
  Description of Artificial Sequence: Synthetic oligonucleotide
  Target: ATXN1; (+) strand; PAM type: YTN; PAM sequence: CTC
aaaggccctccatattattc

SEQ ID NO: 258120 - DNA, 20 bp, Artificial Sequence
  Description of Artificial Sequence: Synthetic oligonucleotide
  Target: ATXN1; (+) strand; PAM type: YTN; PAM sequence: CTC
catattattccaccctgaac

SEQ ID NO: 258121 - DNA, 20 bp, Artificial Sequence
  Description of Artificial Sequence: Synthetic oligonucleotide
  Target: ATXN1; (+) strand; PAM type: YTN; PAM sequence: TTA
ttccaccctgaacctcagag

SEQ ID NO: 258122 - DNA, 20 bp, Artificial Sequence
  Description of Artificial Sequence: Synthetic oligonucleotide
  Target: ATXN1; (+) strand; PAM type: YTN; PAM sequence: TTC
caccctgaacctcagagctc

SEQ ID NO: 258123 - DNA, 20 bp, Artificial Sequence
  Description of Artificial Sequence: Synthetic oligonucleotide
  Target: ATXN1; (+) strand; PAM type: YTN; PAM sequence: CTG
aacctcagagctcttgaggt

SEQ ID NO: 258124 - DNA, 20 bp, Artificial Sequence
  Description of Artificial Sequence: Synthetic oligonucleotide
  Target: ATXN1; (+) strand; PAM type: YTN; PAM sequence: CTC
agagctcttgaggttaaaaa

SEQ ID NO: 258125 - DNA, 20 bp, Artificial Sequence
  Description of Artificial Sequence: Synthetic oligonucleotide
  Target: ATXN1; (+) strand; PAM type: YTN; PAM sequence: CTC
ttgaggttaaaaactatgag

SEQ ID NO: 258126 - DNA, 20 bp, Artificial Sequence
  Description of Artificial Sequence: Synthetic oligonucleotide
  Target: ATXN1; (+) strand; PAM type: YTN; PAM sequence: CTT
gaggttaaaaactatgagaa

SEQ ID NO: 258127 - DNA, 20 bp, Artificial Sequence
  Description of Artificial Sequence: Synthetic oligonucleotide
  Target: ATXN1; (+) strand; PAM type: YTN; PAM sequence: TTG
aggttaaaaactatgagaag

SEQ ID NO: 258128 - DNA, 20 bp, Artificial Sequence
  Description of Artificial Sequence: Synthetic oligonucleotide
  Target: ATXN1; (+) strand; PAM type: YTN; PAM sequence: TTA
aaaactatgagaaggaatgg

SEQ ID NO: 258129 - DNA, 20 bp, Artificial Sequence
  Description of Artificial Sequence: Synthetic oligonucleotide
  Target: ATXN1; (+) strand; PAM type: YTN; PAM sequence: CTA
tgagaaggaatggatgagta

SEQ ID NO: 258130 - DNA, 20 bp, Artificial Sequence
  Description of Artificial Sequence: Synthetic oligonucleotide
  Target: ATXN1; (+) strand; PAM type: YTN; PAM sequence: TTG
tttgagacagggtgattaat

SEQ ID NO: 258131 - DNA, 20 bp, Artificial Sequence
  Description of Artificial Sequence: Synthetic oligonucleotide
  Target: ATXN1; (+) strand; PAM type: YTN; PAM sequence: TTT
gagacagggtgattaatggg

SEQ ID NO: 258132 - DNA, 20 bp, Artificial Sequence
  Description of Artificial Sequence: Synthetic oligonucleotide
  Target: ATXN1; (+) strand; PAM type: YTN; PAM sequence: TTG
agacagggtgattaatggga

SEQ ID NO: 258133 - DNA, 20 bp, Artificial Sequence
  Description of Artificial Sequence: Synthetic oligonucleotide
  Target: ATXN1; (+) strand; PAM type: YTN; PAM sequence: TTA
atgggagcatggtcccaacg

SEQ ID NO: 258134 - DNA, 20 bp, Artificial Sequence
  Description of Artificial Sequence: Synthetic oligonucleotide
  Target: ATXN1; (+) strand; PAM type: YTN; PAM sequence: CTC
tggtgtagcaaaagattgag

SEQ ID NO: 258135 - DNA, 20 bp, Artificial Sequence
  Description of Artificial Sequence: Synthetic oligonucleotide
  Target: ATXN1; (+) strand; PAM type: YTN; PAM sequence: CTG
gtgtagcaaaagattgagaa

SEQ ID NO: 258136 - DNA, 20 bp, Artificial Sequence
  Description of Artificial Sequence: Synthetic oligonucleotide
  Target: ATXN1; (+) strand; PAM type: YTN; PAM sequence: TTG
agaagtgaacactgttgtag

SEQ ID NO: 258137 - DNA, 20 bp, Artificial Sequence
  Description of Artificial Sequence: Synthetic oligonucleotide
  Target: ATXN1; (+) strand; PAM type: YTN; PAM sequence: CTG
ttgtagagctacgaaaagat

SEQ ID NO: 258138 - DNA, 20 bp, Artificial Sequence
  Description of Artificial Sequence: Synthetic oligonucleotide
  Target: ATXN1; (+) strand; PAM type: YTN; PAM sequence: TTG
tagagctacgaaaagatatt

SEQ ID NO: 258139 - DNA, 20 bp, Artificial Sequence
  Description of Artificial Sequence: Synthetic oligonucleotide
  Target: ATXN1; (+) strand; PAM type: YTN; PAM sequence: CTA
cgaaaagatatttggcacat

SEQ ID NO: 258140 - DNA, 20 bp, Artificial Sequence
  Description of Artificial Sequence: Synthetic oligonucleotide
  Target: ATXN1; (+) strand; PAM type: YTN; PAM sequence: TTT
ggcacataataggtgcttaa

SEQ ID NO: 258141 - DNA, 20 bp, Artificial Sequence
  Description of Artificial Sequence: Synthetic oligonucleotide
  Target: ATXN1; (+) strand; PAM type: YTN; PAM sequence: TTG
gcacataataggtgcttaaa

SEQ ID NO: 258142 - DNA, 20 bp, Artificial Sequence
  Description of Artificial Sequence: Synthetic oligonucleotide
  Target: ATXN1; (+) strand; PAM type: YTN; PAM sequence: CTT
aaaatgctcattaaatgaaa

SEQ ID NO: 258143 - DNA, 20 bp, Artificial Sequence
  Description of Artificial Sequence: Synthetic oligonucleotide
  Target: ATXN1; (+) strand; PAM type: YTN; PAM sequence: TTA
aaatgctcattaaatgaaag

SEQ ID NO: 258144 - DNA, 20 bp, Artificial Sequence
  Description of Artificial Sequence: Synthetic oligonucleotide
  Target: ATXN1; (+) strand; PAM type: YTN; PAM sequence: CTC
attaaatgaaagaattaatg

SEQ ID NO: 258145 - DNA, 20 bp, Artificial Sequence
  Description of Artificial Sequence: Synthetic oligonucleotide
  Target: ATXN1; (+) strand; PAM type: YTN; PAM sequence: TTA
aatgaaagaattaatgcata

SEQ ID NO: 258146 - DNA, 20 bp, Artificial Sequence
  Description of Artificial Sequence: Synthetic oligonucleotide
  Target: ATXN1; (+) strand; PAM type: YTN; PAM sequence: TTA
atgcataacccttcctactg

SEQ ID NO: 258147 - DNA, 20 bp, Artificial Sequence
  Description of Artificial Sequence: Synthetic oligonucleotide
  Target: ATXN1; (+) strand; PAM type: YTN; PAM sequence: CTT
cctactgaatgtttgtgtct

SEQ ID NO: 258148 - DNA, 20 bp, Artificial Sequence
  Description of Artificial Sequence: Synthetic oligonucleotide
  Target: ATXN1; (+) strand; PAM type: YTN; PAM sequence: TTC
ctactgaatgtttgtgtcta

SEQ ID NO: 258149 - DNA, 20 bp, Artificial Sequence
  Description of Artificial Sequence: Synthetic oligonucleotide
  Target: ATXN1; (+) strand; PAM type: YTN; PAM sequence: CTA
ctgaatgtttgtgtctagaa

SEQ ID NO: 258150 - DNA, 20 bp, Artificial Sequence
  Description of Artificial Sequence: Synthetic oligonucleotide
  Target: ATXN1; (+) strand; PAM type: YTN; PAM sequence: CTG
aatgtttgtgtctagaagat

SEQ ID NO: 258151 - DNA, 20 bp, Artificial Sequence
  Description of Artificial Sequence: Synthetic oligonucleotide
  Target: ATXN1; (+) strand; PAM type: YTN; PAM sequence: TTT
gtgtctagaagatgcactgt

SEQ ID NO: 258152 - DNA, 20 bp, Artificial Sequence
  Description of Artificial Sequence: Synthetic oligonucleotide
  Target: ATXN1; (+) strand; PAM type: YTN; PAM sequence: TTG
tgtctagaagatgcactgtc

SEQ ID NO: 258153 - DNA, 20 bp, Artificial Sequence
  Description of Artificial Sequence: Synthetic oligonucleotide
  Target: ATXN1; (+) strand; PAM type: YTN; PAM sequence: CTA
gaagatgcactgtctcaaac

SEQ ID NO: 258154 - DNA, 20 bp, Artificial Sequence
  Description of Artificial Sequence: Synthetic oligonucleotide
  Target: ATXN1; (+) strand; PAM type: YTN; PAM sequence: CTG
tctcaaactattcccattat

SEQ ID NO: 258155 - DNA, 20 bp, Artificial Sequence
  Description of Artificial Sequence: Synthetic oligonucleotide
  Target: ATXN1; (+) strand; PAM type: YTN; PAM sequence: CTC
aaactattcccattataaaa

SEQ ID NO: 258156 - DNA, 20 bp, Artificial Sequence
  Description of Artificial Sequence: Synthetic oligonucleotide
  Target: ATXN1; (+) strand; PAM type: YTN; PAM sequence: CTA
ttcccattataaaagtaaat

SEQ ID NO: 258157 - DNA, 20 bp, Artificial Sequence
  Description of Artificial Sequence: Synthetic oligonucleotide
  Target: ATXN1; (+) strand; PAM type: YTN; PAM sequence: TTC
ccattataaaagtaaatatt

SEQ ID NO: 258158 - DNA, 20 bp, Artificial Sequence
  Description of Artificial Sequence: Synthetic oligonucleotide
  Target: ATXN1; (+) strand; PAM type: YTN; PAM sequence: TTA
taaaagtaaatattgttcct

SEQ ID NO: 258159 - DNA, 20 bp, Artificial Sequence
  Description of Artificial Sequence: Synthetic oligonucleotide
  Target: ATXN1; (+) strand; PAM type: YTN; PAM sequence: TTG
ttcctgtgtacaattagtcc

SEQ ID NO: 258160 - DNA, 20 bp, Artificial Sequence
  Description of Artificial Sequence: Synthetic oligonucleotide
  Target: ATXN1; (+) strand; PAM type: YTN; PAM sequence: TTC
ctgtgtacaattagtccctt

SEQ ID NO: 258161 - DNA, 20 bp, Artificial Sequence
  Description of Artificial Sequence: Synthetic oligonucleotide
  Target: ATXN1; (+) strand; PAM type: YTN; PAM sequence: CTG
tgtacaattagtcccttcct

SEQ ID NO: 258162 - DNA, 20 bp, Artificial Sequence
  Description of Artificial Sequence: Synthetic oligonucleotide
  Target: ATXN1; (+) strand; PAM type: YTN; PAM sequence: TTA
gtcccttcctctagactatt

SEQ ID NO: 258163 - DNA, 20 bp, Artificial Sequence
  Description of Artificial Sequence: Synthetic oligonucleotide
  Target: ATXN1; (+) strand; PAM type: YTN; PAM sequence: CTT
cctctagactattaatccct

SEQ ID NO: 258164 - DNA, 20 bp, Artificial Sequence
  Description of Artificial Sequence: Synthetic oligonucleotide
  Target: ATXN1; (+) strand; PAM type: YTN; PAM sequence: TTC
ctctagactattaatccctg

SEQ ID NO: 258165 - DNA, 20 bp, Artificial Sequence
  Description of Artificial Sequence: Synthetic oligonucleotide
  Target: ATXN1; (+) strand; PAM type: YTN; PAM sequence: CTC
tagactattaatccctggct

SEQ ID NO: 258166 - DNA, 20 bp, Artificial Sequence
  Description of Artificial Sequence: Synthetic oligonucleotide
  Target: ATXN1; (+) strand; PAM type: YTN; PAM sequence: CTA
gactattaatccctggctcc

SEQ ID NO: 258167 - DNA, 20 bp, Artificial Sequence
  Description of Artificial Sequence: Synthetic oligonucleotide
  Target: ATXN1; (+) strand; PAM type: YTN; PAM sequence: CTA
ttaatccctggctcctggca

SEQ ID NO: 258168 - DNA, 20 bp, Artificial Sequence
  Description of Artificial Sequence: Synthetic oligonucleotide
  Target: ATXN1; (+) strand; PAM type: YTN; PAM sequence: TTA
atccctggctcctggcaaaa

SEQ ID NO: 258169 - DNA, 20 bp, Artificial Sequence
  Description of Artificial Sequence: Synthetic oligonucleotide
  Target: ATXN1; (+) strand; PAM type: YTN; PAM sequence: CTG
gctcctggcaaaaactcctt

SEQ ID NO: 258170 - DNA, 20 bp, Artificial Sequence
  Description of Artificial Sequence: Synthetic oligonucleotide
  Target: ATXN1; (+) strand; PAM type: YTN; PAM sequence: CTC
ctggcaaaaactccttgcat

SEQ ID NO: 258171 - DNA, 20 bp, Artificial Sequence
  Description of Artificial Sequence: Synthetic oligonucleotide
  Target: ATXN1; (+) strand; PAM type: YTN; PAM sequence: CTG
gcaaaaactccttgcatttg

SEQ ID NO: 258172 - DNA, 20 bp, Artificial Sequence
  Description of Artificial Sequence: Synthetic oligonucleotide
  Target: ATXN1; (+) strand; PAM type: YTN; PAM sequence: CTC
cttgcatttgtacagaaatg

SEQ ID NO: 258173 - DNA, 20 bp, Artificial Sequence
  Description of Artificial Sequence: Synthetic oligonucleotide
  Target: ATXN1; (+) strand; PAM type: YTN; PAM sequence: CTT
gcatttgtacagaaatggaa

SEQ ID NO: 258174 - DNA, 20 bp, Artificial Sequence
  Description of Artificial Sequence: Synthetic oligonucleotide
  Target: ATXN1; (+) strand; PAM type: YTN; PAM sequence: TTG
catttgtacagaaatggaat

SEQ ID NO: 258175 - DNA, 20 bp, Artificial Sequence
  Description of Artificial Sequence: Synthetic oligonucleotide
  Target: ATXN1; (+) strand; PAM type: YTN; PAM sequence: TTT
gtacagaaatggaatcggtt

SEQ ID NO: 258176 - DNA, 20 bp, Artificial Sequence
  Description of Artificial Sequence: Synthetic oligonucleotide
  Target: ATXN1; (+) strand; PAM type: YTN; PAM sequence: TTG
tacagaaatggaatcggttt

SEQ ID NO: 258177 - DNA, 20 bp, Artificial Sequence
  Description of Artificial Sequence: Synthetic oligonucleotide
  Target: ATXN1; (+) strand; PAM type: YTN; PAM sequence: TTT
ttggccacattaagcgatac

SEQ ID NO: 258178 - DNA, 20 bp, Artificial Sequence
  Description of Artificial Sequence: Synthetic oligonucleotide
  Target: ATXN1; (+) strand; PAM type: YTN; PAM sequence: TTT
tggccacattaagcgatact

SEQ ID NO: 258179 - DNA, 20 bp, Artificial Sequence
  Description of Artificial Sequence: Synthetic oligonucleotide
  Target: ATXN1; (+) strand; PAM type: YTN; PAM sequence: TTT
ggccacattaagcgatactt

SEQ ID NO: 258180 - DNA, 20 bp, Artificial Sequence
  Description of Artificial Sequence: Synthetic oligonucleotide
  Target: ATXN1; (+) strand; PAM type: YTN; PAM sequence: TTG
gccacattaagcgatacttc

SEQ ID NO: 258181 - DNA, 20 bp, Artificial Sequence
  Description of Artificial Sequence: Synthetic oligonucleotide
  Target: ATXN1; (+) strand; PAM type: YTN; PAM sequence: TTA
agcgatacttctttccttaa

SEQ ID NO: 258182 - DNA, 20 bp, Artificial Sequence
  Description of Artificial Sequence: Synthetic oligonucleotide
  Target: ATXN1; (+) strand; PAM type: YTN; PAM sequence: CTT
ctttccttaagcacatcaac

SEQ ID NO: 258183 - DNA, 20 bp, Artificial Sequence
  Description of Artificial Sequence: Synthetic oligonucleotide
  Target: ATXN1; (+) strand; PAM type: YTN; PAM sequence: TTC
tttccttaagcacatcaact

SEQ ID NO: 258184 - DNA, 20 bp, Artificial Sequence
  Description of Artificial Sequence: Synthetic oligonucleotide
  Target: ATXN1; (+) strand; PAM type: YTN; PAM sequence: CTT
tccttaagcacatcaactcc

SEQ ID NO: 258185 - DNA, 20 bp, Artificial Sequence
  Description of Artificial Sequence: Synthetic oligonucleotide
  Target: ATXN1; (+) strand; PAM type: YTN; PAM sequence: TTT
ccttaagcacatcaactccc

SEQ ID NO: 258186 - DNA, 20 bp, Artificial Sequence
  Description of Artificial Sequence: Synthetic oligonucleotide
  Target: ATXN1; (+) strand; PAM type: YTN; PAM sequence: TTC
cttaagcacatcaactccct

SEQ ID NO: 258187 - DNA, 20 bp, Artificial Sequence
  Description of Artificial Sequence: Synthetic oligonucleotide
  Target: ATXN1; (+) strand; PAM type: YTN; PAM sequence: CTT
aagcacatcaactccctctg

SEQ ID NO: 258188 - DNA, 20 bp, Artificial Sequence
  Description of Artificial Sequence: Synthetic oligonucleotide
  Target: ATXN1; (+) strand; PAM type: YTN; PAM sequence: TTA
agcacatcaactccctctgt

SEQ ID NO: 258189 - DNA, 20 bp, Artificial Sequence
  Description of Artificial Sequence: Synthetic oligonucleotide
  Target: ATXN1; (+) strand; PAM type: YTN; PAM sequence: CTC
cctctgtggctttcaggaat

SEQ ID NO: 258190 - DNA, 20 bp, Artificial Sequence
  Description of Artificial Sequence: Synthetic oligonucleotide
  Target: ATXN1; (+) strand; PAM type: YTN; PAM sequence: CTC
tgtggctttcaggaatgctt

SEQ ID NO: 258191 - DNA, 20 bp, Artificial Sequence
  Description of Artificial Sequence: Synthetic oligonucleotide
  Target: ATXN1; (+) strand; PAM type: YTN; PAM sequence: CTG
tggctttcaggaatgcttag

SEQ ID NO: 258192 - DNA, 20 bp, Artificial Sequence
  Description of Artificial Sequence: Synthetic oligonucleotide
  Target: ATXN1; (+) strand; PAM type: YTN; PAM sequence: CTT
tcaggaatgcttagcctttg

SEQ ID NO: 258193 - DNA, 20 bp, Artificial Sequence
  Description of Artificial Sequence: Synthetic oligonucleotide
  Target: ATXN1; (+) strand; PAM type: YTN; PAM sequence: TTT
caggaatgcttagcctttgg

SEQ ID NO: 258194 - DNA, 20 bp, Artificial Sequence
  Description of Artificial Sequence: Synthetic oligonucleotide
  Target: ATXN1; (+) strand; PAM type: YTN; PAM sequence: TTC
aggaatgcttagcctttgga

SEQ ID NO: 258195 - DNA, 20 bp, Artificial Sequence
  Description of Artificial Sequence: Synthetic oligonucleotide
  Target: ATXN1; (+) strand; PAM type: YTN; PAM sequence: CTT
agcctttggaataaagtaga

SEQ ID NO: 258196 - DNA, 20 bp, Artificial Sequence
  Description of Artificial Sequence: Synthetic oligonucleotide
  Target: ATXN1; (+) strand; PAM type: YTN; PAM sequence: TTA
gcctttggaataaagtagaa

SEQ ID NO: 258197 - DNA, 20 bp, Artificial Sequence
  Description of Artificial Sequence: Synthetic oligonucleotide
  Target: ATXN1; (+) strand; PAM type: YTN; PAM sequence: CTT
tggaataaagtagaaagtac

SEQ ID NO: 258198 - DNA, 20 bp, Artificial Sequence
  Description of Artificial Sequence: Synthetic oligonucleotide
  Target: ATXN1; (+) strand; PAM type: YTN; PAM sequence: TTT
ggaataaagtagaaagtaca

SEQ ID NO: 258199 - DNA, 20 bp, Artificial Sequence
  Description of Artificial Sequence: Synthetic oligonucleotide
  Target: ATXN1; (+) strand; PAM type: YTN; PAM sequence: TTG
gaataaagtagaaagtacag

SEQ ID NO: 258200 - DNA, 20 bp, Artificial Sequence
  Description of Artificial Sequence: Synthetic oligonucleotide
  Target: ATXN1; (+) strand; PAM type: YTN; PAM sequence: CTG
gaatacatggcctggcacat

SEQ ID NO: 258201 - DNA, 20 bp, Artificial Sequence
  Description of Artificial Sequence: Synthetic oligonucleotide
  Target: ATXN1; (+) strand; PAM type: YTN; PAM sequence: CTG
gcacatgtcaaatcaaagaa

SEQ ID NO: 258202 - DNA, 20 bp, Artificial Sequence
  Description of Artificial Sequence: Synthetic oligonucleotide
  Target: ATXN1; (+) strand; PAM type: YTN; PAM sequence: TTC
atgagatctgaacagtctga

SEQ ID NO: 258203 - DNA, 20 bp, Artificial Sequence
  Description of Artificial Sequence: Synthetic oligonucleotide
  Target: ATXN1; (+) strand; PAM type: YTN; PAM sequence: CTG
aacagtctgaccatgcaata

SEQ ID NO: 258204 - DNA, 20 bp, Artificial Sequence
  Description of Artificial Sequence: Synthetic oligonucleotide
  Target: ATXN1; (+) strand; PAM type: YTN; PAM sequence: CTG
accatgcaatactccttttt

SEQ ID NO: 258205 - DNA, 20 bp, Artificial Sequence
  Description of Artificial Sequence: Synthetic oligonucleotide
  Target: ATXN1; (+) strand; PAM type: YTN; PAM sequence: CTC
cttttttttattttatttta

SEQ ID NO: 258206 - DNA, 20 bp, Artificial Sequence
  Description of Artificial Sequence: Synthetic oligonucleotide
  Target: ATXN1; (+) strand; PAM type: YTN; PAM sequence: CTT
ttttttattttattttatta

SEQ ID NO: 258207 - DNA, 20 bp, Artificial Sequence
  Description of Artificial Sequence: Synthetic oligonucleotide
  Target: ATXN1; (+) strand; PAM type: YTN; PAM sequence: TTT
tttttattttattttattat

SEQ ID NO: 258208 - DNA, 20 bp, Artificial Sequence
  Description of Artificial Sequence: Synthetic oligonucleotide
  Target: ATXN1; (+) strand; PAM type: YTN; PAM sequence: TTT
ttttattttattttattatt

SEQ ID NO: 258209 - DNA, 20 bp, Artificial Sequence
  Description of Artificial Sequence: Synthetic oligonucleotide
  Target: ATXN1; (+) strand; PAM type: YTN; PAM sequence: TTT
tttattttattttattatta

SEQ ID NO: 258210 - DNA, 20 bp, Artificial Sequence
  Description of Artificial Sequence: Synthetic oligonucleotide
  Target: ATXN1; (+) strand; PAM type: YTN; PAM sequence: TTT
ttattttattttattattat

SEQ ID NO: 258211 - DNA, 20 bp, Artificial Sequence
  Description of Artificial Sequence: Synthetic oligonucleotide
  Target: ATXN1; (+) strand; PAM type: YTN; PAM sequence: TTT
tattttattttattattatt

SEQ ID NO: 258212 - DNA, 20 bp, Artificial Sequence
  Description of Artificial Sequence: Synthetic oligonucleotide
  Target: ATXN1; (+) strand; PAM type: YTN; PAM sequence: TTT
attttattttattattatta

SEQ ID NO: 258213 - DNA, 20 bp, Artificial Sequence
  Description of Artificial Sequence: Synthetic oligonucleotide
  Target: ATXN1; (+) strand; PAM type: YTN; PAM sequence: TTA
ttttattttattattattat

SEQ ID NO: 258214 - DNA, 20 bp, Artificial Sequence
  Description of Artificial Sequence: Synthetic oligonucleotide
  Target: ATXN1; (+) strand; PAM type: YTN; PAM sequence: TTT
tattttattattattatact

SEQ ID NO: 258215 - DNA, 20 bp, Artificial Sequence
  Description of Artificial Sequence: Synthetic oligonucleotide
  Target: ATXN1; (+) strand; PAM type: YTN; PAM sequence: TTT
attttattattattatactt

SEQ ID NO: 258216 - DNA, 20 bp, Artificial Sequence
  Description of Artificial Sequence: Synthetic oligonucleotide
  Target: ATXN1; (+) strand; PAM type: YTN; PAM sequence: TTA
ttttattattattatacttt

SEQ ID NO: 258217 - DNA, 20 bp, Artificial Sequence
  Description of Artificial Sequence: Synthetic oligonucleotide
  Target: ATXN1; (+) strand; PAM type: YTN; PAM sequence: TTT
tattattattatactttaag

SEQ ID NO: 258218 - DNA, 20 bp, Artificial Sequence
  Description of Artificial Sequence: Synthetic oligonucleotide
  Target: ATXN1; (+) strand; PAM type: YTN; PAM sequence: TTT
attattattatactttaagt

SEQ ID NO: 258219 - DNA, 20 bp, Artificial Sequence
  Description of Artificial Sequence: Synthetic oligonucleotide
  Target: ATXN1; (+) strand; PAM type: YTN; PAM sequence: TTA
ttattattatactttaagtt

SEQ ID NO: 258220 - DNA, 20 bp, Artificial Sequence
  Description of Artificial Sequence: Synthetic oligonucleotide
  Target: ATXN1; (+) strand; PAM type: YTN; PAM sequence: TTA
ttattatactttaagtttta

SEQ ID NO: 258221 - DNA, 20 bp, Artificial Sequence
  Description of Artificial Sequence: Synthetic oligonucleotide
  Target: ATXN1; (+) strand; PAM type: YTN; PAM sequence: TTA
ttatactttaagttttaggt

SEQ ID NO: 258222 - DNA, 20 bp, Artificial Sequence
  Description of Artificial Sequence: Synthetic oligonucleotide
  Target: ATXN1; (+) strand; PAM type: YTN; PAM sequence: TTA
tactttaagttttaggttac

SEQ ID NO: 258223 - DNA, 20 bp, Artificial Sequence
  Description of Artificial Sequence: Synthetic oligonucleotide
  Target: ATXN1; (+) strand; PAM type: YTN; PAM sequence: CTT
taagttttaggttacatgtg

SEQ ID NO: 258224 - DNA, 20 bp, Artificial Sequence
  Description of Artificial Sequence: Synthetic oligonucleotide
  Target: ATXN1; (+) strand; PAM type: YTN; PAM sequence: TTT
aagttttaggttacatgtgc

SEQ ID NO: 258225 - DNA, 20 bp, Artificial Sequence
  Description of Artificial Sequence: Synthetic oligonucleotide
  Target: ATXN1; (+) strand; PAM type: YTN; PAM sequence: TTA
agttttaggttacatgtgca

SEQ ID NO: 258226 - DNA, 20 bp, Artificial Sequence
  Description of Artificial Sequence: Synthetic oligonucleotide
  Target: ATXN1; (+) strand; PAM type: YTN; PAM sequence: TTT
taggttacatgtgcacaatg

SEQ ID NO: 258227 - DNA, 20 bp, Artificial Sequence
  Description of Artificial Sequence: Synthetic oligonucleotide
  Target: ATXN1; (+) strand; PAM type: YTN; PAM sequence: TTT
aggttacatgtgcacaatgt

SEQ ID NO: 258228 - DNA, 20 bp, Artificial Sequence
  Description of Artificial Sequence: Synthetic oligonucleotide
  Target: ATXN1; (+) strand; PAM type: YTN; PAM sequence: TTA
ggttacatgtgcacaatgtg

SEQ ID NO: 258229 - DNA, 20 bp, Artificial Sequence
  Description of Artificial Sequence: Synthetic oligonucleotide
  Target: ATXN1; (+) strand; PAM type: YTN; PAM sequence: TTA
catgtgcacaatgtgcaggt

SEQ ID NO: 258230 - DNA, 20 bp, Artificial Sequence
  Description of Artificial Sequence: Synthetic oligonucleotide
  Target: ATXN1; (+) strand; PAM type: YTN; PAM sequence: TTA
gttgcatatgtatacatgtg

SEQ ID NO: 258231 - DNA, 20 bp, Artificial Sequence
  Description of Artificial Sequence: Synthetic oligonucleotide
  Target: ATXN1; (+) strand; PAM type: YTN; PAM sequence: TTG
catatgtatacatgtgccat

SEQ ID NO: 258232 - DNA, 20 bp, Artificial Sequence
  Description of Artificial Sequence: Synthetic oligonucleotide
  Target: ATXN1; (+) strand; PAM type: YTN; PAM sequence: CTG
gtgtgctgcacccattaact

SEQ ID NO: 258233 - DNA, 20 bp, Artificial Sequence
  Description of Artificial Sequence: Synthetic oligonucleotide
  Target: ATXN1; (+) strand; PAM type: YTN; PAM sequence: CTG
cacccattaactcgtcattt

SEQ ID NO: 258234 - DNA, 20 bp, Artificial Sequence
  Description of Artificial Sequence: Synthetic oligonucleotide
  Target: ATXN1; (+) strand; PAM type: YTN; PAM sequence: TTA
actcgtcatttagcattagg

SEQ ID NO: 258235 - DNA, 20 bp, Artificial Sequence
  Description of Artificial Sequence: Synthetic oligonucleotide
  Target: ATXN1; (+) strand; PAM type: YTN; PAM sequence: CTC
gtcatttagcattaggtata

SEQ ID NO: 258236 - DNA, 20 bp, Artificial Sequence
  Description of Artificial Sequence: Synthetic oligonucleotide
  Target: ATXN1; (+) strand; PAM type: YTN; PAM sequence: TTT
agcattaggtatatctccta

SEQ ID NO: 258237 - DNA, 20 bp, Artificial Sequence
  Description of Artificial Sequence: Synthetic oligonucleotide
  Target: ATXN1; (+) strand; PAM type: YTN; PAM sequence: TTA
gcattaggtatatctcctaa

SEQ ID NO: 258238 - DNA, 20 bp, Artificial Sequence
  Description of Artificial Sequence: Synthetic oligonucleotide
  Target: ATXN1; (+) strand; PAM type: YTN; PAM sequence: TTA
ggtatatctcctaatgctgt

SEQ ID NO: 258239 - DNA, 20 bp, Artificial Sequence
  Description of Artificial Sequence: Synthetic oligonucleotide
  Target: ATXN1; (+) strand; PAM type: YTN; PAM sequence: CTC
ctaatgctgtccctcccccc

SEQ ID NO: 258240 - DNA, 20 bp, Artificial Sequence
  Description of Artificial Sequence: Synthetic oligonucleotide
  Target: ATXN1; (+) strand; PAM type: YTN; PAM sequence: CTA
atgctgtccctcccccctcc

SEQ ID NO: 258241 - DNA, 20 bp, Artificial Sequence
  Description of Artificial Sequence: Synthetic oligonucleotide
  Target: ATXN1; (+) strand; PAM type: YTN; PAM sequence: CTG
tccctcccccctcccccctc

SEQ ID NO: 258242 - DNA, 20 bp, Artificial Sequence
  Description of Artificial Sequence: Synthetic oligonucleotide
  Target: ATXN1; (+) strand; PAM type: YTN; PAM sequence: CTC
ccccctcccccctcccccca

SEQ ID NO: 258243 - DNA, 20 bp, Artificial Sequence
  Description of Artificial Sequence: Synthetic oligonucleotide
  Target: ATXN1; (+) strand; PAM type: YTN; PAM sequence: CTC
ccccctccccccaccccaca

SEQ ID NO: 258244 - DNA, 20 bp, Artificial Sequence
  Description of Artificial Sequence: Synthetic oligonucleotide
  Target: ATXN1; (+) strand; PAM type: YTN; PAM sequence: CTC
cccccaccccacaacagtcc

SEQ ID NO: 258245 - DNA, 20 bp, Artificial Sequence
  Description of Artificial Sequence: Synthetic oligonucleotide
  Target: ATXN1; (+) strand; PAM type: YTN; PAM sequence: TTC
cccttcctgtgtccatgtgt

SEQ ID NO: 258246 - DNA, 20 bp, Artificial Sequence
  Description of Artificial Sequence: Synthetic oligonucleotide
  Target: ATXN1; (+) strand; PAM type: YTN; PAM sequence: CTT
cctgtgtccatgtgttctca

SEQ ID NO: 258247 - DNA, 20 bp, Artificial Sequence
  Description of Artificial Sequence: Synthetic oligonucleotide
  Target: ATXN1; (+) strand; PAM type: YTN; PAM sequence: TTC
ctgtgtccatgtgttctcat

SEQ ID NO: 258248 - DNA, 20 bp, Artificial Sequence
  Description of Artificial Sequence: Synthetic oligonucleotide
  Target: ATXN1; (+) strand; PAM type: YTN; PAM sequence: CTG
tgtccatgtgttctcattgt

SEQ ID NO: 258249 - DNA, 20 bp, Artificial Sequence
  Description of Artificial Sequence: Synthetic oligonucleotide
  Target: ATXN1; (+) strand; PAM type: YTN; PAM sequence: TTC
tcattgttcaattcccaccg

SEQ ID NO: 258250 - DNA, 20 bp, Artificial Sequence
  Description of Artificial Sequence: Synthetic oligonucleotide
  Target: ATXN1; (+) strand; PAM type: YTN; PAM sequence: CTC
attgttcaattcccaccgca

SEQ ID NO: 258251 - DNA, 20 bp, Artificial Sequence
  Description of Artificial Sequence: Synthetic oligonucleotide
  Target: ATXN1; (+) strand; PAM type: YTN; PAM sequence: TTG
ttcaattcccaccgcaatac

SEQ ID NO: 258252 - DNA, 20 bp, Artificial Sequence
  Description of Artificial Sequence: Synthetic oligonucleotide
  Target: ATXN1; (+) strand; PAM type: YTN; PAM sequence: TTC
aattcccaccgcaatactcc

SEQ ID NO: 258253 - DNA, 20 bp, Artificial Sequence
  Description of Artificial Sequence: Synthetic oligonucleotide
  Target: ATXN1; (+) strand; PAM type: YTN; PAM sequence: TTC
ccaccgcaatactcctaacg

SEQ ID NO: 258254 - DNA, 20 bp, Artificial Sequence
  Description of Artificial Sequence: Synthetic oligonucleotide
  Target: ATXN1; (+) strand; PAM type: YTN; PAM sequence: CTC
ctaacgctaataattgtagg

SEQ ID NO: 258255 - DNA, 20 bp, Artificial Sequence
  Description of Artificial Sequence: Synthetic oligonucleotide
  Target: ATXN1; (+) strand; PAM type: YTN; PAM sequence: CTA
acgctaataattgtaggtgt

SEQ ID NO: 258256 - DNA, 20 bp, Artificial Sequence
  Description of Artificial Sequence: Synthetic oligonucleotide
  Target: ATXN1; (+) strand; PAM type: YTN; PAM sequence: CTA
ataattgtaggtgttaatgg

SEQ ID NO: 258257 - DNA, 20 bp, Artificial Sequence
  Description of Artificial Sequence: Synthetic oligonucleotide
  Target: ATXN1; (+) strand; PAM type: YTN; PAM sequence: TTG
taggtgttaatggtaacaat

SEQ ID NO: 258258 - DNA, 20 bp, Artificial Sequence
  Description of Artificial Sequence: Synthetic oligonucleotide
  Target: ATXN1; (+) strand; PAM type: YTN; PAM sequence: TTA
atggtaacaatttgttataa

SEQ ID NO: 258259 - DNA, 20 bp, Artificial Sequence
  Description of Artificial Sequence: Synthetic oligonucleotide
  Target: ATXN1; (+) strand; PAM type: YTN; PAM sequence: TTT
gttataaatgatacaacata

SEQ ID NO: 258260 - DNA, 20 bp, Artificial Sequence
  Description of Artificial Sequence: Synthetic oligonucleotide
  Target: ATXN1; (+) strand; PAM type: YTN; PAM sequence: TTG
ttataaatgatacaacatat

SEQ ID NO: 258261 - DNA, 20 bp, Artificial Sequence
  Description of Artificial Sequence: Synthetic oligonucleotide
  Target: ATXN1; (+) strand; PAM type: YTN; PAM sequence: TTA
taaatgatacaacatatttc

SEQ ID NO: 258262 - DNA, 20 bp, Artificial Sequence
  Description of Artificial Sequence: Synthetic oligonucleotide
  Target: ATXN1; (+) strand; PAM type: YTN; PAM sequence: TTT
ctatttgttccttagctttc

SEQ ID NO: 258263 - DNA, 20 bp, Artificial Sequence
  Description of Artificial Sequence: Synthetic oligonucleotide
  Target: ATXN1; (+) strand; PAM type: YTN; PAM sequence: TTC
tatttgttccttagctttca

SEQ ID NO: 258264 - DNA, 20 bp, Artificial Sequence
  Description of Artificial Sequence: Synthetic oligonucleotide
  Target: ATXN1; (+) strand; PAM type: YTN; PAM sequence: CTA
tttgttccttagctttcaag

SEQ ID NO: 258265 - DNA, 20 bp, Artificial Sequence
  Description of Artificial Sequence: Synthetic oligonucleotide
  Target: ATXN1; (+) strand; PAM type: YTN; PAM sequence: TTT
gttccttagctttcaagcat

SEQ ID NO: 258266 - DNA, 20 bp, Artificial Sequence
  Description of Artificial Sequence: Synthetic oligonucleotide
  Target: ATXN1; (+) strand; PAM type: YTN; PAM sequence: TTG
ttccttagctttcaagcatt

SEQ ID NO: 258267 - DNA, 20 bp, Artificial Sequence
  Description of Artificial Sequence: Synthetic oligonucleotide
  Target: ATXN1; (+) strand; PAM type: YTN; PAM sequence: TTC
cttagctttcaagcattcgc

SEQ ID NO: 258268 - DNA, 20 bp, Artificial Sequence
  Description of Artificial Sequence: Synthetic oligonucleotide
  Target: ATXN1; (+) strand; PAM type: YTN; PAM sequence: CTT
agctttcaagcattcgcttg

SEQ ID NO: 258269 - DNA, 20 bp, Artificial Sequence
  Description of Artificial Sequence: Synthetic oligonucleotide
  Target: ATXN1; (+) strand; PAM type: YTN; PAM sequence: TTA
gctttcaagcattcgcttga

SEQ ID NO: 258270 - DNA, 20 bp, Artificial Sequence
  Description of Artificial Sequence: Synthetic oligonucleotide
  Target: ATXN1; (+) strand; PAM type: YTN; PAM sequence: CTT
tcaagcattcgcttgatgtc

SEQ ID NO: 258271 - DNA, 20 bp, Artificial Sequence
  Description of Artificial Sequence: Synthetic oligonucleotide
  Target: ATXN1; (+) strand; PAM type: YTN; PAM sequence: TTT
caagcattcgcttgatgtca

SEQ ID NO: 258272 - DNA, 20 bp, Artificial Sequence
  Description of Artificial Sequence: Synthetic oligonucleotide
  Target: ATXN1; (+) strand; PAM type: YTN; PAM sequence: TTC
aagcattcgcttgatgtcat

SEQ ID NO: 258273 - DNA, 20 bp, Artificial Sequence
  Description of Artificial Sequence: Synthetic oligonucleotide
  Target: ATXN1; (+) strand; PAM type: YTN; PAM sequence: TTC
gcttgatgtcatggtctgaa

SEQ ID NO: 258274 - DNA, 20 bp, Artificial Sequence
  Description of Artificial Sequence: Synthetic oligonucleotide
  Target: ATXN1; (+) strand; PAM type: YTN; PAM sequence: CTT
gatgtcatggtctgaaattt

SEQ ID NO: 258275 - DNA, 20 bp, Artificial Sequence
  Description of Artificial Sequence: Synthetic oligonucleotide
  Target: ATXN1; (+) strand; PAM type: YTN; PAM sequence: TTG
atgtcatggtctgaaatttg

SEQ ID NO: 258276 - DNA, 20 bp, Artificial Sequence
  Description of Artificial Sequence: Synthetic oligonucleotide
  Target: ATXN1; (+) strand; PAM type: YTN; PAM sequence: CTG
aaatttggccaaggtgttcc

SEQ ID NO: 258277 - DNA, 20 bp, Artificial Sequence
  Description of Artificial Sequence: Synthetic oligonucleotide
  Target: ATXN1; (+) strand; PAM type: YTN; PAM sequence: TTT
ggccaaggtgttcctatttt

SEQ ID NO: 258278 - DNA, 20 bp, Artificial Sequence
  Description of Artificial Sequence: Synthetic oligonucleotide
  Target: ATXN1; (+) strand; PAM type: YTN; PAM sequence: TTG
gccaaggtgttcctattttc

SEQ ID NO: 258279 - DNA, 20 bp, Artificial Sequence
  Description of Artificial Sequence: Synthetic oligonucleotide
  Target: ATXN1; (+) strand; PAM type: YTN; PAM sequence: TTC
ctattttcaggcctcgatat

SEQ ID NO: 258280 - DNA, 20 bp, Artificial Sequence
  Description of Artificial Sequence: Synthetic oligonucleotide
  Target: ATXN1; (+) strand; PAM type: YTN; PAM sequence: CTA
ttttcaggcctcgatatgcc

SEQ ID NO: 258281 - DNA, 20 bp, Artificial Sequence
  Description of Artificial Sequence: Synthetic oligonucleotide
  Target: ATXN1; (+) strand; PAM type: YTN; PAM sequence: TTT
tcaggcctcgatatgcccac

SEQ ID NO: 258282 - DNA, 20 bp, Artificial Sequence
  Description of Artificial Sequence: Synthetic oligonucleotide
  Target: ATXN1; (+) strand; PAM type: YTN; PAM sequence: TTT
caggcctcgatatgcccaca

SEQ ID NO: 258283 - DNA, 20 bp, Artificial Sequence
  Description of Artificial Sequence: Synthetic oligonucleotide
  Target: ATXN1; (+) strand; PAM type: YTN; PAM sequence: TTC
aggcctcgatatgcccacag

SEQ ID NO: 258284 - DNA, 20 bp, Artificial Sequence
  Description of Artificial Sequence: Synthetic oligonucleotide
  Target: ATXN1; (+) strand; PAM type: YTN; PAM sequence: CTC
gatatgcccacagatgcttc

SEQ ID NO: 258285 - DNA, 20 bp, Artificial Sequence
  Description of Artificial Sequence: Synthetic oligonucleotide
  Target: ATXN1; (+) strand; PAM type: YTN; PAM sequence: CTT
ccctggttatccttcattga

SEQ ID NO: 258286 - DNA, 20 bp, Artificial Sequence
  Description of Artificial Sequence: Synthetic oligonucleotide
  Target: ATXN1; (+) strand; PAM type: YTN; PAM sequence: TTC
cctggttatccttcattgaa

SEQ ID NO: 258287 - DNA, 20 bp, Artificial Sequence
  Description of Artificial Sequence: Synthetic oligonucleotide
  Target: ATXN1; (+) strand; PAM type: YTN; PAM sequence: CTG
gttatccttcattgaaccaa

SEQ ID NO: 258288 - DNA, 20 bp, Artificial Sequence
  Description of Artificial Sequence: Synthetic oligonucleotide
  Target: ATXN1; (+) strand; PAM type: YTN; PAM sequence: TTA
tccttcattgaaccaactcc

SEQ ID NO: 258289 - DNA, 20 bp, Artificial Sequence
  Description of Artificial Sequence: Synthetic oligonucleotide
  Target: ATXN1; (+) strand; PAM type: YTN; PAM sequence: CTT
cattgaaccaactcctccac

SEQ ID NO: 258290 - DNA, 20 bp, Artificial Sequence
  Description of Artificial Sequence: Synthetic oligonucleotide
  Target: ATXN1; (+) strand; PAM type: YTN; PAM sequence: TTC
attgaaccaactcctccact

SEQ ID NO: 258291 - DNA, 20 bp, Artificial Sequence
  Description of Artificial Sequence: Synthetic oligonucleotide
  Target: ATXN1; (+) strand; PAM type: YTN; PAM sequence: TTG
aaccaactcctccacttact

SEQ ID NO: 258292 - DNA, 20 bp, Artificial Sequence
  Description of Artificial Sequence: Synthetic oligonucleotide
  Target: ATXN1; (+) strand; PAM type: YTN; PAM sequence: CTC
ctccacttactagctgtgtg

SEQ ID NO: 258293 - DNA, 20 bp, Artificial Sequence
  Description of Artificial Sequence: Synthetic oligonucleotide
  Target: ATXN1; (+) strand; PAM type: YTN; PAM sequence: CTC
cacttactagctgtgtgact

SEQ ID NO: 258294 - DNA, 20 bp, Artificial Sequence
  Description of Artificial Sequence: Synthetic oligonucleotide
  Target: ATXN1; (+) strand; PAM type: YTN; PAM sequence: CTT
actagctgtgtgactttgta

SEQ ID NO: 258295 - DNA, 20 bp, Artificial Sequence
  Description of Artificial Sequence: Synthetic oligonucleotide
  Target: ATXN1; (+) strand; PAM type: YTN; PAM sequence: TTA
ctagctgtgtgactttgtac

SEQ ID NO: 258296 - DNA, 20 bp, Artificial Sequence
  Description of Artificial Sequence: Synthetic oligonucleotide
  Target: ATXN1; (+) strand; PAM type: YTN; PAM sequence: CTA
gctgtgtgactttgtacaag

SEQ ID NO: 258297 - DNA, 20 bp, Artificial Sequence
  Description of Artificial Sequence: Synthetic oligonucleotide
  Target: ATXN1; (+) strand; PAM type: YTN; PAM sequence: CTG
tgtgactttgtacaagtaag

SEQ ID NO: 258298 - DNA, 20 bp, Artificial Sequence
  Description of Artificial Sequence: Synthetic oligonucleotide
  Target: ATXN1; (+) strand; PAM type: YTN; PAM sequence: CTT
tgtacaagtaaggtaaccac

SEQ ID NO: 258299 - DNA, 20 bp, Artificial Sequence
  Description of Artificial Sequence: Synthetic oligonucleotide
  Target: ATXN1; (+) strand; PAM type: YTN; PAM sequence: TTT
gtacaagtaaggtaaccacc

SEQ ID NO: 258300 - DNA, 20 bp, Artificial Sequence
  Description of Artificial Sequence: Synthetic oligonucleotide
  Target: ATXN1; (+) strand; PAM type: YTN; PAM sequence: TTG
tacaagtaaggtaaccaccc

SEQ ID NO: 258301 - DNA, 20 bp, Artificial Sequence
  Description of Artificial Sequence: Synthetic oligonucleotide
  Target: ATXN1; (+) strand; PAM type: YTN; PAM sequence: CTA
agccccaatttccttttctg

SEQ ID NO: 258302 - DNA, 20 bp, Artificial Sequence
  Description of Artificial Sequence: Synthetic oligonucleotide
  Target: ATXN1; (+) strand; PAM type: YTN; PAM sequence: TTT
ccttttctgttgaataaggg

SEQ ID NO: 258303 - DNA, 20 bp, Artificial Sequence
  Description of Artificial Sequence: Synthetic oligonucleotide
  Target: ATXN1; (+) strand; PAM type: YTN; PAM sequence: TTC
cttttctgttgaataagggt

SEQ ID NO: 258304 - DNA, 20 bp, Artificial Sequence
  Description of Artificial Sequence: Synthetic oligonucleotide
  Target: ATXN1; (+) strand; PAM type: YTN; PAM sequence: CTT
ttctgttgaataagggtaat

SEQ ID NO: 258305 - DNA, 20 bp, Artificial Sequence
  Description of Artificial Sequence: Synthetic oligonucleotide
  Target: ATXN1; (+) strand; PAM type: YTN; PAM sequence: TTT
tctgttgaataagggtaatg

SEQ ID NO: 258306 - DNA, 20 bp, Artificial Sequence
  Description of Artificial Sequence: Synthetic oligonucleotide
  Target: ATXN1; (+) strand; PAM type: YTN; PAM sequence: TTT
ctgttgaataagggtaatga

SEQ ID NO: 258307 - DNA, 20 bp, Artificial Sequence
  Description of Artificial Sequence: Synthetic oligonucleotide
  Target: ATXN1; (+) strand; PAM type: YTN; PAM sequence: TTC
tgttgaataagggtaatgat

SEQ ID NO: 258308 - DNA, 20 bp, Artificial Sequence
  Description of Artificial Sequence: Synthetic oligonucleotide
  Target: ATXN1; (+) strand; PAM type: YTN; PAM sequence: CTG
ttgaataagggtaatgatgg

SEQ ID NO: 258309 - DNA, 20 bp, Artificial Sequence
  Description of Artificial Sequence: Synthetic oligonucleotide
  Target: ATXN1; (+) strand; PAM type: YTN; PAM sequence: TTG
aataagggtaatgatggtac

SEQ ID NO: 258310 - DNA, 20 bp, Artificial Sequence
  Description of Artificial Sequence: Synthetic oligonucleotide
  Target: ATXN1; (+) strand; PAM type: YTN; PAM sequence: CTT
acaactgtcatgagcttttt

SEQ ID NO: 258311 - DNA, 20 bp, Artificial Sequence
  Description of Artificial Sequence: Synthetic oligonucleotide
  Target: ATXN1; (+) strand; PAM type: YTN; PAM sequence: TTA
caactgtcatgagctttttg

SEQ ID NO: 258312 - DNA, 20 bp, Artificial Sequence
  Description of Artificial Sequence: Synthetic oligonucleotide
  Target: ATXN1; (+) strand; PAM type: YTN; PAM sequence: CTG
tcatgagctttttgtattgt

SEQ ID NO: 258313 - DNA, 20 bp, Artificial Sequence
  Description of Artificial Sequence: Synthetic oligonucleotide
  Target: ATXN1; (+) strand; PAM type: YTN; PAM sequence: CTT
tttgtattgttttcttcttt

SEQ ID NO: 258314 - DNA, 20 bp, Artificial Sequence
  Description of Artificial Sequence: Synthetic oligonucleotide
  Target: ATXN1; (+) strand; PAM type: YTN; PAM sequence: TTT
ttgtattgttttcttctttg

SEQ ID NO: 258315 - DNA, 20 bp, Artificial Sequence
  Description of Artificial Sequence: Synthetic oligonucleotide
  Target: ATXN1; (+) strand; PAM type: YTN; PAM sequence: TTT
tgtattgttttcttctttga

SEQ ID NO: 258316 - DNA, 20 bp, Artificial Sequence
  Description of Artificial Sequence: Synthetic oligonucleotide
  Target: ATXN1; (+) strand; PAM type: YTN; PAM sequence: TTT
gtattgttttcttctttgag

SEQ ID NO: 258317 - DNA, 20 bp, Artificial Sequence
  Description of Artificial Sequence: Synthetic oligonucleotide
  Target: ATXN1; (+) strand; PAM type: YTN; PAM sequence: TTG
tattgttttcttctttgaga

SEQ ID NO: 258318 - DNA, 20 bp, Artificial Sequence
  Description of Artificial Sequence: Synthetic oligonucleotide
  Target: ATXN1; (+) strand; PAM type: YTN; PAM sequence: TTG
ttttcttctttgagatgggt

SEQ ID NO: 258319 - DNA, 20 bp, Artificial Sequence
  Description of Artificial Sequence: Synthetic oligonucleotide
  Target: ATXN1; (+) strand; PAM type: YTN; PAM sequence: TTT
tcttctttgagatgggttct

SEQ ID NO: 258320 - DNA, 20 bp, Artificial Sequence
  Description of Artificial Sequence: Synthetic oligonucleotide
  Target: ATXN1; (+) strand; PAM type: YTN; PAM sequence: TTT
cttctttgagatgggttctt

SEQ ID NO: 258321 - DNA, 20 bp, Artificial Sequence
  Description of Artificial Sequence: Synthetic oligonucleotide
  Target: ATXN1; (+) strand; PAM type: YTN; PAM sequence: TTC
ttctttgagatgggttcttg

SEQ ID NO: 258322 - DNA, 20 bp, Artificial Sequence
  Description of Artificial Sequence: Synthetic oligonucleotide
  Target: ATXN1; (+) strand; PAM type: YTN; PAM sequence: CTT
ctttgagatgggttcttgct

SEQ ID NO: 258323 - DNA, 20 bp, Artificial Sequence
  Description of Artificial Sequence: Synthetic oligonucleotide
  Target: ATXN1; (+) strand; PAM type: YTN; PAM sequence: TTC
tttgagatgggttcttgcta

SEQ ID NO: 258324 - DNA, 20 bp, Artificial Sequence
  Description of Artificial Sequence: Synthetic oligonucleotide
  Target: ATXN1; (+) strand; PAM type: YTN; PAM sequence: CTT
tgagatgggttcttgctatg

SEQ ID NO: 258325 - DNA, 20 bp, Artificial Sequence
  Description of Artificial Sequence: Synthetic oligonucleotide
  Target: ATXN1; (+) strand; PAM type: YTN; PAM sequence: TTT
gagatgggttcttgctatgt

SEQ ID NO: 258326 - DNA, 20 bp, Artificial Sequence
  Description of Artificial Sequence: Synthetic oligonucleotide
  Target: ATXN1; (+) strand; PAM type: YTN; PAM sequence: TTG
agatgggttcttgctatgtt

SEQ ID NO: 258327 - DNA, 20 bp, Artificial Sequence
  Description of Artificial Sequence: Synthetic oligonucleotide
  Target: ATXN1; (+) strand; PAM type: YTN; PAM sequence: TTC
ttgctatgttgcctaggcta

SEQ ID NO: 258328 - DNA, 20 bp, Artificial Sequence
  Description of Artificial Sequence: Synthetic oligonucleotide
  Target: ATXN1; (+) strand; PAM type: YTN; PAM sequence: CTT
gctatgttgcctaggctagg

SEQ ID NO: 258329 - DNA, 20 bp, Artificial Sequence
  Description of Artificial Sequence: Synthetic oligonucleotide
  Target: ATXN1; (+) strand; PAM type: YTN; PAM sequence: TTG
ctatgttgcctaggctaggc

SEQ ID NO: 258330 - DNA, 20 bp, Artificial Sequence
  Description of Artificial Sequence: Synthetic oligonucleotide
  Target: ATXN1; (+) strand; PAM type: YTN; PAM sequence: CTA
tgttgcctaggctaggctca

SEQ ID NO: 258331 - DNA, 20 bp, Artificial Sequence
  Description of Artificial Sequence: Synthetic oligonucleotide
  Target: ATXN1; (+) strand; PAM type: YTN; PAM sequence: TTG
cctaggctaggctcaaactc

SEQ ID NO: 258332 - DNA, 20 bp, Artificial Sequence
  Description of Artificial Sequence: Synthetic oligonucleotide
  Target: ATXN1; (+) strand; PAM type: YTN; PAM sequence: CTA
ggctaggctcaaactctggg

SEQ ID NO: 258333 - DNA, 20 bp, Artificial Sequence
  Description of Artificial Sequence: Synthetic oligonucleotide
  Target: ATXN1; (+) strand; PAM type: YTN; PAM sequence: CTA
ggctcaaactctggggctca

SEQ ID NO: 258334 - DNA, 20 bp, Artificial Sequence
  Description of Artificial Sequence: Synthetic oligonucleotide
  Target: ATXN1; (+) strand; PAM type: YTN; PAM sequence: CTC
aaactctggggctcaagtga

SEQ ID NO: 258335 - DNA, 20 bp, Artificial Sequence
  Description of Artificial Sequence: Synthetic oligonucleotide
  Target: ATXN1; (+) strand; PAM type: YTN; PAM sequence: CTC
tggggctcaagtgatcctcc

SEQ ID NO: 258336 - DNA, 20 bp, Artificial Sequence
  Description of Artificial Sequence: Synthetic oligonucleotide
  Target: ATXN1; (+) strand; PAM type: YTN; PAM sequence: CTG
gggctcaagtgatcctcctg

SEQ ID NO: 258337 - DNA, 20 bp, Artificial Sequence
  Description of Artificial Sequence: Synthetic oligonucleotide
  Target: ATXN1; (+) strand; PAM type: YTN; PAM sequence: CTC
aagtgatcctcctgcctcag

SEQ ID NO: 258338 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagccacccaagta

SEQ ID NO: 258339 - DNA, 20 bp, Artificial Sequence
  Description of Artificial Sequence: Synthetic oligonucleotide
  Target: ATXN1; (+) strand; PAM type: YTN; PAM sequence: CTG
cctcagccacccaagtagct

SEQ ID NO: 258340 - DNA, 20 bp, Artificial Sequence
  Description of Artificial Sequence: Synthetic oligonucleotide
  Target: ATXN1; (+) strand; PAM type: YTN; PAM sequence: CTC
agccacccaagtagctggga

SEQ ID NO: 258341 - DNA, 20 bp, Artificial Sequence
  Description of Artificial Sequence: Synthetic oligonucleotide
  Target: ATXN1; (+) strand; PAM type: YTN; PAM sequence: CTG
ggagtacaggtgcatgacac

SEQ ID NO: 258342 - DNA, 20 bp, Artificial Sequence
  Description of Artificial Sequence: Synthetic oligonucleotide
  Target: ATXN1; (+) strand; PAM type: YTN; PAM sequence: CTG
cacatggcttcccatgagct

SEQ ID NO: 258343 - DNA, 20 bp, Artificial Sequence
  Description of Artificial Sequence: Synthetic oligonucleotide
  Target: ATXN1; (+) strand; PAM type: YTN; PAM sequence: CTT
cccatgagcttttgatgaac

SEQ ID NO: 258344 - DNA, 20 bp, Artificial Sequence
  Description of Artificial Sequence: Synthetic oligonucleotide
  Target: ATXN1; (+) strand; PAM type: YTN; PAM sequence: TTC
ccatgagcttttgatgaact

SEQ ID NO: 258345 - DNA, 20 bp, Artificial Sequence
  Description of Artificial Sequence: Synthetic oligonucleotide
  Target: ATXN1; (+) strand; PAM type: YTN; PAM sequence: CTT
ttgatgaactgctgcatgta

SEQ ID NO: 258346 - DNA, 20 bp, Artificial Sequence
  Description of Artificial Sequence: Synthetic oligonucleotide
  Target: ATXN1; (+) strand; PAM type: YTN; PAM sequence: TTT
tgatgaactgctgcatgtaa

SEQ ID NO: 258347 - DNA, 20 bp, Artificial Sequence
  Description of Artificial Sequence: Synthetic oligonucleotide
  Target: ATXN1; (+) strand; PAM type: YTN; PAM sequence: TTT
gatgaactgctgcatgtaaa

SEQ ID NO: 258348 - DNA, 20 bp, Artificial Sequence
  Description of Artificial Sequence: Synthetic oligonucleotide
  Target: ATXN1; (+) strand; PAM type: YTN; PAM sequence: TTG
atgaactgctgcatgtaaat

SEQ ID NO: 258349 - DNA, 20 bp, Artificial Sequence
  Description of Artificial Sequence: Synthetic oligonucleotide
  Target: ATXN1; (+) strand; PAM type: YTN; PAM sequence: CTG
ctgcatgtaaatattttagc

SEQ ID NO: 258350 - DNA, 20 bp, Artificial Sequence
  Description of Artificial Sequence: Synthetic oligonucleotide
  Target: ATXN1; (+) strand; PAM type: YTN; PAM sequence: CTG
catgtaaatattttagcaca

SEQ ID NO: 258351 - DNA, 20 bp, Artificial Sequence
  Description of Artificial Sequence: Synthetic oligonucleotide
  Target: ATXN1; (+) strand; PAM type: YTN; PAM sequence: TTT
tagcacagtgcttggcacat

SEQ ID NO: 258352 - DNA, 20 bp, Artificial Sequence
  Description of Artificial Sequence: Synthetic oligonucleotide
  Target: ATXN1; (+) strand; PAM type: YTN; PAM sequence: TTT
agcacagtgcttggcacata

SEQ ID NO: 258353 - DNA, 20 bp, Artificial Sequence
  Description of Artificial Sequence: Synthetic oligonucleotide
  Target: ATXN1; (+) strand; PAM type: YTN; PAM sequence: TTA
gcacagtgcttggcacataa

SEQ ID NO: 258354 - DNA, 20 bp, Artificial Sequence
  Description of Artificial Sequence: Synthetic oligonucleotide
  Target: ATXN1; (+) strand; PAM type: YTN; PAM sequence: CTT
ggcacataatacatgttcaa

SEQ ID NO: 258355 - DNA, 20 bp, Artificial Sequence
  Description of Artificial Sequence: Synthetic oligonucleotide
  Target: ATXN1; (+) strand; PAM type: YTN; PAM sequence: TTG
gcacataatacatgttcaat

SEQ ID NO: 258356 - DNA, 20 bp, Artificial Sequence
  Description of Artificial Sequence: Synthetic oligonucleotide
  Target: ATXN1; (+) strand; PAM type: YTN; PAM sequence: TTC
aataaatgttatctattcca

SEQ ID NO: 258357 - DNA, 20 bp, Artificial Sequence
  Description of Artificial Sequence: Synthetic oligonucleotide
  Target: ATXN1; (+) strand; PAM type: YTN; PAM sequence: TTA
tctattccaatcattattat

SEQ ID NO: 258358 - DNA, 20 bp, Artificial Sequence
  Description of Artificial Sequence: Synthetic oligonucleotide
  Target: ATXN1; (+) strand; PAM type: YTN; PAM sequence: CTA
ttccaatcattattataatt

SEQ ID NO: 258359 - DNA, 20 bp, Artificial Sequence
  Description of Artificial Sequence: Synthetic oligonucleotide
  Target: ATXN1; (+) strand; PAM type: YTN; PAM sequence: TTC
caatcattattataattaat

SEQ ID NO: 258360 - DNA, 20 bp, Artificial Sequence
  Description of Artificial Sequence: Synthetic oligonucleotide
  Target: ATXN1; (+) strand; PAM type: YTN; PAM sequence: TTA
ttataattaatagccaatcc

SEQ ID NO: 258361 - DNA, 20 bp, Artificial Sequence
  Description of Artificial Sequence: Synthetic oligonucleotide
  Target: ATXN1; (+) strand; PAM type: YTN; PAM sequence: TTA
taattaatagccaatcctat

SEQ ID NO: 258362 - DNA, 20 bp, Artificial Sequence
  Description of Artificial Sequence: Synthetic oligonucleotide
  Target: ATXN1; (+) strand; PAM type: YTN; PAM sequence: TTA
atagccaatcctattcttat

SEQ ID NO: 258363 - DNA, 20 bp, Artificial Sequence
  Description of Artificial Sequence: Synthetic oligonucleotide
  Target: ATXN1; (+) strand; PAM type: YTN; PAM sequence: CTA
ttcttatgatagttctatca

SEQ ID NO: 258364 - DNA, 20 bp, Artificial Sequence
  Description of Artificial Sequence: Synthetic oligonucleotide
  Target: ATXN1; (+) strand; PAM type: YTN; PAM sequence: TTC
ttatgatagttctatcactg

SEQ ID NO: 258365 - DNA, 20 bp, Artificial Sequence
  Description of Artificial Sequence: Synthetic oligonucleotide
  Target: ATXN1; (+) strand; PAM type: YTN; PAM sequence: CTT
atgatagttctatcactgtc

SEQ ID NO: 258366 - DNA, 20 bp, Artificial Sequence
  Description of Artificial Sequence: Synthetic oligonucleotide
  Target: ATXN1; (+) strand; PAM type: YTN; PAM sequence: TTA
tgatagttctatcactgtct

SEQ ID NO: 258367 - DNA, 20 bp, Artificial Sequence
  Description of Artificial Sequence: Synthetic oligonucleotide
  Target: ATXN1; (+) strand; PAM type: YTN; PAM sequence: TTC
tatcactgtctactcatttg

SEQ ID NO: 258368 - DNA, 20 bp, Artificial Sequence
  Description of Artificial Sequence: Synthetic oligonucleotide
  Target: ATXN1; (+) strand; PAM type: YTN; PAM sequence: CTA
tcactgtctactcatttgcc

SEQ ID NO: 258369 - DNA, 20 bp, Artificial Sequence
  Description of Artificial Sequence: Synthetic oligonucleotide
  Target: ATXN1; (+) strand; PAM type: YTN; PAM sequence: CTG
tctactcatttgcctggtaa

SEQ ID NO: 258370 - DNA, 20 bp, Artificial Sequence
  Description of Artificial Sequence: Synthetic oligonucleotide
  Target: ATXN1; (+) strand; PAM type: YTN; PAM sequence: CTA
ctcatttgcctggtaatcat

SEQ ID NO: 258371 - DNA, 20 bp, Artificial Sequence
  Description of Artificial Sequence: Synthetic oligonucleotide
  Target: ATXN1; (+) strand; PAM type: YTN; PAM sequence: CTC
atttgcctggtaatcatata

SEQ ID NO: 258372 - DNA, 20 bp, Artificial Sequence
  Description of Artificial Sequence: Synthetic oligonucleotide
  Target: ATXN1; (+) strand; PAM type: YTN; PAM sequence: TTT
gcctggtaatcatatactct

SEQ ID NO: 258373 - DNA, 20 bp, Artificial Sequence
  Description of Artificial Sequence: Synthetic oligonucleotide
  Target: ATXN1; (+) strand; PAM type: YTN; PAM sequence: TTG
cctggtaatcatatactctt

SEQ ID NO: 258374 - DNA, 20 bp, Artificial Sequence
  Description of Artificial Sequence: Synthetic oligonucleotide
  Target: ATXN1; (+) strand; PAM type: YTN; PAM sequence: CTG
gtaatcatatactctttgta

SEQ ID NO: 258375 - DNA, 20 bp, Artificial Sequence
  Description of Artificial Sequence: Synthetic oligonucleotide
  Target: ATXN1; (+) strand; PAM type: YTN; PAM sequence: CTC
tttgtattttataaatatat

SEQ ID NO: 258376 - DNA, 20 bp, Artificial Sequence
  Description of Artificial Sequence: Synthetic oligonucleotide
  Target: ATXN1; (+) strand; PAM type: YTN; PAM sequence: CTT
tgtattttataaatatatac

SEQ ID NO: 258377 - DNA, 20 bp, Artificial Sequence
  Description of Artificial Sequence: Synthetic oligonucleotide
  Target: ATXN1; (+) strand; PAM type: YTN; PAM sequence: TTT
gtattttataaatatataca

SEQ ID NO: 258378 - DNA, 20 bp, Artificial Sequence
  Description of Artificial Sequence: Synthetic oligonucleotide
  Target: ATXN1; (+) strand; PAM type: YTN; PAM sequence: TTG
tattttataaatatatacat

SEQ ID NO: 258379 - DNA, 20 bp, Artificial Sequence
  Description of Artificial Sequence: Synthetic oligonucleotide
  Target: ATXN1; (+) strand; PAM type: YTN; PAM sequence: TTT
tataaatatatacattaata

SEQ ID NO: 258380 - DNA, 20 bp, Artificial Sequence
  Description of Artificial Sequence: Synthetic oligonucleotide
  Target: ATXN1; (+) strand; PAM type: YTN; PAM sequence: TTT
ataaatatatacattaatat

SEQ ID NO: 258381 - DNA, 20 bp, Artificial Sequence
  Description of Artificial Sequence: Synthetic oligonucleotide
  Target: ATXN1; (+) strand; PAM type: YTN; PAM sequence: TTA
taaatatatacattaatata

SEQ ID NO: 258382 - DNA, 20 bp, Artificial Sequence
  Description of Artificial Sequence: Synthetic oligonucleotide
  Target: ATXN1; (+) strand; PAM type: YTN; PAM sequence: TTA
atatattttataaatatttt

SEQ ID NO: 258383 - DNA, 20 bp, Artificial Sequence
  Description of Artificial Sequence: Synthetic oligonucleotide
  Target: ATXN1; (+) strand; PAM type: YTN; PAM sequence: TTT
tataaatatttttataatat

SEQ ID NO: 258384 - DNA, 20 bp, Artificial Sequence
  Description of Artificial Sequence: Synthetic oligonucleotide
  Target: ATXN1; (+) strand; PAM type: YTN; PAM sequence: TTT
ataaatatttttataatatt

SEQ ID NO: 258385 - DNA, 20 bp, Artificial Sequence
  Description of Artificial Sequence: Synthetic oligonucleotide
  Target: ATXN1; (+) strand; PAM type: YTN; PAM sequence: TTA
taaatatttttataatattt

SEQ ID NO: 258386 - DNA, 20 bp, Artificial Sequence
  Description of Artificial Sequence: Synthetic oligonucleotide
  Target: ATXN1; (+) strand; PAM type: YTN; PAM sequence: TTT
ttataatattttgagtaatt

SEQ ID NO: 258387 - DNA, 20 bp, Artificial Sequence
  Description of Artificial Sequence: Synthetic oligonucleotide
  Target: ATXN1; (+) strand; PAM type: YTN; PAM sequence: TTT
tataatattttgagtaattt

SEQ ID NO: 258388 - DNA, 20 bp, Artificial Sequence
  Description of Artificial Sequence: Synthetic oligonucleotide
  Target: ATXN1; (+) strand; PAM type: YTN; PAM sequence: TTT
ataatattttgagtaattta

SEQ ID NO: 258389 - DNA, 20 bp, Artificial Sequence
  Description of Artificial Sequence: Synthetic oligonucleotide
  Target: ATXN1; (+) strand; PAM type: YTN; PAM sequence: TTA
taatattttgagtaatttaa

SEQ ID NO: 258390 - DNA, 20 bp, Artificial Sequence
  Description of Artificial Sequence: Synthetic oligonucleotide
  Target: ATXN1; (+) strand; PAM type: YTN; PAM sequence: TTT
tgagtaatttaaaatgccca

SEQ ID NO: 258391 - DNA, 20 bp, Artificial Sequence
  Description of Artificial Sequence: Synthetic oligonucleotide
  Target: ATXN1; (+) strand; PAM type: YTN; PAM sequence: TTT
gagtaatttaaaatgcccaa

SEQ ID NO: 258392 - DNA, 20 bp, Artificial Sequence
  Description of Artificial Sequence: Synthetic oligonucleotide
  Target: ATXN1; (+) strand; PAM type: YTN; PAM sequence: TTG
agtaatttaaaatgcccaaa

SEQ ID NO: 258393 - DNA, 20 bp, Artificial Sequence
  Description of Artificial Sequence: Synthetic oligonucleotide
  Target: ATXN1; (+) strand; PAM type: YTN; PAM sequence: TTT
aaaatgcccaaatggctgtt

SEQ ID NO: 258394 - DNA, 20 bp, Artificial Sequence
  Description of Artificial Sequence: Synthetic oligonucleotide
  Target: ATXN1; (+) strand; PAM type: YTN; PAM sequence: TTA
aaatgcccaaatggctgttt

SEQ ID NO: 258395 - DNA, 20 bp, Artificial Sequence
  Description of Artificial Sequence: Synthetic oligonucleotide
  Target: ATXN1; (+) strand; PAM type: YTN; PAM sequence: CTG
ttttcttgtgatacaaccat

SEQ ID NO: 258396 - DNA, 20 bp, Artificial Sequence
  Description of Artificial Sequence: Synthetic oligonucleotide
  Target: ATXN1; (+) strand; PAM type: YTN; PAM sequence: TTT
tcttgtgatacaaccatgga

SEQ ID NO: 258397 - DNA, 20 bp, Artificial Sequence
  Description of Artificial Sequence: Synthetic oligonucleotide
  Target: ATXN1; (+) strand; PAM type: YTN; PAM sequence: TTT
cttgtgatacaaccatggag

SEQ ID NO: 258398 - DNA, 20 bp, Artificial Sequence
  Description of Artificial Sequence: Synthetic oligonucleotide
  Target: ATXN1; (+) strand; PAM type: YTN; PAM sequence: TTC
ttgtgatacaaccatggagt

SEQ ID NO: 258399 - DNA, 20 bp, Artificial Sequence
  Description of Artificial Sequence: Synthetic oligonucleotide
  Target: ATXN1; (+) strand; PAM type: YTN; PAM sequence: CTT
gtgatacaaccatggagtac

SEQ ID NO: 258400 - DNA, 20 bp, Artificial Sequence
  Description of Artificial Sequence: Synthetic oligonucleotide
  Target: ATXN1; (+) strand; PAM type: YTN; PAM sequence: TTG
tgatacaaccatggagtact

SEQ ID NO: 258401 - DNA, 20 bp, Artificial Sequence
  Description of Artificial Sequence: Synthetic oligonucleotide
  Target: ATXN1; (+) strand; PAM type: YTN; PAM sequence: CTT
tccagggtgggtatggcagt

SEQ ID NO: 258402 - DNA, 20 bp, Artificial Sequence
  Description of Artificial Sequence: Synthetic oligonucleotide
  Target: ATXN1; (+) strand; PAM type: YTN; PAM sequence: TTT
ccagggtgggtatggcagtg

SEQ ID NO: 258403 - DNA, 20 bp, Artificial Sequence
  Description of Artificial Sequence: Synthetic oligonucleotide
  Target: ATXN1; (+) strand; PAM type: YTN; PAM sequence: TTC
cagggtgggtatggcagtgt

SEQ ID NO: 258404 - DNA, 20 bp, Artificial Sequence
  Description of Artificial Sequence: Synthetic oligonucleotide
  Target: ATXN1; (+) strand; PAM type: YTN; PAM sequence: CTG
gccctgggcagtgctatttt

SEQ ID NO: 258405 - DNA, 20 bp, Artificial Sequence
  Description of Artificial Sequence: Synthetic oligonucleotide
  Target: ATXN1; (+) strand; PAM type: YTN; PAM sequence: CTG
ggcagtgctattttcagagt

SEQ ID NO: 258406 - DNA, 20 bp, Artificial Sequence
  Description of Artificial Sequence: Synthetic oligonucleotide
  Target: ATXN1; (+) strand; PAM type: YTN; PAM sequence: CTA
ttttcagagtgtgtgagggc

SEQ ID NO: 258407 - DNA, 20 bp, Artificial Sequence
  Description of Artificial Sequence: Synthetic oligonucleotide
  Target: ATXN1; (+) strand; PAM type: YTN; PAM sequence: TTT
tcagagtgtgtgagggccag

SEQ ID NO: 258408 - DNA, 20 bp, Artificial Sequence
  Description of Artificial Sequence: Synthetic oligonucleotide
  Target: ATXN1; (+) strand; PAM type: YTN; PAM sequence: TTT
cagagtgtgtgagggccagg

SEQ ID NO: 258409 - DNA, 20 bp, Artificial Sequence
  Description of Artificial Sequence: Synthetic oligonucleotide
  Target: ATXN1; (+) strand; PAM type: YTN; PAM sequence: TTC
agagtgtgtgagggccaggc

SEQ ID NO: 258410 - DNA, 20 bp, Artificial Sequence
  Description of Artificial Sequence: Synthetic oligonucleotide
  Target: ATXN1; (+) strand; PAM type: YTN; PAM sequence: CTG
caccacatcccatatttccc

SEQ ID NO: 258411 - DNA, 20 bp, Artificial Sequence
  Description of Artificial Sequence: Synthetic oligonucleotide
  Target: ATXN1; (+) strand; PAM type: YTN; PAM sequence: TTT
ccctttgaagaaatcagcca

SEQ ID NO: 258412 - DNA, 20 bp, Artificial Sequence
  Description of Artificial Sequence: Synthetic oligonucleotide
  Target: ATXN1; (+) strand; PAM type: YTN; PAM sequence: TTC
cctttgaagaaatcagccaa

SEQ ID NO: 258413 - DNA, 20 bp, Artificial Sequence
  Description of Artificial Sequence: Synthetic oligonucleotide
  Target: ATXN1; (+) strand; PAM type: YTN; PAM sequence: CTT
tgaagaaatcagccaacgta

SEQ ID NO: 258414 - DNA, 20 bp, Artificial Sequence
  Description of Artificial Sequence: Synthetic oligonucleotide
  Target: ATXN1; (+) strand; PAM type: YTN; PAM sequence: TTT
gaagaaatcagccaacgtaa

SEQ ID NO: 258415 - DNA, 20 bp, Artificial Sequence
  Description of Artificial Sequence: Synthetic oligonucleotide
  Target: ATXN1; (+) strand; PAM type: YTN; PAM sequence: TTG
aagaaatcagccaacgtaac

SEQ ID NO: 258416 - DNA, 20 bp, Artificial Sequence
  Description of Artificial Sequence: Synthetic oligonucleotide
  Target: ATXN1; (+) strand; PAM type: YTN; PAM sequence: CTT
gagggtaccagtgtacaggg

SEQ ID NO: 258417 - DNA, 20 bp, Artificial Sequence
  Description of Artificial Sequence: Synthetic oligonucleotide
  Target: ATXN1; (+) strand; PAM type: YTN; PAM sequence: TTG
agggtaccagtgtacagggg

SEQ ID NO: 258418 - DNA, 20 bp, Artificial Sequence
  Description of Artificial Sequence: Synthetic oligonucleotide
  Target: ATXN1; (+) strand; PAM type: YTN; PAM sequence: CTG
ctacatgtgcatgctgagtg

SEQ ID NO: 258419 - DNA, 20 bp, Artificial Sequence
  Description of Artificial Sequence: Synthetic oligonucleotide
  Target: ATXN1; (+) strand; PAM type: YTN; PAM sequence: CTA
catgtgcatgctgagtggct

SEQ ID NO: 258420 - DNA, 20 bp, Artificial Sequence
  Description of Artificial Sequence: Synthetic oligonucleotide
  Target: ATXN1; (+) strand; PAM type: YTN; PAM sequence: CTG
agtggctgcccgggtctgcc

SEQ ID NO: 258421 - DNA, 20 bp, Artificial Sequence
  Description of Artificial Sequence: Synthetic oligonucleotide
  Target: ATXN1; (+) strand; PAM type: YTN; PAM sequence: CTG
cccgggtctgcctttgtgta

SEQ ID NO: 258422 - DNA, 20 bp, Artificial Sequence
  Description of Artificial Sequence: Synthetic oligonucleotide
  Target: ATXN1; (+) strand; PAM type: YTN; PAM sequence: CTG
cctttgtgtactaggggaat

SEQ ID NO: 258423 - DNA, 20 bp, Artificial Sequence
  Description of Artificial Sequence: Synthetic oligonucleotide
  Target: ATXN1; (+) strand; PAM type: YTN; PAM sequence: CTT
tgtgtactaggggaatgtgt

SEQ ID NO: 258424 - DNA, 20 bp, Artificial Sequence
  Description of Artificial Sequence: Synthetic oligonucleotide
  Target: ATXN1; (+) strand; PAM type: YTN; PAM sequence: TTT
gtgtactaggggaatgtgtg

SEQ ID NO: 258425 - DNA, 20 bp, Artificial Sequence
  Description of Artificial Sequence: Synthetic oligonucleotide
  Target: ATXN1; (+) strand; PAM type: YTN; PAM sequence: TTG
tgtactaggggaatgtgtgg

SEQ ID NO: 258426 - DNA, 20 bp, Artificial Sequence
  Description of Artificial Sequence: Synthetic oligonucleotide
  Target: ATXN1; (+) strand; PAM type: YTN; PAM sequence: CTA
ggggaatgtgtggtgaggct

SEQ ID NO: 258427 - DNA, 20 bp, Artificial Sequence
  Description of Artificial Sequence: Synthetic oligonucleotide
  Target: ATXN1; (+) strand; PAM type: YTN; PAM sequence: CTG
gaggggacagagctggccac

SEQ ID NO: 258428 - DNA, 20 bp, Artificial Sequence
  Description of Artificial Sequence: Synthetic oligonucleotide
  Target: ATXN1; (+) strand; PAM type: YTN; PAM sequence: CTG
gccacctgtgagaaggactc

SEQ ID NO: 258429 - DNA, 20 bp, Artificial Sequence
  Description of Artificial Sequence: Synthetic oligonucleotide
  Target: ATXN1; (+) strand; PAM type: YTN; PAM sequence: CTG
tgagaaggactctcagggct

SEQ ID NO: 258430 - DNA, 20 bp, Artificial Sequence
  Description of Artificial Sequence: Synthetic oligonucleotide
  Target: ATXN1; (+) strand; PAM type: YTN; PAM sequence: CTC
tcagggctgctgtcatcatt

SEQ ID NO: 258431 - DNA, 20 bp, Artificial Sequence
  Description of Artificial Sequence: Synthetic oligonucleotide
  Target: ATXN1; (+) strand; PAM type: YTN; PAM sequence: CTC
agggctgctgtcatcatttg

SEQ ID NO: 258432 - DNA, 20 bp, Artificial Sequence
  Description of Artificial Sequence: Synthetic oligonucleotide
  Target: ATXN1; (+) strand; PAM type: YTN; PAM sequence: CTG
ctgtcatcatttggcagagt

SEQ ID NO: 258433 - DNA, 20 bp, Artificial Sequence
  Description of Artificial Sequence: Synthetic oligonucleotide
  Target: ATXN1; (+) strand; PAM type: YTN; PAM sequence: CTG
tcatcatttggcagagtcca

SEQ ID NO: 258434 - DNA, 20 bp, Artificial Sequence
  Description of Artificial Sequence: Synthetic oligonucleotide
  Target: ATXN1; (+) strand; PAM type: YTN; PAM sequence: TTT
ggcagagtccatccttctac

SEQ ID NO: 258435 - DNA, 20 bp, Artificial Sequence
  Description of Artificial Sequence: Synthetic oligonucleotide
  Target: ATXN1; (+) strand; PAM type: YTN; PAM sequence: TTG
gcagagtccatccttctact

SEQ ID NO: 258436 - DNA, 20 bp, Artificial Sequence
  Description of Artificial Sequence: Synthetic oligonucleotide
  Target: ATXN1; (+) strand; PAM type: YTN; PAM sequence: CTT
ctactccaacccaacctcac

SEQ ID NO: 258437 - DNA, 20 bp, Artificial Sequence
  Description of Artificial Sequence: Synthetic oligonucleotide
  Target: ATXN1; (+) strand; PAM type: YTN; PAM sequence: TTC
tactccaacccaacctcact

SEQ ID NO: 258438 - DNA, 20 bp, Artificial Sequence
  Description of Artificial Sequence: Synthetic oligonucleotide
  Target: ATXN1; (+) strand; PAM type: YTN; PAM sequence: CTA
ctccaacccaacctcactct

SEQ ID NO: 258439 - DNA, 20 bp, Artificial Sequence
  Description of Artificial Sequence: Synthetic oligonucleotide
  Target: ATXN1; (+) strand; PAM type: YTN; PAM sequence: CTC
caacccaacctcactctcag

SEQ ID NO: 258440 - DNA, 20 bp, Artificial Sequence
  Description of Artificial Sequence: Synthetic oligonucleotide
  Target: ATXN1; (+) strand; PAM type: YTN; PAM sequence: CTC
actctcagggaggggacgga

SEQ ID NO: 258441 - DNA, 20 bp, Artificial Sequence
  Description of Artificial Sequence: Synthetic oligonucleotide
  Target: ATXN1; (+) strand; PAM type: YTN; PAM sequence: CTC
tcagggaggggacggatgag

SEQ ID NO: 258442 - DNA, 20 bp, Artificial Sequence
  Description of Artificial Sequence: Synthetic oligonucleotide
  Target: ATXN1; (+) strand; PAM type: YTN; PAM sequence: CTC
agggaggggacggatgagga

SEQ ID NO: 258443 - DNA, 20 bp, Artificial Sequence
  Description of Artificial Sequence: Synthetic oligonucleotide
  Target: ATXN1; (+) strand; PAM type: YTN; PAM sequence: CTC
atcctatcatctacagggtt

SEQ ID NO: 258444 - DNA, 20 bp, Artificial Sequence
  Description of Artificial Sequence: Synthetic oligonucleotide
  Target: ATXN1; (+) strand; PAM type: YTN; PAM sequence: CTA
tcatctacagggtttttaaa

SEQ ID NO: 258445 - DNA, 20 bp, Artificial Sequence
  Description of Artificial Sequence: Synthetic oligonucleotide
  Target: ATXN1; (+) strand; PAM type: YTN; PAM sequence: CTA
cagggtttttaaagtgtggg

SEQ ID NO: 258446 - DNA, 20 bp, Artificial Sequence
  Description of Artificial Sequence: Synthetic oligonucleotide
  Target: ATXN1; (+) strand; PAM type: YTN; PAM sequence: TTT
ttaaagtgtgggtcctcatt

SEQ ID NO: 258447 - DNA, 20 bp, Artificial Sequence
  Description of Artificial Sequence: Synthetic oligonucleotide
  Target: ATXN1; (+) strand; PAM type: YTN; PAM sequence: TTT
taaagtgtgggtcctcattc

SEQ ID NO: 258448 - DNA, 20 bp, Artificial Sequence
  Description of Artificial Sequence: Synthetic oligonucleotide
  Target: ATXN1; (+) strand; PAM type: YTN; PAM sequence: TTT
aaagtgtgggtcctcattct

SEQ ID NO: 258449 - DNA, 20 bp, Artificial Sequence
  Description of Artificial Sequence: Synthetic oligonucleotide
  Target: ATXN1; (+) strand; PAM type: YTN; PAM sequence: TTA
aagtgtgggtcctcattctc

SEQ ID NO: 258450 - DNA, 20 bp, Artificial Sequence
  Description of Artificial Sequence: Synthetic oligonucleotide
  Target: ATXN1; (+) strand; PAM type: YTN; PAM sequence: CTC
attctctggcctgggtggcc

SEQ ID NO: 258451 - DNA, 20 bp, Artificial Sequence
  Description of Artificial Sequence: Synthetic oligonucleotide
  Target: ATXN1; (+) strand; PAM type: YTN; PAM sequence: TTC
tctggcctgggtggccatga

SEQ ID NO: 258452 - DNA, 20 bp, Artificial Sequence
  Description of Artificial Sequence: Synthetic oligonucleotide
  Target: ATXN1; (+) strand; PAM type: YTN; PAM sequence: CTC
tggcctgggtggccatgatc

SEQ ID NO: 258453 - DNA, 20 bp, Artificial Sequence
  Description of Artificial Sequence: Synthetic oligonucleotide
  Target: ATXN1; (+) strand; PAM type: YTN; PAM sequence: CTG
gcctgggtggccatgatccg

SEQ ID NO: 258454 - DNA, 20 bp, Artificial Sequence
  Description of Artificial Sequence: Synthetic oligonucleotide
  Target: ATXN1; (+) strand; PAM type: YTN; PAM sequence: CTG
ggtggccatgatccgagggc

SEQ ID NO: 258455 - DNA, 20 bp, Artificial Sequence
  Description of Artificial Sequence: Synthetic oligonucleotide
  Target: ATXN1; (+) strand; PAM type: YTN; PAM sequence: TTT
tgttctggtgcacagataca

SEQ ID NO: 258456 - DNA, 20 bp, Artificial Sequence
  Description of Artificial Sequence: Synthetic oligonucleotide
  Target: ATXN1; (+) strand; PAM type: YTN; PAM sequence: TTT
gttctggtgcacagatacaa

SEQ ID NO: 258457 - DNA, 20 bp, Artificial Sequence
  Description of Artificial Sequence: Synthetic oligonucleotide
  Target: ATXN1; (+) strand; PAM type: YTN; PAM sequence: TTG
ttctggtgcacagatacaaa

SEQ ID NO: 258458 - DNA, 20 bp, Artificial Sequence
  Description of Artificial Sequence: Synthetic oligonucleotide
  Target: ATXN1; (+) strand; PAM type: YTN; PAM sequence: TTC
tggtgcacagatacaaagac

SEQ ID NO: 258459 - DNA, 20 bp, Artificial Sequence
  Description of Artificial Sequence: Synthetic oligonucleotide
  Target: ATXN1; (+) strand; PAM type: YTN; PAM sequence: CTG
gtgcacagatacaaagactg

SEQ ID NO: 258460 - DNA, 20 bp, Artificial Sequence
  Description of Artificial Sequence: Synthetic oligonucleotide
  Target: ATXN1; (+) strand; PAM type: YTN; PAM sequence: CTG
gggatggggaggacagtaat

SEQ ID NO: 258461 - DNA, 20 bp, Artificial Sequence
  Description of Artificial Sequence: Synthetic oligonucleotide
  Target: ATXN1; (+) strand; PAM type: YTN; PAM sequence: CTT
ttatacaaggacacatgaac

SEQ ID NO: 258462 - DNA, 20 bp, Artificial Sequence
  Description of Artificial Sequence: Synthetic oligonucleotide
  Target: ATXN1; (+) strand; PAM type: YTN; PAM sequence: TTT
tatacaaggacacatgaacc

SEQ ID NO: 258463 - DNA, 20 bp, Artificial Sequence
  Description of Artificial Sequence: Synthetic oligonucleotide
  Target: ATXN1; (+) strand; PAM type: YTN; PAM sequence: TTT
atacaaggacacatgaacca

SEQ ID NO: 258464 - DNA, 20 bp, Artificial Sequence
  Description of Artificial Sequence: Synthetic oligonucleotide
  Target: ATXN1; (+) strand; PAM type: YTN; PAM sequence: TTA
tacaaggacacatgaaccac

SEQ ID NO: 258465 - DNA, 20 bp, Artificial Sequence
  Description of Artificial Sequence: Synthetic oligonucleotide
  Target: ATXN1; (+) strand; PAM type: YTN; PAM sequence: CTG
gtgccttagagaacataggc

SEQ ID NO: 258466 - DNA, 20 bp, Artificial Sequence
  Description of Artificial Sequence: Synthetic oligonucleotide
  Target: ATXN1; (+) strand; PAM type: YTN; PAM sequence: CTT
agagaacataggcaacgaat

SEQ ID NO: 258467 - DNA, 20 bp, Artificial Sequence
  Description of Artificial Sequence: Synthetic oligonucleotide
  Target: ATXN1; (+) strand; PAM type: YTN; PAM sequence: TTA
gagaacataggcaacgaata

SEQ ID NO: 258468 - DNA, 20 bp, Artificial Sequence
  Description of Artificial Sequence: Synthetic oligonucleotide
  Target: ATXN1; (+) strand; PAM type: YTN; PAM sequence: CTC
tgctgcagcataagtgatcg

SEQ ID NO: 258469 - DNA, 20 bp, Artificial Sequence
  Description of Artificial Sequence: Synthetic oligonucleotide
  Target: ATXN1; (+) strand; PAM type: YTN; PAM sequence: CTG
ctgcagcataagtgatcgaa

SEQ ID NO: 258470 - DNA, 20 bp, Artificial Sequence
  Description of Artificial Sequence: Synthetic oligonucleotide
  Target: ATXN1; (+) strand; PAM type: YTN; PAM sequence: CTG
cagcataagtgatcgaaagt

SEQ ID NO: 258471 - DNA, 20 bp, Artificial Sequence
  Description of Artificial Sequence: Synthetic oligonucleotide
  Target: ATXN1; (+) strand; PAM type: YTN; PAM sequence: TTA
atgcaaattatgtaaatcct

SEQ ID NO: 258472 - DNA, 20 bp, Artificial Sequence
  Description of Artificial Sequence: Synthetic oligonucleotide
  Target: ATXN1; (+) strand; PAM type: YTN; PAM sequence: TTA
tgtaaatcctcactaaatga

SEQ ID NO: 258473 - DNA, 20 bp, Artificial Sequence
  Description of Artificial Sequence: Synthetic oligonucleotide
  Target: ATXN1; (+) strand; PAM type: YTN; PAM sequence: CTC
actaaatgatttgaatagaa

SEQ ID NO: 258474 - DNA, 20 bp, Artificial Sequence
  Description of Artificial Sequence: Synthetic oligonucleotide
  Target: ATXN1; (+) strand; PAM type: YTN; PAM sequence: CTA
aatgatttgaatagaaagga

SEQ ID NO: 258475 - DNA, 20 bp, Artificial Sequence
  Description of Artificial Sequence: Synthetic oligonucleotide
  Target: ATXN1; (+) strand; PAM type: YTN; PAM sequence: TTT
gaatagaaaggaaatcacca

SEQ ID NO: 258476 - DNA, 20 bp, Artificial Sequence
  Description of Artificial Sequence: Synthetic oligonucleotide
  Target: ATXN1; (+) strand; PAM type: YTN; PAM sequence: TTG
aatagaaaggaaatcaccat

SEQ ID NO: 258477 - DNA, 20 bp, Artificial Sequence
  Description of Artificial Sequence: Synthetic oligonucleotide
  Target: ATXN1; (+) strand; PAM type: YTN; PAM sequence: CTG
ttctccataacgtgagctgc

SEQ ID NO: 258478 - DNA, 20 bp, Artificial Sequence
  Description of Artificial Sequence: Synthetic oligonucleotide
  Target: ATXN1; (+) strand; PAM type: YTN; PAM sequence: TTC
tccataacgtgagctgcagt

SEQ ID NO: 258479 - DNA, 20 bp, Artificial Sequence
  Description of Artificial Sequence: Synthetic oligonucleotide
  Target: ATXN1; (+) strand; PAM type: YTN; PAM sequence: CTC
cataacgtgagctgcagtgt

SEQ ID NO: 258480 - DNA, 20 bp, Artificial Sequence
  Description of Artificial Sequence: Synthetic oligonucleotide
  Target: ATXN1; (+) strand; PAM type: YTN; PAM sequence: CTG
cagtgttctatgctgcattt

SEQ ID NO: 258481 - DNA, 20 bp, Artificial Sequence
  Description of Artificial Sequence: Synthetic oligonucleotide
  Target: ATXN1; (+) strand; PAM type: YTN; PAM sequence: TTC
tatgctgcattttacttccc

SEQ ID NO: 258482 - DNA, 20 bp, Artificial Sequence
  Description of Artificial Sequence: Synthetic oligonucleotide
  Target: ATXN1; (+) strand; PAM type: YTN; PAM sequence: CTA
tgctgcattttacttccccg

SEQ ID NO: 258483 - DNA, 20 bp, Artificial Sequence
  Description of Artificial Sequence: Synthetic oligonucleotide
  Target: ATXN1; (+) strand; PAM type: YTN; PAM sequence: CTG
cattttacttccccggtatg

SEQ ID NO: 258484 - DNA, 20 bp, Artificial Sequence
  Description of Artificial Sequence: Synthetic oligonucleotide
  Target: ATXN1; (+) strand; PAM type: YTN; PAM sequence: TTT
tacttccccggtatgagggc

SEQ ID NO: 258485 - DNA, 20 bp, Artificial Sequence
  Description of Artificial Sequence: Synthetic oligonucleotide
  Target: ATXN1; (+) strand; PAM type: YTN; PAM sequence: TTT
acttccccggtatgagggca

SEQ ID NO: 258486 - DNA, 20 bp, Artificial Sequence
  Description of Artificial Sequence: Synthetic oligonucleotide
  Target: ATXN1; (+) strand; PAM type: YTN; PAM sequence: TTA
cttccccggtatgagggcag

SEQ ID NO: 258487 - DNA, 20 bp, Artificial Sequence
  Description of Artificial Sequence: Synthetic oligonucleotide
  Target: ATXN1; (+) strand; PAM type: YTN; PAM sequence: CTT
ccccggtatgagggcagcta

SEQ ID NO: 258488 - DNA, 20 bp, Artificial Sequence
  Description of Artificial Sequence: Synthetic oligonucleotide
  Target: ATXN1; (+) strand; PAM type: YTN; PAM sequence: TTC
cccggtatgagggcagctag

SEQ ID NO: 258489 - DNA, 20 bp, Artificial Sequence
  Description of Artificial Sequence: Synthetic oligonucleotide
  Target: ATXN1; (+) strand; PAM type: YTN; PAM sequence: CTA
gagagatggtgggatgactt

SEQ ID NO: 258490 - DNA, 20 bp, Artificial Sequence
  Description of Artificial Sequence: Synthetic oligonucleotide
  Target: ATXN1; (+) strand; PAM type: YTN; PAM sequence: CTT
tcactgtctctggggacctt

SEQ ID NO: 258491 - DNA, 20 bp, Artificial Sequence
  Description of Artificial Sequence: Synthetic oligonucleotide
  Target: ATXN1; (+) strand; PAM type: YTN; PAM sequence: TTT
cactgtctctggggaccttc

SEQ ID NO: 258492 - DNA, 20 bp, Artificial Sequence
  Description of Artificial Sequence: Synthetic oligonucleotide
  Target: ATXN1; (+) strand; PAM type: YTN; PAM sequence: TTC
actgtctctggggaccttca

SEQ ID NO: 258493 - DNA, 20 bp, Artificial Sequence
  Description of Artificial Sequence: Synthetic oligonucleotide
  Target: ATXN1; (+) strand; PAM type: YTN; PAM sequence: CTG
tctctggggaccttcagaca

SEQ ID NO: 258494 - DNA, 20 bp, Artificial Sequence
  Description of Artificial Sequence: Synthetic oligonucleotide
  Target: ATXN1; (+) strand; PAM type: YTN; PAM sequence: CTC
tggggaccttcagacaaatt

SEQ ID NO: 258495 - DNA, 20 bp, Artificial Sequence
  Description of Artificial Sequence: Synthetic oligonucleotide
  Target: ATXN1; (+) strand; PAM type: YTN; PAM sequence: CTG
gggaccttcagacaaattag

SEQ ID NO: 258496 - DNA, 20 bp, Artificial Sequence
  Description of Artificial Sequence: Synthetic oligonucleotide
  Target: ATXN1; (+) strand; PAM type: YTN; PAM sequence: CTT
cagacaaattagctatcttg

SEQ ID NO: 258497 - DNA, 20 bp, Artificial Sequence
  Description of Artificial Sequence: Synthetic oligonucleotide
  Target: ATXN1; (+) strand; PAM type: YTN; PAM sequence: TTC
agacaaattagctatcttgt

SEQ ID NO: 258498 - DNA, 20 bp, Artificial Sequence
  Description of Artificial Sequence: Synthetic oligonucleotide
  Target: ATXN1; (+) strand; PAM type: YTN; PAM sequence: TTA
gctatcttgtgaacagtccc

SEQ ID NO: 258499 - DNA, 20 bp, Artificial Sequence
  Description of Artificial Sequence: Synthetic oligonucleotide
  Target: ATXN1; (+) strand; PAM type: YTN; PAM sequence: CTA
tcttgtgaacagtcccagga

SEQ ID NO: 258500 - DNA, 20 bp, Artificial Sequence
  Description of Artificial Sequence: Synthetic oligonucleotide
  Target: ATXN1; (+) strand; PAM type: YTN; PAM sequence: CTT
gtgaacagtcccaggatgcc

SEQ ID NO: 258501 - DNA, 20 bp, Artificial Sequence
  Description of Artificial Sequence: Synthetic oligonucleotide
  Target: ATXN1; (+) strand; PAM type: YTN; PAM sequence: TTG
tgaacagtcccaggatgcca

SEQ ID NO: 258502 - DNA, 20 bp, Artificial Sequence
  Description of Artificial Sequence: Synthetic oligonucleotide
  Target: ATXN1; (+) strand; PAM type: YTN; PAM sequence: CTT
tctaaataaacatcaaaatg

SEQ ID NO: 258503 - DNA, 20 bp, Artificial Sequence
  Description of Artificial Sequence: Synthetic oligonucleotide
  Target: ATXN1; (+) strand; PAM type: YTN; PAM sequence: TTT
ctaaataaacatcaaaatgc

SEQ ID NO: 258504 - DNA, 20 bp, Artificial Sequence
  Description of Artificial Sequence: Synthetic oligonucleotide
  Target: ATXN1; (+) strand; PAM type: YTN; PAM sequence: TTC
taaataaacatcaaaatgca

SEQ ID NO: 258505 - DNA, 20 bp, Artificial Sequence
  Description of Artificial Sequence: Synthetic oligonucleotide
  Target: ATXN1; (+) strand; PAM type: YTN; PAM sequence: CTA
aataaacatcaaaatgcatt

SEQ ID NO: 258506 - DNA, 20 bp, Artificial Sequence
  Description of Artificial Sequence: Synthetic oligonucleotide
  Target: ATXN1; (+) strand; PAM type: YTN; PAM sequence: TTT
actgtctgtatcacttaaga

SEQ ID NO: 258507 - DNA, 20 bp, Artificial Sequence
  Description of Artificial Sequence: Synthetic oligonucleotide
  Target: ATXN1; (+) strand; PAM type: YTN; PAM sequence: TTA
ctgtctgtatcacttaagag

SEQ ID NO: 258508 - DNA, 20 bp, Artificial Sequence
  Description of Artificial Sequence: Synthetic oligonucleotide
  Target: ATXN1; (+) strand; PAM type: YTN; PAM sequence: CTG
tctgtatcacttaagaggtt

SEQ ID NO: 258509 - DNA, 20 bp, Artificial Sequence
  Description of Artificial Sequence: Synthetic oligonucleotide
  Target: ATXN1; (+) strand; PAM type: YTN; PAM sequence: CTG
tatcacttaagaggttgaga

SEQ ID NO: 258510 - DNA, 20 bp, Artificial Sequence
  Description of Artificial Sequence: Synthetic oligonucleotide
  Target: ATXN1; (+) strand; PAM type: YTN; PAM sequence: CTT
aagaggttgagaatggaggg

SEQ ID NO: 258511 - DNA, 20 bp, Artificial Sequence
  Description of Artificial Sequence: Synthetic oligonucleotide
  Target: ATXN1; (+) strand; PAM type: YTN; PAM sequence: TTA
agaggttgagaatggagggg

SEQ ID NO: 258512 - DNA, 20 bp, Artificial Sequence
  Description of Artificial Sequence: Synthetic oligonucleotide
  Target: ATXN1; (+) strand; PAM type: YTN; PAM sequence: TTG
agaatggaggggggagccta

SEQ ID NO: 258513 - DNA, 20 bp, Artificial Sequence
  Description of Artificial Sequence: Synthetic oligonucleotide
  Target: ATXN1; (+) strand; PAM type: YTN; PAM sequence: CTA
actgcaaacatttgcgtgtt

SEQ ID NO: 258514 - DNA, 20 bp, Artificial Sequence
  Description of Artificial Sequence: Synthetic oligonucleotide
  Target: ATXN1; (+) strand; PAM type: YTN; PAM sequence: CTG
caaacatttgcgtgttttta

SEQ ID NO: 258515 - DNA, 20 bp, Artificial Sequence
  Description of Artificial Sequence: Synthetic oligonucleotide
  Target: ATXN1; (+) strand; PAM type: YTN; PAM sequence: TTT
gcgtgtttttatttaacaat

SEQ ID NO: 258516 - DNA, 20 bp, Artificial Sequence
  Description of Artificial Sequence: Synthetic oligonucleotide
  Target: ATXN1; (+) strand; PAM type: YTN; PAM sequence: TTG
cgtgtttttatttaacaata

SEQ ID NO: 258517 - DNA, 20 bp, Artificial Sequence
  Description of Artificial Sequence: Synthetic oligonucleotide
  Target: ATXN1; (+) strand; PAM type: YTN; PAM sequence: TTT
ttatttaacaatagcttagc

SEQ ID NO: 258518 - DNA, 20 bp, Artificial Sequence
  Description of Artificial Sequence: Synthetic oligonucleotide
  Target: ATXN1; (+) strand; PAM type: YTN; PAM sequence: TTT
tatttaacaatagcttagct

SEQ ID NO: 258519 - DNA, 20 bp, Artificial Sequence
  Description of Artificial Sequence: Synthetic oligonucleotide
  Target: ATXN1; (+) strand; PAM type: YTN; PAM sequence: TTT
atttaacaatagcttagcta

SEQ ID NO: 258520 - DNA, 20 bp, Artificial Sequence
  Description of Artificial Sequence: Synthetic oligonucleotide
  Target: ATXN1; (+) strand; PAM type: YTN; PAM sequence: TTA
tttaacaatagcttagctat

SEQ ID NO: 258521 - DNA, 20 bp, Artificial Sequence
  Description of Artificial Sequence: Synthetic oligonucleotide
  Target: ATXN1; (+) strand; PAM type: YTN; PAM sequence: TTT
aacaatagcttagctattag

SEQ ID NO: 258522 - DNA, 20 bp, Artificial Sequence
  Description of Artificial Sequence: Synthetic oligonucleotide
  Target: ATXN1; (+) strand; PAM type: YTN; PAM sequence: TTA
acaatagcttagctattaga

SEQ ID NO: 258523 - DNA, 20 bp, Artificial Sequence
  Description of Artificial Sequence: Synthetic oligonucleotide
  Target: ATXN1; (+) strand; PAM type: YTN; PAM sequence: CTT
agctattagacaatatagag

SEQ ID NO: 258524 - DNA, 20 bp, Artificial Sequence
  Description of Artificial Sequence: Synthetic oligonucleotide
  Target: ATXN1; (+) strand; PAM type: YTN; PAM sequence: TTA
gctattagacaatatagagt

SEQ ID NO: 258525 - DNA, 20 bp, Artificial Sequence
  Description of Artificial Sequence: Synthetic oligonucleotide
  Target: ATXN1; (+) strand; PAM type: YTN; PAM sequence: CTA
ttagacaatatagagtatta

SEQ ID NO: 258526 - DNA, 20 bp, Artificial Sequence
  Description of Artificial Sequence: Synthetic oligonucleotide
  Target: ATXN1; (+) strand; PAM type: YTN; PAM sequence: TTA
gacaatatagagtattagaa

SEQ ID NO: 258527 - DNA, 20 bp, Artificial Sequence
  Description of Artificial Sequence: Synthetic oligonucleotide
  Target: ATXN1; (+) strand; PAM type: YTN; PAM sequence: TTA
gaaagactgtcttagaagac

SEQ ID NO: 258528 - DNA, 20 bp, Artificial Sequence
  Description of Artificial Sequence: Synthetic oligonucleotide
  Target: ATXN1; (+) strand; PAM type: YTN; PAM sequence: CTG
tcttagaagactgaagaggt

SEQ ID NO: 258529 - DNA, 20 bp, Artificial Sequence
  Description of Artificial Sequence: Synthetic oligonucleotide
  Target: ATXN1; (+) strand; PAM type: YTN; PAM sequence: CTT
agaagactgaagaggtgaag

SEQ ID NO: 258530 - DNA, 20 bp, Artificial Sequence
  Description of Artificial Sequence: Synthetic oligonucleotide
  Target: ATXN1; (+) strand; PAM type: YTN; PAM sequence: TTA
gaagactgaagaggtgaagc

SEQ ID NO: 258531 - DNA, 20 bp, Artificial Sequence
  Description of Artificial Sequence: Synthetic oligonucleotide
  Target: ATXN1; (+) strand; PAM type: YTN; PAM sequence: CTG
aagaggtgaagctggtgttc

SEQ ID NO: 258532 - DNA, 20 bp, Artificial Sequence
  Description of Artificial Sequence: Synthetic oligonucleotide
  Target: ATXN1; (+) strand; PAM type: YTN; PAM sequence: CTG
gtgttctgagtatgtctaca

SEQ ID NO: 258533 - DNA, 20 bp, Artificial Sequence
  Description of Artificial Sequence: Synthetic oligonucleotide
  Target: ATXN1; (+) strand; PAM type: YTN; PAM sequence: TTC
tgagtatgtctacacagcct

SEQ ID NO: 258534 - DNA, 20 bp, Artificial Sequence
  Description of Artificial Sequence: Synthetic oligonucleotide
  Target: ATXN1; (+) strand; PAM type: YTN; PAM sequence: CTG
agtatgtctacacagcctgc

SEQ ID NO: 258535 - DNA, 20 bp, Artificial Sequence
  Description of Artificial Sequence: Synthetic oligonucleotide
  Target: ATXN1; (+) strand; PAM type: YTN; PAM sequence: CTA
cacagcctgcatagaggcag

SEQ ID NO: 258536 - DNA, 20 bp, Artificial Sequence
  Description of Artificial Sequence: Synthetic oligonucleotide
  Target: ATXN1; (+) strand; PAM type: YTN; PAM sequence: CTG
catagaggcagatgtatata

SEQ ID NO: 258537 - DNA, 20 bp, Artificial Sequence
  Description of Artificial Sequence: Synthetic oligonucleotide
  Target: ATXN1; (+) strand; PAM type: YTN; PAM sequence: TTA
ctctgcctaaaatggataaa

SEQ ID NO: 258538 - DNA, 20 bp, Artificial Sequence
  Description of Artificial Sequence: Synthetic oligonucleotide
  Target: ATXN1; (+) strand; PAM type: YTN; PAM sequence: CTC
tgcctaaaatggataaaact

SEQ ID NO: 258539 - DNA, 20 bp, Artificial Sequence
  Description of Artificial Sequence: Synthetic oligonucleotide
  Target: ATXN1; (+) strand; PAM type: YTN; PAM sequence: CTG
cctaaaatggataaaactcg

SEQ ID NO: 258540 - DNA, 20 bp, Artificial Sequence
  Description of Artificial Sequence: Synthetic oligonucleotide
  Target: ATXN1; (+) strand; PAM type: YTN; PAM sequence: CTA
aaatggataaaactcggaac

SEQ ID NO: 258541 - DNA, 20 bp, Artificial Sequence
  Description of Artificial Sequence: Synthetic oligonucleotide
  Target: ATXN1; (+) strand; PAM type: YTN; PAM sequence: CTC
ggaacaaaacaatccacatt

SEQ ID NO: 258542 - DNA, 20 bp, Artificial Sequence
  Description of Artificial Sequence: Synthetic oligonucleotide
  Target: ATXN1; (+) strand; PAM type: YTN; PAM sequence: TTT
agtaataccctgaagctgac

SEQ ID NO: 258543 - DNA, 20 bp, Artificial Sequence
  Description of Artificial Sequence: Synthetic oligonucleotide
  Target: ATXN1; (+) strand; PAM type: YTN; PAM sequence: TTA
gtaataccctgaagctgact

SEQ ID NO: 258544 - DNA, 20 bp, Artificial Sequence
  Description of Artificial Sequence: Synthetic oligonucleotide
  Target: ATXN1; (+) strand; PAM type: YTN; PAM sequence: CTG
aagctgactctaatttgtat

SEQ ID NO: 258545 - DNA, 20 bp, Artificial Sequence
  Description of Artificial Sequence: Synthetic oligonucleotide
  Target: ATXN1; (+) strand; PAM type: YTN; PAM sequence: CTG
actctaatttgtattcactg

SEQ ID NO: 258546 - DNA, 20 bp, Artificial Sequence
  Description of Artificial Sequence: Synthetic oligonucleotide
  Target: ATXN1; (+) strand; PAM type: YTN; PAM sequence: CTC
taatttgtattcactgtgac

SEQ ID NO: 258547 - DNA, 20 bp, Artificial Sequence
  Description of Artificial Sequence: Synthetic oligonucleotide
  Target: ATXN1; (+) strand; PAM type: YTN; PAM sequence: CTA
atttgtattcactgtgacaa

SEQ ID NO: 258548 - DNA, 20 bp, Artificial Sequence
  Description of Artificial Sequence: Synthetic oligonucleotide
  Target: ATXN1; (+) strand; PAM type: YTN; PAM sequence: TTT
gtattcactgtgacaactcc

SEQ ID NO: 258549 - DNA, 20 bp, Artificial Sequence
  Description of Artificial Sequence: Synthetic oligonucleotide
  Target: ATXN1; (+) strand; PAM type: YTN; PAM sequence: TTG
tattcactgtgacaactcct

SEQ ID NO: 258550 - DNA, 20 bp, Artificial Sequence
  Description of Artificial Sequence: Synthetic oligonucleotide
  Target: ATXN1; (+) strand; PAM type: YTN; PAM sequence: TTC
actgtgacaactccttactt

SEQ ID NO: 258551 - DNA, 20 bp, Artificial Sequence
  Description of Artificial Sequence: Synthetic oligonucleotide
  Target: ATXN1; (+) strand; PAM type: YTN; PAM sequence: CTG
tgacaactccttactttcaa

SEQ ID NO: 258552 - DNA, 20 bp, Artificial Sequence
  Description of Artificial Sequence: Synthetic oligonucleotide
  Target: ATXN1; (+) strand; PAM type: YTN; PAM sequence: CTC
cttactttcaaatctgaagt

SEQ ID NO: 258553 - DNA, 20 bp, Artificial Sequence
  Description of Artificial Sequence: Synthetic oligonucleotide
  Target: ATXN1; (+) strand; PAM type: YTN; PAM sequence: CTT
actttcaaatctgaagtaat

SEQ ID NO: 258554 - DNA, 20 bp, Artificial Sequence
  Description of Artificial Sequence: Synthetic oligonucleotide
  Target: ATXN1; (+) strand; PAM type: YTN; PAM sequence: TTA
ctttcaaatctgaagtaatt

SEQ ID NO: 258555 - DNA, 20 bp, Artificial Sequence
  Description of Artificial Sequence: Synthetic oligonucleotide
  Target: ATXN1; (+) strand; PAM type: YTN; PAM sequence: CTT
tcaaatctgaagtaattatt

SEQ ID NO: 258556 - DNA, 20 bp, Artificial Sequence
  Description of Artificial Sequence: Synthetic oligonucleotide
  Target: ATXN1; (+) strand; PAM type: YTN; PAM sequence: TTT
caaatctgaagtaattatta

SEQ ID NO: 258557 - DNA, 20 bp, Artificial Sequence
  Description of Artificial Sequence: Synthetic oligonucleotide
  Target: ATXN1; (+) strand; PAM type: YTN; PAM sequence: TTC
aaatctgaagtaattattag

SEQ ID NO: 258558 - DNA, 20 bp, Artificial Sequence
  Description of Artificial Sequence: Synthetic oligonucleotide
  Target: ATXN1; (+) strand; PAM type: YTN; PAM sequence: CTG
aagtaattattagaaagtga

SEQ ID NO: 258559 - DNA, 20 bp, Artificial Sequence
  Description of Artificial Sequence: Synthetic oligonucleotide
  Target: ATXN1; (+) strand; PAM type: YTN; PAM sequence: TTA
ttagaaagtgagaaaacaga

SEQ ID NO: 258560 - DNA, 20 bp, Artificial Sequence
  Description of Artificial Sequence: Synthetic oligonucleotide
  Target: ATXN1; (+) strand; PAM type: YTN; PAM sequence: TTA
gaaagtgagaaaacagacat

SEQ ID NO: 258561 - DNA, 20 bp, Artificial Sequence
  Description of Artificial Sequence: Synthetic oligonucleotide
  Target: ATXN1; (+) strand; PAM type: YTN; PAM sequence: TTA
cttttgggaagctgggagat

SEQ ID NO: 258562 - DNA, 20 bp, Artificial Sequence
  Description of Artificial Sequence: Synthetic oligonucleotide
  Target: ATXN1; (+) strand; PAM type: YTN; PAM sequence: CTT
ttgggaagctgggagatggc

SEQ ID NO: 258563 - DNA, 20 bp, Artificial Sequence
  Description of Artificial Sequence: Synthetic oligonucleotide
  Target: ATXN1; (+) strand; PAM type: YTN; PAM sequence: TTT
tgggaagctgggagatggct

SEQ ID NO: 258564 - DNA, 20 bp, Artificial Sequence
  Description of Artificial Sequence: Synthetic oligonucleotide
  Target: ATXN1; (+) strand; PAM type: YTN; PAM sequence: TTT
gggaagctgggagatggctt

SEQ ID NO: 258565 - DNA, 20 bp, Artificial Sequence
  Description of Artificial Sequence: Synthetic oligonucleotide
  Target: ATXN1; (+) strand; PAM type: YTN; PAM sequence: TTG
ggaagctgggagatggcttt

SEQ ID NO: 258566 - DNA, 20 bp, Artificial Sequence
  Description of Artificial Sequence: Synthetic oligonucleotide
  Target: ATXN1; (+) strand; PAM type: YTN; PAM sequence: CTG
ggagatggctttatagtcta

SEQ ID NO: 258567 - DNA, 20 bp, Artificial Sequence
  Description of Artificial Sequence: Synthetic oligonucleotide
  Target: ATXN1; (+) strand; PAM type: YTN; PAM sequence: CTT
tatagtctaagttgccacta

SEQ ID NO: 258568 - DNA, 20 bp, Artificial Sequence
  Description of Artificial Sequence: Synthetic oligonucleotide
  Target: ATXN1; (+) strand; PAM type: YTN; PAM sequence: TTT
atagtctaagttgccactag

SEQ ID NO: 258569 - DNA, 20 bp, Artificial Sequence
  Description of Artificial Sequence: Synthetic oligonucleotide
  Target: ATXN1; (+) strand; PAM type: YTN; PAM sequence: TTA
tagtctaagttgccactaga

SEQ ID NO: 258570 - DNA, 20 bp, Artificial Sequence
  Description of Artificial Sequence: Synthetic oligonucleotide
  Target: ATXN1; (+) strand; PAM type: YTN; PAM sequence: CTA
agttgccactagatagaatg

SEQ ID NO: 258571 - DNA, 20 bp, Artificial Sequence
  Description of Artificial Sequence: Synthetic oligonucleotide
  Target: ATXN1; (+) strand; PAM type: YTN; PAM sequence: TTG
ccactagatagaatgaccca

SEQ ID NO: 258572 - DNA, 20 bp, Artificial Sequence
  Description of Artificial Sequence: Synthetic oligonucleotide
  Target: ATXN1; (+) strand; PAM type: YTN; PAM sequence: CTA
gatagaatgacccataaaaa

SEQ ID NO: 258573 - DNA, 20 bp, Artificial Sequence
  Description of Artificial Sequence: Synthetic oligonucleotide
  Target: ATXN1; (+) strand; PAM type: YTN; PAM sequence: TTA
cttggaaggctattatctca

SEQ ID NO: 258574 - DNA, 20 bp, Artificial Sequence
  Description of Artificial Sequence: Synthetic oligonucleotide
  Target: ATXN1; (+) strand; PAM type: YTN; PAM sequence: CTT
ggaaggctattatctcataa

SEQ ID NO: 258575 - DNA, 20 bp, Artificial Sequence
  Description of Artificial Sequence: Synthetic oligonucleotide
  Target: ATXN1; (+) strand; PAM type: YTN; PAM sequence: TTG
gaaggctattatctcataac

SEQ ID NO: 258576 - DNA, 20 bp, Artificial Sequence
  Description of Artificial Sequence: Synthetic oligonucleotide
  Target: ATXN1; (+) strand; PAM type: YTN; PAM sequence: CTA
ttatctcataaccggggcct

SEQ ID NO: 258577 - DNA, 20 bp, Artificial Sequence
  Description of Artificial Sequence: Synthetic oligonucleotide
  Target: ATXN1; (+) strand; PAM type: YTN; PAM sequence: TTA
tctcataaccggggcctata

SEQ ID NO: 258578 - DNA, 20 bp, Artificial Sequence
  Description of Artificial Sequence: Synthetic oligonucleotide
  Target: ATXN1; (+) strand; PAM type: YTN; PAM sequence: CTC
ataaccggggcctataaaat

SEQ ID NO: 258579 - DNA, 20 bp, Artificial Sequence
  Description of Artificial Sequence: Synthetic oligonucleotide
  Target: ATXN1; (+) strand; PAM type: YTN; PAM sequence: CTA
taaaatctaacagttacaga

SEQ ID NO: 258580 - DNA, 20 bp, Artificial Sequence
  Description of Artificial Sequence: Synthetic oligonucleotide
  Target: ATXN1; (+) strand; PAM type: YTN; PAM sequence: CTA
acagttacagattctctctc

SEQ ID NO: 258581 - DNA, 20 bp, Artificial Sequence
  Description of Artificial Sequence: Synthetic oligonucleotide
  Target: ATXN1; (+) strand; PAM type: YTN; PAM sequence: TTA
cagattctctctctctctct

SEQ ID NO: 258582 - DNA, 20 bp, Artificial Sequence
  Description of Artificial Sequence: Synthetic oligonucleotide
  Target: ATXN1; (+) strand; PAM type: YTN; PAM sequence: TTC
tctctctctctctctgtctc

SEQ ID NO: 258583 - DNA, 20 bp, Artificial Sequence
  Description of Artificial Sequence: Synthetic oligonucleotide
  Target: ATXN1; (+) strand; PAM type: YTN; PAM sequence: CTC
tctctctctctctgtctctc

SEQ ID NO: 258584 - DNA, 20 bp, Artificial Sequence
  Description of Artificial Sequence: Synthetic oligonucleotide
  Target: ATXN1; (+) strand; PAM type: YTN; PAM sequence: CTC
tctctctctctgtctctctc

SEQ ID NO: 258585 - DNA, 20 bp, Artificial Sequence
  Description of Artificial Sequence: Synthetic oligonucleotide
  Target: ATXN1; (+) strand; PAM type: YTN; PAM sequence: CTC
tctctctctgtctctctctc

SEQ ID NO: 258586 - DNA, 20 bp, Artificial Sequence
  Description of Artificial Sequence: Synthetic oligonucleotide
  Target: ATXN1; (+) strand; PAM type: YTN; PAM sequence: CTC
tctctctgtctctctctctc

SEQ ID NO: 258587 - DNA, 20 bp, Artificial Sequence
  Description of Artificial Sequence: Synthetic oligonucleotide
  Target: ATXN1; (+) strand; PAM type: YTN; PAM sequence: CTC
tctctgtctctctctctcgt

SEQ ID NO: 258588 - DNA, 20 bp, Artificial Sequence
  Description of Artificial Sequence: Synthetic oligonucleotide
  Target: ATXN1; (+) strand; PAM type: YTN; PAM sequence: CTC
tctgtctctctctctcgtgt

SEQ ID NO: 258589 - DNA, 20 bp, Artificial Sequence
  Description of Artificial Sequence: Synthetic oligonucleotide
  Target: ATXN1; (+) strand; PAM type: YTN; PAM sequence: CTC
tgtctctctctctcgtgtgt

SEQ ID NO: 258590 - DNA, 20 bp, Artificial Sequence
  Description of Artificial Sequence: Synthetic oligonucleotide
  Target: ATXN1; (+) strand; PAM type: YTN; PAM sequence: CTG
tctctctctctcgtgtgtat

SEQ ID NO: 258591 - DNA, 20 bp, Artificial Sequence
  Description of Artificial Sequence: Synthetic oligonucleotide
  Target: ATXN1; (+) strand; PAM type: YTN; PAM sequence: CTC
tctctctcgtgtgtatttta

SEQ ID NO: 258592 - DNA, 20 bp, Artificial Sequence
  Description of Artificial Sequence: Synthetic oligonucleotide
  Target: ATXN1; (+) strand; PAM type: YTN; PAM sequence: CTC
tctctcgtgtgtattttaat

SEQ ID NO: 258593 - DNA, 20 bp, Artificial Sequence
  Description of Artificial Sequence: Synthetic oligonucleotide
  Target: ATXN1; (+) strand; PAM type: YTN; PAM sequence: CTC
tctcgtgtgtattttaatta

SEQ ID NO: 258594 - DNA, 20 bp, Artificial Sequence
  Description of Artificial Sequence: Synthetic oligonucleotide
  Target: ATXN1; (+) strand; PAM type: YTN; PAM sequence: CTC
tcgtgtgtattttaattaaa

SEQ ID NO: 258595 - DNA, 20 bp, Artificial Sequence
  Description of Artificial Sequence: Synthetic oligonucleotide
  Target: ATXN1; (+) strand; PAM type: YTN; PAM sequence: CTC
gtgtgtattttaattaaaga

SEQ ID NO: 258596 - DNA, 20 bp, Artificial Sequence
  Description of Artificial Sequence: Synthetic oligonucleotide
  Target: ATXN1; (+) strand; PAM type: YTN; PAM sequence: TTT
taattaaagacttaaactgc

SEQ ID NO: 258597 - DNA, 20 bp, Artificial Sequence
  Description of Artificial Sequence: Synthetic oligonucleotide
  Target: ATXN1; (+) strand; PAM type: YTN; PAM sequence: TTT
aattaaagacttaaactgct

SEQ ID NO: 258598 - DNA, 20 bp, Artificial Sequence
  Description of Artificial Sequence: Synthetic oligonucleotide
  Target: ATXN1; (+) strand; PAM type: YTN; PAM sequence: TTA
attaaagacttaaactgcta

SEQ ID NO: 258599 - DNA, 20 bp, Artificial Sequence
  Description of Artificial Sequence: Synthetic oligonucleotide
  Target: ATXN1; (+) strand; PAM type: YTN; PAM sequence: TTA
aagacttaaactgctaagag

SEQ ID NO: 258600 - DNA, 20 bp, Artificial Sequence
  Description of Artificial Sequence: Synthetic oligonucleotide
  Target: ATXN1; (+) strand; PAM type: YTN; PAM sequence: CTT
aaactgctaagagacaaaac

SEQ ID NO: 258601 - DNA, 20 bp, Artificial Sequence
  Description of Artificial Sequence: Synthetic oligonucleotide
  Target: ATXN1; (+) strand; PAM type: YTN; PAM sequence: TTA
aactgctaagagacaaaact

SEQ ID NO: 258602 - DNA, 20 bp, Artificial Sequence
  Description of Artificial Sequence: Synthetic oligonucleotide
  Target: ATXN1; (+) strand; PAM type: YTN; PAM sequence: CTG
ctaagagacaaaactgaaaa

SEQ ID NO: 258603 - DNA, 20 bp, Artificial Sequence
  Description of Artificial Sequence: Synthetic oligonucleotide
  Target: ATXN1; (+) strand; PAM type: YTN; PAM sequence: CTA
agagacaaaactgaaaacat

SEQ ID NO: 258604 - DNA, 20 bp, Artificial Sequence
  Description of Artificial Sequence: Synthetic oligonucleotide
  Target: ATXN1; (+) strand; PAM type: YTN; PAM sequence: CTG
aaaacatgtacgtaatccaa

SEQ ID NO: 258605 - DNA, 20 bp, Artificial Sequence
  Description of Artificial Sequence: Synthetic oligonucleotide
  Target: ATXN1; (+) strand; PAM type: YTN; PAM sequence: TTT
tgcataatgtctctgcggtt

SEQ ID NO: 258606 - DNA, 20 bp, Artificial Sequence
  Description of Artificial Sequence: Synthetic oligonucleotide
  Target: ATXN1; (+) strand; PAM type: YTN; PAM sequence: TTT
gcataatgtctctgcggttt

SEQ ID NO: 258607 - DNA, 20 bp, Artificial Sequence
  Description of Artificial Sequence: Synthetic oligonucleotide
  Target: ATXN1; (+) strand; PAM type: YTN; PAM sequence: TTG
cataatgtctctgcggtttt

SEQ ID NO: 258608 - DNA, 20 bp, Artificial Sequence
  Description of Artificial Sequence: Synthetic oligonucleotide
  Target: ATXN1; (+) strand; PAM type: YTN; PAM sequence: CTC
tgcggttttgtagttgattt

SEQ ID NO: 258609 - DNA, 20 bp, Artificial Sequence
  Description of Artificial Sequence: Synthetic oligonucleotide
  Target: ATXN1; (+) strand; PAM type: YTN; PAM sequence: CTG
cggttttgtagttgattttc

SEQ ID NO: 258610 - DNA, 20 bp, Artificial Sequence
  Description of Artificial Sequence: Synthetic oligonucleotide
  Target: ATXN1; (+) strand; PAM type: YTN; PAM sequence: TTT
tgtagttgattttccccatc

SEQ ID NO: 258611 - DNA, 20 bp, Artificial Sequence
  Description of Artificial Sequence: Synthetic oligonucleotide
  Target: ATXN1; (+) strand; PAM type: YTN; PAM sequence: TTT
gtagttgattttccccatct

SEQ ID NO: 258612 - DNA, 20 bp, Artificial Sequence
  Description of Artificial Sequence: Synthetic oligonucleotide
  Target: ATXN1; (+) strand; PAM type: YTN; PAM sequence: TTG
tagttgattttccccatctg

SEQ ID NO: 258613 - DNA, 20 bp, Artificial Sequence
  Description of Artificial Sequence: Synthetic oligonucleotide
  Target: ATXN1; (+) strand; PAM type: YTN; PAM sequence: TTG
attttccccatctgaccctg

SEQ ID NO: 258614 - DNA, 20 bp, Artificial Sequence
  Description of Artificial Sequence: Synthetic oligonucleotide
  Target: ATXN1; (+) strand; PAM type: YTN; PAM sequence: TTT
tccccatctgaccctgactt

SEQ ID NO: 258615 - DNA, 20 bp, Artificial Sequence
  Description of Artificial Sequence: Synthetic oligonucleotide
  Target: ATXN1; (+) strand; PAM type: YTN; PAM sequence: TTT
ccccatctgaccctgactta

SEQ ID NO: 258616 - DNA, 20 bp, Artificial Sequence
  Description of Artificial Sequence: Synthetic oligonucleotide
  Target: ATXN1; (+) strand; PAM type: YTN; PAM sequence: TTC
cccatctgaccctgacttac

SEQ ID NO: 258617 - DNA, 20 bp, Artificial Sequence
  Description of Artificial Sequence: Synthetic oligonucleotide
  Target: ATXN1; (+) strand; PAM type: YTN; PAM sequence: CTG
accctgacttacatgtgata

SEQ ID NO: 258618 - DNA, 20 bp, Artificial Sequence
  Description of Artificial Sequence: Synthetic oligonucleotide
  Target: ATXN1; (+) strand; PAM type: YTN; PAM sequence: CTG
acttacatgtgatacacaca

SEQ ID NO: 258619 - DNA, 20 bp, Artificial Sequence
  Description of Artificial Sequence: Synthetic oligonucleotide
  Target: ATXN1; (+) strand; PAM type: YTN; PAM sequence: CTT
acatgtgatacacacacatt

SEQ ID NO: 258620 - DNA, 20 bp, Artificial Sequence
  Description of Artificial Sequence: Synthetic oligonucleotide
  Target: ATXN1; (+) strand; PAM type: YTN; PAM sequence: TTA
catgtgatacacacacattt

SEQ ID NO: 258621 - DNA, 20 bp, Artificial Sequence
  Description of Artificial Sequence: Synthetic oligonucleotide
  Target: ATXN1; (+) strand; PAM type: YTN; PAM sequence: TTT
actggtttatggtaggaaaa

SEQ ID NO: 258622 - DNA, 20 bp, Artificial Sequence
  Description of Artificial Sequence: Synthetic oligonucleotide
  Target: ATXN1; (+) strand; PAM type: YTN; PAM sequence: TTA
ctggtttatggtaggaaaac

SEQ ID NO: 258623 - DNA, 20 bp, Artificial Sequence
  Description of Artificial Sequence: Synthetic oligonucleotide
  Target: ATXN1; (+) strand; PAM type: YTN; PAM sequence: CTG
gtttatggtaggaaaactgc

SEQ ID NO: 258624 - DNA, 20 bp, Artificial Sequence
  Description of Artificial Sequence: Synthetic oligonucleotide
  Target: ATXN1; (+) strand; PAM type: YTN; PAM sequence: TTT
atggtaggaaaactgctctg

SEQ ID NO: 258625 - DNA, 20 bp, Artificial Sequence
  Description of Artificial Sequence: Synthetic oligonucleotide
  Target: ATXN1; (+) strand; PAM type: YTN; PAM sequence: TTA
tggtaggaaaactgctctgg

SEQ ID NO: 258626 - DNA, 20 bp, Artificial Sequence
  Description of Artificial Sequence: Synthetic oligonucleotide
  Target: ATXN1; (+) strand; PAM type: YTN; PAM sequence: CTG
ctctggctgggtactggcac

SEQ ID NO: 258627 - DNA, 20 bp, Artificial Sequence
  Description of Artificial Sequence: Synthetic oligonucleotide
  Target: ATXN1; (+) strand; PAM type: YTN; PAM sequence: CTC
tggctgggtactggcactcg

SEQ ID NO: 258628 - DNA, 20 bp, Artificial Sequence
  Description of Artificial Sequence: Synthetic oligonucleotide
  Target: ATXN1; (+) strand; PAM type: YTN; PAM sequence: CTG
gctgggtactggcactcgcc

SEQ ID NO: 258629 - DNA, 20 bp, Artificial Sequence
  Description of Artificial Sequence: Synthetic oligonucleotide
  Target: ATXN1; (+) strand; PAM type: YTN; PAM sequence: CTG
ggtactggcactcgcctttg

SEQ ID NO: 258630 - DNA, 20 bp, Artificial Sequence
  Description of Artificial Sequence: Synthetic oligonucleotide
  Target: ATXN1; (+) strand; PAM type: YTN; PAM sequence: CTG
gcactcgcctttgtgattca

SEQ ID NO: 258631 - DNA, 20 bp, Artificial Sequence
  Description of Artificial Sequence: Synthetic oligonucleotide
  Target: ATXN1; (+) strand; PAM type: YTN; PAM sequence: CTC
gcctttgtgattcaggcatg

SEQ ID NO: 258632 - DNA, 20 bp, Artificial Sequence
  Description of Artificial Sequence: Synthetic oligonucleotide
  Target: ATXN1; (+) strand; PAM type: YTN; PAM sequence: CTT
tgtgattcaggcatgaaacc

SEQ ID NO: 258633 - DNA, 20 bp, Artificial Sequence
  Description of Artificial Sequence: Synthetic oligonucleotide
  Target: ATXN1; (+) strand; PAM type: YTN; PAM sequence: TTT
gtgattcaggcatgaaacca

SEQ ID NO: 258634 - DNA, 20 bp, Artificial Sequence
  Description of Artificial Sequence: Synthetic oligonucleotide
  Target: ATXN1; (+) strand; PAM type: YTN; PAM sequence: TTG
tgattcaggcatgaaaccat

SEQ ID NO: 258635 - DNA, 20 bp, Artificial Sequence
  Description of Artificial Sequence: Synthetic oligonucleotide
  Target: ATXN1; (+) strand; PAM type: YTN; PAM sequence: TTC
aggcatgaaaccatgaggtg

SEQ ID NO: 258636 - DNA, 20 bp, Artificial Sequence
  Description of Artificial Sequence: Synthetic oligonucleotide
  Target: ATXN1; (+) strand; PAM type: YTN; PAM sequence: CTG
gaattcagaagaagtacatt

SEQ ID NO: 258637 - DNA, 20 bp, Artificial Sequence
  Description of Artificial Sequence: Synthetic oligonucleotide
  Target: ATXN1; (+) strand; PAM type: YTN; PAM sequence: TTC
agaagaagtacattaggaca

SEQ ID NO: 258638 - DNA, 20 bp, Artificial Sequence
  Description of Artificial Sequence: Synthetic oligonucleotide
  Target: ATXN1; (+) strand; PAM type: YTN; PAM sequence: TTA
ggacagaggggcagctttgt

SEQ ID NO: 258639 - DNA, 20 bp, Artificial Sequence
  Description of Artificial Sequence: Synthetic oligonucleotide
  Target: ATXN1; (+) strand; PAM type: YTN; PAM sequence: CTT
tgtatttatttattaggttc

SEQ ID NO: 258640 - DNA, 20 bp, Artificial Sequence
  Description of Artificial Sequence: Synthetic oligonucleotide
  Target: ATXN1; (+) strand; PAM type: YTN; PAM sequence: TTT
gtatttatttattaggttct

SEQ ID NO: 258641 - DNA, 20 bp, Artificial Sequence
  Description of Artificial Sequence: Synthetic oligonucleotide
  Target: ATXN1; (+) strand; PAM type: YTN; PAM sequence: TTG
tatttatttattaggttctt

SEQ ID NO: 258642 - DNA, 20 bp, Artificial Sequence
  Description of Artificial Sequence: Synthetic oligonucleotide
  Target: ATXN1; (+) strand; PAM type: YTN; PAM sequence: TTT
atttattaggttcttccaac

SEQ ID NO: 258643 - DNA, 20 bp, Artificial Sequence
  Description of Artificial Sequence: Synthetic oligonucleotide
  Target: ATXN1; (+) strand; PAM type: YTN; PAM sequence: TTA
tttattaggttcttccaact

SEQ ID NO: 258644 - DNA, 20 bp, Artificial Sequence
  Description of Artificial Sequence: Synthetic oligonucleotide
  Target: ATXN1; (+) strand; PAM type: YTN; PAM sequence: TTT
attaggttcttccaacttaa

SEQ ID NO: 258645 - DNA, 20 bp, Artificial Sequence
  Description of Artificial Sequence: Synthetic oligonucleotide
  Target: ATXN1; (+) strand; PAM type: YTN; PAM sequence: TTA
ttaggttcttccaacttaag

SEQ ID NO: 258646 - DNA, 20 bp, Artificial Sequence
  Description of Artificial Sequence: Synthetic oligonucleotide
  Target: ATXN1; (+) strand; PAM type: YTN; PAM sequence: TTA
ggttcttccaacttaagttg

SEQ ID NO: 258647 - DNA, 20 bp, Artificial Sequence
  Description of Artificial Sequence: Synthetic oligonucleotide
  Target: ATXN1; (+) strand; PAM type: YTN; PAM sequence: TTC
ttccaacttaagttgccagg

SEQ ID NO: 258648 - DNA, 20 bp, Artificial Sequence
  Description of Artificial Sequence: Synthetic oligonucleotide
  Target: ATXN1; (+) strand; PAM type: YTN; PAM sequence: CTT
ccaacttaagttgccagggt

SEQ ID NO: 258649 - DNA, 20 bp, Artificial Sequence
  Description of Artificial Sequence: Synthetic oligonucleotide
  Target: ATXN1; (+) strand; PAM type: YTN; PAM sequence: TTC
caacttaagttgccagggta

SEQ ID NO: 258650 - DNA, 20 bp, Artificial Sequence
  Description of Artificial Sequence: Synthetic oligonucleotide
  Target: ATXN1; (+) strand; PAM type: YTN; PAM sequence: CTT
aagttgccagggtagcatga

SEQ ID NO: 258651 - DNA, 20 bp, Artificial Sequence
  Description of Artificial Sequence: Synthetic oligonucleotide
  Target: ATXN1; (+) strand; PAM type: YTN; PAM sequence: TTA
agttgccagggtagcatgag

SEQ ID NO: 258652 - DNA, 20 bp, Artificial Sequence
  Description of Artificial Sequence: Synthetic oligonucleotide
  Target: ATXN1; (+) strand; PAM type: YTN; PAM sequence: TTG
ccagggtagcatgagctttt

SEQ ID NO: 258653 - DNA, 20 bp, Artificial Sequence
  Description of Artificial Sequence: Synthetic oligonucleotide
  Target: ATXN1; (+) strand; PAM type: YTN; PAM sequence: CTT
tttaaaaacagttgtttctg

SEQ ID NO: 258654 - DNA, 20 bp, Artificial Sequence
  Description of Artificial Sequence: Synthetic oligonucleotide
  Target: ATXN1; (+) strand; PAM type: YTN; PAM sequence: TTT
ttaaaaacagttgtttctgg

SEQ ID NO: 258655 - DNA, 20 bp, Artificial Sequence
  Description of Artificial Sequence: Synthetic oligonucleotide
  Target: ATXN1; (+) strand; PAM type: YTN; PAM sequence: TTT
taaaaacagttgtttctggc

SEQ ID NO: 258656 - DNA, 20 bp, Artificial Sequence
  Description of Artificial Sequence: Synthetic oligonucleotide
  Target: ATXN1; (+) strand; PAM type: YTN; PAM sequence: TTT
aaaaacagttgtttctggcc

SEQ ID NO: 258657 - DNA, 20 bp, Artificial Sequence
  Description of Artificial Sequence: Synthetic oligonucleotide
  Target: ATXN1; (+) strand; PAM type: YTN; PAM sequence: TTA
aaaacagttgtttctggcct

SEQ ID NO: 258658 - DNA, 20 bp, Artificial Sequence
  Description of Artificial Sequence: Synthetic oligonucleotide
  Target: ATXN1; (+) strand; PAM type: YTN; PAM sequence: TTG
tttctggccttcctgtttta

SEQ ID NO: 258659 - DNA, 20 bp, Artificial Sequence
  Description of Artificial Sequence: Synthetic oligonucleotide
  Target: ATXN1; (+) strand; PAM type: YTN; PAM sequence: TTT
ctggccttcctgttttaggc

SEQ ID NO: 258660 - DNA, 20 bp, Artificial Sequence
  Description of Artificial Sequence: Synthetic oligonucleotide
  Target: ATXN1; (+) strand; PAM type: YTN; PAM sequence: TTC
tggccttcctgttttaggct

SEQ ID NO: 258661 - DNA, 20 bp, Artificial Sequence
  Description of Artificial Sequence: Synthetic oligonucleotide
  Target: ATXN1; (+) strand; PAM type: YTN; PAM sequence: CTG
gccttcctgttttaggcttt

SEQ ID NO: 258662 - DNA, 20 bp, Artificial Sequence
  Description of Artificial Sequence: Synthetic oligonucleotide
  Target: ATXN1; (+) strand; PAM type: YTN; PAM sequence: CTT
cctgttttaggcttttatct

SEQ ID NO: 258663 - DNA, 20 bp, Artificial Sequence
  Description of Artificial Sequence: Synthetic oligonucleotide
  Target: ATXN1; (+) strand; PAM type: YTN; PAM sequence: TTC
ctgttttaggcttttatcta

SEQ ID NO: 258664 - DNA, 20 bp, Artificial Sequence
  Description of Artificial Sequence: Synthetic oligonucleotide
  Target: ATXN1; (+) strand; PAM type: YTN; PAM sequence: CTG
ttttaggcttttatctaata

SEQ ID NO: 258665 - DNA, 20 bp, Artificial Sequence
  Description of Artificial Sequence: Synthetic oligonucleotide
  Target: ATXN1; (+) strand; PAM type: YTN; PAM sequence: TTT
taggcttttatctaatagag

SEQ ID NO: 258666 - DNA, 20 bp, Artificial Sequence
  Description of Artificial Sequence: Synthetic oligonucleotide
  Target: ATXN1; (+) strand; PAM type: YTN; PAM sequence: TTT
aggcttttatctaatagagt

SEQ ID NO: 258667 - DNA, 20 bp, Artificial Sequence
  Description of Artificial Sequence: Synthetic oligonucleotide
  Target: ATXN1; (+) strand; PAM type: YTN; PAM sequence: TTA
ggcttttatctaatagagtg

SEQ ID NO: 258668 - DNA, 20 bp, Artificial Sequence
  Description of Artificial Sequence: Synthetic oligonucleotide
  Target: ATXN1; (+) strand; PAM type: YTN; PAM sequence: CTT
ttatctaatagagtgtgaga

SEQ ID NO: 258669 - DNA, 20 bp, Artificial Sequence
  Description of Artificial Sequence: Synthetic oligonucleotide
  Target: ATXN1; (+) strand; PAM type: YTN; PAM sequence: TTT
tatctaatagagtgtgagaa

SEQ ID NO: 258670 - DNA, 20 bp, Artificial Sequence
  Description of Artificial Sequence: Synthetic oligonucleotide
  Target: ATXN1; (+) strand; PAM type: YTN; PAM sequence: TTT
atctaatagagtgtgagaag

SEQ ID NO: 258671 - DNA, 20 bp, Artificial Sequence
  Description of Artificial Sequence: Synthetic oligonucleotide
  Target: ATXN1; (+) strand; PAM type: YTN; PAM sequence: TTA
tctaatagagtgtgagaaga

SEQ ID NO: 258672 - DNA, 20 bp, Artificial Sequence
  Description of Artificial Sequence: Synthetic oligonucleotide
  Target: ATXN1; (+) strand; PAM type: YTN; PAM sequence: CTA
atagagtgtgagaagacatg

SEQ ID NO: 258673 - DNA, 20 bp, Artificial Sequence
  Description of Artificial Sequence: Synthetic oligonucleotide
  Target: ATXN1; (+) strand; PAM type: YTN; PAM sequence: TTC
acatgcagctaaggatgaga

SEQ ID NO: 258674 - DNA, 20 bp, Artificial Sequence
  Description of Artificial Sequence: Synthetic oligonucleotide
  Target: ATXN1; (+) strand; PAM type: YTN; PAM sequence: CTA
aggatgagattattcaaact

SEQ ID NO: 258675 - DNA, 20 bp, Artificial Sequence
  Description of Artificial Sequence: Synthetic oligonucleotide
  Target: ATXN1; (+) strand; PAM type: YTN; PAM sequence: TTA
ttcaaactgaaaccaacccc

SEQ ID NO: 258676 - DNA, 20 bp, Artificial Sequence
  Description of Artificial Sequence: Synthetic oligonucleotide
  Target: ATXN1; (+) strand; PAM type: YTN; PAM sequence: TTC
aaactgaaaccaaccccaca

SEQ ID NO: 258677 - DNA, 20 bp, Artificial Sequence
  Description of Artificial Sequence: Synthetic oligonucleotide
  Target: ATXN1; (+) strand; PAM type: YTN; PAM sequence: CTG
aaaccaaccccacatatcaa

SEQ ID NO: 258678 - DNA, 20 bp, Artificial Sequence
  Description of Artificial Sequence: Synthetic oligonucleotide
  Target: ATXN1; (+) strand; PAM type: YTN; PAM sequence: TTT
tcgtcactttaacagtagaa

SEQ ID NO: 258679 - DNA, 20 bp, Artificial Sequence
  Description of Artificial Sequence: Synthetic oligonucleotide
  Target: ATXN1; (+) strand; PAM type: YTN; PAM sequence: TTT
cgtcactttaacagtagaaa

SEQ ID NO: 258680 - DNA, 20 bp, Artificial Sequence
  Description of Artificial Sequence: Synthetic oligonucleotide
  Target: ATXN1; (+) strand; PAM type: YTN; PAM sequence: TTC
gtcactttaacagtagaaag

SEQ ID NO: 258681 - DNA, 20 bp, Artificial Sequence
  Description of Artificial Sequence: Synthetic oligonucleotide
  Target: ATXN1; (+) strand; PAM type: YTN; PAM sequence: CTT
taacagtagaaaggacacag

SEQ ID NO: 258682 - DNA, 20 bp, Artificial Sequence
  Description of Artificial Sequence: Synthetic oligonucleotide
  Target: ATXN1; (+) strand; PAM type: YTN; PAM sequence: TTT
aacagtagaaaggacacagg

SEQ ID NO: 258683 - DNA, 20 bp, Artificial Sequence
  Description of Artificial Sequence: Synthetic oligonucleotide
  Target: ATXN1; (+) strand; PAM type: YTN; PAM sequence: TTA
acagtagaaaggacacagga

SEQ ID NO: 258684 - DNA, 20 bp, Artificial Sequence
  Description of Artificial Sequence: Synthetic oligonucleotide
  Target: ATXN1; (+) strand; PAM type: YTN; PAM sequence: TTT
actgaactaacagttacatt

SEQ ID NO: 258685 - DNA, 20 bp, Artificial Sequence
  Description of Artificial Sequence: Synthetic oligonucleotide
  Target: ATXN1; (+) strand; PAM type: YTN; PAM sequence: TTA
ctgaactaacagttacattt

SEQ ID NO: 258686 - DNA, 20 bp, Artificial Sequence
  Description of Artificial Sequence: Synthetic oligonucleotide
  Target: ATXN1; (+) strand; PAM type: YTN; PAM sequence: CTG
aactaacagttacatttgtc

SEQ ID NO: 258687 - DNA, 20 bp, Artificial Sequence
  Description of Artificial Sequence: Synthetic oligonucleotide
  Target: ATXN1; (+) strand; PAM type: YTN; PAM sequence: CTA
acagttacatttgtcccctc

SEQ ID NO: 258688 - DNA, 20 bp, Artificial Sequence
  Description of Artificial Sequence: Synthetic oligonucleotide
  Target: ATXN1; (+) strand; PAM type: YTN; PAM sequence: TTA
catttgtcccctcctgcctt

SEQ ID NO: 258689 - DNA, 20 bp, Artificial Sequence
  Description of Artificial Sequence: Synthetic oligonucleotide
  Target: ATXN1; (+) strand; PAM type: YTN; PAM sequence: TTT
gtcccctcctgccttggata

SEQ ID NO: 258690 - DNA, 20 bp, Artificial Sequence
  Description of Artificial Sequence: Synthetic oligonucleotide
  Target: ATXN1; (+) strand; PAM type: YTN; PAM sequence: TTG
tcccctcctgccttggataa

SEQ ID NO: 258691 - DNA, 20 bp, Artificial Sequence
  Description of Artificial Sequence: Synthetic oligonucleotide
  Target: ATXN1; (+) strand; PAM type: YTN; PAM sequence: CTC
ctgccttggataaataatga

SEQ ID NO: 258692 - DNA, 20 bp, Artificial Sequence
  Description of Artificial Sequence: Synthetic oligonucleotide
  Target: ATXN1; (+) strand; PAM type: YTN; PAM sequence: CTG
ccttggataaataatgacta

SEQ ID NO: 258693 - DNA, 20 bp, Artificial Sequence
  Description of Artificial Sequence: Synthetic oligonucleotide
  Target: ATXN1; (+) strand; PAM type: YTN; PAM sequence: CTT
ggataaataatgactaattt

SEQ ID NO: 258694 - DNA, 20 bp, Artificial Sequence
  Description of Artificial Sequence: Synthetic oligonucleotide
  Target: ATXN1; (+) strand; PAM type: YTN; PAM sequence: TTG
gataaataatgactaatttt

SEQ ID NO: 258695 - DNA, 20 bp, Artificial Sequence
  Description of Artificial Sequence: Synthetic oligonucleotide
  Target: ATXN1; (+) strand; PAM type: YTN; PAM sequence: CTA
atttttaaataacagattgg

SEQ ID NO: 258696 - DNA, 20 bp, Artificial Sequence
  Description of Artificial Sequence: Synthetic oligonucleotide
  Target: ATXN1; (+) strand; PAM type: YTN; PAM sequence: TTT
ttaaataacagattggtaca

SEQ ID NO: 258697 - DNA, 20 bp, Artificial Sequence
  Description of Artificial Sequence: Synthetic oligonucleotide
  Target: ATXN1; (+) strand; PAM type: YTN; PAM sequence: TTT
taaataacagattggtacag

SEQ ID NO: 258698 - DNA, 20 bp, Artificial Sequence
  Description of Artificial Sequence: Synthetic oligonucleotide
  Target: ATXN1; (+) strand; PAM type: YTN; PAM sequence: TTT
aaataacagattggtacagc

SEQ ID NO: 258699 - DNA, 20 bp, Artificial Sequence
  Description of Artificial Sequence: Synthetic oligonucleotide
  Target: ATXN1; (+) strand; PAM type: YTN; PAM sequence: TTA
aataacagattggtacagct

SEQ ID NO: 258700 - DNA, 20 bp, Artificial Sequence
  Description of Artificial Sequence: Synthetic oligonucleotide
  Target: ATXN1; (+) strand; PAM type: YTN; PAM sequence: TTG
gtacagctctgagattagga

SEQ ID NO: 258701 - DNA, 20 bp, Artificial Sequence
  Description of Artificial Sequence: Synthetic oligonucleotide
  Target: ATXN1; (+) strand; PAM type: YTN; PAM sequence: CTC
tgagattaggagacagaaag

SEQ ID NO: 258702 - DNA, 20 bp, Artificial Sequence
  Description of Artificial Sequence: Synthetic oligonucleotide
  Target: ATXN1; (+) strand; PAM type: YTN; PAM sequence: CTG
agattaggagacagaaagca

SEQ ID NO: 258703 - DNA, 20 bp, Artificial Sequence
  Description of Artificial Sequence: Synthetic oligonucleotide
  Target: ATXN1; (+) strand; PAM type: YTN; PAM sequence: TTA
ggagacagaaagcatggaaa

SEQ ID NO: 258704 - DNA, 20 bp, Artificial Sequence
  Description of Artificial Sequence: Synthetic oligonucleotide
  Target: ATXN1; (+) strand; PAM type: YTN; PAM sequence: CTC
agaccttttaggtttggtgc

SEQ ID NO: 258705 - DNA, 20 bp, Artificial Sequence
  Description of Artificial Sequence: Synthetic oligonucleotide
  Target: ATXN1; (+) strand; PAM type: YTN; PAM sequence: CTT
ttaggtttggtgctttcctg

SEQ ID NO: 258706 - DNA, 20 bp, Artificial Sequence
  Description of Artificial Sequence: Synthetic oligonucleotide
  Target: ATXN1; (+) strand; PAM type: YTN; PAM sequence: TTT
taggtttggtgctttcctgt

SEQ ID NO: 258707 - DNA, 20 bp, Artificial Sequence
  Description of Artificial Sequence: Synthetic oligonucleotide
  Target: ATXN1; (+) strand; PAM type: YTN; PAM sequence: TTT
aggtttggtgctttcctgtt

SEQ ID NO: 258708 - DNA, 20 bp, Artificial Sequence
  Description of Artificial Sequence: Synthetic oligonucleotide
  Target: ATXN1; (+) strand; PAM type: YTN; PAM sequence: TTA
ggtttggtgctttcctgttc

SEQ ID NO: 258709 - DNA, 20 bp, Artificial Sequence
  Description of Artificial Sequence: Synthetic oligonucleotide
  Target: ATXN1; (+) strand; PAM type: YTN; PAM sequence: TTT
ggtgctttcctgttcctctg

SEQ ID NO: 258710 - DNA, 20 bp, Artificial Sequence
  Description of Artificial Sequence: Synthetic oligonucleotide
  Target: ATXN1; (+) strand; PAM type: YTN; PAM sequence: TTG
gtgctttcctgttcctctga

SEQ ID NO: 258711 - DNA, 20 bp, Artificial Sequence
  Description of Artificial Sequence: Synthetic oligonucleotide
  Target: ATXN1; (+) strand; PAM type: YTN; PAM sequence: CTT
tcctgttcctctgaatgggc

SEQ ID NO: 258712 - DNA, 20 bp, Artificial Sequence
  Description of Artificial Sequence: Synthetic oligonucleotide
  Target: ATXN1; (+) strand; PAM type: YTN; PAM sequence: TTT
cctgttcctctgaatgggca

SEQ ID NO: 258713 - DNA, 20 bp, Artificial Sequence
  Description of Artificial Sequence: Synthetic oligonucleotide
  Target: ATXN1; (+) strand; PAM type: YTN; PAM sequence: TTC
ctgttcctctgaatgggcat

SEQ ID NO: 258714 - DNA, 20 bp, Artificial Sequence
  Description of Artificial Sequence: Synthetic oligonucleotide
  Target: ATXN1; (+) strand; PAM type: YTN; PAM sequence: CTG
ttcctctgaatgggcatttt

SEQ ID NO: 258715 - DNA, 20 bp, Artificial Sequence
  Description of Artificial Sequence: Synthetic oligonucleotide
  Target: ATXN1; (+) strand; PAM type: YTN; PAM sequence: TTC
ctctgaatgggcatttttca

SEQ ID NO: 258716 - DNA, 20 bp, Artificial Sequence
  Description of Artificial Sequence: Synthetic oligonucleotide
  Target: ATXN1; (+) strand; PAM type: YTN; PAM sequence: CTC
tgaatgggcatttttcaaaa

SEQ ID NO: 258717 - DNA, 20 bp, Artificial Sequence
  Description of Artificial Sequence: Synthetic oligonucleotide
  Target: ATXN1; (+) strand; PAM type: YTN; PAM sequence: CTG
aatgggcatttttcaaaacc

SEQ ID NO: 258718 - DNA, 20 bp, Artificial Sequence
  Description of Artificial Sequence: Synthetic oligonucleotide
  Target: ATXN1; (+) strand; PAM type: YTN; PAM sequence: TTT
ttcaaaaccattttgaatgt

SEQ ID NO: 258719 - DNA, 20 bp, Artificial Sequence
  Description of Artificial Sequence: Synthetic oligonucleotide
  Target: ATXN1; (+) strand; PAM type: YTN; PAM sequence: TTT
tcaaaaccattttgaatgta

SEQ ID NO: 258720 - DNA, 20 bp, Artificial Sequence
  Description of Artificial Sequence: Synthetic oligonucleotide
  Target: ATXN1; (+) strand; PAM type: YTN; PAM sequence: TTT
caaaaccattttgaatgtaa

SEQ ID NO: 258721 - DNA, 20 bp, Artificial Sequence
  Description of Artificial Sequence: Synthetic oligonucleotide
  Target: ATXN1; (+) strand; PAM type: YTN; PAM sequence: TTC
aaaaccattttgaatgtaaa

SEQ ID NO: 258722 - DNA, 20 bp, Artificial Sequence
  Description of Artificial Sequence: Synthetic oligonucleotide
  Target: ATXN1; (+) strand; PAM type: YTN; PAM sequence: TTT
tgaatgtaaaaggctgtaga

SEQ ID NO: 258723 - DNA, 20 bp, Artificial Sequence
  Description of Artificial Sequence: Synthetic oligonucleotide
  Target: ATXN1; (+) strand; PAM type: YTN; PAM sequence: TTT
gaatgtaaaaggctgtagag

SEQ ID NO: 258724 - DNA, 20 bp, Artificial Sequence
  Description of Artificial Sequence: Synthetic oligonucleotide
  Target: ATXN1; (+) strand; PAM type: YTN; PAM sequence: TTG
aatgtaaaaggctgtagagt

SEQ ID NO: 258725 - DNA, 20 bp, Artificial Sequence
  Description of Artificial Sequence: Synthetic oligonucleotide
  Target: ATXN1; (+) strand; PAM type: YTN; PAM sequence: CTG
tagagttcaacactgggctt

SEQ ID NO: 258726 - DNA, 20 bp, Artificial Sequence
  Description of Artificial Sequence: Synthetic oligonucleotide
  Target: ATXN1; (+) strand; PAM type: YTN; PAM sequence: TTC
aacactgggcttcttcctac

SEQ ID NO: 258727 - DNA, 20 bp, Artificial Sequence
  Description of Artificial Sequence: Synthetic oligonucleotide
  Target: ATXN1; (+) strand; PAM type: YTN; PAM sequence: CTG
ggcttcttcctactttatga

SEQ ID NO: 258728 - DNA, 20 bp, Artificial Sequence
  Description of Artificial Sequence: Synthetic oligonucleotide
  Target: ATXN1; (+) strand; PAM type: YTN; PAM sequence: CTT
cttcctactttatgaggtta

SEQ ID NO: 258729 - DNA, 20 bp, Artificial Sequence
  Description of Artificial Sequence: Synthetic oligonucleotide
  Target: ATXN1; (+) strand; PAM type: YTN; PAM sequence: TTC
ttcctactttatgaggttat

SEQ ID NO: 258730 - DNA, 20 bp, Artificial Sequence
  Description of Artificial Sequence: Synthetic oligonucleotide
  Target: ATXN1; (+) strand; PAM type: YTN; PAM sequence: CTT
cctactttatgaggttatac

SEQ ID NO: 258731 - DNA, 20 bp, Artificial Sequence
  Description of Artificial Sequence: Synthetic oligonucleotide
  Target: ATXN1; (+) strand; PAM type: YTN; PAM sequence: TTC
ctactttatgaggttataca

SEQ ID NO: 258732 - DNA, 20 bp, Artificial Sequence
  Description of Artificial Sequence: Synthetic oligonucleotide
  Target: ATXN1; (+) strand; PAM type: YTN; PAM sequence: CTA
ctttatgaggttatacacag

SEQ ID NO: 258733 - DNA, 20 bp, Artificial Sequence
  Description of Artificial Sequence: Synthetic oligonucleotide
  Target: ATXN1; (+) strand; PAM type: YTN; PAM sequence: CTT
tatgaggttatacacaggtt

SEQ ID NO: 258734 - DNA, 20 bp, Artificial Sequence
  Description of Artificial Sequence: Synthetic oligonucleotide
  Target: ATXN1; (+) strand; PAM type: YTN; PAM sequence: TTT
atgaggttatacacaggttc

SEQ ID NO: 258735 - DNA, 20 bp, Artificial Sequence
  Description of Artificial Sequence: Synthetic oligonucleotide
  Target: ATXN1; (+) strand; PAM type: YTN; PAM sequence: TTA
tgaggttatacacaggttca

SEQ ID NO: 258736 - DNA, 20 bp, Artificial Sequence
  Description of Artificial Sequence: Synthetic oligonucleotide
  Target: ATXN1; (+) strand; PAM type: YTN; PAM sequence: TTA
tacacaggttcaagggtgag

SEQ ID NO: 258737 - DNA, 20 bp, Artificial Sequence
  Description of Artificial Sequence: Synthetic oligonucleotide
  Target: ATXN1; (+) strand; PAM type: YTN; PAM sequence: TTC
aagggtgagggtaaagacaa

SEQ ID NO: 258738 - DNA, 20 bp, Artificial Sequence
  Description of Artificial Sequence: Synthetic oligonucleotide
  Target: ATXN1; (+) strand; PAM type: YTN; PAM sequence: TTT
cacacgggagggtggggggg

SEQ ID NO: 258739 - DNA, 20 bp, Artificial Sequence
  Description of Artificial Sequence: Synthetic oligonucleotide
  Target: ATXN1; (+) strand; PAM type: YTN; PAM sequence: TTC
acacgggagggtgggggggg

SEQ ID NO: 258740 - DNA, 20 bp, Artificial Sequence
  Description of Artificial Sequence: Synthetic oligonucleotide
  Target: ATXN1; (+) strand; PAM type: YTN; PAM sequence: TTT
gtgggagatgagcgtgcatg

SEQ ID NO: 258741 - DNA, 20 bp, Artificial Sequence
  Description of Artificial Sequence: Synthetic oligonucleotide
  Target: ATXN1; (+) strand; PAM type: YTN; PAM sequence: TTG
tgggagatgagcgtgcatgc

SEQ ID NO: 258742 - DNA, 20 bp, Artificial Sequence
  Description of Artificial Sequence: Synthetic oligonucleotide
  Target: ATXN1; (+) strand; PAM type: YTN; PAM sequence: TTG
atatgcatacatgtgtgcag

SEQ ID NO: 258743 - DNA, 20 bp, Artificial Sequence
  Description of Artificial Sequence: Synthetic oligonucleotide
  Target: ATXN1; (+) strand; PAM type: YTN; PAM sequence: CTG
tgcatgtatatgtacactgc

SEQ ID NO: 258744 - DNA, 20 bp, Artificial Sequence
  Description of Artificial Sequence: Synthetic oligonucleotide
  Target: ATXN1; (+) strand; PAM type: YTN; PAM sequence: CTG
caggggcaatatggaaaaaa

SEQ ID NO: 258745 - DNA, 20 bp, Artificial Sequence
  Description of Artificial Sequence: Synthetic oligonucleotide
  Target: ATXN1; (+) strand; PAM type: YTN; PAM sequence: TTT
agccacgactggcagccaag

SEQ ID NO: 258746 - DNA, 20 bp, Artificial Sequence
  Description of Artificial Sequence: Synthetic oligonucleotide
  Target: ATXN1; (+) strand; PAM type: YTN; PAM sequence: TTA
gccacgactggcagccaaga

SEQ ID NO: 258747 - DNA, 20 bp, Artificial Sequence
  Description of Artificial Sequence: Synthetic oligonucleotide
  Target: ATXN1; (+) strand; PAM type: YTN; PAM sequence: CTG
gcagccaagattgaccttta

SEQ ID NO: 258748 - DNA, 20 bp, Artificial Sequence
  Description of Artificial Sequence: Synthetic oligonucleotide
  Target: ATXN1; (+) strand; PAM type: YTN; PAM sequence: TTG
acctttaagcccatttcatg

SEQ ID NO: 258749 - DNA, 20 bp, Artificial Sequence
  Description of Artificial Sequence: Synthetic oligonucleotide
  Target: ATXN1; (+) strand; PAM type: YTN; PAM sequence: CTT
taagcccatttcatggccac

SEQ ID NO: 258750 - DNA, 20 bp, Artificial Sequence
  Description of Artificial Sequence: Synthetic oligonucleotide
  Target: ATXN1; (+) strand; PAM type: YTN; PAM sequence: TTT
aagcccatttcatggccact

SEQ ID NO: 258751 - DNA, 20 bp, Artificial Sequence
  Description of Artificial Sequence: Synthetic oligonucleotide
  Target: ATXN1; (+) strand; PAM type: YTN; PAM sequence: TTA
agcccatttcatggccactg

SEQ ID NO: 258752 - DNA, 20 bp, Artificial Sequence
  Description of Artificial Sequence: Synthetic oligonucleotide
  Target: ATXN1; (+) strand; PAM type: YTN; PAM sequence: TTT
catggccactgcatatgcat

SEQ ID NO: 258753 - DNA, 20 bp, Artificial Sequence
  Description of Artificial Sequence: Synthetic oligonucleotide
  Target: ATXN1; (+) strand; PAM type: YTN; PAM sequence: TTC
atggccactgcatatgcatt

SEQ ID NO: 258754 - DNA, 20 bp, Artificial Sequence
  Description of Artificial Sequence: Synthetic oligonucleotide
  Target: ATXN1; (+) strand; PAM type: YTN; PAM sequence: CTG
catatgcattttttattata

SEQ ID NO: 258755 - DNA, 20 bp, Artificial Sequence
  Description of Artificial Sequence: Synthetic oligonucleotide
  Target: ATXN1; (+) strand; PAM type: YTN; PAM sequence: TTT
tttattatatgccaatccca

SEQ ID NO: 258756 - DNA, 20 bp, Artificial Sequence
  Description of Artificial Sequence: Synthetic oligonucleotide
  Target: ATXN1; (+) strand; PAM type: YTN; PAM sequence: TTT
ttattatatgccaatcccag

SEQ ID NO: 258757 - DNA, 20 bp, Artificial Sequence
  Description of Artificial Sequence: Synthetic oligonucleotide
  Target: ATXN1; (+) strand; PAM type: YTN; PAM sequence: TTT
tattatatgccaatcccagg

SEQ ID NO: 258758 - DNA, 20 bp, Artificial Sequence
  Description of Artificial Sequence: Synthetic oligonucleotide
  Target: ATXN1; (+) strand; PAM type: YTN; PAM sequence: TTT
attatatgccaatcccagga

SEQ ID NO: 258759 - DNA, 20 bp, Artificial Sequence
  Description of Artificial Sequence: Synthetic oligonucleotide
  Target: ATXN1; (+) strand; PAM type: YTN; PAM sequence: TTA
ttatatgccaatcccaggac

SEQ ID NO: 258760 - DNA, 20 bp, Artificial Sequence
  Description of Artificial Sequence: Synthetic oligonucleotide
  Target: ATXN1; (+) strand; PAM type: YTN; PAM sequence: TTA
tatgccaatcccaggacctg

SEQ ID NO: 258761 - DNA, 20 bp, Artificial Sequence
  Description of Artificial Sequence: Synthetic oligonucleotide
  Target: ATXN1; (+) strand; PAM type: YTN; PAM sequence: CTG
gtgcaaagatagccagtaag

SEQ ID NO: 258762 - DNA, 20 bp, Artificial Sequence
  Description of Artificial Sequence: Synthetic oligonucleotide
  Target: ATXN1; (+) strand; PAM type: YTN; PAM sequence: CTT
catcttttgaagtatataag

SEQ ID NO: 258763 - DNA, 20 bp, Artificial Sequence
  Description of Artificial Sequence: Synthetic oligonucleotide
  Target: ATXN1; (+) strand; PAM type: YTN; PAM sequence: TTC
atcttttgaagtatataagg

SEQ ID NO: 258764 - DNA, 20 bp, Artificial Sequence
  Description of Artificial Sequence: Synthetic oligonucleotide
  Target: ATXN1; (+) strand; PAM type: YTN; PAM sequence: CTT
ttgaagtatataagggtttt

SEQ ID NO: 258765 - DNA, 20 bp, Artificial Sequence
  Description of Artificial Sequence: Synthetic oligonucleotide
  Target: ATXN1; (+) strand; PAM type: YTN; PAM sequence: TTT
tgaagtatataagggttttt

SEQ ID NO: 258766 - DNA, 20 bp, Artificial Sequence
  Description of Artificial Sequence: Synthetic oligonucleotide
  Target: ATXN1; (+) strand; PAM type: YTN; PAM sequence: TTT
gaagtatataagggtttttt

SEQ ID NO: 258767 - DNA, 20 bp, Artificial Sequence
  Description of Artificial Sequence: Synthetic oligonucleotide
  Target: ATXN1; (+) strand; PAM type: YTN; PAM sequence: TTG
aagtatataagggttttttt

SEQ ID NO: 258768 - DNA, 20 bp, Artificial Sequence
  Description of Artificial Sequence: Synthetic oligonucleotide
  Target: ATXN1; (+) strand; PAM type: YTN; PAM sequence: TTT
ttttttttatttgcctctgt

SEQ ID NO: 258769 - DNA, 20 bp, Artificial Sequence
  Description of Artificial Sequence: Synthetic oligonucleotide
  Target: ATXN1; (+) strand; PAM type: YTN; PAM sequence: TTT
tttttttatttgcctctgtg

SEQ ID NO: 258770 - DNA, 20 bp, Artificial Sequence
  Description of Artificial Sequence: Synthetic oligonucleotide
  Target: ATXN1; (+) strand; PAM type: YTN; PAM sequence: TTT
ttttttatttgcctctgtgc

SEQ ID NO: 258771 - DNA, 20 bp, Artificial Sequence
  Description of Artificial Sequence: Synthetic oligonucleotide
  Target: ATXN1; (+) strand; PAM type: YTN; PAM sequence: TTT
tttttatttgcctctgtgct

SEQ ID NO: 258772 - DNA, 20 bp, Artificial Sequence
  Description of Artificial Sequence: Synthetic oligonucleotide
  Target: ATXN1; (+) strand; PAM type: YTN; PAM sequence: TTT
ttttatttgcctctgtgcta

SEQ ID NO: 258773 - DNA, 20 bp, Artificial Sequence
  Description of Artificial Sequence: Synthetic oligonucleotide
  Target: ATXN1; (+) strand; PAM type: YTN; PAM sequence: TTT
tttatttgcctctgtgctaa

SEQ ID NO: 258774 - DNA, 20 bp, Artificial Sequence
  Description of Artificial Sequence: Synthetic oligonucleotide
  Target: ATXN1; (+) strand; PAM type: YTN; PAM sequence: TTT
ttatttgcctctgtgctaag

SEQ ID NO: 258775 - DNA, 20 bp, Artificial Sequence
  Description of Artificial Sequence: Synthetic oligonucleotide
  Target: ATXN1; (+) strand; PAM type: YTN; PAM sequence: TTT
tatttgcctctgtgctaaga

SEQ ID NO: 258776 - DNA, 20 bp, Artificial Sequence
  Description of Artificial Sequence: Synthetic oligonucleotide
  Target: ATXN1; (+) strand; PAM type: YTN; PAM sequence: TTT
atttgcctctgtgctaagaa

SEQ ID NO: 258777 - DNA, 20 bp, Artificial Sequence
  Description of Artificial Sequence: Synthetic oligonucleotide
  Target: ATXN1; (+) strand; PAM type: YTN; PAM sequence: TTA
tttgcctctgtgctaagaag

SEQ ID NO: 258778 - DNA, 20 bp, Artificial Sequence
  Description of Artificial Sequence: Synthetic oligonucleotide
  Target: ATXN1; (+) strand; PAM type: YTN; PAM sequence: TTT
gcctctgtgctaagaagaat

SEQ ID NO: 258779 - DNA, 20 bp, Artificial Sequence
  Description of Artificial Sequence: Synthetic oligonucleotide
  Target: ATXN1; (+) strand; PAM type: YTN; PAM sequence: TTG
cctctgtgctaagaagaatg

SEQ ID NO: 258780 - DNA, 20 bp, Artificial Sequence
  Description of Artificial Sequence: Synthetic oligonucleotide
  Target: ATXN1; (+) strand; PAM type: YTN; PAM sequence: CTC
tgtgctaagaagaatggcca

SEQ ID NO: 258781 - DNA, 20 bp, Artificial Sequence
  Description of Artificial Sequence: Synthetic oligonucleotide
  Target: ATXN1; (+) strand; PAM type: YTN; PAM sequence: CTG
tgctaagaagaatggccaaa

SEQ ID NO: 258782 - DNA, 20 bp, Artificial Sequence
  Description of Artificial Sequence: Synthetic oligonucleotide
  Target: ATXN1; (+) strand; PAM type: YTN; PAM sequence: CTA
agaagaatggccaaatcata

SEQ ID NO: 258783 - DNA, 20 bp, Artificial Sequence
  Description of Artificial Sequence: Synthetic oligonucleotide
  Target: ATXN1; (+) strand; PAM type: YTN; PAM sequence: TTC
ctcttcattccaagttggag

SEQ ID NO: 258784 - DNA, 20 bp, Artificial Sequence
  Description of Artificial Sequence: Synthetic oligonucleotide
  Target: ATXN1; (+) strand; PAM type: YTN; PAM sequence: CTC
ttcattccaagttggagcag

SEQ ID NO: 258785 - DNA, 20 bp, Artificial Sequence
  Description of Artificial Sequence: Synthetic oligonucleotide
  Target: ATXN1; (+) strand; PAM type: YTN; PAM sequence: CTT
cattccaagttggagcagaa

SEQ ID NO: 258786 - DNA, 20 bp, Artificial Sequence
  Description of Artificial Sequence: Synthetic oligonucleotide
  Target: ATXN1; (+) strand; PAM type: YTN; PAM sequence: TTC
attccaagttggagcagaac

SEQ ID NO: 258787 - DNA, 20 bp, Artificial Sequence
  Description of Artificial Sequence: Synthetic oligonucleotide
  Target: ATXN1; (+) strand; PAM type: YTN; PAM sequence: TTC
caagttggagcagaacagcc

SEQ ID NO: 258788 - DNA, 20 bp, Artificial Sequence
  Description of Artificial Sequence: Synthetic oligonucleotide
  Target: ATXN1; (+) strand; PAM type: YTN; PAM sequence: TTG
gagcagaacagccttaggtt

SEQ ID NO: 258789 - DNA, 20 bp, Artificial Sequence
  Description of Artificial Sequence: Synthetic oligonucleotide
  Target: ATXN1; (+) strand; PAM type: YTN; PAM sequence: CTT
aggttgctgccaactgttat

SEQ ID NO: 258790 - DNA, 20 bp, Artificial Sequence
  Description of Artificial Sequence: Synthetic oligonucleotide
  Target: ATXN1; (+) strand; PAM type: YTN; PAM sequence: TTA
ggttgctgccaactgttatc

SEQ ID NO: 258791 - DNA, 20 bp, Artificial Sequence
  Description of Artificial Sequence: Synthetic oligonucleotide
  Target: ATXN1; (+) strand; PAM type: YTN; PAM sequence: TTG
ctgccaactgttatccttcg

SEQ ID NO: 258792 - DNA, 20 bp, Artificial Sequence
  Description of Artificial Sequence: Synthetic oligonucleotide
  Target: ATXN1; (+) strand; PAM type: YTN; PAM sequence: CTG
ccaactgttatccttcgaga

SEQ ID NO: 258793 - DNA, 20 bp, Artificial Sequence
  Description of Artificial Sequence: Synthetic oligonucleotide
  Target: ATXN1; (+) strand; PAM type: YTN; PAM sequence: CTG
ttatccttcgagagggccac

SEQ ID NO: 258794 - DNA, 20 bp, Artificial Sequence
  Description of Artificial Sequence: Synthetic oligonucleotide
  Target: ATXN1; (+) strand; PAM type: YTN; PAM sequence: TTA
tccttcgagagggccacata

SEQ ID NO: 258795 - DNA, 20 bp, Artificial Sequence
  Description of Artificial Sequence: Synthetic oligonucleotide
  Target: ATXN1; (+) strand; PAM type: YTN; PAM sequence: CTT
cgagagggccacatattttg

SEQ ID NO: 258796 - DNA, 20 bp, Artificial Sequence
  Description of Artificial Sequence: Synthetic oligonucleotide
  Target: ATXN1; (+) strand; PAM type: YTN; PAM sequence: TTC
gagagggccacatattttga

SEQ ID NO: 258797 - DNA, 20 bp, Artificial Sequence
  Description of Artificial Sequence: Synthetic oligonucleotide
  Target: ATXN1; (+) strand; PAM type: YTN; PAM sequence: TTT
tgaggtttcagagacagtga

SEQ ID NO: 258798 - DNA, 20 bp, Artificial Sequence
  Description of Artificial Sequence: Synthetic oligonucleotide
  Target: ATXN1; (+) strand; PAM type: YTN; PAM sequence: TTT
gaggtttcagagacagtgag

SEQ ID NO: 258799 - DNA, 20 bp, Artificial Sequence
  Description of Artificial Sequence: Synthetic oligonucleotide
  Target: ATXN1; (+) strand; PAM type: YTN; PAM sequence: TTG
aggtttcagagacagtgagg

SEQ ID NO: 258800 - DNA, 20 bp, Artificial Sequence
  Description of Artificial Sequence: Synthetic oligonucleotide
  Target: ATXN1; (+) strand; PAM type: YTN; PAM sequence: TTT
cagagacagtgaggtagatt

SEQ ID NO: 258801 - DNA, 20 bp, Artificial Sequence
  Description of Artificial Sequence: Synthetic oligonucleotide
  Target: ATXN1; (+) strand; PAM type: YTN; PAM sequence: TTC
agagacagtgaggtagattc

SEQ ID NO: 258802 - DNA, 20 bp, Artificial Sequence
  Description of Artificial Sequence: Synthetic oligonucleotide
  Target: ATXN1; (+) strand; PAM type: YTN; PAM sequence: TTC
tgccttgagaaatatcagac

SEQ ID NO: 258803 - DNA, 20 bp, Artificial Sequence
  Description of Artificial Sequence: Synthetic oligonucleotide
  Target: ATXN1; (+) strand; PAM type: YTN; PAM sequence: CTG
ccttgagaaatatcagacac

SEQ ID NO: 258804 - DNA, 20 bp, Artificial Sequence
  Description of Artificial Sequence: Synthetic oligonucleotide
  Target: ATXN1; (+) strand; PAM type: YTN; PAM sequence: CTT
gagaaatatcagacactcaa

SEQ ID NO: 258805 - DNA, 20 bp, Artificial Sequence
  Description of Artificial Sequence: Synthetic oligonucleotide
  Target: ATXN1; (+) strand; PAM type: YTN; PAM sequence: TTG
agaaatatcagacactcaag

SEQ ID NO: 258806 - DNA, 20 bp, Artificial Sequence
  Description of Artificial Sequence: Synthetic oligonucleotide
  Target: ATXN1; (+) strand; PAM type: YTN; PAM sequence: CTC
aagtactccggcgacacact

SEQ ID NO: 258807 - DNA, 20 bp, Artificial Sequence
  Description of Artificial Sequence: Synthetic oligonucleotide
  Target: ATXN1; (+) strand; PAM type: YTN; PAM sequence: CTC
cggcgacacactgagcaaat

SEQ ID NO: 258808 - DNA, 20 bp, Artificial Sequence
  Description of Artificial Sequence: Synthetic oligonucleotide
  Target: ATXN1; (+) strand; PAM type: YTN; PAM sequence: CTG
agcaaatgtttttgccagca

SEQ ID NO: 258809 - DNA, 20 bp, Artificial Sequence
  Description of Artificial Sequence: Synthetic oligonucleotide
  Target: ATXN1; (+) strand; PAM type: YTN; PAM sequence: TTT
ttgccagcagaaagatatag

SEQ ID NO: 258810 - DNA, 20 bp, Artificial Sequence
  Description of Artificial Sequence: Synthetic oligonucleotide
  Target: ATXN1; (+) strand; PAM type: YTN; PAM sequence: TTT
tgccagcagaaagatatagg

SEQ ID NO: 258811 - DNA, 20 bp, Artificial Sequence
  Description of Artificial Sequence: Synthetic oligonucleotide
  Target: ATXN1; (+) strand; PAM type: YTN; PAM sequence: TTT
gccagcagaaagatataggt

SEQ ID NO: 258812 - DNA, 20 bp, Artificial Sequence
  Description of Artificial Sequence: Synthetic oligonucleotide
  Target: ATXN1; (+) strand; PAM type: YTN; PAM sequence: TTG
ccagcagaaagatataggtg

SEQ ID NO: 258813 - DNA, 20 bp, Artificial Sequence
  Description of Artificial Sequence: Synthetic oligonucleotide
  Target: ATXN1; (+) strand; PAM type: YTN; PAM sequence: TTC
accgtggcgcaggtgaggga

SEQ ID NO: 258814 - DNA, 20 bp, Artificial Sequence
  Description of Artificial Sequence: Synthetic oligonucleotide
  Target: ATXN1; (+) strand; PAM type: YTN; PAM sequence: CTG
tgcacagtaagcgcactttc

SEQ ID NO: 258815 - DNA, 20 bp, Artificial Sequence
  Description of Artificial Sequence: Synthetic oligonucleotide
  Target: ATXN1; (+) strand; PAM type: YTN; PAM sequence: CTT
tctcttctccagacatcctg

SEQ ID NO: 258816 - DNA, 20 bp, Artificial Sequence
  Description of Artificial Sequence: Synthetic oligonucleotide
  Target: ATXN1; (+) strand; PAM type: YTN; PAM sequence: TTT
ctcttctccagacatcctgg

SEQ ID NO: 258817 - DNA, 20 bp, Artificial Sequence
  Description of Artificial Sequence: Synthetic oligonucleotide
  Target: ATXN1; (+) strand; PAM type: YTN; PAM sequence: TTC
tcttctccagacatcctggt

SEQ ID NO: 258818 - DNA, 20 bp, Artificial Sequence
  Description of Artificial Sequence: Synthetic oligonucleotide
  Target: ATXN1; (+) strand; PAM type: YTN; PAM sequence: CTC
ttctccagacatcctggtgc

SEQ ID NO: 258819 - DNA, 20 bp, Artificial Sequence
  Description of Artificial Sequence: Synthetic oligonucleotide
  Target: ATXN1; (+) strand; PAM type: YTN; PAM sequence: CTT
ctccagacatcctggtgcca

SEQ ID NO: 258820 - DNA, 20 bp, Artificial Sequence
  Description of Artificial Sequence: Synthetic oligonucleotide
  Target: ATXN1; (+) strand; PAM type: YTN; PAM sequence: TTC
tccagacatcctggtgccac

SEQ ID NO: 258821 - DNA, 20 bp, Artificial Sequence
  Description of Artificial Sequence: Synthetic oligonucleotide
  Target: ATXN1; (+) strand; PAM type: YTN; PAM sequence: CTC
cagacatcctggtgccacag

SEQ ID NO: 258822 - DNA, 20 bp, Artificial Sequence
  Description of Artificial Sequence: Synthetic oligonucleotide
  Target: ATXN1; (+) strand; PAM type: YTN; PAM sequence: CTG
gtgccacagtagttcccatt

SEQ ID NO: 258823 - DNA, 20 bp, Artificial Sequence
  Description of Artificial Sequence: Synthetic oligonucleotide
  Target: ATXN1; (+) strand; PAM type: YTN; PAM sequence: TTC
ccattctctctcctcttctg

SEQ ID NO: 258824 - DNA, 20 bp, Artificial Sequence
  Description of Artificial Sequence: Synthetic oligonucleotide
  Target: ATXN1; (+) strand; PAM type: YTN; PAM sequence: TTC
tctctcctcttctgtaactt

SEQ ID NO: 258825 - DNA, 20 bp, Artificial Sequence
  Description of Artificial Sequence: Synthetic oligonucleotide
  Target: ATXN1; (+) strand; PAM type: YTN; PAM sequence: CTC
tctcctcttctgtaacttct

SEQ ID NO: 258826 - DNA, 20 bp, Artificial Sequence
  Description of Artificial Sequence: Synthetic oligonucleotide
  Target: ATXN1; (+) strand; PAM type: YTN; PAM sequence: CTC
tcctcttctgtaacttctaa

SEQ ID NO: 258827 - DNA, 20 bp, Artificial Sequence
  Description of Artificial Sequence: Synthetic oligonucleotide
  Target: ATXN1; (+) strand; PAM type: YTN; PAM sequence: CTC
ctcttctgtaacttctaaga

SEQ ID NO: 258828 - DNA, 20 bp, Artificial Sequence
  Description of Artificial Sequence: Synthetic oligonucleotide
  Target: ATXN1; (+) strand; PAM type: YTN; PAM sequence: CTC
ttctgtaacttctaagacct

SEQ ID NO: 258829 - DNA, 20 bp, Artificial Sequence
  Description of Artificial Sequence: Synthetic oligonucleotide
  Target: ATXN1; (+) strand; PAM type: YTN; PAM sequence: CTT
ctgtaacttctaagaccttt

SEQ ID NO: 258830 - DNA, 20 bp, Artificial Sequence
  Description of Artificial Sequence: Synthetic oligonucleotide
  Target: ATXN1; (+) strand; PAM type: YTN; PAM sequence: TTC
tgtaacttctaagacctttg

SEQ ID NO: 258831 - DNA, 20 bp, Artificial Sequence
  Description of Artificial Sequence: Synthetic oligonucleotide
  Target: ATXN1; (+) strand; PAM type: YTN; PAM sequence: CTG
taacttctaagacctttgcc

SEQ ID NO: 258832 - DNA, 20 bp, Artificial Sequence
  Description of Artificial Sequence: Synthetic oligonucleotide
  Target: ATXN1; (+) strand; PAM type: YTN; PAM sequence: CTT
ctaagacctttgccttaagt

SEQ ID NO: 258833 - DNA, 20 bp, Artificial Sequence
  Description of Artificial Sequence: Synthetic oligonucleotide
  Target: ATXN1; (+) strand; PAM type: YTN; PAM sequence: TTC
taagacctttgccttaagtg

SEQ ID NO: 258834 - DNA, 20 bp, Artificial Sequence
  Description of Artificial Sequence: Synthetic oligonucleotide
  Target: ATXN1; (+) strand; PAM type: YTN; PAM sequence: CTA
agacctttgccttaagtgaa

SEQ ID NO: 258835 - DNA, 20 bp, Artificial Sequence
  Description of Artificial Sequence: Synthetic oligonucleotide
  Target: ATXN1; (+) strand; PAM type: YTN; PAM sequence: CTT
tgccttaagtgaatggatcc

SEQ ID NO: 258836 - DNA, 20 bp, Artificial Sequence
  Description of Artificial Sequence: Synthetic oligonucleotide
  Target: ATXN1; (+) strand; PAM type: YTN; PAM sequence: TTT
gccttaagtgaatggatcct

SEQ ID NO: 258837 - DNA, 20 bp, Artificial Sequence
  Description of Artificial Sequence: Synthetic oligonucleotide
  Target: ATXN1; (+) strand; PAM type: YTN; PAM sequence: TTG
ccttaagtgaatggatcctc

SEQ ID NO: 258838 - DNA, 20 bp, Artificial Sequence
  Description of Artificial Sequence: Synthetic oligonucleotide
  Target: ATXN1; (+) strand; PAM type: YTN; PAM sequence: CTT
aagtgaatggatcctcctaa

SEQ ID NO: 258839 - DNA, 20 bp, Artificial Sequence
  Description of Artificial Sequence: Synthetic oligonucleotide
  Target: ATXN1; (+) strand; PAM type: YTN; PAM sequence: TTA
agtgaatggatcctcctaag

SEQ ID NO: 258840 - DNA, 20 bp, Artificial Sequence
  Description of Artificial Sequence: Synthetic oligonucleotide
  Target: ATXN1; (+) strand; PAM type: YTN; PAM sequence: CTC
ctaagacagccataactgca

SEQ ID NO: 258841 - DNA, 20 bp, Artificial Sequence
  Description of Artificial Sequence: Synthetic oligonucleotide
  Target: ATXN1; (+) strand; PAM type: YTN; PAM sequence: CTA
agacagccataactgcattt

SEQ ID NO: 258842 - DNA, 20 bp, Artificial Sequence
  Description of Artificial Sequence: Synthetic oligonucleotide
  Target: ATXN1; (+) strand; PAM type: YTN; PAM sequence: CTG
catttatttacgtccctgct

SEQ ID NO: 258843 - DNA, 20 bp, Artificial Sequence
  Description of Artificial Sequence: Synthetic oligonucleotide
  Target: ATXN1; (+) strand; PAM type: YTN; PAM sequence: TTT
atttacgtccctgctctttg

SEQ ID NO: 258844 - DNA, 20 bp, Artificial Sequence
  Description of Artificial Sequence: Synthetic oligonucleotide
  Target: ATXN1; (+) strand; PAM type: YTN; PAM sequence: TTA
tttacgtccctgctctttga

SEQ ID NO: 258845 - DNA, 20 bp, Artificial Sequence
  Description of Artificial Sequence: Synthetic oligonucleotide
  Target: ATXN1; (+) strand; PAM type: YTN; PAM sequence: TTT
acgtccctgctctttgactt

SEQ ID NO: 258846 - DNA, 20 bp, Artificial Sequence
  Description of Artificial Sequence: Synthetic oligonucleotide
  Target: ATXN1; (+) strand; PAM type: YTN; PAM sequence: TTA
cgtccctgctctttgacttg

SEQ ID NO: 258847 - DNA, 20 bp, Artificial Sequence
  Description of Artificial Sequence: Synthetic oligonucleotide
  Target: ATXN1; (+) strand; PAM type: YTN; PAM sequence: CTG
ctctttgacttgaaaagttc

SEQ ID NO: 258848 - DNA, 20 bp, Artificial Sequence
  Description of Artificial Sequence: Synthetic oligonucleotide
  Target: ATXN1; (+) strand; PAM type: YTN; PAM sequence: CTC
tttgacttgaaaagttcacc

SEQ ID NO: 258849 - DNA, 20 bp, Artificial Sequence
  Description of Artificial Sequence: Synthetic oligonucleotide
  Target: ATXN1; (+) strand; PAM type: YTN; PAM sequence: CTT
tgacttgaaaagttcaccct

SEQ ID NO: 258850 - DNA, 20 bp, Artificial Sequence
  Description of Artificial Sequence: Synthetic oligonucleotide
  Target: ATXN1; (+) strand; PAM type: YTN; PAM sequence: TTT
gacttgaaaagttcaccctt

SEQ ID NO: 258851 - DNA, 20 bp, Artificial Sequence
  Description of Artificial Sequence: Synthetic oligonucleotide
  Target: ATXN1; (+) strand; PAM type: YTN; PAM sequence: TTG
acttgaaaagttcacccttt

SEQ ID NO: 258852 - DNA, 20 bp, Artificial Sequence
  Description of Artificial Sequence: Synthetic oligonucleotide
  Target: ATXN1; (+) strand; PAM type: YTN; PAM sequence: CTT
gaaaagttcaccctttcttg

SEQ ID NO: 258853 - DNA, 20 bp, Artificial Sequence
  Description of Artificial Sequence: Synthetic oligonucleotide
  Target: ATXN1; (+) strand; PAM type: YTN; PAM sequence: TTG
aaaagttcaccctttcttgg

SEQ ID NO: 258854 - DNA, 20 bp, Artificial Sequence
  Description of Artificial Sequence: Synthetic oligonucleotide
  Target: ATXN1; (+) strand; PAM type: YTN; PAM sequence: TTC
accctttcttggagagagag

SEQ ID NO: 258855 - DNA, 20 bp, Artificial Sequence
  Description of Artificial Sequence: Synthetic oligonucleotide
  Target: ATXN1; (+) strand; PAM type: YTN; PAM sequence: CTT
tcttggagagagagacttgg

SEQ ID NO: 258856 - DNA, 20 bp, Artificial Sequence
  Description of Artificial Sequence: Synthetic oligonucleotide
  Target: ATXN1; (+) strand; PAM type: YTN; PAM sequence: TTT
cttggagagagagacttgga

SEQ ID NO: 258857 - DNA, 20 bp, Artificial Sequence
  Description of Artificial Sequence: Synthetic oligonucleotide
  Target: ATXN1; (+) strand; PAM type: YTN; PAM sequence: TTC
ttggagagagagacttggaa

SEQ ID NO: 258858 - DNA, 20 bp, Artificial Sequence
  Description of Artificial Sequence: Synthetic oligonucleotide
  Target: ATXN1; (+) strand; PAM type: YTN; PAM sequence: CTT
ggagagagagacttggaaaa

SEQ ID NO: 258859 - DNA, 20 bp, Artificial Sequence
  Description of Artificial Sequence: Synthetic oligonucleotide
  Target: ATXN1; (+) strand; PAM type: YTN; PAM sequence: TTG
gagagagagacttggaaaag

SEQ ID NO: 258860 - DNA, 20 bp, Artificial Sequence
  Description of Artificial Sequence: Synthetic oligonucleotide
  Target: ATXN1; (+) strand; PAM type: YTN; PAM sequence: CTT
ggaaaagagaggcatgaagg

SEQ ID NO: 258861 - DNA, 20 bp, Artificial Sequence
  Description of Artificial Sequence: Synthetic oligonucleotide
  Target: ATXN1; (+) strand; PAM type: YTN; PAM sequence: TTG
gaaaagagaggcatgaaggg

SEQ ID NO: 258862 - DNA, 20 bp, Artificial Sequence
  Description of Artificial Sequence: Synthetic oligonucleotide
  Target: ATXN1; (+) strand; PAM type: YTN; PAM sequence: CTC
aagccctggcaattctgcct

SEQ ID NO: 258863 - DNA, 20 bp, Artificial Sequence
  Description of Artificial Sequence: Synthetic oligonucleotide
  Target: ATXN1; (+) strand; PAM type: YTN; PAM sequence: CTG
gcaattctgcctcagtgaat

SEQ ID NO: 258864 - DNA, 20 bp, Artificial Sequence
  Description of Artificial Sequence: Synthetic oligonucleotide
  Target: ATXN1; (+) strand; PAM type: YTN; PAM sequence: TTC
tgcctcagtgaatccgactt

SEQ ID NO: 258865 - DNA, 20 bp, Artificial Sequence
  Description of Artificial Sequence: Synthetic oligonucleotide
  Target: ATXN1; (+) strand; PAM type: YTN; PAM sequence: CTG
cctcagtgaatccgacttct

SEQ ID NO: 258866 - DNA, 20 bp, Artificial Sequence
  Description of Artificial Sequence: Synthetic oligonucleotide
  Target: ATXN1; (+) strand; PAM type: YTN; PAM sequence: CTC
agtgaatccgacttctacct

SEQ ID NO: 258867 - DNA, 20 bp, Artificial Sequence
  Description of Artificial Sequence: Synthetic oligonucleotide
  Target: ATXN1; (+) strand; PAM type: YTN; PAM sequence: CTT
ctacctccacagtgaaatct

SEQ ID NO: 258868 - DNA, 20 bp, Artificial Sequence
  Description of Artificial Sequence: Synthetic oligonucleotide
  Target: ATXN1; (+) strand; PAM type: YTN; PAM sequence: TTC
tacctccacagtgaaatctc

SEQ ID NO: 258869 - DNA, 20 bp, Artificial Sequence
  Description of Artificial Sequence: Synthetic oligonucleotide
  Target: ATXN1; (+) strand; PAM type: YTN; PAM sequence: CTA
cctccacagtgaaatctccc

SEQ ID NO: 258870 - DNA, 20 bp, Artificial Sequence
  Description of Artificial Sequence: Synthetic oligonucleotide
  Target: ATXN1; (+) strand; PAM type: YTN; PAM sequence: CTC
cacagtgaaatctccctagc

SEQ ID NO: 258871 - DNA, 20 bp, Artificial Sequence
  Description of Artificial Sequence: Synthetic oligonucleotide
  Target: ATXN1; (+) strand; PAM type: YTN; PAM sequence: CTC
cctagctagttgaggggcag

SEQ ID NO: 258872 - DNA, 20 bp, Artificial Sequence
  Description of Artificial Sequence: Synthetic oligonucleotide
  Target: ATXN1; (+) strand; PAM type: YTN; PAM sequence: CTA
gctagttgaggggcagcagt

SEQ ID NO: 258873 - DNA, 20 bp, Artificial Sequence
  Description of Artificial Sequence: Synthetic oligonucleotide
  Target: ATXN1; (+) strand; PAM type: YTN; PAM sequence: CTA
gttgaggggcagcagtatta

SEQ ID NO: 258874 - DNA, 20 bp, Artificial Sequence
  Description of Artificial Sequence: Synthetic oligonucleotide
  Target: ATXN1; (+) strand; PAM type: YTN; PAM sequence: TTG
aggggcagcagtattaattg

SEQ ID NO: 258875 - DNA, 20 bp, Artificial Sequence
  Description of Artificial Sequence: Synthetic oligonucleotide
  Target: ATXN1; (+) strand; PAM type: YTN; PAM sequence: TTA
attgttccttcctaagagtt

SEQ ID NO: 258876 - DNA, 20 bp, Artificial Sequence
  Description of Artificial Sequence: Synthetic oligonucleotide
  Target: ATXN1; (+) strand; PAM type: YTN; PAM sequence: TTG
ttccttcctaagagttgtca

SEQ ID NO: 258877 - DNA, 20 bp, Artificial Sequence
  Description of Artificial Sequence: Synthetic oligonucleotide
  Target: ATXN1; (+) strand; PAM type: YTN; PAM sequence: TTC
cttcctaagagttgtcaagc

SEQ ID NO: 258878 - DNA, 20 bp, Artificial Sequence
  Description of Artificial Sequence: Synthetic oligonucleotide
  Target: ATXN1; (+) strand; PAM type: YTN; PAM sequence: CTT
cctaagagttgtcaagcaaa

SEQ ID NO: 258879 - DNA, 20 bp, Artificial Sequence
  Description of Artificial Sequence: Synthetic oligonucleotide
  Target: ATXN1; (+) strand; PAM type: YTN; PAM sequence: TTC
ctaagagttgtcaagcaaat

SEQ ID NO: 258880 - DNA, 20 bp, Artificial Sequence
  Description of Artificial Sequence: Synthetic oligonucleotide
  Target: ATXN1; (+) strand; PAM type: YTN; PAM sequence: CTA
agagttgtcaagcaaatcaa

SEQ ID NO: 258881 - DNA, 20 bp, Artificial Sequence
  Description of Artificial Sequence: Synthetic oligonucleotide
  Target: ATXN1; (+) strand; PAM type: YTN; PAM sequence: TTG
tcaagcaaatcaacctgaga

SEQ ID NO: 258882 - DNA, 20 bp, Artificial Sequence
  Description of Artificial Sequence: Synthetic oligonucleotide
  Target: ATXN1; (+) strand; PAM type: YTN; PAM sequence: CTG
agaactggaatccacccaag

SEQ ID NO: 258883 - DNA, 20 bp, Artificial Sequence
  Description of Artificial Sequence: Synthetic oligonucleotide
  Target: ATXN1; (+) strand; PAM type: YTN; PAM sequence: CTG
gaatccacccaagacacacc

SEQ ID NO: 258884 - DNA, 20 bp, Artificial Sequence
  Description of Artificial Sequence: Synthetic oligonucleotide
  Target: ATXN1; (+) strand; PAM type: YTN; PAM sequence: CTA
tgccttttacaataaagatt

SEQ ID NO: 258885 - DNA, 20 bp, Artificial Sequence
  Description of Artificial Sequence: Synthetic oligonucleotide
  Target: ATXN1; (+) strand; PAM type: YTN; PAM sequence: CTT
ttacaataaagattcagtga

SEQ ID NO: 258886 - DNA, 20 bp, Artificial Sequence
  Description of Artificial Sequence: Synthetic oligonucleotide
  Target: ATXN1; (+) strand; PAM type: YTN; PAM sequence: TTT
tacaataaagattcagtgaa

SEQ ID NO: 258887 - DNA, 20 bp, Artificial Sequence
  Description of Artificial Sequence: Synthetic oligonucleotide
  Target: ATXN1; (+) strand; PAM type: YTN; PAM sequence: TTT
acaataaagattcagtgaag

SEQ ID NO: 258888 - DNA, 20 bp, Artificial Sequence
  Description of Artificial Sequence: Synthetic oligonucleotide
  Target: ATXN1; (+) strand; PAM type: YTN; PAM sequence: TTA
caataaagattcagtgaaga

SEQ ID NO: 258889 - DNA, 20 bp, Artificial Sequence
  Description of Artificial Sequence: Synthetic oligonucleotide
  Target: ATXN1; (+) strand; PAM type: YTN; PAM sequence: TTC
agtgaagaatcctgcccttc

SEQ ID NO: 258890 - DNA, 20 bp, Artificial Sequence
  Description of Artificial Sequence: Synthetic oligonucleotide
  Target: ATXN1; (+) strand; PAM type: YTN; PAM sequence: CTG
cccttcacaacagcctcctc

SEQ ID NO: 258891 - DNA, 20 bp, Artificial Sequence
  Description of Artificial Sequence: Synthetic oligonucleotide
  Target: ATXN1; (+) strand; PAM type: YTN; PAM sequence: CTT
cacaacagcctcctcaagta

SEQ ID NO: 258892 - DNA, 20 bp, Artificial Sequence
  Description of Artificial Sequence: Synthetic oligonucleotide
  Target: ATXN1; (+) strand; PAM type: YTN; PAM sequence: TTC
acaacagcctcctcaagtag

SEQ ID NO: 258893 - DNA, 20 bp, Artificial Sequence
  Description of Artificial Sequence: Synthetic oligonucleotide
  Target: ATXN1; (+) strand; PAM type: YTN; PAM sequence: CTC
ctcaagtagggaaaacgcta

SEQ ID NO: 258894 - DNA, 20 bp, Artificial Sequence
  Description of Artificial Sequence: Synthetic oligonucleotide
  Target: ATXN1; (+) strand; PAM type: YTN; PAM sequence: CTC
aagtagggaaaacgctacaa

SEQ ID NO: 258895 - DNA, 20 bp, Artificial Sequence
  Description of Artificial Sequence: Synthetic oligonucleotide
  Target: ATXN1; (+) strand; PAM type: YTN; PAM sequence: CTA
caaaaaatggatacatgaca

SEQ ID NO: 258896 - DNA, 20 bp, Artificial Sequence
  Description of Artificial Sequence: Synthetic oligonucleotide
  Target: ATXN1; (+) strand; PAM type: YTN; PAM sequence: CTC
cttcacccacagagagatgt

SEQ ID NO: 258897 - DNA, 20 bp, Artificial Sequence
  Description of Artificial Sequence: Synthetic oligonucleotide
  Target: ATXN1; (+) strand; PAM type: YTN; PAM sequence: CTT
cacccacagagagatgtttc

SEQ ID NO: 258898 - DNA, 20 bp, Artificial Sequence
  Description of Artificial Sequence: Synthetic oligonucleotide
  Target: ATXN1; (+) strand; PAM type: YTN; PAM sequence: TTC
acccacagagagatgtttct

SEQ ID NO: 258899 - DNA, 20 bp, Artificial Sequence
  Description of Artificial Sequence: Synthetic oligonucleotide
  Target: ATXN1; (+) strand; PAM type: YTN; PAM sequence: TTT
ctttgatctgccttatctct

SEQ ID NO: 258900 - DNA, 20 bp, Artificial Sequence
  Description of Artificial Sequence: Synthetic oligonucleotide
  Target: ATXN1; (+) strand; PAM type: YTN; PAM sequence: TTC
tttgatctgccttatctctg

SEQ ID NO: 258901 - DNA, 20 bp, Artificial Sequence
  Description of Artificial Sequence: Synthetic oligonucleotide
  Target: ATXN1; (+) strand; PAM type: YTN; PAM sequence: CTT
tgatctgccttatctctgcc

SEQ ID NO: 258902 - DNA, 20 bp, Artificial Sequence
  Description of Artificial Sequence: Synthetic oligonucleotide
  Target: ATXN1; (+) strand; PAM type: YTN; PAM sequence: TTT
gatctgccttatctctgcca

SEQ ID NO: 258903 - DNA, 20 bp, Artificial Sequence
  Description of Artificial Sequence: Synthetic oligonucleotide
  Target: ATXN1; (+) strand; PAM type: YTN; PAM sequence: TTG
atctgccttatctctgccat

SEQ ID NO: 258904 - DNA, 20 bp, Artificial Sequence
  Description of Artificial Sequence: Synthetic oligonucleotide
  Target: ATXN1; (+) strand; PAM type: YTN; PAM sequence: CTG
ccttatctctgccatctgtt

SEQ ID NO: 258905 - DNA, 20 bp, Artificial Sequence
  Description of Artificial Sequence: Synthetic oligonucleotide
  Target: ATXN1; (+) strand; PAM type: YTN; PAM sequence: CTT
atctctgccatctgttttcc

SEQ ID NO: 258906 - DNA, 20 bp, Artificial Sequence
  Description of Artificial Sequence: Synthetic oligonucleotide
  Target: ATXN1; (+) strand; PAM type: YTN; PAM sequence: TTA
tctctgccatctgttttccc

SEQ ID NO: 258907 - DNA, 20 bp, Artificial Sequence
  Description of Artificial Sequence: Synthetic oligonucleotide
  Target: ATXN1; (+) strand; PAM type: YTN; PAM sequence: CTC
tgccatctgttttcccaacc

SEQ ID NO: 258908 - DNA, 20 bp, Artificial Sequence
  Description of Artificial Sequence: Synthetic oligonucleotide
  Target: ATXN1; (+) strand; PAM type: YTN; PAM sequence: CTG
ccatctgttttcccaacctg

SEQ ID NO: 258909 - DNA, 20 bp, Artificial Sequence
  Description of Artificial Sequence: Synthetic oligonucleotide
  Target: ATXN1; (+) strand; PAM type: YTN; PAM sequence: CTG
ttttcccaacctgggccaat

SEQ ID NO: 258910 - DNA, 20 bp, Artificial Sequence
  Description of Artificial Sequence: Synthetic oligonucleotide
  Target: ATXN1; (+) strand; PAM type: YTN; PAM sequence: TTT
tcccaacctgggccaatgtg

SEQ ID NO: 258911 - DNA, 20 bp, Artificial Sequence
  Description of Artificial Sequence: Synthetic oligonucleotide
  Target: ATXN1; (+) strand; PAM type: YTN; PAM sequence: TTT
cccaacctgggccaatgtgg

SEQ ID NO: 258912 - DNA, 20 bp, Artificial Sequence
  Description of Artificial Sequence: Synthetic oligonucleotide
  Target: ATXN1; (+) strand; PAM type: YTN; PAM sequence: TTC
ccaacctgggccaatgtggt

SEQ ID NO: 258913 - DNA, 20 bp, Artificial Sequence
  Description of Artificial Sequence: Synthetic oligonucleotide
  Target: ATXN1; (+) strand; PAM type: YTN; PAM sequence: CTG
ggccaatgtggtctaatttc

SEQ ID NO: 258914 - DNA, 20 bp, Artificial Sequence
  Description of Artificial Sequence: Synthetic oligonucleotide
  Target: ATXN1; (+) strand; PAM type: YTN; PAM sequence: CTA
atttcagttctttcatattt

SEQ ID NO: 258915 - DNA, 20 bp, Artificial Sequence
  Description of Artificial Sequence: Synthetic oligonucleotide
  Target: ATXN1; (+) strand; PAM type: YTN; PAM sequence: TTT
cagttctttcatattttcac

SEQ ID NO: 258916 - DNA, 20 bp, Artificial Sequence
  Description of Artificial Sequence: Synthetic oligonucleotide
  Target: ATXN1; (+) strand; PAM type: YTN; PAM sequence: TTC
agttctttcatattttcaca

SEQ ID NO: 258917 - DNA, 20 bp, Artificial Sequence
  Description of Artificial Sequence: Synthetic oligonucleotide
  Target: ATXN1; (+) strand; PAM type: YTN; PAM sequence: TTC
tttcatattttcacaagtca

SEQ ID NO: 258918 - DNA, 20 bp, Artificial Sequence
  Description of Artificial Sequence: Synthetic oligonucleotide
  Target: ATXN1; (+) strand; PAM type: YTN; PAM sequence: CTT
tcatattttcacaagtcaga

SEQ ID NO: 258919 - DNA, 20 bp, Artificial Sequence
  Description of Artificial Sequence: Synthetic oligonucleotide
  Target: ATXN1; (+) strand; PAM type: YTN; PAM sequence: TTT
catattttcacaagtcagag

SEQ ID NO: 258920 - DNA, 20 bp, Artificial Sequence
  Description of Artificial Sequence: Synthetic oligonucleotide
  Target: ATXN1; (+) strand; PAM type: YTN; PAM sequence: TTC
atattttcacaagtcagagg

SEQ ID NO: 258921 - DNA, 20 bp, Artificial Sequence
  Description of Artificial Sequence: Synthetic oligonucleotide
  Target: ATXN1; (+) strand; PAM type: YTN; PAM sequence: TTT
tcacaagtcagagggaaacc

SEQ ID NO: 258922 - DNA, 20 bp, Artificial Sequence
  Description of Artificial Sequence: Synthetic oligonucleotide
  Target: ATXN1; (+) strand; PAM type: YTN; PAM sequence: TTT
cacaagtcagagggaaacca

SEQ ID NO: 258923 - DNA, 20 bp, Artificial Sequence
  Description of Artificial Sequence: Synthetic oligonucleotide
  Target: ATXN1; (+) strand; PAM type: YTN; PAM sequence: TTC
acaagtcagagggaaaccag

SEQ ID NO: 258924 - DNA, 20 bp, Artificial Sequence
  Description of Artificial Sequence: Synthetic oligonucleotide
  Target: ATXN1; (+) strand; PAM type: YTN; PAM sequence: CTT
aaaggtttactactgaaaag

SEQ ID NO: 258925 - DNA, 20 bp, Artificial Sequence
  Description of Artificial Sequence: Synthetic oligonucleotide
  Target: ATXN1; (+) strand; PAM type: YTN; PAM sequence: TTA
aaggtttactactgaaaagc

SEQ ID NO: 258926 - DNA, 20 bp, Artificial Sequence
  Description of Artificial Sequence: Synthetic oligonucleotide
  Target: ATXN1; (+) strand; PAM type: YTN; PAM sequence: TTT
actactgaaaagcactttat

SEQ ID NO: 258927 - DNA, 20 bp, Artificial Sequence
  Description of Artificial Sequence: Synthetic oligonucleotide
  Target: ATXN1; (+) strand; PAM type: YTN; PAM sequence: TTA
ctactgaaaagcactttatt

SEQ ID NO: 258928 - DNA, 20 bp, Artificial Sequence
  Description of Artificial Sequence: Synthetic oligonucleotide
  Target: ATXN1; (+) strand; PAM type: YTN; PAM sequence: CTA
ctgaaaagcactttattttc

SEQ ID NO: 258929 - DNA, 20 bp, Artificial Sequence
  Description of Artificial Sequence: Synthetic oligonucleotide
  Target: ATXN1; (+) strand; PAM type: YTN; PAM sequence: CTG
aaaagcactttattttcagt

SEQ ID NO: 258930 - DNA, 20 bp, Artificial Sequence
  Description of Artificial Sequence: Synthetic oligonucleotide
  Target: ATXN1; (+) strand; PAM type: YTN; PAM sequence: CTT
tattttcagtaaggtgcttt

SEQ ID NO: 258931 - DNA, 20 bp, Artificial Sequence
  Description of Artificial Sequence: Synthetic oligonucleotide
  Target: ATXN1; (+) strand; PAM type: YTN; PAM sequence: TTT
attttcagtaaggtgcttta

SEQ ID NO: 258932 - DNA, 20 bp, Artificial Sequence
  Description of Artificial Sequence: Synthetic oligonucleotide
  Target: ATXN1; (+) strand; PAM type: YTN; PAM sequence: TTA
ttttcagtaaggtgctttaa

SEQ ID NO: 258933 - DNA, 20 bp, Artificial Sequence
  Description of Artificial Sequence: Synthetic oligonucleotide
  Target: ATXN1; (+) strand; PAM type: YTN; PAM sequence: TTT
tcagtaaggtgctttaaaaa

SEQ ID NO: 258934 - DNA, 20 bp, Artificial Sequence
  Description of Artificial Sequence: Synthetic oligonucleotide
  Target: ATXN1; (+) strand; PAM type: YTN; PAM sequence: TTT
cagtaaggtgctttaaaaaa

SEQ ID NO: 258935 - DNA, 20 bp, Artificial Sequence
  Description of Artificial Sequence: Synthetic oligonucleotide
  Target: ATXN1; (+) strand; PAM type: YTN; PAM sequence: TTC
agtaaggtgctttaaaaaat

SEQ ID NO: 258936 - DNA, 20 bp, Artificial Sequence
  Description of Artificial Sequence: Synthetic oligonucleotide
  Target: ATXN1; (+) strand; PAM type: YTN; PAM sequence: CTT
taaaaaatagaattgtcata

SEQ ID NO: 258937 - DNA, 20 bp, Artificial Sequence
  Description of Artificial Sequence: Synthetic oligonucleotide
  Target: ATXN1; (+) strand; PAM type: YTN; PAM sequence: TTT
aaaaaatagaattgtcatat

SEQ ID NO: 258938 - DNA, 20 bp, Artificial Sequence
  Description of Artificial Sequence: Synthetic oligonucleotide
  Target: ATXN1; (+) strand; PAM type: YTN; PAM sequence: TTA
aaaaatagaattgtcatatc

SEQ ID NO: 258939 - DNA, 20 bp, Artificial Sequence
  Description of Artificial Sequence: Synthetic oligonucleotide
  Target: ATXN1; (+) strand; PAM type: YTN; PAM sequence: TTG
tcatatctgatctgattcag

SEQ ID NO: 258940 - DNA, 20 bp, Artificial Sequence
  Description of Artificial Sequence: Synthetic oligonucleotide
  Target: ATXN1; (+) strand; PAM type: YTN; PAM sequence: CTG
atctgattcaggtaagaaat

SEQ ID NO: 258941 - DNA, 20 bp, Artificial Sequence
  Description of Artificial Sequence: Synthetic oligonucleotide
  Target: ATXN1; (+) strand; PAM type: YTN; PAM sequence: CTG
attcaggtaagaaatttcag

SEQ ID NO: 258942 - DNA, 20 bp, Artificial Sequence
  Description of Artificial Sequence: Synthetic oligonucleotide
  Target: ATXN1; (+) strand; PAM type: YTN; PAM sequence: TTC
aggtaagaaatttcagaaag

SEQ ID NO: 258943 - DNA, 20 bp, Artificial Sequence
  Description of Artificial Sequence: Synthetic oligonucleotide
  Target: ATXN1; (+) strand; PAM type: YTN; PAM sequence: TTT
cagaaagggaactctagaat

SEQ ID NO: 258944 - DNA, 20 bp, Artificial Sequence
  Description of Artificial Sequence: Synthetic oligonucleotide
  Target: ATXN1; (+) strand; PAM type: YTN; PAM sequence: TTC
agaaagggaactctagaatt

SEQ ID NO: 258945 - DNA, 20 bp, Artificial Sequence
  Description of Artificial Sequence: Synthetic oligonucleotide
  Target: ATXN1; (+) strand; PAM type: YTN; PAM sequence: CTC
tagaattcatttttcataaa

SEQ ID NO: 258946 - DNA, 20 bp, Artificial Sequence
  Description of Artificial Sequence: Synthetic oligonucleotide
  Target: ATXN1; (+) strand; PAM type: YTN; PAM sequence: CTA
gaattcatttttcataaagg

SEQ ID NO: 258947 - DNA, 20 bp, Artificial Sequence
  Description of Artificial Sequence: Synthetic oligonucleotide
  Target: ATXN1; (+) strand; PAM type: YTN; PAM sequence: TTC
atttttcataaagggacagt

SEQ ID NO: 258948 - DNA, 20 bp, Artificial Sequence
  Description of Artificial Sequence: Synthetic oligonucleotide
  Target: ATXN1; (+) strand; PAM type: YTN; PAM sequence: TTT
ttcataaagggacagtcagt

SEQ ID NO: 258949 - DNA, 20 bp, Artificial Sequence
  Description of Artificial Sequence: Synthetic oligonucleotide
  Target: ATXN1; (+) strand; PAM type: YTN; PAM sequence: TTT
tcataaagggacagtcagtg

SEQ ID NO: 258950 - DNA, 20 bp, Artificial Sequence
  Description of Artificial Sequence: Synthetic oligonucleotide
  Target: ATXN1; (+) strand; PAM type: YTN; PAM sequence: TTT
cataaagggacagtcagtgg

SEQ ID NO: 258951 - DNA, 20 bp, Artificial Sequence
  Description of Artificial Sequence: Synthetic oligonucleotide
  Target: ATXN1; (+) strand; PAM type: YTN; PAM sequence: TTC
ataaagggacagtcagtgga

SEQ ID NO: 258952 - DNA, 20 bp, Artificial Sequence
  Description of Artificial Sequence: Synthetic oligonucleotide
  Target: ATXN1; (+) strand; PAM type: YTN; PAM sequence: CTT
tataatcacacacctctctc

SEQ ID NO: 258953 - DNA, 20 bp, Artificial Sequence
  Description of Artificial Sequence: Synthetic oligonucleotide
  Target: ATXN1; (+) strand; PAM type: YTN; PAM sequence: TTT
ataatcacacacctctctct

SEQ ID NO: 258954 - DNA, 20 bp, Artificial Sequence
  Description of Artificial Sequence: Synthetic oligonucleotide
  Target: ATXN1; (+) strand; PAM type: YTN; PAM sequence: TTA
taatcacacacctctctctg

SEQ ID NO: 258955 - DNA, 20 bp, Artificial Sequence
  Description of Artificial Sequence: Synthetic oligonucleotide
  Target: ATXN1; (+) strand; PAM type: YTN; PAM sequence: CTC
tctctgaatacatttcactt

SEQ ID NO: 258956 - DNA, 20 bp, Artificial Sequence
  Description of Artificial Sequence: Synthetic oligonucleotide
  Target: ATXN1; (+) strand; PAM type: YTN; PAM sequence: CTC
tctgaatacatttcacttgt

SEQ ID NO: 258957 - DNA, 20 bp, Artificial Sequence
  Description of Artificial Sequence: Synthetic oligonucleotide
  Target: ATXN1; (+) strand; PAM type: YTN; PAM sequence: CTC
tgaatacatttcacttgtta

SEQ ID NO: 258958 - DNA, 20 bp, Artificial Sequence
  Description of Artificial Sequence: Synthetic oligonucleotide
  Target: ATXN1; (+) strand; PAM type: YTN; PAM sequence: CTG
aatacatttcacttgttagc

SEQ ID NO: 258959 - DNA, 20 bp, Artificial Sequence
  Description of Artificial Sequence: Synthetic oligonucleotide
  Target: ATXN1; (+) strand; PAM type: YTN; PAM sequence: TTT
cacttgttagccatcaggtc

SEQ ID NO: 258960 - DNA, 20 bp, Artificial Sequence
  Description of Artificial Sequence: Synthetic oligonucleotide
  Target: ATXN1; (+) strand; PAM type: YTN; PAM sequence: TTC
acttgttagccatcaggtct

SEQ ID NO: 258961 - DNA, 20 bp, Artificial Sequence
  Description of Artificial Sequence: Synthetic oligonucleotide
  Target: ATXN1; (+) strand; PAM type: YTN; PAM sequence: CTT
gttagccatcaggtctgaaa

SEQ ID NO: 258962 - DNA, 20 bp, Artificial Sequence
  Description of Artificial Sequence: Synthetic oligonucleotide
  Target: ATXN1; (+) strand; PAM type: YTN; PAM sequence: TTG
ttagccatcaggtctgaaaa

SEQ ID NO: 258963 - DNA, 20 bp, Artificial Sequence
  Description of Artificial Sequence: Synthetic oligonucleotide
  Target: ATXN1; (+) strand; PAM type: YTN; PAM sequence: TTA
gccatcaggtctgaaaactg

SEQ ID NO: 258964 - DNA, 20 bp, Artificial Sequence
  Description of Artificial Sequence: Synthetic oligonucleotide
  Target: ATXN1; (+) strand; PAM type: YTN; PAM sequence: CTG
aaaactgtagtgctggctct

SEQ ID NO: 258965 - DNA, 20 bp, Artificial Sequence
  Description of Artificial Sequence: Synthetic oligonucleotide
  Target: ATXN1; (+) strand; PAM type: YTN; PAM sequence: CTG
tagtgctggctctgttcagt

SEQ ID NO: 258966 - DNA, 20 bp, Artificial Sequence
  Description of Artificial Sequence: Synthetic oligonucleotide
  Target: ATXN1; (+) strand; PAM type: YTN; PAM sequence: CTG
gctctgttcagttattgttc

SEQ ID NO: 258967 - DNA, 20 bp, Artificial Sequence
  Description of Artificial Sequence: Synthetic oligonucleotide
  Target: ATXN1; (+) strand; PAM type: YTN; PAM sequence: CTC
tgttcagttattgttcaagt

SEQ ID NO: 258968 - DNA, 20 bp, Artificial Sequence
  Description of Artificial Sequence: Synthetic oligonucleotide
  Target: ATXN1; (+) strand; PAM type: YTN; PAM sequence: CTG
ttcagttattgttcaagtgt

SEQ ID NO: 258969 - DNA, 20 bp, Artificial Sequence
  Description of Artificial Sequence: Synthetic oligonucleotide
  Target: ATXN1; (+) strand; PAM type: YTN; PAM sequence: TTC
agttattgttcaagtgtgat

SEQ ID NO: 258970 - DNA, 20 bp, Artificial Sequence
  Description of Artificial Sequence: Synthetic oligonucleotide
  Target: ATXN1; (+) strand; PAM type: YTN; PAM sequence: TTA
ttgttcaagtgtgatctcaa

SEQ ID NO: 258971 - DNA, 20 bp, Artificial Sequence
  Description of Artificial Sequence: Synthetic oligonucleotide
  Target: ATXN1; (+) strand; PAM type: YTN; PAM sequence: TTG
ttcaagtgtgatctcaacga

SEQ ID NO: 258972 - DNA, 20 bp, Artificial Sequence
  Description of Artificial Sequence: Synthetic oligonucleotide
  Target: ATXN1; (+) strand; PAM type: YTN; PAM sequence: TTC
aagtgtgatctcaacgaccc

SEQ ID NO: 258973 - DNA, 20 bp, Artificial Sequence
  Description of Artificial Sequence: Synthetic oligonucleotide
  Target: ATXN1; (+) strand; PAM type: YTN; PAM sequence: CTC
aacgaccctgaaattcttct

SEQ ID NO: 258974 - DNA, 20 bp, Artificial Sequence
  Description of Artificial Sequence: Synthetic oligonucleotide
  Target: ATXN1; (+) strand; PAM type: YTN; PAM sequence: CTG
aaattcttctttgtcatttt

SEQ ID NO: 258975 - DNA, 20 bp, Artificial Sequence
  Description of Artificial Sequence: Synthetic oligonucleotide
  Target: ATXN1; (+) strand; PAM type: YTN; PAM sequence: TTC
ttctttgtcattttgcatca

SEQ ID NO: 258976 - DNA, 20 bp, Artificial Sequence
  Description of Artificial Sequence: Synthetic oligonucleotide
  Target: ATXN1; (+) strand; PAM type: YTN; PAM sequence: CTT
ctttgtcattttgcatcagg

SEQ ID NO: 258977 - DNA, 20 bp, Artificial Sequence
  Description of Artificial Sequence: Synthetic oligonucleotide
  Target: ATXN1; (+) strand; PAM type: YTN; PAM sequence: TTC
tttgtcattttgcatcaggc

SEQ ID NO: 258978 - DNA, 20 bp, Artificial Sequence
  Description of Artificial Sequence: Synthetic oligonucleotide
  Target: ATXN1; (+) strand; PAM type: YTN; PAM sequence: CTT
tgtcattttgcatcaggctg

SEQ ID NO: 258979 - DNA, 20 bp, Artificial Sequence
  Description of Artificial Sequence: Synthetic oligonucleotide
  Target: ATXN1; (+) strand; PAM type: YTN; PAM sequence: TTT
gtcattttgcatcaggctgt

SEQ ID NO: 258980 - DNA, 20 bp, Artificial Sequence
  Description of Artificial Sequence: Synthetic oligonucleotide
  Target: ATXN1; (+) strand; PAM type: YTN; PAM sequence: TTG
tcattttgcatcaggctgtt

SEQ ID NO: 258981 - DNA, 20 bp, Artificial Sequence
  Description of Artificial Sequence: Synthetic oligonucleotide
  Target: ATXN1; (+) strand; PAM type: YTN; PAM sequence: TTT
tgcatcaggctgtttttcat

SEQ ID NO: 258982 - DNA, 20 bp, Artificial Sequence
  Description of Artificial Sequence: Synthetic oligonucleotide
  Target: ATXN1; (+) strand; PAM type: YTN; PAM sequence: TTT
gcatcaggctgtttttcatg

SEQ ID NO: 258983 - DNA, 20 bp, Artificial Sequence
  Description of Artificial Sequence: Synthetic oligonucleotide
  Target: ATXN1; (+) strand; PAM type: YTN; PAM sequence: TTG
catcaggctgtttttcatga

SEQ ID NO: 258984 - DNA, 20 bp, Artificial Sequence
  Description of Artificial Sequence: Synthetic oligonucleotide
  Target: ATXN1; (+) strand; PAM type: YTN; PAM sequence: CTG
tttttcatgatttcactttg

SEQ ID NO: 258985 - DNA, 20 bp, Artificial Sequence
  Description of Artificial Sequence: Synthetic oligonucleotide
  Target: ATXN1; (+) strand; PAM type: YTN; PAM sequence: TTT
ttcatgatttcactttgttc

SEQ ID NO: 258986 - DNA, 20 bp, Artificial Sequence
  Description of Artificial Sequence: Synthetic oligonucleotide
  Target: ATXN1; (+) strand; PAM type: YTN; PAM sequence: TTT
tcatgatttcactttgttcc

SEQ ID NO: 258987 - DNA, 20 bp, Artificial Sequence
  Description of Artificial Sequence: Synthetic oligonucleotide
  Target: ATXN1; (+) strand; PAM type: YTN; PAM sequence: TTT
catgatttcactttgttccc

SEQ ID NO: 258988 - DNA, 20 bp, Artificial Sequence
  Description of Artificial Sequence: Synthetic oligonucleotide
  Target: ATXN1; (+) strand; PAM type: YTN; PAM sequence: TTC
atgatttcactttgttccca

SEQ ID NO: 258989 - DNA, 20 bp, Artificial Sequence
  Description of Artificial Sequence: Synthetic oligonucleotide
  Target: ATXN1; (+) strand; PAM type: YTN; PAM sequence: TTT
cactttgttcccatcctcac

SEQ ID NO: 258990 - DNA, 20 bp, Artificial Sequence
  Description of Artificial Sequence: Synthetic oligonucleotide
  Target: ATXN1; (+) strand; PAM type: YTN; PAM sequence: TTC
actttgttcccatcctcacg

SEQ ID NO: 258991 - DNA, 20 bp, Artificial Sequence
  Description of Artificial Sequence: Synthetic oligonucleotide
  Target: ATXN1; (+) strand; PAM type: YTN; PAM sequence: CTT
tgttcccatcctcacggcct

SEQ ID NO: 258992 - DNA, 20 bp, Artificial Sequence
  Description of Artificial Sequence: Synthetic oligonucleotide
  Target: ATXN1; (+) strand; PAM type: YTN; PAM sequence: TTT
gttcccatcctcacggcctt

SEQ ID NO: 258993 - DNA, 20 bp, Artificial Sequence
  Description of Artificial Sequence: Synthetic oligonucleotide
  Target: ATXN1; (+) strand; PAM type: YTN; PAM sequence: TTG
ttcccatcctcacggccttc

SEQ ID NO: 258994 - DNA, 20 bp, Artificial Sequence
  Description of Artificial Sequence: Synthetic oligonucleotide
  Target: ATXN1; (+) strand; PAM type: YTN; PAM sequence: TTC
ccatcctcacggccttctac

SEQ ID NO: 258995 - DNA, 20 bp, Artificial Sequence
  Description of Artificial Sequence: Synthetic oligonucleotide
  Target: ATXN1; (+) strand; PAM type: YTN; PAM sequence: CTC
acggccttctactacgcaag

SEQ ID NO: 258996 - DNA, 20 bp, Artificial Sequence
  Description of Artificial Sequence: Synthetic oligonucleotide
  Target: ATXN1; (+) strand; PAM type: YTN; PAM sequence: CTT
ctactacgcaaggtctcatg

SEQ ID NO: 258997 - DNA, 20 bp, Artificial Sequence
  Description of Artificial Sequence: Synthetic oligonucleotide
  Target: ATXN1; (+) strand; PAM type: YTN; PAM sequence: TTC
tactacgcaaggtctcatga

SEQ ID NO: 258998 - DNA, 20 bp, Artificial Sequence
  Description of Artificial Sequence: Synthetic oligonucleotide
  Target: ATXN1; (+) strand; PAM type: YTN; PAM sequence: CTA
ctacgcaaggtctcatgata

SEQ ID NO: 258999 - DNA, 20 bp, Artificial Sequence
  Description of Artificial Sequence: Synthetic oligonucleotide
  Target: ATXN1; (+) strand; PAM type: YTN; PAM sequence: CTA
cgcaaggtctcatgatataa

SEQ ID NO: 259000 - DNA, 20 bp, Artificial Sequence
  Description of Artificial Sequence: Synthetic oligonucleotide
  Target: ATXN1; (+) strand; PAM type: YTN; PAM sequence: CTC
atgatataaatgaaggttat

SEQ ID NO: 259001 - DNA, 20 bp, Artificial Sequence
  Description of Artificial Sequence: Synthetic oligonucleotide
  Target: ATXN1; (+) strand; PAM type: YTN; PAM sequence: TTA
tcttcttttccttccagtca

SEQ ID NO: 259002 - DNA, 20 bp, Artificial Sequence
  Description of Artificial Sequence: Synthetic oligonucleotide
  Target: ATXN1; (+) strand; PAM type: YTN; PAM sequence: CTT
cttttccttccagtcactcc

SEQ ID NO: 259003 - DNA, 20 bp, Artificial Sequence
  Description of Artificial Sequence: Synthetic oligonucleotide
  Target: ATXN1; (+) strand; PAM type: YTN; PAM sequence: TTC
ttttccttccagtcactcct

SEQ ID NO: 259004 - DNA, 20 bp, Artificial Sequence
  Description of Artificial Sequence: Synthetic oligonucleotide
  Target: ATXN1; (+) strand; PAM type: YTN; PAM sequence: CTT
ttccttccagtcactcctct

SEQ ID NO: 259005 - DNA, 20 bp, Artificial Sequence
  Description of Artificial Sequence: Synthetic oligonucleotide
  Target: ATXN1; (+) strand; PAM type: YTN; PAM sequence: TTT
tccttccagtcactcctctt

SEQ ID NO: 259006 - DNA, 20 bp, Artificial Sequence
  Description of Artificial Sequence: Synthetic oligonucleotide
  Target: ATXN1; (+) strand; PAM type: YTN; PAM sequence: TTT
ccttccagtcactcctcttt

SEQ ID NO: 259007 - DNA, 20 bp, Artificial Sequence
  Description of Artificial Sequence: Synthetic oligonucleotide
  Target: ATXN1; (+) strand; PAM type: YTN; PAM sequence: TTC
cttccagtcactcctcttta

SEQ ID NO: 259008 - DNA, 20 bp, Artificial Sequence
  Description of Artificial Sequence: Synthetic oligonucleotide
  Target: ATXN1; (+) strand; PAM type: YTN; PAM sequence: CTT
ccagtcactcctctttacag

SEQ ID NO: 259009 - DNA, 20 bp, Artificial Sequence
  Description of Artificial Sequence: Synthetic oligonucleotide
  Target: ATXN1; (+) strand; PAM type: YTN; PAM sequence: TTC
cagtcactcctctttacaga

SEQ ID NO: 259010 - DNA, 20 bp, Artificial Sequence
  Description of Artificial Sequence: Synthetic oligonucleotide
  Target: ATXN1; (+) strand; PAM type: YTN; PAM sequence: CTC
ctctttacagaaatctccta

SEQ ID NO: 259011 - DNA, 20 bp, Artificial Sequence
  Description of Artificial Sequence: Synthetic oligonucleotide
  Target: ATXN1; (+) strand; PAM type: YTN; PAM sequence: CTC
tttacagaaatctcctacat

SEQ ID NO: 259012 - DNA, 20 bp, Artificial Sequence
  Description of Artificial Sequence: Synthetic oligonucleotide
  Target: ATXN1; (+) strand; PAM type: YTN; PAM sequence: CTT
tacagaaatctcctacataa

SEQ ID NO: 259013 - DNA, 20 bp, Artificial Sequence
  Description of Artificial Sequence: Synthetic oligonucleotide
  Target: ATXN1; (+) strand; PAM type: YTN; PAM sequence: TTT
acagaaatctcctacataat

SEQ ID NO: 259014 - DNA, 20 bp, Artificial Sequence
  Description of Artificial Sequence: Synthetic oligonucleotide
  Target: ATXN1; (+) strand; PAM type: YTN; PAM sequence: TTA
cagaaatctcctacataatt

SEQ ID NO: 259015 - DNA, 20 bp, Artificial Sequence
  Description of Artificial Sequence: Synthetic oligonucleotide
  Target: ATXN1; (+) strand; PAM type: YTN; PAM sequence: CTC
ctacataattgagatgctgt

SEQ ID NO: 259016 - DNA, 20 bp, Artificial Sequence
  Description of Artificial Sequence: Synthetic oligonucleotide
  Target: ATXN1; (+) strand; PAM type: YTN; PAM sequence: CTA
cataattgagatgctgtcat

SEQ ID NO: 259017 - DNA, 20 bp, Artificial Sequence
  Description of Artificial Sequence: Synthetic oligonucleotide
  Target: ATXN1; (+) strand; PAM type: YTN; PAM sequence: TTG
agatgctgtcatcaatcagt

SEQ ID NO: 259018 - DNA, 20 bp, Artificial Sequence
  Description of Artificial Sequence: Synthetic oligonucleotide
  Target: ATXN1; (+) strand; PAM type: YTN; PAM sequence: CTG
tcatcaatcagtcaaccaac

SEQ ID NO: 259019 - DNA, 20 bp, Artificial Sequence
  Description of Artificial Sequence: Synthetic oligonucleotide
  Target: ATXN1; (+) strand; PAM type: YTN; PAM sequence: CTG
aactgggtccttgtgatgtt

SEQ ID NO: 259020 - DNA, 20 bp, Artificial Sequence
  Description of Artificial Sequence: Synthetic oligonucleotide
  Target: ATXN1; (+) strand; PAM type: YTN; PAM sequence: CTG
ggtccttgtgatgttccagg

SEQ ID NO: 259021 - DNA, 20 bp, Artificial Sequence
  Description of Artificial Sequence: Synthetic oligonucleotide
  Target: ATXN1; (+) strand; PAM type: YTN; PAM sequence: CTT
gtgatgttccaggggtttaa

SEQ ID NO: 259022 - DNA, 20 bp, Artificial Sequence
  Description of Artificial Sequence: Synthetic oligonucleotide
  Target: ATXN1; (+) strand; PAM type: YTN; PAM sequence: TTG
tgatgttccaggggtttaat

SEQ ID NO: 259023 - DNA, 20 bp, Artificial Sequence
  Description of Artificial Sequence: Synthetic oligonucleotide
  Target: ATXN1; (+) strand; PAM type: YTN; PAM sequence: TTC
caggggtttaattacaagga

SEQ ID NO: 259024 - DNA, 20 bp, Artificial Sequence
  Description of Artificial Sequence: Synthetic oligonucleotide
  Target: ATXN1; (+) strand; PAM type: YTN; PAM sequence: TTT
aattacaaggaatgctagct

SEQ ID NO: 259025 - DNA, 20 bp, Artificial Sequence
  Description of Artificial Sequence: Synthetic oligonucleotide
  Target: ATXN1; (+) strand; PAM type: YTN; PAM sequence: TTA
attacaaggaatgctagctc

SEQ ID NO: 259026 - DNA, 20 bp, Artificial Sequence
  Description of Artificial Sequence: Synthetic oligonucleotide
  Target: ATXN1; (+) strand; PAM type: YTN; PAM sequence: TTA
caaggaatgctagctcctaa

SEQ ID NO: 259027 - DNA, 20 bp, Artificial Sequence
  Description of Artificial Sequence: Synthetic oligonucleotide
  Target: ATXN1; (+) strand; PAM type: YTN; PAM sequence: CTA
gctcctaacatctcagatac

SEQ ID NO: 259028 - DNA, 20 bp, Artificial Sequence
  Description of Artificial Sequence: Synthetic oligonucleotide
  Target: ATXN1; (+) strand; PAM type: YTN; PAM sequence: CTC
ctaacatctcagataccatg

SEQ ID NO: 259029 - DNA, 20 bp, Artificial Sequence
  Description of Artificial Sequence: Synthetic oligonucleotide
  Target: ATXN1; (+) strand; PAM type: YTN; PAM sequence: CTA
acatctcagataccatgggc

SEQ ID NO: 259030 - DNA, 20 bp, Artificial Sequence
  Description of Artificial Sequence: Synthetic oligonucleotide
  Target: ATXN1; (+) strand; PAM type: YTN; PAM sequence: CTC
agataccatgggctcgaaga

SEQ ID NO: 259031 - DNA, 20 bp, Artificial Sequence
  Description of Artificial Sequence: Synthetic oligonucleotide
  Target: ATXN1; (+) strand; PAM type: YTN; PAM sequence: CTC
gaagacttgtaacatgtgat

SEQ ID NO: 259032 - DNA, 20 bp, Artificial Sequence
  Description of Artificial Sequence: Synthetic oligonucleotide
  Target: ATXN1; (+) strand; PAM type: YTN; PAM sequence: CTT
gtaacatgtgatattagggc

SEQ ID NO: 259033 - DNA, 20 bp, Artificial Sequence
  Description of Artificial Sequence: Synthetic oligonucleotide
  Target: ATXN1; (+) strand; PAM type: YTN; PAM sequence: TTG
taacatgtgatattagggca

SEQ ID NO: 259034 - DNA, 20 bp, Artificial Sequence
  Description of Artificial Sequence: Synthetic oligonucleotide
  Target: ATXN1; (+) strand; PAM type: YTN; PAM sequence: TTA
gggcagcaatggtttcctct

SEQ ID NO: 259035 - DNA, 20 bp, Artificial Sequence
  Description of Artificial Sequence: Synthetic oligonucleotide
  Target: ATXN1; (+) strand; PAM type: YTN; PAM sequence: TTT
cctctactggtccgggattt

SEQ ID NO: 259036 - DNA, 20 bp, Artificial Sequence
  Description of Artificial Sequence: Synthetic oligonucleotide
  Target: ATXN1; (+) strand; PAM type: YTN; PAM sequence: TTC
ctctactggtccgggatttg

SEQ ID NO: 259037 - DNA, 20 bp, Artificial Sequence
  Description of Artificial Sequence: Synthetic oligonucleotide
  Target: ATXN1; (+) strand; PAM type: YTN; PAM sequence: CTC
tactggtccgggatttgggg

SEQ ID NO: 259038 - DNA, 20 bp, Artificial Sequence
  Description of Artificial Sequence: Synthetic oligonucleotide
  Target: ATXN1; (+) strand; PAM type: YTN; PAM sequence: CTA
ctggtccgggatttggggtt

SEQ ID NO: 259039 - DNA, 20 bp, Artificial Sequence
  Description of Artificial Sequence: Synthetic oligonucleotide
  Target: ATXN1; (+) strand; PAM type: YTN; PAM sequence: CTG
gtccgggatttggggtttta

SEQ ID NO: 259040 - DNA, 20 bp, Artificial Sequence
  Description of Artificial Sequence: Synthetic oligonucleotide
  Target: ATXN1; (+) strand; PAM type: YTN; PAM sequence: TTT
ggggttttaggggctctctt

SEQ ID NO: 259041 - DNA, 20 bp, Artificial Sequence
  Description of Artificial Sequence: Synthetic oligonucleotide
  Target: ATXN1; (+) strand; PAM type: YTN; PAM sequence: TTG
gggttttaggggctctcttc

SEQ ID NO: 259042 - DNA, 20 bp, Artificial Sequence
  Description of Artificial Sequence: Synthetic oligonucleotide
  Target: ATXN1; (+) strand; PAM type: YTN; PAM sequence: TTT
taggggctctcttcacagat

SEQ ID NO: 259043 - DNA, 20 bp, Artificial Sequence
  Description of Artificial Sequence: Synthetic oligonucleotide
  Target: ATXN1; (+) strand; PAM type: YTN; PAM sequence: TTT
aggggctctcttcacagatg

SEQ ID NO: 259044 - DNA, 20 bp, Artificial Sequence
  Description of Artificial Sequence: Synthetic oligonucleotide
  Target: ATXN1; (+) strand; PAM type: YTN; PAM sequence: TTA
ggggctctcttcacagatga

SEQ ID NO: 259045 - DNA, 20 bp, Artificial Sequence
  Description of Artificial Sequence: Synthetic oligonucleotide
  Target: ATXN1; (+) strand; PAM type: YTN; PAM sequence: CTC
tcttcacagatgagagaatt

SEQ ID NO: 259046 - DNA, 20 bp, Artificial Sequence
  Description of Artificial Sequence: Synthetic oligonucleotide
  Target: ATXN1; (+) strand; PAM type: YTN; PAM sequence: CTC
ttcacagatgagagaatttt

SEQ ID NO: 259047 - DNA, 20 bp, Artificial Sequence
  Description of Artificial Sequence: Synthetic oligonucleotide
  Target: ATXN1; (+) strand; PAM type: YTN; PAM sequence: CTT
cacagatgagagaattttgc

SEQ ID NO: 259048 - DNA, 20 bp, Artificial Sequence
  Description of Artificial Sequence: Synthetic oligonucleotide
  Target: ATXN1; (+) strand; PAM type: YTN; PAM sequence: TTC
acagatgagagaattttgca

SEQ ID NO: 259049 - DNA, 20 bp, Artificial Sequence
  Description of Artificial Sequence: Synthetic oligonucleotide
  Target: ATXN1; (+) strand; PAM type: YTN; PAM sequence: TTT
tgcagcttcttgccactggc

SEQ ID NO: 259050 - DNA, 20 bp, Artificial Sequence
  Description of Artificial Sequence: Synthetic oligonucleotide
  Target: ATXN1; (+) strand; PAM type: YTN; PAM sequence: TTT
gcagcttcttgccactggct

SEQ ID NO: 259051 - DNA, 20 bp, Artificial Sequence
  Description of Artificial Sequence: Synthetic oligonucleotide
  Target: ATXN1; (+) strand; PAM type: YTN; PAM sequence: TTG
cagcttcttgccactggctg

SEQ ID NO: 259052 - DNA, 20 bp, Artificial Sequence
  Description of Artificial Sequence: Synthetic oligonucleotide
  Target: ATXN1; (+) strand; PAM type: YTN; PAM sequence: CTT
cttgccactggctgcaatga

SEQ ID NO: 259053 - DNA, 20 bp, Artificial Sequence
  Description of Artificial Sequence: Synthetic oligonucleotide
  Target: ATXN1; (+) strand; PAM type: YTN; PAM sequence: TTC
ttgccactggctgcaatgac

SEQ ID NO: 259054 - DNA, 20 bp, Artificial Sequence
  Description of Artificial Sequence: Synthetic oligonucleotide
  Target: ATXN1; (+) strand; PAM type: YTN; PAM sequence: CTT
gccactggctgcaatgacgc

SEQ ID NO: 259055 - DNA, 20 bp, Artificial Sequence
  Description of Artificial Sequence: Synthetic oligonucleotide
  Target: ATXN1; (+) strand; PAM type: YTN; PAM sequence: TTG
ccactggctgcaatgacgct

SEQ ID NO: 259056 - DNA, 20 bp, Artificial Sequence
  Description of Artificial Sequence: Synthetic oligonucleotide
  Target: ATXN1; (+) strand; PAM type: YTN; PAM sequence: CTG
gctgcaatgacgctccccag

SEQ ID NO: 259057 - DNA, 20 bp, Artificial Sequence
  Description of Artificial Sequence: Synthetic oligonucleotide
  Target: ATXN1; (+) strand; PAM type: YTN; PAM sequence: CTG
caatgacgctccccagtgag

SEQ ID NO: 259058 - DNA, 20 bp, Artificial Sequence
  Description of Artificial Sequence: Synthetic oligonucleotide
  Target: ATXN1; (+) strand; PAM type: YTN; PAM sequence: CTC
cccagtgaggtggaggccta

SEQ ID NO: 259059 - DNA, 20 bp, Artificial Sequence
  Description of Artificial Sequence: Synthetic oligonucleotide
  Target: ATXN1; (+) strand; PAM type: YTN; PAM sequence: CTA
gagagaggggagggtgactt

SEQ ID NO: 259060 - DNA, 20 bp, Artificial Sequence
  Description of Artificial Sequence: Synthetic oligonucleotide
  Target: ATXN1; (+) strand; PAM type: YTN; PAM sequence: CTT
aaggtgggcagggcctagcc

SEQ ID NO: 259061 - DNA, 20 bp, Artificial Sequence
  Description of Artificial Sequence: Synthetic oligonucleotide
  Target: ATXN1; (+) strand; PAM type: YTN; PAM sequence: TTA
aggtgggcagggcctagcct

SEQ ID NO: 259062 - DNA, 20 bp, Artificial Sequence
  Description of Artificial Sequence: Synthetic oligonucleotide
  Target: ATXN1; (+) strand; PAM type: YTN; PAM sequence: CTA
gccttgattacaggctctca

SEQ ID NO: 259063 - DNA, 20 bp, Artificial Sequence
  Description of Artificial Sequence: Synthetic oligonucleotide
  Target: ATXN1; (+) strand; PAM type: YTN; PAM sequence: CTT
gattacaggctctcaaggat

SEQ ID NO: 259064 - DNA, 20 bp, Artificial Sequence
  Description of Artificial Sequence: Synthetic oligonucleotide
  Target: ATXN1; (+) strand; PAM type: YTN; PAM sequence: TTG
attacaggctctcaaggatt

SEQ ID NO: 259065 - DNA, 20 bp, Artificial Sequence
  Description of Artificial Sequence: Synthetic oligonucleotide
  Target: ATXN1; (+) strand; PAM type: YTN; PAM sequence: TTA
caggctctcaaggattaacc

SEQ ID NO: 259066 - DNA, 20 bp, Artificial Sequence
  Description of Artificial Sequence: Synthetic oligonucleotide
  Target: ATXN1; (+) strand; PAM type: YTN; PAM sequence: CTC
tcaaggattaacctcgggag

SEQ ID NO: 259067 - DNA, 20 bp, Artificial Sequence
  Description of Artificial Sequence: Synthetic oligonucleotide
  Target: ATXN1; (+) strand; PAM type: YTN; PAM sequence: CTC
aaggattaacctcgggagga

SEQ ID NO: 259068 - DNA, 20 bp, Artificial Sequence
  Description of Artificial Sequence: Synthetic oligonucleotide
  Target: ATXN1; (+) strand; PAM type: YTN; PAM sequence: TTA
acctcgggaggacagagagg

SEQ ID NO: 259069 - DNA, 20 bp, Artificial Sequence
  Description of Artificial Sequence: Synthetic oligonucleotide
  Target: ATXN1; (+) strand; PAM type: YTN; PAM sequence: CTC
gggaggacagagaggagaga

SEQ ID NO: 259070 - DNA, 20 bp, Artificial Sequence
  Description of Artificial Sequence: Synthetic oligonucleotide
  Target: ATXN1; (+) strand; PAM type: YTN; PAM sequence: CTT
tgtgagtggacagaaattaa

SEQ ID NO: 259071 - DNA, 20 bp, Artificial Sequence
  Description of Artificial Sequence: Synthetic oligonucleotide
  Target: ATXN1; (+) strand; PAM type: YTN; PAM sequence: TTT
gtgagtggacagaaattaaa

SEQ ID NO: 259072 - DNA, 20 bp, Artificial Sequence
  Description of Artificial Sequence: Synthetic oligonucleotide
  Target: ATXN1; (+) strand; PAM type: YTN; PAM sequence: TTG
tgagtggacagaaattaaat

SEQ ID NO: 259073 - DNA, 20 bp, Artificial Sequence
  Description of Artificial Sequence: Synthetic oligonucleotide
  Target: ATXN1; (+) strand; PAM type: YTN; PAM sequence: TTA
aataaaggggtttccaagtt

SEQ ID NO: 259074 - DNA, 20 bp, Artificial Sequence
  Description of Artificial Sequence: Synthetic oligonucleotide
  Target: ATXN1; (+) strand; PAM type: YTN; PAM sequence: TTT
ccaagttaagtacagtgctc

SEQ ID NO: 259075 - DNA, 20 bp, Artificial Sequence
  Description of Artificial Sequence: Synthetic oligonucleotide
  Target: ATXN1; (+) strand; PAM type: YTN; PAM sequence: TTC
caagttaagtacagtgctcc

SEQ ID NO: 259076 - DNA, 20 bp, Artificial Sequence
  Description of Artificial Sequence: Synthetic oligonucleotide
  Target: ATXN1; (+) strand; PAM type: YTN; PAM sequence: TTA
agtacagtgctcctggagaa

SEQ ID NO: 259077 - DNA, 20 bp, Artificial Sequence
  Description of Artificial Sequence: Synthetic oligonucleotide
  Target: ATXN1; (+) strand; PAM type: YTN; PAM sequence: CTC
ctggagaagcaagttggagg

SEQ ID NO: 259078 - DNA, 20 bp, Artificial Sequence
  Description of Artificial Sequence: Synthetic oligonucleotide
  Target: ATXN1; (+) strand; PAM type: YTN; PAM sequence: CTG
gagaagcaagttggaggctg

SEQ ID NO: 259079 - DNA, 20 bp, Artificial Sequence
  Description of Artificial Sequence: Synthetic oligonucleotide
  Target: ATXN1; (+) strand; PAM type: YTN; PAM sequence: TTG
gaggctgctggtatcatgca

SEQ ID NO: 259080 - DNA, 20 bp, Artificial Sequence
  Description of Artificial Sequence: Synthetic oligonucleotide
  Target: ATXN1; (+) strand; PAM type: YTN; PAM sequence: CTG
ctggtatcatgcatacacat

SEQ ID NO: 259081 - DNA, 20 bp, Artificial Sequence
  Description of Artificial Sequence: Synthetic oligonucleotide
  Target: ATXN1; (+) strand; PAM type: YTN; PAM sequence: CTG
gtatcatgcatacacatgca

SEQ ID NO: 259082 - DNA, 20 bp, Artificial Sequence
  Description of Artificial Sequence: Synthetic oligonucleotide
  Target: ATXN1; (+) strand; PAM type: YTN; PAM sequence: CTA
tttagtggtacctgattatt

SEQ ID NO: 259083 - DNA, 20 bp, Artificial Sequence
  Description of Artificial Sequence: Synthetic oligonucleotide
  Target: ATXN1; (+) strand; PAM type: YTN; PAM sequence: TTT
agtggtacctgattattctg

SEQ ID NO: 259084 - DNA, 20 bp, Artificial Sequence
  Description of Artificial Sequence: Synthetic oligonucleotide
  Target: ATXN1; (+) strand; PAM type: YTN; PAM sequence: TTA
gtggtacctgattattctga

SEQ ID NO: 259085 - DNA, 20 bp, Artificial Sequence
  Description of Artificial Sequence: Synthetic oligonucleotide
  Target: ATXN1; (+) strand; PAM type: YTN; PAM sequence: CTG
attattctgatcacaaacaa

SEQ ID NO: 259086 - DNA, 20 bp, Artificial Sequence
  Description of Artificial Sequence: Synthetic oligonucleotide
  Target: ATXN1; (+) strand; PAM type: YTN; PAM sequence: TTA
ttctgatcacaaacaatggt

SEQ ID NO: 259087 - DNA, 20 bp, Artificial Sequence
  Description of Artificial Sequence: Synthetic oligonucleotide
  Target: ATXN1; (+) strand; PAM type: YTN; PAM sequence: TTC
tgatcacaaacaatggtgtt

SEQ ID NO: 259088 - DNA, 20 bp, Artificial Sequence
  Description of Artificial Sequence: Synthetic oligonucleotide
  Target: ATXN1; (+) strand; PAM type: YTN; PAM sequence: CTG
atcacaaacaatggtgtttt

SEQ ID NO: 259089 - DNA, 20 bp, Artificial Sequence
  Description of Artificial Sequence: Synthetic oligonucleotide
  Target: ATXN1; (+) strand; PAM type: YTN; PAM sequence: TTT
ttatgcatcatttatcttca

SEQ ID NO: 259090 - DNA, 20 bp, Artificial Sequence
  Description of Artificial Sequence: Synthetic oligonucleotide
  Target: ATXN1; (+) strand; PAM type: YTN; PAM sequence: TTT
tatgcatcatttatcttcag

SEQ ID NO: 259091 - DNA, 20 bp, Artificial Sequence
  Description of Artificial Sequence: Synthetic oligonucleotide
  Target: ATXN1; (+) strand; PAM type: YTN; PAM sequence: TTT
atgcatcatttatcttcaga

SEQ ID NO: 259092 - DNA, 20 bp, Artificial Sequence
  Description of Artificial Sequence: Synthetic oligonucleotide
  Target: ATXN1; (+) strand; PAM type: YTN; PAM sequence: TTA
tgcatcatttatcttcagag

SEQ ID NO: 259093 - DNA, 20 bp, Artificial Sequence
  Description of Artificial Sequence: Synthetic oligonucleotide
  Target: ATXN1; (+) strand; PAM type: YTN; PAM sequence: TTT
atcttcagagagtgtctatc

SEQ ID NO: 259094 - DNA, 20 bp, Artificial Sequence
  Description of Artificial Sequence: Synthetic oligonucleotide
  Target: ATXN1; (+) strand; PAM type: YTN; PAM sequence: TTA
tcttcagagagtgtctatct

SEQ ID NO: 259095 - DNA, 20 bp, Artificial Sequence
  Description of Artificial Sequence: Synthetic oligonucleotide
  Target: ATXN1; (+) strand; PAM type: YTN; PAM sequence: CTT
cagagagtgtctatctgagc

SEQ ID NO: 259096 - DNA, 20 bp, Artificial Sequence
  Description of Artificial Sequence: Synthetic oligonucleotide
  Target: ATXN1; (+) strand; PAM type: YTN; PAM sequence: TTC
agagagtgtctatctgagct

SEQ ID NO: 259097 - DNA, 20 bp, Artificial Sequence
  Description of Artificial Sequence: Synthetic oligonucleotide
  Target: ATXN1; (+) strand; PAM type: YTN; PAM sequence: CTA
tctgagctgcttgaagcaaa

SEQ ID NO: 259098 - DNA, 20 bp, Artificial Sequence
  Description of Artificial Sequence: Synthetic oligonucleotide
  Target: ATXN1; (+) strand; PAM type: YTN; PAM sequence: CTG
agctgcttgaagcaaacgaa

SEQ ID NO: 259099 - DNA, 20 bp, Artificial Sequence
  Description of Artificial Sequence: Synthetic oligonucleotide
  Target: ATXN1; (+) strand; PAM type: YTN; PAM sequence: CTG
cttgaagcaaacgaaactta

SEQ ID NO: 259100 - DNA, 20 bp, Artificial Sequence
  Description of Artificial Sequence: Synthetic oligonucleotide
  Target: ATXN1; (+) strand; PAM type: YTN; PAM sequence: CTT
gaagcaaacgaaacttatgg

SEQ ID NO: 259101 - DNA, 20 bp, Artificial Sequence
  Description of Artificial Sequence: Synthetic oligonucleotide
  Target: ATXN1; (+) strand; PAM type: YTN; PAM sequence: TTG
aagcaaacgaaacttatgga

SEQ ID NO: 259102 - DNA, 20 bp, Artificial Sequence
  Description of Artificial Sequence: Synthetic oligonucleotide
  Target: ATXN1; (+) strand; PAM type: YTN; PAM sequence: CTT
atggattggactagccttac

SEQ ID NO: 259103 - DNA, 20 bp, Artificial Sequence
  Description of Artificial Sequence: Synthetic oligonucleotide
  Target: ATXN1; (+) strand; PAM type: YTN; PAM sequence: TTA
tggattggactagccttacg

SEQ ID NO: 259104 - DNA, 20 bp, Artificial Sequence
  Description of Artificial Sequence: Synthetic oligonucleotide
  Target: ATXN1; (+) strand; PAM type: YTN; PAM sequence: TTG
gactagccttacgagaatgc

SEQ ID NO: 259105 - DNA, 20 bp, Artificial Sequence
  Description of Artificial Sequence: Synthetic oligonucleotide
  Target: ATXN1; (+) strand; PAM type: YTN; PAM sequence: CTA
gccttacgagaatgctagtt

SEQ ID NO: 259106 - DNA, 20 bp, Artificial Sequence
  Description of Artificial Sequence: Synthetic oligonucleotide
  Target: ATXN1; (+) strand; PAM type: YTN; PAM sequence: CTT
acgagaatgctagtttcaga

SEQ ID NO: 259107 - DNA, 20 bp, Artificial Sequence
  Description of Artificial Sequence: Synthetic oligonucleotide
  Target: ATXN1; (+) strand; PAM type: YTN; PAM sequence: TTA
cgagaatgctagtttcagag

SEQ ID NO: 259108 - DNA, 20 bp, Artificial Sequence
  Description of Artificial Sequence: Synthetic oligonucleotide
  Target: ATXN1; (+) strand; PAM type: YTN; PAM sequence: CTA
gtttcagagctatggctgtg

SEQ ID NO: 259109 - DNA, 20 bp, Artificial Sequence
  Description of Artificial Sequence: Synthetic oligonucleotide
  Target: ATXN1; (+) strand; PAM type: YTN; PAM sequence: TTT
cagagctatggctgtgccta

SEQ ID NO: 259110 - DNA, 20 bp, Artificial Sequence
  Description of Artificial Sequence: Synthetic oligonucleotide
  Target: ATXN1; (+) strand; PAM type: YTN; PAM sequence: TTC
agagctatggctgtgcctat

SEQ ID NO: 259111 - DNA, 20 bp, Artificial Sequence
  Description of Artificial Sequence: Synthetic oligonucleotide
  Target: ATXN1; (+) strand; PAM type: YTN; PAM sequence: CTA
tggctgtgcctatagcagtt

SEQ ID NO: 259112 - DNA, 20 bp, Artificial Sequence
  Description of Artificial Sequence: Synthetic oligonucleotide
  Target: ATXN1; (+) strand; PAM type: YTN; PAM sequence: CTG
tgcctatagcagtttgtagg

SEQ ID NO: 259113 - DNA, 20 bp, Artificial Sequence
  Description of Artificial Sequence: Synthetic oligonucleotide
  Target: ATXN1; (+) strand; PAM type: YTN; PAM sequence: CTA
tagcagtttgtaggaattta

SEQ ID NO: 259114 - DNA, 20 bp, Artificial Sequence
  Description of Artificial Sequence: Synthetic oligonucleotide
  Target: ATXN1; (+) strand; PAM type: YTN; PAM sequence: TTT
gtaggaatttattatataaa

SEQ ID NO: 259115 - DNA, 20 bp, Artificial Sequence
  Description of Artificial Sequence: Synthetic oligonucleotide
  Target: ATXN1; (+) strand; PAM type: YTN; PAM sequence: TTG
taggaatttattatataaag

SEQ ID NO: 259116 - DNA, 20 bp, Artificial Sequence
  Description of Artificial Sequence: Synthetic oligonucleotide
  Target: ATXN1; (+) strand; PAM type: YTN; PAM sequence: TTT
attatataaagtccttttaa

SEQ ID NO: 259117 - DNA, 20 bp, Artificial Sequence
  Description of Artificial Sequence: Synthetic oligonucleotide
  Target: ATXN1; (+) strand; PAM type: YTN; PAM sequence: TTA
ttatataaagtccttttaac

SEQ ID NO: 259118 - DNA, 20 bp, Artificial Sequence
  Description of Artificial Sequence: Synthetic oligonucleotide
  Target: ATXN1; (+) strand; PAM type: YTN; PAM sequence: TTA
tataaagtccttttaacccc

SEQ ID NO: 259119 - DNA, 20 bp, Artificial Sequence
  Description of Artificial Sequence: Synthetic oligonucleotide
  Target: ATXN1; (+) strand; PAM type: YTN; PAM sequence: CTT
ttaaccccttggagcacttt

SEQ ID NO: 259120 - DNA, 20 bp, Artificial Sequence
  Description of Artificial Sequence: Synthetic oligonucleotide
  Target: ATXN1; (+) strand; PAM type: YTN; PAM sequence: TTT
taaccccttggagcactttt

SEQ ID NO: 259121 - DNA, 20 bp, Artificial Sequence
  Description of Artificial Sequence: Synthetic oligonucleotide
  Target: ATXN1; (+) strand; PAM type: YTN; PAM sequence: TTT
aaccccttggagcactttta

SEQ ID NO: 259122 - DNA, 20 bp, Artificial Sequence
  Description of Artificial Sequence: Synthetic oligonucleotide
  Target: ATXN1; (+) strand; PAM type: YTN; PAM sequence: TTA
accccttggagcacttttac

SEQ ID NO: 259123 - DNA, 20 bp, Artificial Sequence
  Description of Artificial Sequence: Synthetic oligonucleotide
  Target: ATXN1; (+) strand; PAM type: YTN; PAM sequence: CTT
ggagcacttttacatccttc

SEQ ID NO: 259124 - DNA, 20 bp, Artificial Sequence
  Description of Artificial Sequence: Synthetic oligonucleotide
  Target: ATXN1; (+) strand; PAM type: YTN; PAM sequence: TTG
gagcacttttacatccttcg

SEQ ID NO: 259125 - DNA, 20 bp, Artificial Sequence
  Description of Artificial Sequence: Synthetic oligonucleotide
  Target: ATXN1; (+) strand; PAM type: YTN; PAM sequence: CTT
ttacatccttcgcatcacat

SEQ ID NO: 259126 - DNA, 20 bp, Artificial Sequence
  Description of Artificial Sequence: Synthetic oligonucleotide
  Target: ATXN1; (+) strand; PAM type: YTN; PAM sequence: TTT
tacatccttcgcatcacatg

SEQ ID NO: 259127 - DNA, 20 bp, Artificial Sequence
  Description of Artificial Sequence: Synthetic oligonucleotide
  Target: ATXN1; (+) strand; PAM type: YTN; PAM sequence: TTT
acatccttcgcatcacatga

SEQ ID NO: 259128 - DNA, 20 bp, Artificial Sequence
  Description of Artificial Sequence: Synthetic oligonucleotide
  Target: ATXN1; (+) strand; PAM type: YTN; PAM sequence: TTA
catccttcgcatcacatgat

SEQ ID NO: 259129 - DNA, 20 bp, Artificial Sequence
  Description of Artificial Sequence: Synthetic oligonucleotide
  Target: ATXN1; (+) strand; PAM type: YTN; PAM sequence: CTT
cgcatcacatgatcctccag

SEQ ID NO: 259130 - DNA, 20 bp, Artificial Sequence
  Description of Artificial Sequence: Synthetic oligonucleotide
  Target: ATXN1; (+) strand; PAM type: YTN; PAM sequence: TTC
gcatcacatgatcctccagg

SEQ ID NO: 259131 - DNA, 20 bp, Artificial Sequence
  Description of Artificial Sequence: Synthetic oligonucleotide
  Target: ATXN1; (+) strand; PAM type: YTN; PAM sequence: CTC
caggtaatcctataagactg

SEQ ID NO: 259132 - DNA, 20 bp, Artificial Sequence
  Description of Artificial Sequence: Synthetic oligonucleotide
  Target: ATXN1; (+) strand; PAM type: YTN; PAM sequence: CTA
taagactggaagaacaggtg

SEQ ID NO: 259133 - DNA, 20 bp, Artificial Sequence
  Description of Artificial Sequence: Synthetic oligonucleotide
  Target: ATXN1; (+) strand; PAM type: YTN; PAM sequence: CTG
gaagaacaggtgtgaaaaga

SEQ ID NO: 259134 - DNA, 20 bp, Artificial Sequence
  Description of Artificial Sequence: Synthetic oligonucleotide
  Target: ATXN1; (+) strand; PAM type: YTN; PAM sequence: CTT
atcaagacccagtgggccta

SEQ ID NO: 259135 - DNA, 20 bp, Artificial Sequence
  Description of Artificial Sequence: Synthetic oligonucleotide
  Target: ATXN1; (+) strand; PAM type: YTN; PAM sequence: TTA
tcaagacccagtgggcctaa

SEQ ID NO: 259136 - DNA, 20 bp, Artificial Sequence
  Description of Artificial Sequence: Synthetic oligonucleotide
  Target: ATXN1; (+) strand; PAM type: YTN; PAM sequence: CTA
agtgatctgtctaaggtaga

SEQ ID NO: 259137 - DNA, 20 bp, Artificial Sequence
  Description of Artificial Sequence: Synthetic oligonucleotide
  Target: ATXN1; (+) strand; PAM type: YTN; PAM sequence: CTG
tctaaggtagacagagggca

SEQ ID NO: 259138 - DNA, 20 bp, Artificial Sequence
  Description of Artificial Sequence: Synthetic oligonucleotide
  Target: ATXN1; (+) strand; PAM type: YTN; PAM sequence: CTA
aggtagacagagggcaggtg

SEQ ID NO: 259139 - DNA, 20 bp, Artificial Sequence
  Description of Artificial Sequence: Synthetic oligonucleotide
  Target: ATXN1; (+) strand; PAM type: YTN; PAM sequence: CTG
gatctgccttctgattttgt

SEQ ID NO: 259140 - DNA, 20 bp, Artificial Sequence
  Description of Artificial Sequence: Synthetic oligonucleotide
  Target: ATXN1; (+) strand; PAM type: YTN; PAM sequence: CTG
ccttctgattttgtttcttt

SEQ ID NO: 259141 - DNA, 20 bp, Artificial Sequence
  Description of Artificial Sequence: Synthetic oligonucleotide
  Target: ATXN1; (+) strand; PAM type: YTN; PAM sequence: CTT
ctgattttgtttcttttgtc

SEQ ID NO: 259142 - DNA, 20 bp, Artificial Sequence
  Description of Artificial Sequence: Synthetic oligonucleotide
  Target: ATXN1; (+) strand; PAM type: YTN; PAM sequence: TTC
tgattttgtttcttttgtca

SEQ ID NO: 259143 - DNA, 20 bp, Artificial Sequence
  Description of Artificial Sequence: Synthetic oligonucleotide
  Target: ATXN1; (+) strand; PAM type: YTN; PAM sequence: CTG
attttgtttcttttgtcatg

SEQ ID NO: 259144 - DNA, 20 bp, Artificial Sequence
  Description of Artificial Sequence: Synthetic oligonucleotide
  Target: ATXN1; (+) strand; PAM type: YTN; PAM sequence: TTT
tgtttcttttgtcatggttg

SEQ ID NO: 259145 - DNA, 20 bp, Artificial Sequence
  Description of Artificial Sequence: Synthetic oligonucleotide
  Target: ATXN1; (+) strand; PAM type: YTN; PAM sequence: TTT
gtttcttttgtcatggttgc

SEQ ID NO: 259146 - DNA, 20 bp, Artificial Sequence
  Description of Artificial Sequence: Synthetic oligonucleotide
  Target: ATXN1; (+) strand; PAM type: YTN; PAM sequence: TTG
tttcttttgtcatggttgct

SEQ ID NO: 259147 - DNA, 20 bp, Artificial Sequence
  Description of Artificial Sequence: Synthetic oligonucleotide
  Target: ATXN1; (+) strand; PAM type: YTN; PAM sequence: TTT
cttttgtcatggttgctaca

SEQ ID NO: 259148 - DNA, 20 bp, Artificial Sequence
  Description of Artificial Sequence: Synthetic oligonucleotide
  Target: ATXN1; (+) strand; PAM type: YTN; PAM sequence: TTC
ttttgtcatggttgctacaa

SEQ ID NO: 259149 - DNA, 20 bp, Artificial Sequence
  Description of Artificial Sequence: Synthetic oligonucleotide
  Target: ATXN1; (+) strand; PAM type: YTN; PAM sequence: CTT
ttgtcatggttgctacaaca

SEQ ID NO: 259150 - DNA, 20 bp, Artificial Sequence
  Description of Artificial Sequence: Synthetic oligonucleotide
  Target: ATXN1; (+) strand; PAM type: YTN; PAM sequence: TTT
tgtcatggttgctacaacat

SEQ ID NO: 259151 - DNA, 20 bp, Artificial Sequence
  Description of Artificial Sequence: Synthetic oligonucleotide
  Target: ATXN1; (+) strand; PAM type: YTN; PAM sequence: TTT
gtcatggttgctacaacatc

SEQ ID NO: 259152 - DNA, 20 bp, Artificial Sequence
  Description of Artificial Sequence: Synthetic oligonucleotide
  Target: ATXN1; (+) strand; PAM type: YTN; PAM sequence: TTG
tcatggttgctacaacatca

SEQ ID NO: 259153 - DNA, 20 bp, Artificial Sequence
  Description of Artificial Sequence: Synthetic oligonucleotide
  Target: ATXN1; (+) strand; PAM type: YTN; PAM sequence: TTG
ctacaacatcattgctccta

SEQ ID NO: 259154 - DNA, 20 bp, Artificial Sequence
  Description of Artificial Sequence: Synthetic oligonucleotide
  Target: ATXN1; (+) strand; PAM type: YTN; PAM sequence: CTA
caacatcattgctcctacag

SEQ ID NO: 259155 - DNA, 20 bp, Artificial Sequence
  Description of Artificial Sequence: Synthetic oligonucleotide
  Target: ATXN1; (+) strand; PAM type: YTN; PAM sequence: TTG
ctcctacaggcagaatcaag

SEQ ID NO: 259156 - DNA, 20 bp, Artificial Sequence
  Description of Artificial Sequence: Synthetic oligonucleotide
  Target: ATXN1; (+) strand; PAM type: YTN; PAM sequence: CTC
ctacaggcagaatcaagagc

SEQ ID NO: 259157 - DNA, 20 bp, Artificial Sequence
  Description of Artificial Sequence: Synthetic oligonucleotide
  Target: ATXN1; (+) strand; PAM type: YTN; PAM sequence: CTA
caggcagaatcaagagctac

SEQ ID NO: 259158 - DNA, 20 bp, Artificial Sequence
  Description of Artificial Sequence: Synthetic oligonucleotide
  Target: ATXN1; (+) strand; PAM type: YTN; PAM sequence: CTA
cgggttcaagggacgagagg

SEQ ID NO: 259159 - DNA, 20 bp, Artificial Sequence
  Description of Artificial Sequence: Synthetic oligonucleotide
  Target: ATXN1; (+) strand; PAM type: YTN; PAM sequence: TTC
aagggacgagagggaagaag

SEQ ID NO: 259160 - DNA, 20 bp, Artificial Sequence
  Description of Artificial Sequence: Synthetic oligonucleotide
  Target: ATXN1; (+) strand; PAM type: YTN; PAM sequence: CTG
cgtgcacaaacattcggtga

SEQ ID NO: 259161 - DNA, 20 bp, Artificial Sequence
  Description of Artificial Sequence: Synthetic oligonucleotide
  Target: ATXN1; (+) strand; PAM type: YTN; PAM sequence: TTC
ggtgatttggagccatttac

SEQ ID NO: 259162 - DNA, 20 bp, Artificial Sequence
  Description of Artificial Sequence: Synthetic oligonucleotide
  Target: ATXN1; (+) strand; PAM type: YTN; PAM sequence: TTT
ggagccatttacgcagctca

SEQ ID NO: 259163 - DNA, 20 bp, Artificial Sequence
  Description of Artificial Sequence: Synthetic oligonucleotide
  Target: ATXN1; (+) strand; PAM type: YTN; PAM sequence: TTG
gagccatttacgcagctcat

SEQ ID NO: 259164 - DNA, 20 bp, Artificial Sequence
  Description of Artificial Sequence: Synthetic oligonucleotide
  Target: ATXN1; (+) strand; PAM type: YTN; PAM sequence: TTT
acgcagctcatctggaaaat

SEQ ID NO: 259165 - DNA, 20 bp, Artificial Sequence
  Description of Artificial Sequence: Synthetic oligonucleotide
  Target: ATXN1; (+) strand; PAM type: YTN; PAM sequence: TTA
cgcagctcatctggaaaatc

SEQ ID NO: 259166 - DNA, 20 bp, Artificial Sequence
  Description of Artificial Sequence: Synthetic oligonucleotide
  Target: ATXN1; (+) strand; PAM type: YTN; PAM sequence: CTC
atctggaaaatcacagcaga

SEQ ID NO: 259167 - DNA, 20 bp, Artificial Sequence
  Description of Artificial Sequence: Synthetic oligonucleotide
  Target: ATXN1; (+) strand; PAM type: YTN; PAM sequence: CTG
gaaaatcacagcagaggaga

SEQ ID NO: 259168 - DNA, 20 bp, Artificial Sequence
  Description of Artificial Sequence: Synthetic oligonucleotide
  Target: ATXN1; (+) strand; PAM type: YTN; PAM sequence: TTT
cctatggggaagtctgttgg

SEQ ID NO: 259169 - DNA, 20 bp, Artificial Sequence
  Description of Artificial Sequence: Synthetic oligonucleotide
  Target: ATXN1; (+) strand; PAM type: YTN; PAM sequence: TTC
ctatggggaagtctgttggg

SEQ ID NO: 259170 - DNA, 20 bp, Artificial Sequence
  Description of Artificial Sequence: Synthetic oligonucleotide
  Target: ATXN1; (+) strand; PAM type: YTN; PAM sequence: CTA
tggggaagtctgttgggagc

SEQ ID NO: 259171 - DNA, 20 bp, Artificial Sequence
  Description of Artificial Sequence: Synthetic oligonucleotide
  Target: ATXN1; (+) strand; PAM type: YTN; PAM sequence: CTG
ttgggagcctgattttaccc

SEQ ID NO: 259172 - DNA, 20 bp, Artificial Sequence
  Description of Artificial Sequence: Synthetic oligonucleotide
  Target: ATXN1; (+) strand; PAM type: YTN; PAM sequence: TTG
ggagcctgattttacccctc

SEQ ID NO: 259173 - DNA, 20 bp, Artificial Sequence
  Description of Artificial Sequence: Synthetic oligonucleotide
  Target: ATXN1; (+) strand; PAM type: YTN; PAM sequence: CTG
attttacccctctctctttg

SEQ ID NO: 259174 - DNA, 20 bp, Artificial Sequence
  Description of Artificial Sequence: Synthetic oligonucleotide
  Target: ATXN1; (+) strand; PAM type: YTN; PAM sequence: TTT
tacccctctctctttgctcc

SEQ ID NO: 259175 - DNA, 20 bp, Artificial Sequence
  Description of Artificial Sequence: Synthetic oligonucleotide
  Target: ATXN1; (+) strand; PAM type: YTN; PAM sequence: TTT
acccctctctctttgctcca

SEQ ID NO: 259176 - DNA, 20 bp, Artificial Sequence
  Description of Artificial Sequence: Synthetic oligonucleotide
  Target: ATXN1; (+) strand; PAM type: YTN; PAM sequence: TTA
cccctctctctttgctccag

SEQ ID NO: 259177 - DNA, 20 bp, Artificial Sequence
  Description of Artificial Sequence: Synthetic oligonucleotide
  Target: ATXN1; (+) strand; PAM type: YTN; PAM sequence: CTC
tctctttgctccaggctgca

SEQ ID NO: 259178 - DNA, 20 bp, Artificial Sequence
  Description of Artificial Sequence: Synthetic oligonucleotide
  Target: ATXN1; (+) strand; PAM type: YTN; PAM sequence: CTC
tctttgctccaggctgcact

SEQ ID NO: 259179 - DNA, 20 bp, Artificial Sequence
  Description of Artificial Sequence: Synthetic oligonucleotide
  Target: ATXN1; (+) strand; PAM type: YTN; PAM sequence: CTC
tttgctccaggctgcactgg

SEQ ID NO: 259180 - DNA, 20 bp, Artificial Sequence
  Description of Artificial Sequence: Synthetic oligonucleotide
  Target: ATXN1; (+) strand; PAM type: YTN; PAM sequence: CTT
tgctccaggctgcactggca

SEQ ID NO: 259181 - DNA, 20 bp, Artificial Sequence
  Description of Artificial Sequence: Synthetic oligonucleotide
  Target: ATXN1; (+) strand; PAM type: YTN; PAM sequence: TTT
gctccaggctgcactggcaa

SEQ ID NO: 259182 - DNA, 20 bp, Artificial Sequence
  Description of Artificial Sequence: Synthetic oligonucleotide
  Target: ATXN1; (+) strand; PAM type: YTN; PAM sequence: TTG
ctccaggctgcactggcaaa

SEQ ID NO: 259183 - DNA, 20 bp, Artificial Sequence
  Description of Artificial Sequence: Synthetic oligonucleotide
  Target: ATXN1; (+) strand; PAM type: YTN; PAM sequence: CTC
caggctgcactggcaaacct

SEQ ID NO: 259184 - DNA, 20 bp, Artificial Sequence
  Description of Artificial Sequence: Synthetic oligonucleotide
  Target: ATXN1; (+) strand; PAM type: YTN; PAM sequence: CTG
cactggcaaaccttcggcta

SEQ ID NO: 259185 - DNA, 20 bp, Artificial Sequence
  Description of Artificial Sequence: Synthetic oligonucleotide
  Target: ATXN1; (+) strand; PAM type: YTN; PAM sequence: CTG
gcaaaccttcggctatttaa

SEQ ID NO: 259186 - DNA, 20 bp, Artificial Sequence
  Description of Artificial Sequence: Synthetic oligonucleotide
  Target: ATXN1; (+) strand; PAM type: YTN; PAM sequence: CTT
cggctatttaataatagtat

SEQ ID NO: 259187 - DNA, 20 bp, Artificial Sequence
  Description of Artificial Sequence: Synthetic oligonucleotide
  Target: ATXN1; (+) strand; PAM type: YTN; PAM sequence: TTC
ggctatttaataatagtatc

SEQ ID NO: 259188 - DNA, 20 bp, Artificial Sequence
  Description of Artificial Sequence: Synthetic oligonucleotide
  Target: ATXN1; (+) strand; PAM type: YTN; PAM sequence: CTA
tttaataatagtatctagtt

SEQ ID NO: 259189 - DNA, 20 bp, Artificial Sequence
  Description of Artificial Sequence: Synthetic oligonucleotide
  Target: ATXN1; (+) strand; PAM type: YTN; PAM sequence: TTT
aataatagtatctagttgat

SEQ ID NO: 259190 - DNA, 20 bp, Artificial Sequence
  Description of Artificial Sequence: Synthetic oligonucleotide
  Target: ATXN1; (+) strand; PAM type: YTN; PAM sequence: TTA
ataatagtatctagttgatt

SEQ ID NO: 259191 - DNA, 20 bp, Artificial Sequence
  Description of Artificial Sequence: Synthetic oligonucleotide
  Target: ATXN1; (+) strand; PAM type: YTN; PAM sequence: CTA
gttgatttacatccagggtt

SEQ ID NO: 259192 - DNA, 20 bp, Artificial Sequence
  Description of Artificial Sequence: Synthetic oligonucleotide
  Target: ATXN1; (+) strand; PAM type: YTN; PAM sequence: TTG
atttacatccagggttgccc

SEQ ID NO: 259193 - DNA, 20 bp, Artificial Sequence
  Description of Artificial Sequence: Synthetic oligonucleotide
  Target: ATXN1; (+) strand; PAM type: YTN; PAM sequence: TTT
acatccagggttgcccaggg

SEQ ID NO: 259194 - DNA, 20 bp, Artificial Sequence
  Description of Artificial Sequence: Synthetic oligonucleotide
  Target: ATXN1; (+) strand; PAM type: YTN; PAM sequence: TTA
catccagggttgcccagggt

SEQ ID NO: 259195 - DNA, 20 bp, Artificial Sequence
  Description of Artificial Sequence: Synthetic oligonucleotide
  Target: ATXN1; (+) strand; PAM type: YTN; PAM sequence: TTG
cccagggttctagtgtgtgc

SEQ ID NO: 259196 - DNA, 20 bp, Artificial Sequence
  Description of Artificial Sequence: Synthetic oligonucleotide
  Target: ATXN1; (+) strand; PAM type: YTN; PAM sequence: TTC
tagtgtgtgcactgccaggc

SEQ ID NO: 259197 - DNA, 20 bp, Artificial Sequence
  Description of Artificial Sequence: Synthetic oligonucleotide
  Target: ATXN1; (+) strand; PAM type: YTN; PAM sequence: CTA
gtgtgtgcactgccaggcac

SEQ ID NO: 259198 - DNA, 20 bp, Artificial Sequence
  Description of Artificial Sequence: Synthetic oligonucleotide
  Target: ATXN1; (+) strand; PAM type: YTN; PAM sequence: CTG
ccaggcacaaacaagtacag

SEQ ID NO: 259199 - DNA, 20 bp, Artificial Sequence
  Description of Artificial Sequence: Synthetic oligonucleotide
  Target: ATXN1; (+) strand; PAM type: YTN; PAM sequence: CTC
atgccccacaacaaagtggc

SEQ ID NO: 259200 - DNA, 20 bp, Artificial Sequence
  Description of Artificial Sequence: Synthetic oligonucleotide
  Target: ATXN1; (+) strand; PAM type: YTN; PAM sequence: TTT
tatggggaatcaactggaat

SEQ ID NO: 259201 - DNA, 20 bp, Artificial Sequence
  Description of Artificial Sequence: Synthetic oligonucleotide
  Target: ATXN1; (+) strand; PAM type: YTN; PAM sequence: TTT
atggggaatcaactggaatt

SEQ ID NO: 259202 - DNA, 20 bp, Artificial Sequence
  Description of Artificial Sequence: Synthetic oligonucleotide
  Target: ATXN1; (+) strand; PAM type: YTN; PAM sequence: TTA
tggggaatcaactggaattc

SEQ ID NO: 259203 - DNA, 20 bp, Artificial Sequence
  Description of Artificial Sequence: Synthetic oligonucleotide
  Target: ATXN1; (+) strand; PAM type: YTN; PAM sequence: CTG
gaattctccattgctgtctc

SEQ ID NO: 259204 - DNA, 20 bp, Artificial Sequence
  Description of Artificial Sequence: Synthetic oligonucleotide
  Target: ATXN1; (+) strand; PAM type: YTN; PAM sequence: TTC
tccattgctgtctctgtctg

SEQ ID NO: 259205 - DNA, 20 bp, Artificial Sequence
  Description of Artificial Sequence: Synthetic oligonucleotide
  Target: ATXN1; (+) strand; PAM type: YTN; PAM sequence: CTC
cattgctgtctctgtctgcc

SEQ ID NO: 259206 - DNA, 20 bp, Artificial Sequence
  Description of Artificial Sequence: Synthetic oligonucleotide
  Target: ATXN1; (+) strand; PAM type: YTN; PAM sequence: TTG
ctgtctctgtctgccctgct

SEQ ID NO: 259207 - DNA, 20 bp, Artificial Sequence
  Description of Artificial Sequence: Synthetic oligonucleotide
  Target: ATXN1; (+) strand; PAM type: YTN; PAM sequence: CTG
tctctgtctgccctgctact

SEQ ID NO: 259208 - DNA, 20 bp, Artificial Sequence
  Description of Artificial Sequence: Synthetic oligonucleotide
  Target: ATXN1; (+) strand; PAM type: YTN; PAM sequence: CTC
tgtctgccctgctactcaga

SEQ ID NO: 259209 - DNA, 20 bp, Artificial Sequence
  Description of Artificial Sequence: Synthetic oligonucleotide
  Target: ATXN1; (+) strand; PAM type: YTN; PAM sequence: CTG
tctgccctgctactcagaag

SEQ ID NO: 259210 - DNA, 20 bp, Artificial Sequence
  Description of Artificial Sequence: Synthetic oligonucleotide
  Target: ATXN1; (+) strand; PAM type: YTN; PAM sequence: CTG
ccctgctactcagaagacgg

SEQ ID NO: 259211 - DNA, 20 bp, Artificial Sequence
  Description of Artificial Sequence: Synthetic oligonucleotide
  Target: ATXN1; (+) strand; PAM type: YTN; PAM sequence: CTG
ctactcagaagacggtggaa

SEQ ID NO: 259212 - DNA, 20 bp, Artificial Sequence
  Description of Artificial Sequence: Synthetic oligonucleotide
  Target: ATXN1; (+) strand; PAM type: YTN; PAM sequence: CTA
ctcagaagacggtggaagga

SEQ ID NO: 259213 - DNA, 20 bp, Artificial Sequence
  Description of Artificial Sequence: Synthetic oligonucleotide
  Target: ATXN1; (+) strand; PAM type: YTN; PAM sequence: CTC
agaagacggtggaaggaatg

SEQ ID NO: 259214 - DNA, 20 bp, Artificial Sequence
  Description of Artificial Sequence: Synthetic oligonucleotide
  Target: ATXN1; (+) strand; PAM type: YTN; PAM sequence: CTG
aagtaagcttctgtaagagc

SEQ ID NO: 259215 - DNA, 20 bp, Artificial Sequence
  Description of Artificial Sequence: Synthetic oligonucleotide
  Target: ATXN1; (+) strand; PAM type: YTN; PAM sequence: CTT
ctgtaagagctcactggcct

SEQ ID NO: 259216 - DNA, 20 bp, Artificial Sequence
  Description of Artificial Sequence: Synthetic oligonucleotide
  Target: ATXN1; (+) strand; PAM type: YTN; PAM sequence: TTC
tgtaagagctcactggcctg

SEQ ID NO: 259217 - DNA, 20 bp, Artificial Sequence
  Description of Artificial Sequence: Synthetic oligonucleotide
  Target: ATXN1; (+) strand; PAM type: YTN; PAM sequence: CTG
taagagctcactggcctggc

SEQ ID NO: 259218 - DNA, 20 bp, Artificial Sequence
  Description of Artificial Sequence: Synthetic oligonucleotide
  Target: ATXN1; (+) strand; PAM type: YTN; PAM sequence: CTC
actggcctggctttgaaaga

SEQ ID NO: 259219 - DNA, 20 bp, Artificial Sequence
  Description of Artificial Sequence: Synthetic oligonucleotide
  Target: ATXN1; (+) strand; PAM type: YTN; PAM sequence: CTG
gcctggctttgaaagagagg

SEQ ID NO: 259220 - DNA, 20 bp, Artificial Sequence
  Description of Artificial Sequence: Synthetic oligonucleotide
  Target: ATXN1; (+) strand; PAM type: YTN; PAM sequence: CTG
gctttgaaagagaggatcag

SEQ ID NO: 259221 - DNA, 20 bp, Artificial Sequence
  Description of Artificial Sequence: Synthetic oligonucleotide
  Target: ATXN1; (+) strand; PAM type: YTN; PAM sequence: CTT
tgaaagagaggatcagctgg

SEQ ID NO: 259222 - DNA, 20 bp, Artificial Sequence
  Description of Artificial Sequence: Synthetic oligonucleotide
  Target: ATXN1; (+) strand; PAM type: YTN; PAM sequence: TTT
gaaagagaggatcagctggg

SEQ ID NO: 259223 - DNA, 20 bp, Artificial Sequence
  Description of Artificial Sequence: Synthetic oligonucleotide
  Target: ATXN1; (+) strand; PAM type: YTN; PAM sequence: TTG
aaagagaggatcagctggga

SEQ ID NO: 259224 - DNA, 20 bp, Artificial Sequence
  Description of Artificial Sequence: Synthetic oligonucleotide
  Target: ATXN1; (+) strand; PAM type: YTN; PAM sequence: CTG
ggatctctgaatagatgagg

SEQ ID NO: 259225 - DNA, 20 bp, Artificial Sequence
  Description of Artificial Sequence: Synthetic oligonucleotide
  Target: ATXN1; (+) strand; PAM type: YTN; PAM sequence: CTC
tgaatagatgaggagtcagg

SEQ ID NO: 259226 - DNA, 20 bp, Artificial Sequence
  Description of Artificial Sequence: Synthetic oligonucleotide
  Target: ATXN1; (+) strand; PAM type: YTN; PAM sequence: CTG
aatagatgaggagtcagggt

SEQ ID NO: 259227 - DNA, 20 bp, Artificial Sequence
  Description of Artificial Sequence: Synthetic oligonucleotide
  Target: ATXN1; (+) strand; PAM type: YTN; PAM sequence: TTT
caggtgcaaaggaaatgtgg

SEQ ID NO: 259228 - DNA, 20 bp, Artificial Sequence
  Description of Artificial Sequence: Synthetic oligonucleotide
  Target: ATXN1; (+) strand; PAM type: YTN; PAM sequence: TTC
aggtgcaaaggaaatgtggg

SEQ ID NO: 259229 - DNA, 20 bp, Artificial Sequence
  Description of Artificial Sequence: Synthetic oligonucleotide
  Target: ATXN1; (+) strand; PAM type: YTN; PAM sequence: CTC
catgactctctgaagggagt

SEQ ID NO: 259230 - DNA, 20 bp, Artificial Sequence
  Description of Artificial Sequence: Synthetic oligonucleotide
  Target: ATXN1; (+) strand; PAM type: YTN; PAM sequence: CTC
tctgaagggagtccaagggc

SEQ ID NO: 259231 - DNA, 20 bp, Artificial Sequence
  Description of Artificial Sequence: Synthetic oligonucleotide
  Target: ATXN1; (+) strand; PAM type: YTN; PAM sequence: CTC
tgaagggagtccaagggctg

SEQ ID NO: 259232 - DNA, 20 bp, Artificial Sequence
  Description of Artificial Sequence: Synthetic oligonucleotide
  Target: ATXN1; (+) strand; PAM type: YTN; PAM sequence: CTG
aagggagtccaagggctgga

SEQ ID NO: 259233 - DNA, 20 bp, Artificial Sequence
  Description of Artificial Sequence: Synthetic oligonucleotide
  Target: ATXN1; (+) strand; PAM type: YTN; PAM sequence: CTG
gaccattcagaaccttcagg

SEQ ID NO: 259234 - DNA, 20 bp, Artificial Sequence
  Description of Artificial Sequence: Synthetic oligonucleotide
  Target: ATXN1; (+) strand; PAM type: YTN; PAM sequence: TTC
agaaccttcaggaagactca

SEQ ID NO: 259235 - DNA, 20 bp, Artificial Sequence
  Description of Artificial Sequence: Synthetic oligonucleotide
  Target: ATXN1; (+) strand; PAM type: YTN; PAM sequence: CTT
caggaagactcagaacagct

SEQ ID NO: 259236 - DNA, 20 bp, Artificial Sequence
  Description of Artificial Sequence: Synthetic oligonucleotide
  Target: ATXN1; (+) strand; PAM type: YTN; PAM sequence: TTC
aggaagactcagaacagctc

SEQ ID NO: 259237 - DNA, 20 bp, Artificial Sequence
  Description of Artificial Sequence: Synthetic oligonucleotide
  Target: ATXN1; (+) strand; PAM type: YTN; PAM sequence: CTC
agaacagctccagcctgcct

SEQ ID NO: 259238 - DNA, 20 bp, Artificial Sequence
  Description of Artificial Sequence: Synthetic oligonucleotide
  Target: ATXN1; (+) strand; PAM type: YTN; PAM sequence: CTC
cagcctgcctgagctggaag

SEQ ID NO: 259239 - DNA, 20 bp, Artificial Sequence
  Description of Artificial Sequence: Synthetic oligonucleotide
  Target: ATXN1; (+) strand; PAM type: YTN; PAM sequence: CTG
cctgagctggaagcagtgtc

SEQ ID NO: 259240 - DNA, 20 bp, Artificial Sequence
  Description of Artificial Sequence: Synthetic oligonucleotide
  Target: ATXN1; (+) strand; PAM type: YTN; PAM sequence: CTG
agctggaagcagtgtcactg

SEQ ID NO: 259241 - DNA, 20 bp, Artificial Sequence
  Description of Artificial Sequence: Synthetic oligonucleotide
  Target: ATXN1; (+) strand; PAM type: YTN; PAM sequence: CTG
gaagcagtgtcactgttggt

SEQ ID NO: 259242 - DNA, 20 bp, Artificial Sequence
  Description of Artificial Sequence: Synthetic oligonucleotide
  Target: ATXN1; (+) strand; PAM type: YTN; PAM sequence: CTG
ttggtgttgcgtctcctctg

SEQ ID NO: 259243 - DNA, 20 bp, Artificial Sequence
  Description of Artificial Sequence: Synthetic oligonucleotide
  Target: ATXN1; (+) strand; PAM type: YTN; PAM sequence: TTG
gtgttgcgtctcctctgagg

SEQ ID NO: 259244 - DNA, 20 bp, Artificial Sequence
  Description of Artificial Sequence: Synthetic oligonucleotide
  Target: ATXN1; (+) strand; PAM type: YTN; PAM sequence: TTG
cgtctcctctgaggaccttc

SEQ ID NO: 259245 - DNA, 20 bp, Artificial Sequence
  Description of Artificial Sequence: Synthetic oligonucleotide
  Target: ATXN1; (+) strand; PAM type: YTN; PAM sequence: CTC
ctctgaggaccttccagaac

SEQ ID NO: 259246 - DNA, 20 bp, Artificial Sequence
  Description of Artificial Sequence: Synthetic oligonucleotide
  Target: ATXN1; (+) strand; PAM type: YTN; PAM sequence: CTC
tgaggaccttccagaaccat

SEQ ID NO: 259247 - DNA, 20 bp, Artificial Sequence
  Description of Artificial Sequence: Synthetic oligonucleotide
  Target: ATXN1; (+) strand; PAM type: YTN; PAM sequence: CTG
aggaccttccagaaccatct

SEQ ID NO: 259248 - DNA, 20 bp, Artificial Sequence
  Description of Artificial Sequence: Synthetic oligonucleotide
  Target: ATXN1; (+) strand; PAM type: YTN; PAM sequence: CTT
ccagaaccatctaatggcat

SEQ ID NO: 259249 - DNA, 20 bp, Artificial Sequence
  Description of Artificial Sequence: Synthetic oligonucleotide
  Target: ATXN1; (+) strand; PAM type: YTN; PAM sequence: TTC
cagaaccatctaatggcatg

SEQ ID NO: 259250 - DNA, 20 bp, Artificial Sequence
  Description of Artificial Sequence: Synthetic oligonucleotide
  Target: ATXN1; (+) strand; PAM type: YTN; PAM sequence: CTA
atggcatgggtcagaactac

SEQ ID NO: 259251 - DNA, 20 bp, Artificial Sequence
  Description of Artificial Sequence: Synthetic oligonucleotide
  Target: ATXN1; (+) strand; PAM type: YTN; PAM sequence: CTA
ctgactgctgcattttgcac

SEQ ID NO: 259252 - DNA, 20 bp, Artificial Sequence
  Description of Artificial Sequence: Synthetic oligonucleotide
  Target: ATXN1; (+) strand; PAM type: YTN; PAM sequence: CTG
actgctgcattttgcactca

SEQ ID NO: 259253 - DNA, 20 bp, Artificial Sequence
  Description of Artificial Sequence: Synthetic oligonucleotide
  Target: ATXN1; (+) strand; PAM type: YTN; PAM sequence: CTG
ctgcattttgcactcagggc

SEQ ID NO: 259254 - DNA, 20 bp, Artificial Sequence
  Description of Artificial Sequence: Synthetic oligonucleotide
  Target: ATXN1; (+) strand; PAM type: YTN; PAM sequence: CTG
cattttgcactcagggcctt

SEQ ID NO: 259255 - DNA, 20 bp, Artificial Sequence
  Description of Artificial Sequence: Synthetic oligonucleotide
  Target: ATXN1; (+) strand; PAM type: YTN; PAM sequence: TTT
tgcactcagggccttccatg

SEQ ID NO: 259256 - DNA, 20 bp, Artificial Sequence
  Description of Artificial Sequence: Synthetic oligonucleotide
  Target: ATXN1; (+) strand; PAM type: YTN; PAM sequence: TTT
gcactcagggccttccatga

SEQ ID NO: 259257 - DNA, 20 bp, Artificial Sequence
  Description of Artificial Sequence: Synthetic oligonucleotide
  Target: ATXN1; (+) strand; PAM type: YTN; PAM sequence: TTG
cactcagggccttccatgaa

SEQ ID NO: 259258 - DNA, 20 bp, Artificial Sequence
  Description of Artificial Sequence: Synthetic oligonucleotide
  Target: ATXN1; (+) strand; PAM type: YTN; PAM sequence: CTC
agggccttccatgaatggca

SEQ ID NO: 259259 - DNA, 20 bp, Artificial Sequence
  Description of Artificial Sequence: Synthetic oligonucleotide
  Target: ATXN1; (+) strand; PAM type: YTN; PAM sequence: CTT
ccatgaatggcagtttctgg

SEQ ID NO: 259260 - DNA, 20 bp, Artificial Sequence
  Description of Artificial Sequence: Synthetic oligonucleotide
  Target: ATXN1; (+) strand; PAM type: YTN; PAM sequence: TTC
catgaatggcagtttctggt

SEQ ID NO: 259261 - DNA, 20 bp, Artificial Sequence
  Description of Artificial Sequence: Synthetic oligonucleotide
  Target: ATXN1; (+) strand; PAM type: YTN; PAM sequence: TTT
ctggtacctttgcagactat

SEQ ID NO: 259262 - DNA, 20 bp, Artificial Sequence
  Description of Artificial Sequence: Synthetic oligonucleotide
  Target: ATXN1; (+) strand; PAM type: YTN; PAM sequence: TTC
tggtacctttgcagactatt

SEQ ID NO: 259263 - DNA, 20 bp, Artificial Sequence
  Description of Artificial Sequence: Synthetic oligonucleotide
  Target: ATXN1; (+) strand; PAM type: YTN; PAM sequence: CTG
gtacctttgcagactattcc

SEQ ID NO: 259264 - DNA, 20 bp, Artificial Sequence
  Description of Artificial Sequence: Synthetic oligonucleotide
  Target: ATXN1; (+) strand; PAM type: YTN; PAM sequence: CTT
tgcagactattccctaacat

SEQ ID NO: 259265 - DNA, 20 bp, Artificial Sequence
  Description of Artificial Sequence: Synthetic oligonucleotide
  Target: ATXN1; (+) strand; PAM type: YTN; PAM sequence: TTT
gcagactattccctaacatg

SEQ ID NO: 259266 - DNA, 20 bp, Artificial Sequence
  Description of Artificial Sequence: Synthetic oligonucleotide
  Target: ATXN1; (+) strand; PAM type: YTN; PAM sequence: TTG
cagactattccctaacatgc

SEQ ID NO: 259267 - DNA, 20 bp, Artificial Sequence
  Description of Artificial Sequence: Synthetic oligonucleotide
  Target: ATXN1; (+) strand; PAM type: YTN; PAM sequence: CTA
ttccctaacatgccctttac

SEQ ID NO: 259268 - DNA, 20 bp, Artificial Sequence
  Description of Artificial Sequence: Synthetic oligonucleotide
  Target: ATXN1; (+) strand; PAM type: YTN; PAM sequence: TTC
cctaacatgccctttacaca

SEQ ID NO: 259269 - DNA, 20 bp, Artificial Sequence
  Description of Artificial Sequence: Synthetic oligonucleotide
  Target: ATXN1; (+) strand; PAM type: YTN; PAM sequence: CTA
acatgccctttacacataaa

SEQ ID NO: 259270 - DNA, 20 bp, Artificial Sequence
  Description of Artificial Sequence: Synthetic oligonucleotide
  Target: ATXN1; (+) strand; PAM type: YTN; PAM sequence: CTT
tacacataaattcagccaac

SEQ ID NO: 259271 - DNA, 20 bp, Artificial Sequence
  Description of Artificial Sequence: Synthetic oligonucleotide
  Target: ATXN1; (+) strand; PAM type: YTN; PAM sequence: TTT
acacataaattcagccaact

SEQ ID NO: 259272 - DNA, 20 bp, Artificial Sequence
  Description of Artificial Sequence: Synthetic oligonucleotide
  Target: ATXN1; (+) strand; PAM type: YTN; PAM sequence: TTA
cacataaattcagccaactg

SEQ ID NO: 259273 - DNA, 20 bp, Artificial Sequence
  Description of Artificial Sequence: Synthetic oligonucleotide
  Target: ATXN1; (+) strand; PAM type: YTN; PAM sequence: TTC
agccaactgaaatcagagca

SEQ ID NO: 259274 - DNA, 20 bp, Artificial Sequence
  Description of Artificial Sequence: Synthetic oligonucleotide
  Target: ATXN1; (+) strand; PAM type: YTN; PAM sequence: CTG
aaatcagagcaatatttgag

SEQ ID NO: 259275 - DNA, 20 bp, Artificial Sequence
  Description of Artificial Sequence: Synthetic oligonucleotide
  Target: ATXN1; (+) strand; PAM type: YTN; PAM sequence: TTT
gagctatggccttttttccc

SEQ ID NO: 259276 - DNA, 20 bp, Artificial Sequence
  Description of Artificial Sequence: Synthetic oligonucleotide
  Target: ATXN1; (+) strand; PAM type: YTN; PAM sequence: TTG
agctatggccttttttccct

SEQ ID NO: 259277 - DNA, 20 bp, Artificial Sequence
  Description of Artificial Sequence: Synthetic oligonucleotide
  Target: ATXN1; (+) strand; PAM type: YTN; PAM sequence: CTA
tggccttttttccctctaaa

SEQ ID NO: 259278 - DNA, 20 bp, Artificial Sequence
  Description of Artificial Sequence: Synthetic oligonucleotide
  Target: ATXN1; (+) strand; PAM type: YTN; PAM sequence: CTT
ttttccctctaaaatgctac

SEQ ID NO: 259279 - DNA, 20 bp, Artificial Sequence
  Description of Artificial Sequence: Synthetic oligonucleotide
  Target: ATXN1; (+) strand; PAM type: YTN; PAM sequence: TTT
tttccctctaaaatgctacc

SEQ ID NO: 259280 - DNA, 20 bp, Artificial Sequence
  Description of Artificial Sequence: Synthetic oligonucleotide
  Target: ATXN1; (+) strand; PAM type: YTN; PAM sequence: TTT
ttccctctaaaatgctacca

SEQ ID NO: 259281 - DNA, 20 bp, Artificial Sequence
  Description of Artificial Sequence: Synthetic oligonucleotide
  Target: ATXN1; (+) strand; PAM type: YTN; PAM sequence: TTT
tccctctaaaatgctaccaa

SEQ ID NO: 259282 - DNA, 20 bp, Artificial Sequence
  Description of Artificial Sequence: Synthetic oligonucleotide
  Target: ATXN1; (+) strand; PAM type: YTN; PAM sequence: TTT
ccctctaaaatgctaccaaa

SEQ ID NO: 259283 - DNA, 20 bp, Artificial Sequence
  Description of Artificial Sequence: Synthetic oligonucleotide
  Target: ATXN1; (+) strand; PAM type: YTN; PAM sequence: TTC
cctctaaaatgctaccaaac

SEQ ID NO: 259284 - DNA, 20 bp, Artificial Sequence
  Description of Artificial Sequence: Synthetic oligonucleotide
  Target: ATXN1; (+) strand; PAM type: YTN; PAM sequence: CTC
taaaatgctaccaaacacta

SEQ ID NO: 259285 - DNA, 20 bp, Artificial Sequence
  Description of Artificial Sequence: Synthetic oligonucleotide
  Target: ATXN1; (+) strand; PAM type: YTN; PAM sequence: CTA
aaatgctaccaaacactaga

SEQ ID NO: 259286 - DNA, 20 bp, Artificial Sequence
  Description of Artificial Sequence: Synthetic oligonucleotide
  Target: ATXN1; (+) strand; PAM type: YTN; PAM sequence: CTA
ccaaacactagatctcttag

SEQ ID NO: 259287 - DNA, 20 bp, Artificial Sequence
  Description of Artificial Sequence: Synthetic oligonucleotide
  Target: ATXN1; (+) strand; PAM type: YTN; PAM sequence: CTA
gatctcttagttctttcata

SEQ ID NO: 259288 - DNA, 20 bp, Artificial Sequence
  Description of Artificial Sequence: Synthetic oligonucleotide
  Target: ATXN1; (+) strand; PAM type: YTN; PAM sequence: CTC
ttagttctttcatattttaa

SEQ ID NO: 259289 - DNA, 20 bp, Artificial Sequence
  Description of Artificial Sequence: Synthetic oligonucleotide
  Target: ATXN1; (+) strand; PAM type: YTN; PAM sequence: CTT
agttctttcatattttaaag

SEQ ID NO: 259290 - DNA, 20 bp, Artificial Sequence
  Description of Artificial Sequence: Synthetic oligonucleotide
  Target: ATXN1; (+) strand; PAM type: YTN; PAM sequence: TTA
gttctttcatattttaaagt

SEQ ID NO: 259291 - DNA, 20 bp, Artificial Sequence
  Description of Artificial Sequence: Synthetic oligonucleotide
  Target: ATXN1; (+) strand; PAM type: YTN; PAM sequence: TTC
tttcatattttaaagtgcac

SEQ ID NO: 259292 - DNA, 20 bp, Artificial Sequence
  Description of Artificial Sequence: Synthetic oligonucleotide
  Target: ATXN1; (+) strand; PAM type: YTN; PAM sequence: CTT
tcatattttaaagtgcacag

SEQ ID NO: 259293 - DNA, 20 bp, Artificial Sequence
  Description of Artificial Sequence: Synthetic oligonucleotide
  Target: ATXN1; (+) strand; PAM type: YTN; PAM sequence: TTT
catattttaaagtgcacaga

SEQ ID NO: 259294 - DNA, 20 bp, Artificial Sequence
  Description of Artificial Sequence: Synthetic oligonucleotide
  Target: ATXN1; (+) strand; PAM type: YTN; PAM sequence: TTC
atattttaaagtgcacagat

SEQ ID NO: 259295 - DNA, 20 bp, Artificial Sequence
  Description of Artificial Sequence: Synthetic oligonucleotide
  Target: ATXN1; (+) strand; PAM type: YTN; PAM sequence: TTT
taaagtgcacagatgcctga

SEQ ID NO: 259296 - DNA, 20 bp, Artificial Sequence
  Description of Artificial Sequence: Synthetic oligonucleotide
  Target: ATXN1; (+) strand; PAM type: YTN; PAM sequence: TTT
aaagtgcacagatgcctgat

SEQ ID NO: 259297 - DNA, 20 bp, Artificial Sequence
  Description of Artificial Sequence: Synthetic oligonucleotide
  Target: ATXN1; (+) strand; PAM type: YTN; PAM sequence: TTA
aagtgcacagatgcctgatt

SEQ ID NO: 259298 - DNA, 20 bp, Artificial Sequence
  Description of Artificial Sequence: Synthetic oligonucleotide
  Target: ATXN1; (+) strand; PAM type: YTN; PAM sequence: CTG
atttcagattctgtgaaaca

SEQ ID NO: 259299 - DNA, 20 bp, Artificial Sequence
  Description of Artificial Sequence: Synthetic oligonucleotide
  Target: ATXN1; (+) strand; PAM type: YTN; PAM sequence: TTT
cagattctgtgaaacagagc

SEQ ID NO: 259300 - DNA, 20 bp, Artificial Sequence
  Description of Artificial Sequence: Synthetic oligonucleotide
  Target: ATXN1; (+) strand; PAM type: YTN; PAM sequence: TTC
agattctgtgaaacagagca

SEQ ID NO: 259301 - DNA, 20 bp, Artificial Sequence
  Description of Artificial Sequence: Synthetic oligonucleotide
  Target: ATXN1; (+) strand; PAM type: YTN; PAM sequence: TTC
tgtgaaacagagcacaaatt

SEQ ID NO: 259302 - DNA, 20 bp, Artificial Sequence
  Description of Artificial Sequence: Synthetic oligonucleotide
  Target: ATXN1; (+) strand; PAM type: YTN; PAM sequence: CTG
tgaaacagagcacaaattaa

SEQ ID NO: 259303 - DNA, 20 bp, Artificial Sequence
  Description of Artificial Sequence: Synthetic oligonucleotide
  Target: ATXN1; (+) strand; PAM type: YTN; PAM sequence: TTA
atatttacaaatgctttctg

SEQ ID NO: 259304 - DNA, 20 bp, Artificial Sequence
  Description of Artificial Sequence: Synthetic oligonucleotide
  Target: ATXN1; (+) strand; PAM type: YTN; PAM sequence: TTT
acaaatgctttctgtctcag

SEQ ID NO: 259305 - DNA, 20 bp, Artificial Sequence
  Description of Artificial Sequence: Synthetic oligonucleotide
  Target: ATXN1; (+) strand; PAM type: YTN; PAM sequence: TTA
caaatgctttctgtctcagg

SEQ ID NO: 259306 - DNA, 20 bp, Artificial Sequence
  Description of Artificial Sequence: Synthetic oligonucleotide
  Target: ATXN1; (+) strand; PAM type: YTN; PAM sequence: CTT
tctgtctcaggacccctctg

SEQ ID NO: 259307 - DNA, 20 bp, Artificial Sequence
  Description of Artificial Sequence: Synthetic oligonucleotide
  Target: ATXN1; (+) strand; PAM type: YTN; PAM sequence: TTT
ctgtctcaggacccctctgt

SEQ ID NO: 259308 - DNA, 20 bp, Artificial Sequence
  Description of Artificial Sequence: Synthetic oligonucleotide
  Target: ATXN1; (+) strand; PAM type: YTN; PAM sequence: TTC
tgtctcaggacccctctgta

SEQ ID NO: 259309 - DNA, 20 bp, Artificial Sequence
  Description of Artificial Sequence: Synthetic oligonucleotide
  Target: ATXN1; (+) strand; PAM type: YTN; PAM sequence: CTG
tctcaggacccctctgtagc

SEQ ID NO: 259310 - DNA, 20 bp, Artificial Sequence
  Description of Artificial Sequence: Synthetic oligonucleotide
  Target: ATXN1; (+) strand; PAM type: YTN; PAM sequence: CTC
aggacccctctgtagctact

SEQ ID NO: 259311 - DNA, 20 bp, Artificial Sequence
  Description of Artificial Sequence: Synthetic oligonucleotide
  Target: ATXN1; (+) strand; PAM type: YTN; PAM sequence: CTC
tgtagctactaacttcacat

SEQ ID NO: 259312 - DNA, 20 bp, Artificial Sequence
  Description of Artificial Sequence: Synthetic oligonucleotide
  Target: ATXN1; (+) strand; PAM type: YTN; PAM sequence: CTG
tagctactaacttcacattt

SEQ ID NO: 259313 - DNA, 20 bp, Artificial Sequence
  Description of Artificial Sequence: Synthetic oligonucleotide
  Target: ATXN1; (+) strand; PAM type: YTN; PAM sequence: CTA
ctaacttcacatttgggaaa

SEQ ID NO: 259314 - DNA, 20 bp, Artificial Sequence
  Description of Artificial Sequence: Synthetic oligonucleotide
  Target: ATXN1; (+) strand; PAM type: YTN; PAM sequence: CTA
acttcacatttgggaaaaag

SEQ ID NO: 259315 - DNA, 20 bp, Artificial Sequence
  Description of Artificial Sequence: Synthetic oligonucleotide
  Target: ATXN1; (+) strand; PAM type: YTN; PAM sequence: CTT
cacatttgggaaaaagtaga

SEQ ID NO: 259316 - DNA, 20 bp, Artificial Sequence
  Description of Artificial Sequence: Synthetic oligonucleotide
  Target: ATXN1; (+) strand; PAM type: YTN; PAM sequence: TTC
acatttgggaaaaagtagac

SEQ ID NO: 259317 - DNA, 20 bp, Artificial Sequence
  Description of Artificial Sequence: Synthetic oligonucleotide
  Target: ATXN1; (+) strand; PAM type: YTN; PAM sequence: TTT
gggaaaaagtagaccctact

SEQ ID NO: 259318 - DNA, 20 bp, Artificial Sequence
  Description of Artificial Sequence: Synthetic oligonucleotide
  Target: ATXN1; (+) strand; PAM type: YTN; PAM sequence: TTG
ggaaaaagtagaccctactc

SEQ ID NO: 259319 - DNA, 20 bp, Artificial Sequence
  Description of Artificial Sequence: Synthetic oligonucleotide
  Target: ATXN1; (+) strand; PAM type: YTN; PAM sequence: CTA
ctccatcccactgtgccacg

SEQ ID NO: 259320 - DNA, 20 bp, Artificial Sequence
  Description of Artificial Sequence: Synthetic oligonucleotide
  Target: ATXN1; (+) strand; PAM type: YTN; PAM sequence: CTC
catcccactgtgccacgttg

SEQ ID NO: 259321 - DNA, 20 bp, Artificial Sequence
  Description of Artificial Sequence: Synthetic oligonucleotide
  Target: ATXN1; (+) strand; PAM type: YTN; PAM sequence: CTG
tgccacgttgtttaccaaaa

SEQ ID NO: 259322 - DNA, 20 bp, Artificial Sequence
  Description of Artificial Sequence: Synthetic oligonucleotide
  Target: ATXN1; (+) strand; PAM type: YTN; PAM sequence: TTG
tttaccaaaagtatcccacc

SEQ ID NO: 259323 - DNA, 20 bp, Artificial Sequence
  Description of Artificial Sequence: Synthetic oligonucleotide
  Target: ATXN1; (+) strand; PAM type: YTN; PAM sequence: TTT
accaaaagtatcccaccagg

SEQ ID NO: 259324 - DNA, 20 bp, Artificial Sequence
  Description of Artificial Sequence: Synthetic oligonucleotide
  Target: ATXN1; (+) strand; PAM type: YTN; PAM sequence: TTA
ccaaaagtatcccaccaggc

SEQ ID NO: 259325 - DNA, 20 bp, Artificial Sequence
  Description of Artificial Sequence: Synthetic oligonucleotide
  Target: ATXN1; (+) strand; PAM type: YTN; PAM sequence: CTT
gtattcctcacccacgtgta

SEQ ID NO: 259326 - DNA, 20 bp, Artificial Sequence
  Description of Artificial Sequence: Synthetic oligonucleotide
  Target: ATXN1; (+) strand; PAM type: YTN; PAM sequence: TTG
tattcctcacccacgtgtat

SEQ ID NO: 259327 - DNA, 20 bp, Artificial Sequence
  Description of Artificial Sequence: Synthetic oligonucleotide
  Target: ATXN1; (+) strand; PAM type: YTN; PAM sequence: TTC
ctcacccacgtgtattactt

SEQ ID NO: 259328 - DNA, 20 bp, Artificial Sequence
  Description of Artificial Sequence: Synthetic oligonucleotide
  Target: ATXN1; (+) strand; PAM type: YTN; PAM sequence: CTC
acccacgtgtattactttaa

SEQ ID NO: 259329 - DNA, 20 bp, Artificial Sequence
  Description of Artificial Sequence: Synthetic oligonucleotide
  Target: ATXN1; (+) strand; PAM type: YTN; PAM sequence: TTA
ctttaaaatgcctttcggta

SEQ ID NO: 259330 - DNA, 20 bp, Artificial Sequence
  Description of Artificial Sequence: Synthetic oligonucleotide
  Target: ATXN1; (+) strand; PAM type: YTN; PAM sequence: CTT
taaaatgcctttcggtaaag

SEQ ID NO: 259331 - DNA, 20 bp, Artificial Sequence
  Description of Artificial Sequence: Synthetic oligonucleotide
  Target: ATXN1; (+) strand; PAM type: YTN; PAM sequence: TTT
aaaatgcctttcggtaaagg

SEQ ID NO: 259332 - DNA, 20 bp, Artificial Sequence
  Description of Artificial Sequence: Synthetic oligonucleotide
  Target: ATXN1; (+) strand; PAM type: YTN; PAM sequence: TTA
aaatgcctttcggtaaagga

SEQ ID NO: 259333 - DNA, 20 bp, Artificial Sequence
  Description of Artificial Sequence: Synthetic oligonucleotide
  Target: ATXN1; (+) strand; PAM type: YTN; PAM sequence: CTT
tcggtaaaggagaatttgaa

SEQ ID NO: 259334 - DNA, 20 bp, Artificial Sequence
  Description of Artificial Sequence: Synthetic oligonucleotide
  Target: ATXN1; (+) strand; PAM type: YTN; PAM sequence: TTT
cggtaaaggagaatttgaat

SEQ ID NO: 259335 - DNA, 20 bp, Artificial Sequence
  Description of Artificial Sequence: Synthetic oligonucleotide
  Target: ATXN1; (+) strand; PAM type: YTN; PAM sequence: TTC
ggtaaaggagaatttgaata

SEQ ID NO: 259336 - DNA, 20 bp, Artificial Sequence
  Description of Artificial Sequence: Synthetic oligonucleotide
  Target: ATXN1; (+) strand; PAM type: YTN; PAM sequence: TTT
gaatagcattttacgcatta

SEQ ID NO: 259337 - DNA, 20 bp, Artificial Sequence
  Description of Artificial Sequence: Synthetic oligonucleotide
  Target: ATXN1; (+) strand; PAM type: YTN; PAM sequence: TTG
aatagcattttacgcattaa

SEQ ID NO: 259338 - DNA, 20 bp, Artificial Sequence
  Description of Artificial Sequence: Synthetic oligonucleotide
  Target: ATXN1; (+) strand; PAM type: YTN; PAM sequence: TTT
tacgcattaactgtctggga

SEQ ID NO: 259339 - DNA, 20 bp, Artificial Sequence
  Description of Artificial Sequence: Synthetic oligonucleotide
  Target: ATXN1; (+) strand; PAM type: YTN; PAM sequence: TTT
acgcattaactgtctgggaa

SEQ ID NO: 259340 - DNA, 20 bp, Artificial Sequence
  Description of Artificial Sequence: Synthetic oligonucleotide
  Target: ATXN1; (+) strand; PAM type: YTN; PAM sequence: TTA
cgcattaactgtctgggaat

SEQ ID NO: 259341 - DNA, 20 bp, Artificial Sequence
  Description of Artificial Sequence: Synthetic oligonucleotide
  Target: ATXN1; (+) strand; PAM type: YTN; PAM sequence: TTA
actgtctgggaatgctccca

SEQ ID NO: 259342 - DNA, 20 bp, Artificial Sequence
  Description of Artificial Sequence: Synthetic oligonucleotide
  Target: ATXN1; (+) strand; PAM type: YTN; PAM sequence: CTG
tctgggaatgctcccaacat

SEQ ID NO: 259343 - DNA, 20 bp, Artificial Sequence
  Description of Artificial Sequence: Synthetic oligonucleotide
  Target: ATXN1; (+) strand; PAM type: YTN; PAM sequence: CTG
ggaatgctcccaacataata

SEQ ID NO: 259344 - DNA, 20 bp, Artificial Sequence
  Description of Artificial Sequence: Synthetic oligonucleotide
  Target: ATXN1; (+) strand; PAM type: YTN; PAM sequence: CTC
ccaacataatatactgaaac

SEQ ID NO: 259345 - DNA, 20 bp, Artificial Sequence
  Description of Artificial Sequence: Synthetic oligonucleotide
  Target: ATXN1; (+) strand; PAM type: YTN; PAM sequence: CTG
aaacacagaagactggctgt

SEQ ID NO: 259346 - DNA, 20 bp, Artificial Sequence
  Description of Artificial Sequence: Synthetic oligonucleotide
  Target: ATXN1; (+) strand; PAM type: YTN; PAM sequence: CTG
gctgtaggtccagatcacct

SEQ ID NO: 259347 - DNA, 20 bp, Artificial Sequence
  Description of Artificial Sequence: Synthetic oligonucleotide
  Target: ATXN1; (+) strand; PAM type: YTN; PAM sequence: CTG
taggtccagatcacctggta

SEQ ID NO: 259348 - DNA, 20 bp, Artificial Sequence
  Description of Artificial Sequence: Synthetic oligonucleotide
  Target: ATXN1; (+) strand; PAM type: YTN; PAM sequence: CTG
gtagtgaaccatggaaaggt

SEQ ID NO: 259349 - DNA, 20 bp, Artificial Sequence
  Description of Artificial Sequence: Synthetic oligonucleotide
  Target: ATXN1; (+) strand; PAM type: YTN; PAM sequence: TTA
ttcacacaccttggagcctg

SEQ ID NO: 259350 - DNA, 20 bp, Artificial Sequence
  Description of Artificial Sequence: Synthetic oligonucleotide
  Target: ATXN1; (+) strand; PAM type: YTN; PAM sequence: TTC
acacaccttggagcctgcgg

SEQ ID NO: 259351 - DNA, 20 bp, Artificial Sequence
  Description of Artificial Sequence: Synthetic oligonucleotide
  Target: ATXN1; (+) strand; PAM type: YTN; PAM sequence: CTT
ggagcctgcggattctctaa

SEQ ID NO: 259352 - DNA, 20 bp, Artificial Sequence
  Description of Artificial Sequence: Synthetic oligonucleotide
  Target: ATXN1; (+) strand; PAM type: YTN; PAM sequence: TTG
gagcctgcggattctctaag

SEQ ID NO: 259353 - DNA, 20 bp, Artificial Sequence
  Description of Artificial Sequence: Synthetic oligonucleotide
  Target: ATXN1; (+) strand; PAM type: YTN; PAM sequence: CTG
cggattctctaagccttctt

SEQ ID NO: 259354 - DNA, 20 bp, Artificial Sequence
  Description of Artificial Sequence: Synthetic oligonucleotide
  Target: ATXN1; (+) strand; PAM type: YTN; PAM sequence: TTC
tctaagccttcttaatcatt

SEQ ID NO: 259355 - DNA, 20 bp, Artificial Sequence
  Description of Artificial Sequence: Synthetic oligonucleotide
  Target: ATXN1; (+) strand; PAM type: YTN; PAM sequence: CTC
taagccttcttaatcattct

SEQ ID NO: 259356 - DNA, 20 bp, Artificial Sequence
  Description of Artificial Sequence: Synthetic oligonucleotide
  Target: ATXN1; (+) strand; PAM type: YTN; PAM sequence: CTA
agccttcttaatcattcttc

SEQ ID NO: 259357 - DNA, 20 bp, Artificial Sequence
  Description of Artificial Sequence: Synthetic oligonucleotide
  Target: ATXN1; (+) strand; PAM type: YTN; PAM sequence: CTT
cttaatcattcttcaggtat

SEQ ID NO: 259358 - DNA, 20 bp, Artificial Sequence
  Description of Artificial Sequence: Synthetic oligonucleotide
  Target: ATXN1; (+) strand; PAM type: YTN; PAM sequence: TTC
ttaatcattcttcaggtatt

SEQ ID NO: 259359 - DNA, 20 bp, Artificial Sequence
  Description of Artificial Sequence: Synthetic oligonucleotide
  Target: ATXN1; (+) strand; PAM type: YTN; PAM sequence: CTT
aatcattcttcaggtattac

SEQ ID NO: 259360 - DNA, 20 bp, Artificial Sequence
  Description of Artificial Sequence: Synthetic oligonucleotide
  Target: ATXN1; (+) strand; PAM type: YTN; PAM sequence: TTA
atcattcttcaggtattact

SEQ ID NO: 259361 - DNA, 20 bp, Artificial Sequence
  Description of Artificial Sequence: Synthetic oligonucleotide
  Target: ATXN1; (+) strand; PAM type: YTN; PAM sequence: TTC
ttcaggtattactttgtcct

SEQ ID NO: 259362 - DNA, 20 bp, Artificial Sequence
  Description of Artificial Sequence: Synthetic oligonucleotide
  Target: ATXN1; (+) strand; PAM type: YTN; PAM sequence: CTT
caggtattactttgtccttc

SEQ ID NO: 259363 - DNA, 20 bp, Artificial Sequence
  Description of Artificial Sequence: Synthetic oligonucleotide
  Target: ATXN1; (+) strand; PAM type: YTN; PAM sequence: TTC
aggtattactttgtccttca

SEQ ID NO: 259364 - DNA, 20 bp, Artificial Sequence
  Description of Artificial Sequence: Synthetic oligonucleotide
  Target: ATXN1; (+) strand; PAM type: YTN; PAM sequence: TTA
ctttgtccttcaaaacagca

SEQ ID NO: 259365 - DNA, 20 bp, Artificial Sequence
  Description of Artificial Sequence: Synthetic oligonucleotide
  Target: ATXN1; (+) strand; PAM type: YTN; PAM sequence: CTT
tgtccttcaaaacagcagat

SEQ ID NO: 259366 - DNA, 20 bp, Artificial Sequence
  Description of Artificial Sequence: Synthetic oligonucleotide
  Target: ATXN1; (+) strand; PAM type: YTN; PAM sequence: TTT
gtccttcaaaacagcagatt

SEQ ID NO: 259367 - DNA, 20 bp, Artificial Sequence
  Description of Artificial Sequence: Synthetic oligonucleotide
  Target: ATXN1; (+) strand; PAM type: YTN; PAM sequence: TTG
tccttcaaaacagcagattt

SEQ ID NO: 259368 - DNA, 20 bp, Artificial Sequence
  Description of Artificial Sequence: Synthetic oligonucleotide
  Target: ATXN1; (+) strand; PAM type: YTN; PAM sequence: CTT
caaaacagcagatttcagac

SEQ ID NO: 259369 - DNA, 20 bp, Artificial Sequence
  Description of Artificial Sequence: Synthetic oligonucleotide
  Target: ATXN1; (+) strand; PAM type: YTN; PAM sequence: TTC
aaaacagcagatttcagacg

SEQ ID NO: 259370 - DNA, 20 bp, Artificial Sequence
  Description of Artificial Sequence: Synthetic oligonucleotide
  Target: ATXN1; (+) strand; PAM type: YTN; PAM sequence: TTT
cagacgcatttataaaacaa

SEQ ID NO: 259371 - DNA, 20 bp, Artificial Sequence
  Description of Artificial Sequence: Synthetic oligonucleotide
  Target: ATXN1; (+) strand; PAM type: YTN; PAM sequence: TTC
agacgcatttataaaacaat

SEQ ID NO: 259372 - DNA, 20 bp, Artificial Sequence
  Description of Artificial Sequence: Synthetic oligonucleotide
  Target: ATXN1; (+) strand; PAM type: YTN; PAM sequence: TTT
ataaaacaattcagttgtaa

SEQ ID NO: 259373 - DNA, 20 bp, Artificial Sequence
  Description of Artificial Sequence: Synthetic oligonucleotide
  Target: ATXN1; (+) strand; PAM type: YTN; PAM sequence: TTA
taaaacaattcagttgtaat

SEQ ID NO: 259374 - DNA, 20 bp, Artificial Sequence
  Description of Artificial Sequence: Synthetic oligonucleotide
  Target: ATXN1; (+) strand; PAM type: YTN; PAM sequence: TTC
agttgtaatctgggtcccta

SEQ ID NO: 259375 - DNA, 20 bp, Artificial Sequence
  Description of Artificial Sequence: Synthetic oligonucleotide
  Target: ATXN1; (+) strand; PAM type: YTN; PAM sequence: TTG
taatctgggtccctaaagct

SEQ ID NO: 259376 - DNA, 20 bp, Artificial Sequence
  Description of Artificial Sequence: Synthetic oligonucleotide
  Target: ATXN1; (+) strand; PAM type: YTN; PAM sequence: CTG
ggtccctaaagcttcagtat

SEQ ID NO: 259377 - DNA, 20 bp, Artificial Sequence
  Description of Artificial Sequence: Synthetic oligonucleotide
  Target: ATXN1; (+) strand; PAM type: YTN; PAM sequence: CTA
aagcttcagtatagacattt

SEQ ID NO: 259378 - DNA, 20 bp, Artificial Sequence
  Description of Artificial Sequence: Synthetic oligonucleotide
  Target: ATXN1; (+) strand; PAM type: YTN; PAM sequence: CTT
cagtatagacatttatcttg

SEQ ID NO: 259379 - DNA, 20 bp, Artificial Sequence
  Description of Artificial Sequence: Synthetic oligonucleotide
  Target: ATXN1; (+) strand; PAM type: YTN; PAM sequence: TTC
agtatagacatttatcttgt

SEQ ID NO: 259380 - DNA, 20 bp, Artificial Sequence
  Description of Artificial Sequence: Synthetic oligonucleotide
  Target: ATXN1; (+) strand; PAM type: YTN; PAM sequence: TTT
atcttgtaagtaacaaagag

SEQ ID NO: 259381 - DNA, 20 bp, Artificial Sequence
  Description of Artificial Sequence: Synthetic oligonucleotide
  Target: ATXN1; (+) strand; PAM type: YTN; PAM sequence: TTA
tcttgtaagtaacaaagaga

SEQ ID NO: 259382 - DNA, 20 bp, Artificial Sequence
  Description of Artificial Sequence: Synthetic oligonucleotide
  Target: ATXN1; (+) strand; PAM type: YTN; PAM sequence: CTT
gtaagtaacaaagagatggg

SEQ ID NO: 259383 - DNA, 20 bp, Artificial Sequence
  Description of Artificial Sequence: Synthetic oligonucleotide
  Target: ATXN1; (+) strand; PAM type: YTN; PAM sequence: TTG
taagtaacaaagagatggga

SEQ ID NO: 259384 - DNA, 20 bp, Artificial Sequence
  Description of Artificial Sequence: Synthetic oligonucleotide
  Target: ATXN1; (+) strand; PAM type: YTN; PAM sequence: TTT
cctaagttctcatgctatcc

SEQ ID NO: 259385 - DNA, 20 bp, Artificial Sequence
  Description of Artificial Sequence: Synthetic oligonucleotide
  Target: ATXN1; (+) strand; PAM type: YTN; PAM sequence: TTC
ctaagttctcatgctatccc

SEQ ID NO: 259386 - DNA, 20 bp, Artificial Sequence
  Description of Artificial Sequence: Synthetic oligonucleotide
  Target: ATXN1; (+) strand; PAM type: YTN; PAM sequence: CTA
agttctcatgctatcccacc

SEQ ID NO: 259387 - DNA, 20 bp, Artificial Sequence
  Description of Artificial Sequence: Synthetic oligonucleotide
  Target: ATXN1; (+) strand; PAM type: YTN; PAM sequence: TTC
tcatgctatcccacctcctg

SEQ ID NO: 259388 - DNA, 20 bp, Artificial Sequence
  Description of Artificial Sequence: Synthetic oligonucleotide
  Target: ATXN1; (+) strand; PAM type: YTN; PAM sequence: CTC
atgctatcccacctcctgct

SEQ ID NO: 259389 - DNA, 20 bp, Artificial Sequence
  Description of Artificial Sequence: Synthetic oligonucleotide
  Target: ATXN1; (+) strand; PAM type: YTN; PAM sequence: CTA
tcccacctcctgcttgtgtt

SEQ ID NO: 259390 - DNA, 20 bp, Artificial Sequence
  Description of Artificial Sequence: Synthetic oligonucleotide
  Target: ATXN1; (+) strand; PAM type: YTN; PAM sequence: CTC
ctgcttgtgttactcactat

SEQ ID NO: 259391 - DNA, 20 bp, Artificial Sequence
  Description of Artificial Sequence: Synthetic oligonucleotide
  Target: ATXN1; (+) strand; PAM type: YTN; PAM sequence: CTG
cttgtgttactcactattca

SEQ ID NO: 259392 - DNA, 20 bp, Artificial Sequence
  Description of Artificial Sequence: Synthetic oligonucleotide
  Target: ATXN1; (+) strand; PAM type: YTN; PAM sequence: CTT
gtgttactcactattcaaaa

SEQ ID NO: 259393 - DNA, 20 bp, Artificial Sequence
  Description of Artificial Sequence: Synthetic oligonucleotide
  Target: ATXN1; (+) strand; PAM type: YTN; PAM sequence: TTG
tgttactcactattcaaaat

SEQ ID NO: 259394 - DNA, 20 bp, Artificial Sequence
  Description of Artificial Sequence: Synthetic oligonucleotide
  Target: ATXN1; (+) strand; PAM type: YTN; PAM sequence: TTA
ctcactattcaaaatttaag

SEQ ID NO: 259395 - DNA, 20 bp, Artificial Sequence
  Description of Artificial Sequence: Synthetic oligonucleotide
  Target: ATXN1; (+) strand; PAM type: YTN; PAM sequence: CTC
actattcaaaatttaagaat

SEQ ID NO: 259396 - DNA, 20 bp, Artificial Sequence
  Description of Artificial Sequence: Synthetic oligonucleotide
  Target: ATXN1; (+) strand; PAM type: YTN; PAM sequence: CTA
ttcaaaatttaagaataaga

SEQ ID NO: 259397 - DNA, 20 bp, Artificial Sequence
  Description of Artificial Sequence: Synthetic oligonucleotide
  Target: ATXN1; (+) strand; PAM type: YTN; PAM sequence: TTC
aaaatttaagaataagaagt

SEQ ID NO: 259398 - DNA, 20 bp, Artificial Sequence
  Description of Artificial Sequence: Synthetic oligonucleotide
  Target: ATXN1; (+) strand; PAM type: YTN; PAM sequence: TTT
aagaataagaagtcatctgg

SEQ ID NO: 259399 - DNA, 20 bp, Artificial Sequence
  Description of Artificial Sequence: Synthetic oligonucleotide
  Target: ATXN1; (+) strand; PAM type: YTN; PAM sequence: TTA
agaataagaagtcatctggg

SEQ ID NO: 259400 - DNA, 20 bp, Artificial Sequence
  Description of Artificial Sequence: Synthetic oligonucleotide
  Target: ATXN1; (+) strand; PAM type: YTN; PAM sequence: CTG
ggagaaaggggatgggaccg

SEQ ID NO: 259401 - DNA, 20 bp, Artificial Sequence
  Description of Artificial Sequence: Synthetic oligonucleotide
  Target: ATXN1; (+) strand; PAM type: YTN; PAM sequence: CTG
aaacacggctcagggcttgg

SEQ ID NO: 259402 - DNA, 20 bp, Artificial Sequence
  Description of Artificial Sequence: Synthetic oligonucleotide
  Target: ATXN1; (+) strand; PAM type: YTN; PAM sequence: CTC
agggcttggttccctcctat

SEQ ID NO: 259403 - DNA, 20 bp, Artificial Sequence
  Description of Artificial Sequence: Synthetic oligonucleotide
  Target: ATXN1; (+) strand; PAM type: YTN; PAM sequence: CTT
ggttccctcctatgcccatc

SEQ ID NO: 259404 - DNA, 20 bp, Artificial Sequence
  Description of Artificial Sequence: Synthetic oligonucleotide
  Target: ATXN1; (+) strand; PAM type: YTN; PAM sequence: TTG
gttccctcctatgcccatca

SEQ ID NO: 259405 - DNA, 20 bp, Artificial Sequence
  Description of Artificial Sequence: Synthetic oligonucleotide
  Target: ATXN1; (+) strand; PAM type: YTN; PAM sequence: TTC
cctcctatgcccatcacctg

SEQ ID NO: 259406 - DNA, 20 bp, Artificial Sequence
  Description of Artificial Sequence: Synthetic oligonucleotide
  Target: ATXN1; (+) strand; PAM type: YTN; PAM sequence: CTC
ctatgcccatcacctgctcc

SEQ ID NO: 259407 - DNA, 20 bp, Artificial Sequence
  Description of Artificial Sequence: Synthetic oligonucleotide
  Target: ATXN1; (+) strand; PAM type: YTN; PAM sequence: CTA
tgcccatcacctgctccctc

SEQ ID NO: 259408 - DNA, 20 bp, Artificial Sequence
  Description of Artificial Sequence: Synthetic oligonucleotide
  Target: ATXN1; (+) strand; PAM type: YTN; PAM sequence: CTG
ctccctcactcaaccacaaa

SEQ ID NO: 259409 - DNA, 20 bp, Artificial Sequence
  Description of Artificial Sequence: Synthetic oligonucleotide
  Target: ATXN1; (+) strand; PAM type: YTN; PAM sequence: CTC
cctcactcaaccacaaacac

SEQ ID NO: 259410 - DNA, 20 bp, Artificial Sequence
  Description of Artificial Sequence: Synthetic oligonucleotide
  Target: ATXN1; (+) strand; PAM type: YTN; PAM sequence: CTC
actcaaccacaaacacggct

SEQ ID NO: 259411 - DNA, 20 bp, Artificial Sequence
  Description of Artificial Sequence: Synthetic oligonucleotide
  Target: ATXN1; (+) strand; PAM type: YTN; PAM sequence: CTC
aaccacaaacacggctgcaa

SEQ ID NO: 259412 - DNA, 20 bp, Artificial Sequence
  Description of Artificial Sequence: Synthetic oligonucleotide
  Target: ATXN1; (+) strand; PAM type: YTN; PAM sequence: CTG
caatatcagggtcagtgttc

SEQ ID NO: 259413 - DNA, 20 bp, Artificial Sequence
  Description of Artificial Sequence: Synthetic oligonucleotide
  Target: ATXN1; (+) strand; PAM type: YTN; PAM sequence: TTC
cacatcccgtagcagatgac

SEQ ID NO: 259414 - DNA, 20 bp, Artificial Sequence
  Description of Artificial Sequence: Synthetic oligonucleotide
  Target: ATXN1; (+) strand; PAM type: YTN; PAM sequence: CTC
tgttccagaacaaacaaagt

SEQ ID NO: 259415 - DNA, 20 bp, Artificial Sequence
  Description of Artificial Sequence: Synthetic oligonucleotide
  Target: ATXN1; (+) strand; PAM type: YTN; PAM sequence: CTG
ttccagaacaaacaaagtgt

SEQ ID NO: 259416 - DNA, 20 bp, Artificial Sequence
  Description of Artificial Sequence: Synthetic oligonucleotide
  Target: ATXN1; (+) strand; PAM type: YTN; PAM sequence: TTC
cagaacaaacaaagtgtgca

SEQ ID NO: 259417 - DNA, 20 bp, Artificial Sequence
  Description of Artificial Sequence: Synthetic oligonucleotide
  Target: ATXN1; (+) strand; PAM type: YTN; PAM sequence: CTA
taagcatgatgacattagaa

SEQ ID NO: 259418 - DNA, 20 bp, Artificial Sequence
  Description of Artificial Sequence: Synthetic oligonucleotide
  Target: ATXN1; (+) strand; PAM type: YTN; PAM sequence: TTA
gaattagacttcaaagctag

SEQ ID NO: 259419 - DNA, 20 bp, Artificial Sequence
  Description of Artificial Sequence: Synthetic oligonucleotide
  Target: ATXN1; (+) strand; PAM type: YTN; PAM sequence: TTA
gacttcaaagctagcctcaa

SEQ ID NO: 259420 - DNA, 20 bp, Artificial Sequence
  Description of Artificial Sequence: Synthetic oligonucleotide
  Target: ATXN1; (+) strand; PAM type: YTN; PAM sequence: CTT
caaagctagcctcaagatgc

SEQ ID NO: 259421 - DNA, 20 bp, Artificial Sequence
  Description of Artificial Sequence: Synthetic oligonucleotide
  Target: ATXN1; (+) strand; PAM type: YTN; PAM sequence: TTC
aaagctagcctcaagatgct

SEQ ID NO: 259422 - DNA, 20 bp, Artificial Sequence
  Description of Artificial Sequence: Synthetic oligonucleotide
  Target: ATXN1; (+) strand; PAM type: YTN; PAM sequence: CTA
gcctcaagatgctcacagac

SEQ ID NO: 259423 - DNA, 20 bp, Artificial Sequence
  Description of Artificial Sequence: Synthetic oligonucleotide
  Target: ATXN1; (+) strand; PAM type: YTN; PAM sequence: CTC
aagatgctcacagactgata

SEQ ID NO: 259424 - DNA, 20 bp, Artificial Sequence
  Description of Artificial Sequence: Synthetic oligonucleotide
  Target: ATXN1; (+) strand; PAM type: YTN; PAM sequence: CTC
acagactgatattaaccact

SEQ ID NO: 259425 - DNA, 20 bp, Artificial Sequence
  Description of Artificial Sequence: Synthetic oligonucleotide
  Target: ATXN1; (+) strand; PAM type: YTN; PAM sequence: CTG
atattaaccactgtctgcca

SEQ ID NO: 259426 - DNA, 20 bp, Artificial Sequence
  Description of Artificial Sequence: Synthetic oligonucleotide
  Target: ATXN1; (+) strand; PAM type: YTN; PAM sequence: TTA
accactgtctgccacaagca

SEQ ID NO: 259427 - DNA, 20 bp, Artificial Sequence
  Description of Artificial Sequence: Synthetic oligonucleotide
  Target: ATXN1; (+) strand; PAM type: YTN; PAM sequence: CTG
tctgccacaagcatatggca

SEQ ID NO: 259428 - DNA, 20 bp, Artificial Sequence
  Description of Artificial Sequence: Synthetic oligonucleotide
  Target: ATXN1; (+) strand; PAM type: YTN; PAM sequence: CTG
ccacaagcatatggcacaag

SEQ ID NO: 259429 - DNA, 20 bp, Artificial Sequence
  Description of Artificial Sequence: Synthetic oligonucleotide
  Target: ATXN1; (+) strand; PAM type: YTN; PAM sequence: CTG
gagcagatcacaaggaaaga

SEQ ID NO: 259430 - DNA, 20 bp, Artificial Sequence
  Description of Artificial Sequence: Synthetic oligonucleotide
  Target: ATXN1; (+) strand; PAM type: YTN; PAM sequence: CTC
gttggcatattggcccacaa

SEQ ID NO: 259431 - DNA, 20 bp, Artificial Sequence
  Description of Artificial Sequence: Synthetic oligonucleotide
  Target: ATXN1; (+) strand; PAM type: YTN; PAM sequence: TTG
gcatattggcccacaatact

SEQ ID NO: 259432 - DNA, 20 bp, Artificial Sequence
  Description of Artificial Sequence: Synthetic oligonucleotide
  Target: ATXN1; (+) strand; PAM type: YTN; PAM sequence: TTG
gcccacaatactgccacaga

SEQ ID NO: 259433 - DNA, 20 bp, Artificial Sequence
  Description of Artificial Sequence: Synthetic oligonucleotide
  Target: ATXN1; (+) strand; PAM type: YTN; PAM sequence: CTG
ccacagaggcagagcttaga

SEQ ID NO: 259434 - DNA, 20 bp, Artificial Sequence
  Description of Artificial Sequence: Synthetic oligonucleotide
  Target: ATXN1; (+) strand; PAM type: YTN; PAM sequence: CTT
agagagggtgctaggcaagg

SEQ ID NO: 259435 - DNA, 20 bp, Artificial Sequence
  Description of Artificial Sequence: Synthetic oligonucleotide
  Target: ATXN1; (+) strand; PAM type: YTN; PAM sequence: TTA
gagagggtgctaggcaaggc

SEQ ID NO: 259436 - DNA, 20 bp, Artificial Sequence
  Description of Artificial Sequence: Synthetic oligonucleotide
  Target: ATXN1; (+) strand; PAM type: YTN; PAM sequence: CTA
ggcaaggcattcatccgcta

SEQ ID NO: 259437 - DNA, 20 bp, Artificial Sequence
  Description of Artificial Sequence: Synthetic oligonucleotide
  Target: ATXN1; (+) strand; PAM type: YTN; PAM sequence: TTC
atccgctatttcactctgga

SEQ ID NO: 259438 - DNA, 20 bp, Artificial Sequence
  Description of Artificial Sequence: Synthetic oligonucleotide
  Target: ATXN1; (+) strand; PAM type: YTN; PAM sequence: CTA
tttcactctggaaaggggat

SEQ ID NO: 259439 - DNA, 20 bp, Artificial Sequence
  Description of Artificial Sequence: Synthetic oligonucleotide
  Target: ATXN1; (+) strand; PAM type: YTN; PAM sequence: TTT
cactctggaaaggggatcag

SEQ ID NO: 259440 - DNA, 20 bp, Artificial Sequence
  Description of Artificial Sequence: Synthetic oligonucleotide
  Target: ATXN1; (+) strand; PAM type: YTN; PAM sequence: TTC
actctggaaaggggatcagt

SEQ ID NO: 259441 - DNA, 20 bp, Artificial Sequence
  Description of Artificial Sequence: Synthetic oligonucleotide
  Target: ATXN1; (+) strand; PAM type: YTN; PAM sequence: CTC
tggaaaggggatcagttggg

SEQ ID NO: 259442 - DNA, 20 bp, Artificial Sequence
  Description of Artificial Sequence: Synthetic oligonucleotide
  Target: ATXN1; (+) strand; PAM type: YTN; PAM sequence: CTG
gaaaggggatcagttggggg

SEQ ID NO: 259443 - DNA, 20 bp, Artificial Sequence
  Description of Artificial Sequence: Synthetic oligonucleotide
  Target: ATXN1; (+) strand; PAM type: YTN; PAM sequence: TTG
ggggaaaaaaatctgcaaac

SEQ ID NO: 259444 - DNA, 20 bp, Artificial Sequence
  Description of Artificial Sequence: Synthetic oligonucleotide
  Target: ATXN1; (+) strand; PAM type: YTN; PAM sequence: CTG
caaaccttttgaggacagaa

SEQ ID NO: 259445 - DNA, 20 bp, Artificial Sequence
  Description of Artificial Sequence: Synthetic oligonucleotide
  Target: ATXN1; (+) strand; PAM type: YTN; PAM sequence: CTT
ttgaggacagaaggcaatat

SEQ ID NO: 259446 - DNA, 20 bp, Artificial Sequence
  Description of Artificial Sequence: Synthetic oligonucleotide
  Target: ATXN1; (+) strand; PAM type: YTN; PAM sequence: TTT
tgaggacagaaggcaatatt

SEQ ID NO: 259447 - DNA, 20 bp, Artificial Sequence
  Description of Artificial Sequence: Synthetic oligonucleotide
  Target: ATXN1; (+) strand; PAM type: YTN; PAM sequence: TTT
gaggacagaaggcaatattg

SEQ ID NO: 259448 - DNA, 20 bp, Artificial Sequence
  Description of Artificial Sequence: Synthetic oligonucleotide
  Target: ATXN1; (+) strand; PAM type: YTN; PAM sequence: TTG
aggacagaaggcaatattgc

SEQ ID NO: 259449 - DNA, 20 bp, Artificial Sequence
  Description of Artificial Sequence: Synthetic oligonucleotide
  Target: ATXN1; (+) strand; PAM type: YTN; PAM sequence: TTG
cttgaaatttatgagtaatg

SEQ ID NO: 259450 - DNA, 20 bp, Artificial Sequence
  Description of Artificial Sequence: Synthetic oligonucleotide
  Target: ATXN1; (+) strand; PAM type: YTN; PAM sequence: CTT
gaaatttatgagtaatgagc

SEQ ID NO: 259451 - DNA, 20 bp, Artificial Sequence
  Description of Artificial Sequence: Synthetic oligonucleotide
  Target: ATXN1; (+) strand; PAM type: YTN; PAM sequence: TTG
aaatttatgagtaatgagcc

SEQ ID NO: 259452 - DNA, 20 bp, Artificial Sequence
  Description of Artificial Sequence: Synthetic oligonucleotide
  Target: ATXN1; (+) strand; PAM type: YTN; PAM sequence: TTT
atgagtaatgagccattttg

SEQ ID NO: 259453 - DNA, 20 bp, Artificial Sequence
  Description of Artificial Sequence: Synthetic oligonucleotide
  Target: ATXN1; (+) strand; PAM type: YTN; PAM sequence: TTA
tgagtaatgagccattttgg

SEQ ID NO: 259454 - DNA, 20 bp, Artificial Sequence
  Description of Artificial Sequence: Synthetic oligonucleotide
  Target: ATXN1; (+) strand; PAM type: YTN; PAM sequence: TTT
tgggagaaggaagttgattc

SEQ ID NO: 259455 - DNA, 20 bp, Artificial Sequence
  Description of Artificial Sequence: Synthetic oligonucleotide
  Target: ATXN1; (+) strand; PAM type: YTN; PAM sequence: TTT
gggagaaggaagttgattct

SEQ ID NO: 259456 - DNA, 20 bp, Artificial Sequence
  Description of Artificial Sequence: Synthetic oligonucleotide
  Target: ATXN1; (+) strand; PAM type: YTN; PAM sequence: TTG
ggagaaggaagttgattctg

SEQ ID NO: 259457 - DNA, 20 bp, Artificial Sequence
  Description of Artificial Sequence: Synthetic oligonucleotide
  Target: ATXN1; (+) strand; PAM type: YTN; PAM sequence: TTG
attctgtcattcattttgac

SEQ ID NO: 259458 - DNA, 20 bp, Artificial Sequence
  Description of Artificial Sequence: Synthetic oligonucleotide
  Target: ATXN1; (+) strand; PAM type: YTN; PAM sequence: TTC
tgtcattcattttgacaggg

SEQ ID NO: 259459 - DNA, 20 bp, Artificial Sequence
  Description of Artificial Sequence: Synthetic oligonucleotide
  Target: ATXN1; (+) strand; PAM type: YTN; PAM sequence: CTG
tcattcattttgacagggct

SEQ ID NO: 259460 - DNA, 20 bp, Artificial Sequence
  Description of Artificial Sequence: Synthetic oligonucleotide
  Target: ATXN1; (+) strand; PAM type: YTN; PAM sequence: TTC
attttgacagggcttattaa

SEQ ID NO: 259461 - DNA, 20 bp, Artificial Sequence
  Description of Artificial Sequence: Synthetic oligonucleotide
  Target: ATXN1; (+) strand; PAM type: YTN; PAM sequence: TTT
tgacagggcttattaacaca

SEQ ID NO: 259462 - DNA, 20 bp, Artificial Sequence
  Description of Artificial Sequence: Synthetic oligonucleotide
  Target: ATXN1; (+) strand; PAM type: YTN; PAM sequence: TTT
gacagggcttattaacacaa

SEQ ID NO: 259463 - DNA, 20 bp, Artificial Sequence
  Description of Artificial Sequence: Synthetic oligonucleotide
  Target: ATXN1; (+) strand; PAM type: YTN; PAM sequence: TTG
acagggcttattaacacaaa

SEQ ID NO: 259464 - DNA, 20 bp, Artificial Sequence
  Description of Artificial Sequence: Synthetic oligonucleotide
  Target: ATXN1; (+) strand; PAM type: YTN; PAM sequence: CTT
attaacacaaaaggaggaga

SEQ ID NO: 259465 - DNA, 20 bp, Artificial Sequence
  Description of Artificial Sequence: Synthetic oligonucleotide
  Target: ATXN1; (+) strand; PAM type: YTN; PAM sequence: TTA
ttaacacaaaaggaggagag

SEQ ID NO: 259466 - DNA, 20 bp, Artificial Sequence
  Description of Artificial Sequence: Synthetic oligonucleotide
  Target: ATXN1; (+) strand; PAM type: YTN; PAM sequence: TTA
acacaaaaggaggagagggc

SEQ ID NO: 259467 - DNA, 20 bp, Artificial Sequence
  Description of Artificial Sequence: Synthetic oligonucleotide
  Target: ATXN1; (+) strand; PAM type: YTN; PAM sequence: CTG
gtggggagggtggggcactt

SEQ ID NO: 259468 - DNA, 20 bp, Artificial Sequence
  Description of Artificial Sequence: Synthetic oligonucleotide
  Target: ATXN1; (+) strand; PAM type: YTN; PAM sequence: CTT
gtgggaaggtgcagagagga

SEQ ID NO: 259469 - DNA, 20 bp, Artificial Sequence
  Description of Artificial Sequence: Synthetic oligonucleotide
  Target: ATXN1; (+) strand; PAM type: YTN; PAM sequence: TTG
tgggaaggtgcagagaggac

SEQ ID NO: 259470 - DNA, 20 bp, Artificial Sequence
  Description of Artificial Sequence: Synthetic oligonucleotide
  Target: ATXN1; (+) strand; PAM type: YTN; PAM sequence: TTG
caattatggaccttatggag

SEQ ID NO: 259471 - DNA, 20 bp, Artificial Sequence
  Description of Artificial Sequence: Synthetic oligonucleotide
  Target: ATXN1; (+) strand; PAM type: YTN; PAM sequence: TTA
tggaccttatggaggagctg

SEQ ID NO: 259472 - DNA, 20 bp, Artificial Sequence
  Description of Artificial Sequence: Synthetic oligonucleotide
  Target: ATXN1; (+) strand; PAM type: YTN; PAM sequence: CTT
atggaggagctgctggtaag

SEQ ID NO: 259473 - DNA, 20 bp, Artificial Sequence
  Description of Artificial Sequence: Synthetic oligonucleotide
  Target: ATXN1; (+) strand; PAM type: YTN; PAM sequence: TTA
tggaggagctgctggtaagc

SEQ ID NO: 259474 - DNA, 20 bp, Artificial Sequence
  Description of Artificial Sequence: Synthetic oligonucleotide
  Target: ATXN1; (+) strand; PAM type: YTN; PAM sequence: CTG
ctggtaagctaccctggcca

SEQ ID NO: 259475 - DNA, 20 bp, Artificial Sequence
  Description of Artificial Sequence: Synthetic oligonucleotide
  Target: ATXN1; (+) strand; PAM type: YTN; PAM sequence: CTG
gtaagctaccctggccaaag

SEQ ID NO: 259476 - DNA, 20 bp, Artificial Sequence
  Description of Artificial Sequence: Synthetic oligonucleotide
  Target: ATXN1; (+) strand; PAM type: YTN; PAM sequence: CTA
ccctggccaaaggaaaatgt

SEQ ID NO: 259477 - DNA, 20 bp, Artificial Sequence
  Description of Artificial Sequence: Synthetic oligonucleotide
  Target: ATXN1; (+) strand; PAM type: YTN; PAM sequence: CTG
gccaaaggaaaatgttgatt

SEQ ID NO: 259478 - DNA, 20 bp, Artificial Sequence
  Description of Artificial Sequence: Synthetic oligonucleotide
  Target: ATXN1; (+) strand; PAM type: YTN; PAM sequence: TTG
attggaccaattttcagagg

SEQ ID NO: 259479 - DNA, 20 bp, Artificial Sequence
  Description of Artificial Sequence: Synthetic oligonucleotide
  Target: ATXN1; (+) strand; PAM type: YTN; PAM sequence: TTG
gaccaattttcagagggaaa

SEQ ID NO: 259480 - DNA, 20 bp, Artificial Sequence
  Description of Artificial Sequence: Synthetic oligonucleotide
  Target: ATXN1; (+) strand; PAM type: YTN; PAM sequence: TTT
tcagagggaaacagacagct

SEQ ID NO: 259481 - DNA, 20 bp, Artificial Sequence
  Description of Artificial Sequence: Synthetic oligonucleotide
  Target: ATXN1; (+) strand; PAM type: YTN; PAM sequence: TTT
cagagggaaacagacagctc

SEQ ID NO: 259482 - DNA, 20 bp, Artificial Sequence
  Description of Artificial Sequence: Synthetic oligonucleotide
  Target: ATXN1; (+) strand; PAM type: YTN; PAM sequence: TTC
agagggaaacagacagctct

SEQ ID NO: 259483 - DNA, 20 bp, Artificial Sequence
  Description of Artificial Sequence: Synthetic oligonucleotide
  Target: ATXN1; (+) strand; PAM type: YTN; PAM sequence: CTC
ttctgcaagcagatggatga

SEQ ID NO: 259484 - DNA, 20 bp, Artificial Sequence
  Description of Artificial Sequence: Synthetic oligonucleotide
  Target: ATXN1; (+) strand; PAM type: YTN; PAM sequence: CTT
ctgcaagcagatggatgaca

SEQ ID NO: 259485 - DNA, 20 bp, Artificial Sequence
  Description of Artificial Sequence: Synthetic oligonucleotide
  Target: ATXN1; (+) strand; PAM type: YTN; PAM sequence: TTC
tgcaagcagatggatgacaa

SEQ ID NO: 259486 - DNA, 20 bp, Artificial Sequence
  Description of Artificial Sequence: Synthetic oligonucleotide
  Target: ATXN1; (+) strand; PAM type: YTN; PAM sequence: CTG
caagcagatggatgacaaat

SEQ ID NO: 259487 - DNA, 20 bp, Artificial Sequence
  Description of Artificial Sequence: Synthetic oligonucleotide
  Target: ATXN1; (+) strand; PAM type: YTN; PAM sequence: CTC
taggaggaggctgtgttgtt

SEQ ID NO: 259488 - DNA, 20 bp, Artificial Sequence
  Description of Artificial Sequence: Synthetic oligonucleotide
  Target: ATXN1; (+) strand; PAM type: YTN; PAM sequence: CTA
ggaggaggctgtgttgttca

SEQ ID NO: 259489 - DNA, 20 bp, Artificial Sequence
  Description of Artificial Sequence: Synthetic oligonucleotide
  Target: ATXN1; (+) strand; PAM type: YTN; PAM sequence: CTG
tgttgttcatgtgtgaaatg

SEQ ID NO: 259490 - DNA, 20 bp, Artificial Sequence
  Description of Artificial Sequence: Synthetic oligonucleotide
  Target: ATXN1; (+) strand; PAM type: YTN; PAM sequence: TTG
ttcatgtgtgaaatggtctt

SEQ ID NO: 259491 - DNA, 20 bp, Artificial Sequence
  Description of Artificial Sequence: Synthetic oligonucleotide
  Target: ATXN1; (+) strand; PAM type: YTN; PAM sequence: TTC
atgtgtgaaatggtcttagc

SEQ ID NO: 259492 - DNA, 20 bp, Artificial Sequence
  Description of Artificial Sequence: Synthetic oligonucleotide
  Target: ATXN1; (+) strand; PAM type: YTN; PAM sequence: CTT
agccaaggagtaaaagcgcc

SEQ ID NO: 259493 - DNA, 20 bp, Artificial Sequence
  Description of Artificial Sequence: Synthetic oligonucleotide
  Target: ATXN1; (+) strand; PAM type: YTN; PAM sequence: TTA
gccaaggagtaaaagcgcca

SEQ ID NO: 259494 - DNA, 20 bp, Artificial Sequence
  Description of Artificial Sequence: Synthetic oligonucleotide
  Target: ATXN1; (+) strand; PAM type: YTN; PAM sequence: CTG
gcctgtgtgtggtggtgggg

SEQ ID NO: 259495 - DNA, 20 bp, Artificial Sequence
  Description of Artificial Sequence: Synthetic oligonucleotide
  Target: ATXN1; (+) strand; PAM type: YTN; PAM sequence: CTG
tgtgtggtggtggggccgag

SEQ ID NO: 259496 - DNA, 20 bp, Artificial Sequence
  Description of Artificial Sequence: Synthetic oligonucleotide
  Target: ATXN1; (+) strand; PAM type: YTN; PAM sequence: CTG
tatgtgtgtgtgtgtgagag

SEQ ID NO: 259497 - DNA, 20 bp, Artificial Sequence
  Description of Artificial Sequence: Synthetic oligonucleotide
  Target: ATXN1; (+) strand; PAM type: YTN; PAM sequence: CTG
gcagcaaaatctcttgctga

SEQ ID NO: 259498 - DNA, 20 bp, Artificial Sequence
  Description of Artificial Sequence: Synthetic oligonucleotide
  Target: ATXN1; (+) strand; PAM type: YTN; PAM sequence: CTC
ttgctgaaaactccaggaca

SEQ ID NO: 259499 - DNA, 20 bp, Artificial Sequence
  Description of Artificial Sequence: Synthetic oligonucleotide
  Target: ATXN1; (+) strand; PAM type: YTN; PAM sequence: CTT
gctgaaaactccaggacact

SEQ ID NO: 259500 - DNA, 20 bp, Artificial Sequence
  Description of Artificial Sequence: Synthetic oligonucleotide
  Target: ATXN1; (+) strand; PAM type: YTN; PAM sequence: TTG
ctgaaaactccaggacactt

SEQ ID NO: 259501 - DNA, 20 bp, Artificial Sequence
  Description of Artificial Sequence: Synthetic oligonucleotide
  Target: ATXN1; (+) strand; PAM type: YTN; PAM sequence: CTG
aaaactccaggacactttaa

SEQ ID NO: 259502 - DNA, 20 bp, Artificial Sequence
  Description of Artificial Sequence: Synthetic oligonucleotide
  Target: ATXN1; (+) strand; PAM type: YTN; PAM sequence: CTC
caggacactttaaccaagca

SEQ ID NO: 259503 - DNA, 20 bp, Artificial Sequence
  Description of Artificial Sequence: Synthetic oligonucleotide
  Target: ATXN1; (+) strand; PAM type: YTN; PAM sequence: CTT
taaccaagcagcccccattt

SEQ ID NO: 259504 - DNA, 20 bp, Artificial Sequence
  Description of Artificial Sequence: Synthetic oligonucleotide
  Target: ATXN1; (+) strand; PAM type: YTN; PAM sequence: TTT
aaccaagcagcccccatttg

SEQ ID NO: 259505 - DNA, 20 bp, Artificial Sequence
  Description of Artificial Sequence: Synthetic oligonucleotide
  Target: ATXN1; (+) strand; PAM type: YTN; PAM sequence: TTA
accaagcagcccccatttgt

SEQ ID NO: 259506 - DNA, 20 bp, Artificial Sequence
  Description of Artificial Sequence: Synthetic oligonucleotide
  Target: ATXN1; (+) strand; PAM type: YTN; PAM sequence: TTT
gtacatctctgtctatctct

SEQ ID NO: 259507 - DNA, 20 bp, Artificial Sequence
  Description of Artificial Sequence: Synthetic oligonucleotide
  Target: ATXN1; (+) strand; PAM type: YTN; PAM sequence: TTG
tacatctctgtctatctctg

SEQ ID NO: 259508 - DNA, 20 bp, Artificial Sequence
  Description of Artificial Sequence: Synthetic oligonucleotide
  Target: ATXN1; (+) strand; PAM type: YTN; PAM sequence: CTC
tgtctatctctgtctctctg

SEQ ID NO: 259509 - DNA, 20 bp, Artificial Sequence
  Description of Artificial Sequence: Synthetic oligonucleotide
  Target: ATXN1; (+) strand; PAM type: YTN; PAM sequence: CTG
tctatctctgtctctctgtc

SEQ ID NO: 259510 - DNA, 20 bp, Artificial Sequence
  Description of Artificial Sequence: Synthetic oligonucleotide
  Target: ATXN1; (+) strand; PAM type: YTN; PAM sequence: CTA
tctctgtctctctgtcttgt

SEQ ID NO: 259511 - DNA, 20 bp, Artificial Sequence
  Description of Artificial Sequence: Synthetic oligonucleotide
  Target: ATXN1; (+) strand; PAM type: YTN; PAM sequence: CTC
tgtctctctgtcttgttttt

SEQ ID NO: 259512 - DNA, 20 bp, Artificial Sequence
  Description of Artificial Sequence: Synthetic oligonucleotide
  Target: ATXN1; (+) strand; PAM type: YTN; PAM sequence: CTG
tctctctgtcttgttttttc

SEQ ID NO: 259513 - DNA, 20 bp, Artificial Sequence
  Description of Artificial Sequence: Synthetic oligonucleotide
  Target: ATXN1; (+) strand; PAM type: YTN; PAM sequence: CTC
tctgtcttgttttttccttt

SEQ ID NO: 259514 - DNA, 20 bp, Artificial Sequence
  Description of Artificial Sequence: Synthetic oligonucleotide
  Target: ATXN1; (+) strand; PAM type: YTN; PAM sequence: CTC
tgtcttgttttttcctttct

SEQ ID NO: 259515 - DNA, 20 bp, Artificial Sequence
  Description of Artificial Sequence: Synthetic oligonucleotide
  Target: ATXN1; (+) strand; PAM type: YTN; PAM sequence: CTG
tcttgttttttcctttcttg

SEQ ID NO: 259516 - DNA, 20 bp, Artificial Sequence
  Description of Artificial Sequence: Synthetic oligonucleotide
  Target: ATXN1; (+) strand; PAM type: YTN; PAM sequence: CTT
gttttttcctttcttgtttc

SEQ ID NO: 259517 - DNA, 20 bp, Artificial Sequence
  Description of Artificial Sequence: Synthetic oligonucleotide
  Target: ATXN1; (+) strand; PAM type: YTN; PAM sequence: TTG
ttttttcctttcttgtttcc

SEQ ID NO: 259518 - DNA, 20 bp, Artificial Sequence
  Description of Artificial Sequence: Synthetic oligonucleotide
  Target: ATXN1; (+) strand; PAM type: YTN; PAM sequence: TTT
tttcctttcttgtttccctc

SEQ ID NO: 259519 - DNA, 20 bp, Artificial Sequence
  Description of Artificial Sequence: Synthetic oligonucleotide
  Target: ATXN1; (+) strand; PAM type: YTN; PAM sequence: TTT
ttcctttcttgtttccctcc

SEQ ID NO: 259520 - DNA, 20 bp, Artificial Sequence
  Description of Artificial Sequence: Synthetic oligonucleotide
  Target: ATXN1; (+) strand; PAM type: YTN; PAM sequence: TTT
tcctttcttgtttccctccc

SEQ ID NO: 259521 - DNA, 20 bp, Artificial Sequence
  Description of Artificial Sequence: Synthetic oligonucleotide
  Target: ATXN1; (+) strand; PAM type: YTN; PAM sequence: TTT
cctttcttgtttccctcccc

SEQ ID NO: 259522 - DNA, 20 bp, Artificial Sequence
  Description of Artificial Sequence: Synthetic oligonucleotide
  Target: ATXN1; (+) strand; PAM type: YTN; PAM sequence: TTC
ctttcttgtttccctccccc

SEQ ID NO: 259523 - DNA, 20 bp, Artificial Sequence
  Description of Artificial Sequence: Synthetic oligonucleotide
  Target: ATXN1; (+) strand; PAM type: YTN; PAM sequence: CTT
tcttgtttccctccccctct

SEQ ID NO: 259524 - DNA, 20 bp, Artificial Sequence
  Description of Artificial Sequence: Synthetic oligonucleotide
  Target: ATXN1; (+) strand; PAM type: YTN; PAM sequence: TTT
cttgtttccctccccctcta

SEQ ID NO: 259525 - DNA, 20 bp, Artificial Sequence
  Description of Artificial Sequence: Synthetic oligonucleotide
  Target: ATXN1; (+) strand; PAM type: YTN; PAM sequence: TTC
ttgtttccctccccctctat

SEQ ID NO: 259526 - DNA, 20 bp, Artificial Sequence
  Description of Artificial Sequence: Synthetic oligonucleotide
  Target: ATXN1; (+) strand; PAM type: YTN; PAM sequence: CTT
gtttccctccccctctatcc

SEQ ID NO: 259527 - DNA, 20 bp, Artificial Sequence
  Description of Artificial Sequence: Synthetic oligonucleotide
  Target: ATXN1; (+) strand; PAM type: YTN; PAM sequence: TTG
tttccctccccctctatcca

SEQ ID NO: 259528 - DNA, 20 bp, Artificial Sequence
  Description of Artificial Sequence: Synthetic oligonucleotide
  Target: ATXN1; (+) strand; PAM type: YTN; PAM sequence: TTT
ccctccccctctatccagca

SEQ ID NO: 259529 - DNA, 20 bp, Artificial Sequence
  Description of Artificial Sequence: Synthetic oligonucleotide
  Target: ATXN1; (+) strand; PAM type: YTN; PAM sequence: TTC
cctccccctctatccagcat

SEQ ID NO: 259530 - DNA, 20 bp, Artificial Sequence
  Description of Artificial Sequence: Synthetic oligonucleotide
  Target: ATXN1; (+) strand; PAM type: YTN; PAM sequence: CTC
cccctctatccagcatcccc

SEQ ID NO: 259531 - DNA, 20 bp, Artificial Sequence
  Description of Artificial Sequence: Synthetic oligonucleotide
  Target: ATXN1; (+) strand; PAM type: YTN; PAM sequence: CTC
tatccagcatccccttgctg

SEQ ID NO: 259532 - DNA, 20 bp, Artificial Sequence
  Description of Artificial Sequence: Synthetic oligonucleotide
  Target: ATXN1; (+) strand; PAM type: YTN; PAM sequence: CTA
tccagcatccccttgctgct

SEQ ID NO: 259533 - DNA, 20 bp, Artificial Sequence
  Description of Artificial Sequence: Synthetic oligonucleotide
  Target: ATXN1; (+) strand; PAM type: YTN; PAM sequence: CTT
gctgctttaaccttttcccc

SEQ ID NO: 259534 - DNA, 20 bp, Artificial Sequence
  Description of Artificial Sequence: Synthetic oligonucleotide
  Target: ATXN1; (+) strand; PAM type: YTN; PAM sequence: TTG
ctgctttaaccttttccccc

SEQ ID NO: 259535 - DNA, 20 bp, Artificial Sequence
  Description of Artificial Sequence: Synthetic oligonucleotide
  Target: ATXN1; (+) strand; PAM type: YTN; PAM sequence: CTG
ctttaaccttttcccccatc

SEQ ID NO: 259536 - DNA, 20 bp, Artificial Sequence
  Description of Artificial Sequence: Synthetic oligonucleotide
  Target: ATXN1; (+) strand; PAM type: YTN; PAM sequence: CTT
taaccttttcccccatctct

SEQ ID NO: 259537 - DNA, 20 bp, Artificial Sequence
  Description of Artificial Sequence: Synthetic oligonucleotide
  Target: ATXN1; (+) strand; PAM type: YTN; PAM sequence: TTT
aaccttttcccccatctctt

SEQ ID NO: 259538 - DNA, 20 bp, Artificial Sequence
  Description of Artificial Sequence: Synthetic oligonucleotide
  Target: ATXN1; (+) strand; PAM type: YTN; PAM sequence: TTA
accttttcccccatctctta

SEQ ID NO: 259539 - DNA, 20 bp, Artificial Sequence
  Description of Artificial Sequence: Synthetic oligonucleotide
  Target: ATXN1; (+) strand; PAM type: YTN; PAM sequence: CTT
ttcccccatctcttagatgt

SEQ ID NO: 259540 - DNA, 20 bp, Artificial Sequence
  Description of Artificial Sequence: Synthetic oligonucleotide
  Target: ATXN1; (+) strand; PAM type: YTN; PAM sequence: TTT
tcccccatctcttagatgta

SEQ ID NO: 259541 - DNA, 20 bp, Artificial Sequence
  Description of Artificial Sequence: Synthetic oligonucleotide
  Target: ATXN1; (+) strand; PAM type: YTN; PAM sequence: TTT
cccccatctcttagatgtat

SEQ ID NO: 259542 - DNA, 20 bp, Artificial Sequence
  Description of Artificial Sequence: Synthetic oligonucleotide
  Target: ATXN1; (+) strand; PAM type: YTN; PAM sequence: TTC
ccccatctcttagatgtatc

SEQ ID NO: 259543 - DNA, 20 bp, Artificial Sequence
  Description of Artificial Sequence: Synthetic oligonucleotide
  Target: ATXN1; (+) strand; PAM type: YTN; PAM sequence: CTC
ttagatgtatcttgtcctgt

SEQ ID NO: 259544 - DNA, 20 bp, Artificial Sequence
  Description of Artificial Sequence: Synthetic oligonucleotide
  Target: ATXN1; (+) strand; PAM type: YTN; PAM sequence: CTT
agatgtatcttgtcctgtgg

SEQ ID NO: 259545 - DNA, 20 bp, Artificial Sequence
  Description of Artificial Sequence: Synthetic oligonucleotide
  Target: ATXN1; (+) strand; PAM type: YTN; PAM sequence: TTA
gatgtatcttgtcctgtgga

SEQ ID NO: 259546 - DNA, 20 bp, Artificial Sequence
  Description of Artificial Sequence: Synthetic oligonucleotide
  Target: ATXN1; (+) strand; PAM type: YTN; PAM sequence: CTT
gtcctgtggaactataagat

SEQ ID NO: 259547 - DNA, 20 bp, Artificial Sequence
  Description of Artificial Sequence: Synthetic oligonucleotide
  Target: ATXN1; (+) strand; PAM type: YTN; PAM sequence: TTG
tcctgtggaactataagatc

SEQ ID NO: 259548 - DNA, 20 bp, Artificial Sequence
  Description of Artificial Sequence: Synthetic oligonucleotide
  Target: ATXN1; (+) strand; PAM type: YTN; PAM sequence: CTG
tggaactataagatccaaaa

SEQ ID NO: 259549 - DNA, 20 bp, Artificial Sequence
  Description of Artificial Sequence: Synthetic oligonucleotide
  Target: ATXN1; (+) strand; PAM type: YTN; PAM sequence: CTA
taagatccaaaaactggggg

SEQ ID NO: 259550 - DNA, 20 bp, Artificial Sequence
  Description of Artificial Sequence: Synthetic oligonucleotide
  Target: ATXN1; (+) strand; PAM type: YTN; PAM sequence: CTG
ggggaaagaaaaaaaaaaaa

SEQ ID NO: 259551 - DNA, 20 bp, Artificial Sequence
  Description of Artificial Sequence: Synthetic oligonucleotide
  Target: ATXN1; (+) strand; PAM type: YTN; PAM sequence: TTA
aagtggccagaaaataatct

SEQ ID NO: 259552 - DNA, 20 bp, Artificial Sequence
  Description of Artificial Sequence: Synthetic oligonucleotide
  Target: ATXN1; (+) strand; PAM type: YTN; PAM sequence: CTG
ccagcagaggccaagctcag

SEQ ID NO: 259553 - DNA, 20 bp, Artificial Sequence
  Description of Artificial Sequence: Synthetic oligonucleotide
  Target: ATXN1; (+) strand; PAM type: YTN; PAM sequence: CTC
agaacaagcccttcaatgcc

SEQ ID NO: 259554 - DNA, 20 bp, Artificial Sequence
  Description of Artificial Sequence: Synthetic oligonucleotide
  Target: ATXN1; (+) strand; PAM type: YTN; PAM sequence: CTT
caatgccgctcacctaaagc

SEQ ID NO: 259555 - DNA, 20 bp, Artificial Sequence
  Description of Artificial Sequence: Synthetic oligonucleotide
  Target: ATXN1; (+) strand; PAM type: YTN; PAM sequence: TTC
aatgccgctcacctaaagcc

SEQ ID NO: 259556 - DNA, 20 bp, Artificial Sequence
  Description of Artificial Sequence: Synthetic oligonucleotide
  Target: ATXN1; (+) strand; PAM type: YTN; PAM sequence: CTC
acctaaagccccgccccctc

SEQ ID NO: 259557 - DNA, 20 bp, Artificial Sequence
  Description of Artificial Sequence: Synthetic oligonucleotide
  Target: ATXN1; (+) strand; PAM type: YTN; PAM sequence: CTA
aagccccgccccctcaccaa

SEQ ID NO: 259558 - DNA, 20 bp, Artificial Sequence
  Description of Artificial Sequence: Synthetic oligonucleotide
  Target: ATXN1; (+) strand; PAM type: YTN; PAM sequence: CTC
accaataaagtctattctca

SEQ ID NO: 259559 - DNA, 20 bp, Artificial Sequence
  Description of Artificial Sequence: Synthetic oligonucleotide
  Target: ATXN1; (+) strand; PAM type: YTN; PAM sequence: CTA
ttctcatggaccagattgta

SEQ ID NO: 259560 - DNA, 20 bp, Artificial Sequence
  Description of Artificial Sequence: Synthetic oligonucleotide
  Target: ATXN1; (+) strand; PAM type: YTN; PAM sequence: TTC
tcatggaccagattgtatgt

SEQ ID NO: 259561 - DNA, 20 bp, Artificial Sequence
  Description of Artificial Sequence: Synthetic oligonucleotide
  Target: ATXN1; (+) strand; PAM type: YTN; PAM sequence: CTC
atggaccagattgtatgtcg

SEQ ID NO: 259562 - DNA, 20 bp, Artificial Sequence
  Description of Artificial Sequence: Synthetic oligonucleotide
  Target: ATXN1; (+) strand; PAM type: YTN; PAM sequence: TTG
tatgtcggagaagagcagga

SEQ ID NO: 259563 - DNA, 20 bp, Artificial Sequence
  Description of Artificial Sequence: Synthetic oligonucleotide
  Target: ATXN1; (+) strand; PAM type: YTN; PAM sequence: CTT
tgtggatggacacggtctag

SEQ ID NO: 259564 - DNA, 20 bp, Artificial Sequence
  Description of Artificial Sequence: Synthetic oligonucleotide
  Target: ATXN1; (+) strand; PAM type: YTN; PAM sequence: TTT
gtggatggacacggtctaga

SEQ ID NO: 259565 - DNA, 20 bp, Artificial Sequence
  Description of Artificial Sequence: Synthetic oligonucleotide
  Target: ATXN1; (+) strand; PAM type: YTN; PAM sequence: TTG
tggatggacacggtctagat

SEQ ID NO: 259566 - DNA, 20 bp, Artificial Sequence
  Description of Artificial Sequence: Synthetic oligonucleotide
  Target: ATXN1; (+) strand; PAM type: YTN; PAM sequence: CTA
gatccagacatggaactctc

SEQ ID NO: 259567 - DNA, 20 bp, Artificial Sequence
  Description of Artificial Sequence: Synthetic oligonucleotide
  Target: ATXN1; (+) strand; PAM type: YTN; PAM sequence: CTC
tccatgtccttgactggggg

SEQ ID NO: 259568 - DNA, 20 bp, Artificial Sequence
  Description of Artificial Sequence: Synthetic oligonucleotide
  Target: ATXN1; (+) strand; PAM type: YTN; PAM sequence: CTC
catgtccttgactgggggcc

SEQ ID NO: 259569 - DNA, 20 bp, Artificial Sequence
  Description of Artificial Sequence: Synthetic oligonucleotide
  Target: ATXN1; (+) strand; PAM type: YTN; PAM sequence: CTT
gactgggggccatgcttctc

SEQ ID NO: 259570 - DNA, 20 bp, Artificial Sequence
  Description of Artificial Sequence: Synthetic oligonucleotide
  Target: ATXN1; (+) strand; PAM type: YTN; PAM sequence: TTG
actgggggccatgcttctct

SEQ ID NO: 259571 - DNA, 20 bp, Artificial Sequence
  Description of Artificial Sequence: Synthetic oligonucleotide
  Target: ATXN1; (+) strand; PAM type: YTN; PAM sequence: CTG
ggggccatgcttctctccag

SEQ ID NO: 259572 - DNA, 20 bp, Artificial Sequence
  Description of Artificial Sequence: Synthetic oligonucleotide
  Target: ATXN1; (+) strand; PAM type: YTN; PAM sequence: CTT
ctctccagtacagatgtggc

SEQ ID NO: 259573 - DNA, 20 bp, Artificial Sequence
  Description of Artificial Sequence: Synthetic oligonucleotide
  Target: ATXN1; (+) strand; PAM type: YTN; PAM sequence: TTC
tctccagtacagatgtggca

SEQ ID NO: 259574 - DNA, 20 bp, Artificial Sequence
  Description of Artificial Sequence: Synthetic oligonucleotide
  Target: ATXN1; (+) strand; PAM type: YTN; PAM sequence: CTC
tccagtacagatgtggcaga

SEQ ID NO: 259575 - DNA, 20 bp, Artificial Sequence
  Description of Artificial Sequence: Synthetic oligonucleotide
  Target: ATXN1; (+) strand; PAM type: YTN; PAM sequence: CTC
cagtacagatgtggcagaca

SEQ ID NO: 259576 - DNA, 20 bp, Artificial Sequence
  Description of Artificial Sequence: Synthetic oligonucleotide
  Target: ATXN1; (+) strand; PAM type: YTN; PAM sequence: CTT
cccaagcattcgaattgttc

SEQ ID NO: 259577 - DNA, 20 bp, Artificial Sequence
  Description of Artificial Sequence: Synthetic oligonucleotide
  Target: ATXN1; (+) strand; PAM type: YTN; PAM sequence: TTC
ccaagcattcgaattgttct

SEQ ID NO: 259578 - DNA, 20 bp, Artificial Sequence
  Description of Artificial Sequence: Synthetic oligonucleotide
  Target: ATXN1; (+) strand; PAM type: YTN; PAM sequence: TTC
gaattgttcttttaaggtta

SEQ ID NO: 259579 - DNA, 20 bp, Artificial Sequence
  Description of Artificial Sequence: Synthetic oligonucleotide
  Target: ATXN1; (+) strand; PAM type: YTN; PAM sequence: TTG
ttcttttaaggttaaggtaa

SEQ ID NO: 259580 - DNA, 20 bp, Artificial Sequence
  Description of Artificial Sequence: Synthetic oligonucleotide
  Target: ATXN1; (+) strand; PAM type: YTN; PAM sequence: TTC
ttttaaggttaaggtaaacc

SEQ ID NO: 259581 - DNA, 20 bp, Artificial Sequence
  Description of Artificial Sequence: Synthetic oligonucleotide
  Target: ATXN1; (+) strand; PAM type: YTN; PAM sequence: CTT
ttaaggttaaggtaaaccag

SEQ ID NO: 259582 - DNA, 20 bp, Artificial Sequence
  Description of Artificial Sequence: Synthetic oligonucleotide
  Target: ATXN1; (+) strand; PAM type: YTN; PAM sequence: TTT
taaggttaaggtaaaccagg

SEQ ID NO: 259583 - DNA, 20 bp, Artificial Sequence
  Description of Artificial Sequence: Synthetic oligonucleotide
  Target: ATXN1; (+) strand; PAM type: YTN; PAM sequence: TTT
aaggttaaggtaaaccaggg

SEQ ID NO: 259584 - DNA, 20 bp, Artificial Sequence
  Description of Artificial Sequence: Synthetic oligonucleotide
  Target: ATXN1; (+) strand; PAM type: YTN; PAM sequence: TTA
aggttaaggtaaaccagggt

SEQ ID NO: 259585 - DNA, 20 bp, Artificial Sequence
  Description of Artificial Sequence: Synthetic oligonucleotide
  Target: ATXN1; (+) strand; PAM type: YTN; PAM sequence: TTA
aggtaaaccagggtttctca

SEQ ID NO: 259586 - DNA, 20 bp, Artificial Sequence
  Description of Artificial Sequence: Synthetic oligonucleotide
  Target: ATXN1; (+) strand; PAM type: YTN; PAM sequence: TTT
ctcagccttggcactgttga

SEQ ID NO: 259587 - DNA, 20 bp, Artificial Sequence
  Description of Artificial Sequence: Synthetic oligonucleotide
  Target: ATXN1; (+) strand; PAM type: YTN; PAM sequence: TTC
tcagccttggcactgttgac

SEQ ID NO: 259588 - DNA, 20 bp, Artificial Sequence
  Description of Artificial Sequence: Synthetic oligonucleotide
  Target: ATXN1; (+) strand; PAM type: YTN; PAM sequence: CTC
agccttggcactgttgacat

SEQ ID NO: 259589 - DNA, 20 bp, Artificial Sequence
  Description of Artificial Sequence: Synthetic oligonucleotide
  Target: ATXN1; (+) strand; PAM type: YTN; PAM sequence: CTT
ggcactgttgacatcttgtg

SEQ ID NO: 259590 - DNA, 20 bp, Artificial Sequence
  Description of Artificial Sequence: Synthetic oligonucleotide
  Target: ATXN1; (+) strand; PAM type: YTN; PAM sequence: TTG
gcactgttgacatcttgtgc

SEQ ID NO: 259591 - DNA, 20 bp, Artificial Sequence
  Description of Artificial Sequence: Synthetic oligonucleotide
  Target: ATXN1; (+) strand; PAM type: YTN; PAM sequence: CTG
ttgacatcttgtgctggatg

SEQ ID NO: 259592 - DNA, 20 bp, Artificial Sequence
  Description of Artificial Sequence: Synthetic oligonucleotide
  Target: ATXN1; (+) strand; PAM type: YTN; PAM sequence: TTG
acatcttgtgctggatgatt

SEQ ID NO: 259593 - DNA, 20 bp, Artificial Sequence
  Description of Artificial Sequence: Synthetic oligonucleotide
  Target: ATXN1; (+) strand; PAM type: YTN; PAM sequence: CTT
gtgctggatgattctttgtg

SEQ ID NO: 259594 - DNA, 20 bp, Artificial Sequence
  Description of Artificial Sequence: Synthetic oligonucleotide
  Target: ATXN1; (+) strand; PAM type: YTN; PAM sequence: TTG
tgctggatgattctttgtgg

SEQ ID NO: 259595 - DNA, 20 bp, Artificial Sequence
  Description of Artificial Sequence: Synthetic oligonucleotide
  Target: ATXN1; (+) strand; PAM type: YTN; PAM sequence: CTG
gatgattctttgtggtgggg

SEQ ID NO: 259596 - DNA, 20 bp, Artificial Sequence
  Description of Artificial Sequence: Synthetic oligonucleotide
  Target: ATXN1; (+) strand; PAM type: YTN; PAM sequence: TTC
tttgtggtgggggctgtcct

SEQ ID NO: 259597 - DNA, 20 bp, Artificial Sequence
  Description of Artificial Sequence: Synthetic oligonucleotide
  Target: ATXN1; (+) strand; PAM type: YTN; PAM sequence: CTT
tgtggtgggggctgtcctgt

SEQ ID NO: 259598 - DNA, 20 bp, Artificial Sequence
  Description of Artificial Sequence: Synthetic oligonucleotide
  Target: ATXN1; (+) strand; PAM type: YTN; PAM sequence: TTT
gtggtgggggctgtcctgtg

SEQ ID NO: 259599 - DNA, 20 bp, Artificial Sequence
  Description of Artificial Sequence: Synthetic oligonucleotide
  Target: ATXN1; (+) strand; PAM type: YTN; PAM sequence: TTG
tggtgggggctgtcctgtgt

SEQ ID NO: 259600 - DNA, 20 bp, Artificial Sequence
  Description of Artificial Sequence: Synthetic oligonucleotide
  Target: ATXN1; (+) strand; PAM type: YTN; PAM sequence: CTG
tcctgtgtgttgcaggatgt

SEQ ID NO: 259601 - DNA, 20 bp, Artificial Sequence
  Description of Artificial Sequence: Synthetic oligonucleotide
  Target: ATXN1; (+) strand; PAM type: YTN; PAM sequence: CTG
tgtgttgcaggatgtttagc

SEQ ID NO: 259602 - DNA, 20 bp, Artificial Sequence
  Description of Artificial Sequence: Synthetic oligonucleotide
  Target: ATXN1; (+) strand; PAM type: YTN; PAM sequence: TTG
caggatgtttagcagcattc

SEQ ID NO: 259603 - DNA, 20 bp, Artificial Sequence
  Description of Artificial Sequence: Synthetic oligonucleotide
  Target: ATXN1; (+) strand; PAM type: YTN; PAM sequence: TTT
agcagcattcctcacttcta

SEQ ID NO: 259604 - DNA, 20 bp, Artificial Sequence
  Description of Artificial Sequence: Synthetic oligonucleotide
  Target: ATXN1; (+) strand; PAM type: YTN; PAM sequence: TTA
gcagcattcctcacttctac

SEQ ID NO: 259605 - DNA, 20 bp, Artificial Sequence
  Description of Artificial Sequence: Synthetic oligonucleotide
  Target: ATXN1; (+) strand; PAM type: YTN; PAM sequence: TTC
ctcacttctactcactagat

SEQ ID NO: 259606 - DNA, 20 bp, Artificial Sequence
  Description of Artificial Sequence: Synthetic oligonucleotide
  Target: ATXN1; (+) strand; PAM type: YTN; PAM sequence: CTC
acttctactcactagatgct

SEQ ID NO: 259607 - DNA, 20 bp, Artificial Sequence
  Description of Artificial Sequence: Synthetic oligonucleotide
  Target: ATXN1; (+) strand; PAM type: YTN; PAM sequence: CTT
ctactcactagatgctggta

SEQ ID NO: 259608 - DNA, 20 bp, Artificial Sequence
  Description of Artificial Sequence: Synthetic oligonucleotide
  Target: ATXN1; (+) strand; PAM type: YTN; PAM sequence: TTC
tactcactagatgctggtag

SEQ ID NO: 259609 - DNA, 20 bp, Artificial Sequence
  Description of Artificial Sequence: Synthetic oligonucleotide
  Target: ATXN1; (+) strand; PAM type: YTN; PAM sequence: CTA
ctcactagatgctggtagct

SEQ ID NO: 259610 - DNA, 20 bp, Artificial Sequence
  Description of Artificial Sequence: Synthetic oligonucleotide
  Target: ATXN1; (+) strand; PAM type: YTN; PAM sequence: CTC
actagatgctggtagctcct

SEQ ID NO: 259611 - DNA, 20 bp, Artificial Sequence
  Description of Artificial Sequence: Synthetic oligonucleotide
  Target: ATXN1; (+) strand; PAM type: YTN; PAM sequence: CTA
gatgctggtagctcctcccc

SEQ ID NO: 259612 - DNA, 20 bp, Artificial Sequence
  Description of Artificial Sequence: Synthetic oligonucleotide
  Target: ATXN1; (+) strand; PAM type: YTN; PAM sequence: CTG
gtagctcctccccagtcgtg

SEQ ID NO: 259613 - DNA, 20 bp, Artificial Sequence
  Description of Artificial Sequence: Synthetic oligonucleotide
  Target: ATXN1; (+) strand; PAM type: YTN; PAM sequence: CTC
ctccccagtcgtgacaagca

SEQ ID NO: 259614 - DNA, 20 bp, Artificial Sequence
  Description of Artificial Sequence: Synthetic oligonucleotide
  Target: ATXN1; (+) strand; PAM type: YTN; PAM sequence: CTC
cccagtcgtgacaagcaaaa

SEQ ID NO: 259615 - DNA, 20 bp, Artificial Sequence
  Description of Artificial Sequence: Synthetic oligonucleotide
  Target: ATXN1; (+) strand; PAM type: YTN; PAM sequence: CTT
cagacattcagacattgcca

SEQ ID NO: 259616 - DNA, 20 bp, Artificial Sequence
  Description of Artificial Sequence: Synthetic oligonucleotide
  Target: ATXN1; (+) strand; PAM type: YTN; PAM sequence: TTC
agacattcagacattgccaa

SEQ ID NO: 259617 - DNA, 20 bp, Artificial Sequence
  Description of Artificial Sequence: Synthetic oligonucleotide
  Target: ATXN1; (+) strand; PAM type: YTN; PAM sequence: TTC
agacattgccaacttgccca

SEQ ID NO: 259618 - DNA, 20 bp, Artificial Sequence
  Description of Artificial Sequence: Synthetic oligonucleotide
  Target: ATXN1; (+) strand; PAM type: YTN; PAM sequence: TTG
ccaacttgcccacggcggag

SEQ ID NO: 259619 - DNA, 20 bp, Artificial Sequence
  Description of Artificial Sequence: Synthetic oligonucleotide
  Target: ATXN1; (+) strand; PAM type: YTN; PAM sequence: CTT
gcccacggcggagggagcaa

SEQ ID NO: 259620 - DNA, 20 bp, Artificial Sequence
  Description of Artificial Sequence: Synthetic oligonucleotide
  Target: ATXN1; (+) strand; PAM type: YTN; PAM sequence: TTG
cccacggcggagggagcaaa

SEQ ID NO: 259621 - DNA, 20 bp, Artificial Sequence
  Description of Artificial Sequence: Synthetic oligonucleotide
  Target: ATXN1; (+) strand; PAM type: YTN; PAM sequence: TTA
gaatcacggaggtaaatttt

SEQ ID NO: 259622 - DNA, 20 bp, Artificial Sequence
  Description of Artificial Sequence: Synthetic oligonucleotide
  Target: ATXN1; (+) strand; PAM type: YTN; PAM sequence: TTT
tatagagagttggctggttc

SEQ ID NO: 259623 - DNA, 20 bp, Artificial Sequence
  Description of Artificial Sequence: Synthetic oligonucleotide
  Target: ATXN1; (+) strand; PAM type: YTN; PAM sequence: TTT
atagagagttggctggttct

SEQ ID NO: 259624 - DNA, 20 bp, Artificial Sequence
  Description of Artificial Sequence: Synthetic oligonucleotide
  Target: ATXN1; (+) strand; PAM type: YTN; PAM sequence: TTA
tagagagttggctggttcta

SEQ ID NO: 259625 - DNA, 20 bp, Artificial Sequence
  Description of Artificial Sequence: Synthetic oligonucleotide
  Target: ATXN1; (+) strand; PAM type: YTN; PAM sequence: TTG
gctggttctaagtggaaaac

SEQ ID NO: 259626 - DNA, 20 bp, Artificial Sequence
  Description of Artificial Sequence: Synthetic oligonucleotide
  Target: ATXN1; (+) strand; PAM type: YTN; PAM sequence: CTG
gttctaagtggaaaactact

SEQ ID NO: 259627 - DNA, 20 bp, Artificial Sequence
  Description of Artificial Sequence: Synthetic oligonucleotide
  Target: ATXN1; (+) strand; PAM type: YTN; PAM sequence: TTC
taagtggaaaactactctct

SEQ ID NO: 259628 - DNA, 20 bp, Artificial Sequence
  Description of Artificial Sequence: Synthetic oligonucleotide
  Target: ATXN1; (+) strand; PAM type: YTN; PAM sequence: CTA
agtggaaaactactctctta

SEQ ID NO: 259629 - DNA, 20 bp, Artificial Sequence
  Description of Artificial Sequence: Synthetic oligonucleotide
  Target: ATXN1; (+) strand; PAM type: YTN; PAM sequence: CTA
ctctcttattgcatgaaggt

SEQ ID NO: 259630 - DNA, 20 bp, Artificial Sequence
  Description of Artificial Sequence: Synthetic oligonucleotide
  Target: ATXN1; (+) strand; PAM type: YTN; PAM sequence: CTC
tcttattgcatgaaggttaa

SEQ ID NO: 259631 - DNA, 20 bp, Artificial Sequence
  Description of Artificial Sequence: Synthetic oligonucleotide
  Target: ATXN1; (+) strand; PAM type: YTN; PAM sequence: CTC
ttattgcatgaaggttaaat

SEQ ID NO: 259632 - DNA, 20 bp, Artificial Sequence
  Description of Artificial Sequence: Synthetic oligonucleotide
  Target: ATXN1; (+) strand; PAM type: YTN; PAM sequence: CTT
attgcatgaaggttaaatgc

SEQ ID NO: 259633 - DNA, 20 bp, Artificial Sequence
  Description of Artificial Sequence: Synthetic oligonucleotide
  Target: ATXN1; (+) strand; PAM type: YTN; PAM sequence: TTA
ttgcatgaaggttaaatgca

SEQ ID NO: 259634 - DNA, 20 bp, Artificial Sequence
  Description of Artificial Sequence: Synthetic oligonucleotide
  Target: ATXN1; (+) strand; PAM type: YTN; PAM sequence: TTG
catgaaggttaaatgcactc

SEQ ID NO: 259635 - DNA, 20 bp, Artificial Sequence
  Description of Artificial Sequence: Synthetic oligonucleotide
  Target: ATXN1; (+) strand; PAM type: YTN; PAM sequence: TTA
aatgcactcacatgtgacac

SEQ ID NO: 259636 - DNA, 20 bp, Artificial Sequence
  Description of Artificial Sequence: Synthetic oligonucleotide
  Target: ATXN1; (+) strand; PAM type: YTN; PAM sequence: CTC
acatgtgacacacactcaca

SEQ ID NO: 259637 - DNA, 20 bp, Artificial Sequence
  Description of Artificial Sequence: Synthetic oligonucleotide
  Target: ATXN1; (+) strand; PAM type: YTN; PAM sequence: CTC
acattcataaacacacacac

SEQ ID NO: 259638 - DNA, 20 bp, Artificial Sequence
  Description of Artificial Sequence: Synthetic oligonucleotide
  Target: ATXN1; (+) strand; PAM type: YTN; PAM sequence: TTC
ataaacacacacacgataca

SEQ ID NO: 259639 - DNA, 20 bp, Artificial Sequence
  Description of Artificial Sequence: Synthetic oligonucleotide
  Target: ATXN1; (+) strand; PAM type: YTN; PAM sequence: CTA
agacagagtggtcctcgttt

SEQ ID NO: 259640 - DNA, 20 bp, Artificial Sequence
  Description of Artificial Sequence: Synthetic oligonucleotide
  Target: ATXN1; (+) strand; PAM type: YTN; PAM sequence: CTC
gtttctgatttttccacact

SEQ ID NO: 259641 - DNA, 20 bp, Artificial Sequence
  Description of Artificial Sequence: Synthetic oligonucleotide
  Target: ATXN1; (+) strand; PAM type: YTN; PAM sequence: TTT
ctgatttttccacactttca

SEQ ID NO: 259642 - DNA, 20 bp, Artificial Sequence
  Description of Artificial Sequence: Synthetic oligonucleotide
  Target: ATXN1; (+) strand; PAM type: YTN; PAM sequence: TTC
tgatttttccacactttcat

SEQ ID NO: 259643 - DNA, 20 bp, Artificial Sequence
  Description of Artificial Sequence: Synthetic oligonucleotide
  Target: ATXN1; (+) strand; PAM type: YTN; PAM sequence: CTG
atttttccacactttcattt

SEQ ID NO: 259644 - DNA, 20 bp, Artificial Sequence
  Description of Artificial Sequence: Synthetic oligonucleotide
  Target: ATXN1; (+) strand; PAM type: YTN; PAM sequence: TTT
ttccacactttcatttgcct

SEQ ID NO: 259645 - DNA, 20 bp, Artificial Sequence
  Description of Artificial Sequence: Synthetic oligonucleotide
  Target: ATXN1; (+) strand; PAM type: YTN; PAM sequence: TTT
tccacactttcatttgcctg

SEQ ID NO: 259646 - DNA, 20 bp, Artificial Sequence
  Description of Artificial Sequence: Synthetic oligonucleotide
  Target: ATXN1; (+) strand; PAM type: YTN; PAM sequence: TTT
ccacactttcatttgcctga

SEQ ID NO: 259647 - DNA, 20 bp, Artificial Sequence
  Description of Artificial Sequence: Synthetic oligonucleotide
  Target: ATXN1; (+) strand; PAM type: YTN; PAM sequence: TTC
cacactttcatttgcctgat

SEQ ID NO: 259648 - DNA, 20 bp, Artificial Sequence
  Description of Artificial Sequence: Synthetic oligonucleotide
  Target: ATXN1; (+) strand; PAM type: YTN; PAM sequence: CTT
tcatttgcctgatttgttgt

SEQ ID NO: 259649 - DNA, 20 bp, Artificial Sequence
  Description of Artificial Sequence: Synthetic oligonucleotide
  Target: ATXN1; (+) strand; PAM type: YTN; PAM sequence: TTT
catttgcctgatttgttgta

SEQ ID NO: 259650 - DNA, 20 bp, Artificial Sequence
  Description of Artificial Sequence: Synthetic oligonucleotide
  Target: ATXN1; (+) strand; PAM type: YTN; PAM sequence: TTC
atttgcctgatttgttgtaa

SEQ ID NO: 259651 - DNA, 20 bp, Artificial Sequence
  Description of Artificial Sequence: Synthetic oligonucleotide
  Target: ATXN1; (+) strand; PAM type: YTN; PAM sequence: TTT
gcctgatttgttgtaaatgc

SEQ ID NO: 259652 - DNA, 20 bp, Artificial Sequence
  Description of Artificial Sequence: Synthetic oligonucleotide
  Target: ATXN1; (+) strand; PAM type: YTN; PAM sequence: TTG
cctgatttgttgtaaatgcc

SEQ ID NO: 259653 - DNA, 20 bp, Artificial Sequence
  Description of Artificial Sequence: Synthetic oligonucleotide
  Target: ATXN1; (+) strand; PAM type: YTN; PAM sequence: CTG
atttgttgtaaatgcctcta

SEQ ID NO: 259654 - DNA, 20 bp, Artificial Sequence
  Description of Artificial Sequence: Synthetic oligonucleotide
  Target: ATXN1; (+) strand; PAM type: YTN; PAM sequence: TTT
gttgtaaatgcctctaaagt

SEQ ID NO: 259655 - DNA, 20 bp, Artificial Sequence
  Description of Artificial Sequence: Synthetic oligonucleotide
  Target: ATXN1; (+) strand; PAM type: YTN; PAM sequence: TTG
ttgtaaatgcctctaaagtt

SEQ ID NO: 259656 - DNA, 20 bp, Artificial Sequence
  Description of Artificial Sequence: Synthetic oligonucleotide
  Target: ATXN1; (+) strand; PAM type: YTN; PAM sequence: TTG
taaatgcctctaaagtttga

SEQ ID NO: 259657 - DNA, 20 bp, Artificial Sequence
  Description of Artificial Sequence: Synthetic oligonucleotide
  Target: ATXN1; (+) strand; PAM type: YTN; PAM sequence: CTC
taaagtttgagcagaacatc

SEQ ID NO: 259658 - DNA, 20 bp, Artificial Sequence
  Description of Artificial Sequence: Synthetic oligonucleotide
  Target: ATXN1; (+) strand; PAM type: YTN; PAM sequence: CTA
aagtttgagcagaacatcaa

SEQ ID NO: 259659 - DNA, 20 bp, Artificial Sequence
  Description of Artificial Sequence: Synthetic oligonucleotide
  Target: ATXN1; (+) strand; PAM type: YTN; PAM sequence: TTT
gagcagaacatcaagggttc

SEQ ID NO: 259660 - DNA, 20 bp, Artificial Sequence
  Description of Artificial Sequence: Synthetic oligonucleotide
  Target: ATXN1; (+) strand; PAM type: YTN; PAM sequence: TTG
agcagaacatcaagggttcc

SEQ ID NO: 259661 - DNA, 20 bp, Artificial Sequence
  Description of Artificial Sequence: Synthetic oligonucleotide
  Target: ATXN1; (+) strand; PAM type: YTN; PAM sequence: TTC
cgttttcaaagtgacctcaa

SEQ ID NO: 259662 - DNA, 20 bp, Artificial Sequence
  Description of Artificial Sequence: Synthetic oligonucleotide
  Target: ATXN1; (+) strand; PAM type: YTN; PAM sequence: TTT
tcaaagtgacctcaactgcc

SEQ ID NO: 259663 - DNA, 20 bp, Artificial Sequence
  Description of Artificial Sequence: Synthetic oligonucleotide
  Target: ATXN1; (+) strand; PAM type: YTN; PAM sequence: TTT
caaagtgacctcaactgcct

SEQ ID NO: 259664 - DNA, 20 bp, Artificial Sequence
  Description of Artificial Sequence: Synthetic oligonucleotide
  Target: ATXN1; (+) strand; PAM type: YTN; PAM sequence: TTC
aaagtgacctcaactgcctc

SEQ ID NO: 259665 - DNA, 20 bp, Artificial Sequence
  Description of Artificial Sequence: Synthetic oligonucleotide
  Target: ATXN1; (+) strand; PAM type: YTN; PAM sequence: CTC
aactgcctccagcgtttcag

SEQ ID NO: 259666 - DNA, 20 bp, Artificial Sequence
  Description of Artificial Sequence: Synthetic oligonucleotide
  Target: ATXN1; (+) strand; PAM type: YTN; PAM sequence: CTG
cctccagcgtttcaggtgtt

SEQ ID NO: 259667 - DNA, 20 bp, Artificial Sequence
  Description of Artificial Sequence: Synthetic oligonucleotide
  Target: ATXN1; (+) strand; PAM type: YTN; PAM sequence: CTC
cagcgtttcaggtgttgagc

SEQ ID NO: 259668 - DNA, 20 bp, Artificial Sequence
  Description of Artificial Sequence: Synthetic oligonucleotide
  Target: ATXN1; (+) strand; PAM type: YTN; PAM sequence: TTT
caggtgttgagctctagaag

SEQ ID NO: 259669 - DNA, 20 bp, Artificial Sequence
  Description of Artificial Sequence: Synthetic oligonucleotide
  Target: ATXN1; (+) strand; PAM type: YTN; PAM sequence: TTC
aggtgttgagctctagaagc

SEQ ID NO: 259670 - DNA, 20 bp, Artificial Sequence
  Description of Artificial Sequence: Synthetic oligonucleotide
  Target: ATXN1; (+) strand; PAM type: YTN; PAM sequence: TTG
agctctagaagccaggatgg

SEQ ID NO: 259671 - DNA, 20 bp, Artificial Sequence
  Description of Artificial Sequence: Synthetic oligonucleotide
  Target: ATXN1; (+) strand; PAM type: YTN; PAM sequence: CTC
tagaagccaggatggaagtt

SEQ ID NO: 259672 - DNA, 20 bp, Artificial Sequence
  Description of Artificial Sequence: Synthetic oligonucleotide
  Target: ATXN1; (+) strand; PAM type: YTN; PAM sequence: CTA
gaagccaggatggaagtttt

SEQ ID NO: 259673 - DNA, 20 bp, Artificial Sequence
  Description of Artificial Sequence: Synthetic oligonucleotide
  Target: ATXN1; (+) strand; PAM type: YTN; PAM sequence: TTT
tcaggcagatacaactccca

SEQ ID NO: 259674 - DNA, 20 bp, Artificial Sequence
  Description of Artificial Sequence: Synthetic oligonucleotide
  Target: ATXN1; (+) strand; PAM type: YTN; PAM sequence: TTT
caggcagatacaactcccag

SEQ ID NO: 259675 - DNA, 20 bp, Artificial Sequence
  Description of Artificial Sequence: Synthetic oligonucleotide
  Target: ATXN1; (+) strand; PAM type: YTN; PAM sequence: TTC
aggcagatacaactcccagg

SEQ ID NO: 259676 - DNA, 20 bp, Artificial Sequence
  Description of Artificial Sequence: Synthetic oligonucleotide
  Target: ATXN1; (+) strand; PAM type: YTN; PAM sequence: CTC
ccaggctttcattcagcttc

SEQ ID NO: 259677 - DNA, 20 bp, Artificial Sequence
  Description of Artificial Sequence: Synthetic oligonucleotide
  Target: ATXN1; (+) strand; PAM type: YTN; PAM sequence: CTT
tcattcagcttctataaaac

SEQ ID NO: 259678 - DNA, 20 bp, Artificial Sequence
  Description of Artificial Sequence: Synthetic oligonucleotide
  Target: ATXN1; (+) strand; PAM type: YTN; PAM sequence: TTT
cattcagcttctataaaaca

SEQ ID NO: 259679 - DNA, 20 bp, Artificial Sequence
  Description of Artificial Sequence: Synthetic oligonucleotide
  Target: ATXN1; (+) strand; PAM type: YTN; PAM sequence: TTC
attcagcttctataaaacaa

SEQ ID NO: 259680 - DNA, 20 bp, Artificial Sequence
  Description of Artificial Sequence: Synthetic oligonucleotide
  Target: ATXN1; (+) strand; PAM type: YTN; PAM sequence: TTC
agcttctataaaacaacagt

SEQ ID NO: 259681 - DNA, 20 bp, Artificial Sequence
  Description of Artificial Sequence: Synthetic oligonucleotide
  Target: ATXN1; (+) strand; PAM type: YTN; PAM sequence: CTT
ctataaaacaacagtgcaca

SEQ ID NO: 259682 - DNA, 20 bp, Artificial Sequence
  Description of Artificial Sequence: Synthetic oligonucleotide
  Target: ATXN1; (+) strand; PAM type: YTN; PAM sequence: TTC
tataaaacaacagtgcacac

SEQ ID NO: 259683 - DNA, 20 bp, Artificial Sequence
  Description of Artificial Sequence: Synthetic oligonucleotide
  Target: ATXN1; (+) strand; PAM type: YTN; PAM sequence: CTA
taaaacaacagtgcacacag

SEQ ID NO: 259684 - DNA, 20 bp, Artificial Sequence
  Description of Artificial Sequence: Synthetic oligonucleotide
  Target: ATXN1; (+) strand; PAM type: YTN; PAM sequence: CTC
atcaccagtgtctgctgtgt

SEQ ID NO: 259685 - DNA, 20 bp, Artificial Sequence
  Description of Artificial Sequence: Synthetic oligonucleotide
  Target: ATXN1; (+) strand; PAM type: YTN; PAM sequence: CTG
ctgtgtgcacccaaaaaaga

SEQ ID NO: 259686 - DNA, 20 bp, Artificial Sequence
  Description of Artificial Sequence: Synthetic oligonucleotide
  Target: ATXN1; (+) strand; PAM type: YTN; PAM sequence: CTG
tgtgcacccaaaaaagaaag

SEQ ID NO: 259687 - DNA, 20 bp, Artificial Sequence
  Description of Artificial Sequence: Synthetic oligonucleotide
  Target: ATXN1; (+) strand; PAM type: YTN; PAM sequence: TTG
aaaatgtattccatagggct

SEQ ID NO: 259688 - DNA, 20 bp, Artificial Sequence
  Description of Artificial Sequence: Synthetic oligonucleotide
  Target: ATXN1; (+) strand; PAM type: YTN; PAM sequence: TTC
catagggctctagggttgtc

SEQ ID NO: 259689 - DNA, 20 bp, Artificial Sequence
  Description of Artificial Sequence: Synthetic oligonucleotide
  Target: ATXN1; (+) strand; PAM type: YTN; PAM sequence: CTC
tagggttgtcttgaaatgct

SEQ ID NO: 259690 - DNA, 20 bp, Artificial Sequence
  Description of Artificial Sequence: Synthetic oligonucleotide
  Target: ATXN1; (+) strand; PAM type: YTN; PAM sequence: CTA
gggttgtcttgaaatgctct

SEQ ID NO: 259691 - DNA, 20 bp, Artificial Sequence
  Description of Artificial Sequence: Synthetic oligonucleotide
  Target: ATXN1; (+) strand; PAM type: YTN; PAM sequence: TTG
tcttgaaatgctctgttctg

SEQ ID NO: 259692 - DNA, 20 bp, Artificial Sequence
  Description of Artificial Sequence: Synthetic oligonucleotide
  Target: ATXN1; (+) strand; PAM type: YTN; PAM sequence: CTT
gaaatgctctgttctgaaac

SEQ ID NO: 259693 - DNA, 20 bp, Artificial Sequence
  Description of Artificial Sequence: Synthetic oligonucleotide
  Target: ATXN1; (+) strand; PAM type: YTN; PAM sequence: TTG
aaatgctctgttctgaaaca

SEQ ID NO: 259694 - DNA, 20 bp, Artificial Sequence
  Description of Artificial Sequence: Synthetic oligonucleotide
  Target: ATXN1; (+) strand; PAM type: YTN; PAM sequence: CTC
tgttctgaaacactctataa

SEQ ID NO: 259695 - DNA, 20 bp, Artificial Sequence
  Description of Artificial Sequence: Synthetic oligonucleotide
  Target: ATXN1; (+) strand; PAM type: YTN; PAM sequence: CTG
ttctgaaacactctataaaa

SEQ ID NO: 259696 - DNA, 20 bp, Artificial Sequence
  Description of Artificial Sequence: Synthetic oligonucleotide
  Target: ATXN1; (+) strand; PAM type: YTN; PAM sequence: TTC
tgaaacactctataaaaatt

SEQ ID NO: 259697 - DNA, 20 bp, Artificial Sequence
  Description of Artificial Sequence: Synthetic oligonucleotide
  Target: ATXN1; (+) strand; PAM type: YTN; PAM sequence: CTG
aaacactctataaaaattcc

SEQ ID NO: 259698 - DNA, 20 bp, Artificial Sequence
  Description of Artificial Sequence: Synthetic oligonucleotide
  Target: ATXN1; (+) strand; PAM type: YTN; PAM sequence: CTC
tataaaaattcctcacagat

SEQ ID NO: 259699 - DNA, 20 bp, Artificial Sequence
  Description of Artificial Sequence: Synthetic oligonucleotide
  Target: ATXN1; (+) strand; PAM type: YTN; PAM sequence: CTA
taaaaattcctcacagattt

SEQ ID NO: 259700 - DNA, 20 bp, Artificial Sequence
  Description of Artificial Sequence: Synthetic oligonucleotide
  Target: ATXN1; (+) strand; PAM type: YTN; PAM sequence: TTC
ctcacagattttcagtgact

SEQ ID NO: 259701 - DNA, 20 bp, Artificial Sequence
  Description of Artificial Sequence: Synthetic oligonucleotide
  Target: ATXN1; (+) strand; PAM type: YTN; PAM sequence: CTC
acagattttcagtgactaga

SEQ ID NO: 259702 - DNA, 20 bp, Artificial Sequence
  Description of Artificial Sequence: Synthetic oligonucleotide
  Target: ATXN1; (+) strand; PAM type: YTN; PAM sequence: TTT
tcagtgactagaggcatggg

SEQ ID NO: 259703 - DNA, 20 bp, Artificial Sequence
  Description of Artificial Sequence: Synthetic oligonucleotide
  Target: ATXN1; (+) strand; PAM type: YTN; PAM sequence: TTT
cagtgactagaggcatgggg

SEQ ID NO: 259704 - DNA, 20 bp, Artificial Sequence
  Description of Artificial Sequence: Synthetic oligonucleotide
  Target: ATXN1; (+) strand; PAM type: YTN; PAM sequence: TTC
agtgactagaggcatggggc

SEQ ID NO: 259705 - DNA, 20 bp, Artificial Sequence
  Description of Artificial Sequence: Synthetic oligonucleotide
  Target: ATXN1; (+) strand; PAM type: YTN; PAM sequence: CTA
gaggcatggggctgtgggag

SEQ ID NO: 259706 - DNA, 20 bp, Artificial Sequence
  Description of Artificial Sequence: Synthetic oligonucleotide
  Target: ATXN1; (+) strand; PAM type: YTN; PAM sequence: CTG
tgggagggggtgctcagctg

SEQ ID NO: 259707 - DNA, 20 bp, Artificial Sequence
  Description of Artificial Sequence: Synthetic oligonucleotide
  Target: ATXN1; (+) strand; PAM type: YTN; PAM sequence: CTC
agctgcactcttttattatt

SEQ ID NO: 259708 - DNA, 20 bp, Artificial Sequence
  Description of Artificial Sequence: Synthetic oligonucleotide
  Target: ATXN1; (+) strand; PAM type: YTN; PAM sequence: CTG
cactcttttattattgagct

SEQ ID NO: 259709 - DNA, 20 bp, Artificial Sequence
  Description of Artificial Sequence: Synthetic oligonucleotide
  Target: ATXN1; (+) strand; PAM type: YTN; PAM sequence: CTC
ttttattattgagctgattc

SEQ ID NO: 259710 - DNA, 20 bp, Artificial Sequence
  Description of Artificial Sequence: Synthetic oligonucleotide
  Target: ATXN1; (+) strand; PAM type: YTN; PAM sequence: CTT
ttattattgagctgattcaa

SEQ ID NO: 259711 - DNA, 20 bp, Artificial Sequence
  Description of Artificial Sequence: Synthetic oligonucleotide
  Target: ATXN1; (+) strand; PAM type: YTN; PAM sequence: TTT
tattattgagctgattcaaa

SEQ ID NO: 259712 - DNA, 20 bp, Artificial Sequence
  Description of Artificial Sequence: Synthetic oligonucleotide
  Target: ATXN1; (+) strand; PAM type: YTN; PAM sequence: TTT
attattgagctgattcaaag

SEQ ID NO: 259713 - DNA, 20 bp, Artificial Sequence
  Description of Artificial Sequence: Synthetic oligonucleotide
  Target: ATXN1; (+) strand; PAM type: YTN; PAM sequence: TTA
ttattgagctgattcaaagg

SEQ ID NO: 259714 - DNA, 20 bp, Artificial Sequence
  Description of Artificial Sequence: Synthetic oligonucleotide
  Target: ATXN1; (+) strand; PAM type: YTN; PAM sequence: TTA
ttgagctgattcaaaggaac

SEQ ID NO: 259715 - DNA, 20 bp, Artificial Sequence
  Description of Artificial Sequence: Synthetic oligonucleotide
  Target: ATXN1; (+) strand; PAM type: YTN; PAM sequence: TTG
agctgattcaaaggaacaga

SEQ ID NO: 259716 - DNA, 20 bp, Artificial Sequence
  Description of Artificial Sequence: Synthetic oligonucleotide
  Target: ATXN1; (+) strand; PAM type: YTN; PAM sequence: CTG
attcaaaggaacagatttta

SEQ ID NO: 259717 - DNA, 20 bp, Artificial Sequence
  Description of Artificial Sequence: Synthetic oligonucleotide
  Target: ATXN1; (+) strand; PAM type: YTN; PAM sequence: TTC
aaaggaacagattttatgtt

SEQ ID NO: 259718 - DNA, 20 bp, Artificial Sequence
  Description of Artificial Sequence: Synthetic oligonucleotide
  Target: ATXN1; (+) strand; PAM type: YTN; PAM sequence: TTT
tatgttgataaatgtacctg

SEQ ID NO: 259719 - DNA, 20 bp, Artificial Sequence
  Description of Artificial Sequence: Synthetic oligonucleotide
  Target: ATXN1; (+) strand; PAM type: YTN; PAM sequence: TTT
atgttgataaatgtacctga

SEQ ID NO: 259720 - DNA, 20 bp, Artificial Sequence
  Description of Artificial Sequence: Synthetic oligonucleotide
  Target: ATXN1; (+) strand; PAM type: YTN; PAM sequence: TTA
tgttgataaatgtacctgat

SEQ ID NO: 259721 - DNA, 20 bp, Artificial Sequence
  Description of Artificial Sequence: Synthetic oligonucleotide
  Target: ATXN1; (+) strand; PAM type: YTN; PAM sequence: TTG
ataaatgtacctgatactga

SEQ ID NO: 259722 - DNA, 20 bp, Artificial Sequence
  Description of Artificial Sequence: Synthetic oligonucleotide
  Target: ATXN1; (+) strand; PAM type: YTN; PAM sequence: CTG
atactgactttaatgttcat

SEQ ID NO: 259723 - DNA, 20 bp, Artificial Sequence
  Description of Artificial Sequence: Synthetic oligonucleotide
  Target: ATXN1; (+) strand; PAM type: YTN; PAM sequence: CTG
actttaatgttcatggactg

SEQ ID NO: 259724 - DNA, 20 bp, Artificial Sequence
  Description of Artificial Sequence: Synthetic oligonucleotide
  Target: ATXN1; (+) strand; PAM type: YTN; PAM sequence: CTT
taatgttcatggactgggtc

SEQ ID NO: 259725 - DNA, 20 bp, Artificial Sequence
  Description of Artificial Sequence: Synthetic oligonucleotide
  Target: ATXN1; (+) strand; PAM type: YTN; PAM sequence: TTT
aatgttcatggactgggtct

SEQ ID NO: 259726 - DNA, 20 bp, Artificial Sequence
  Description of Artificial Sequence: Synthetic oligonucleotide
  Target: ATXN1; (+) strand; PAM type: YTN; PAM sequence: TTA
atgttcatggactgggtctt

SEQ ID NO: 259727 - DNA, 20 bp, Artificial Sequence
  Description of Artificial Sequence: Synthetic oligonucleotide
  Target: ATXN1; (+) strand; PAM type: YTN; PAM sequence: TTC
atggactgggtcttttctat

SEQ ID NO: 259728 - DNA, 20 bp, Artificial Sequence
  Description of Artificial Sequence: Synthetic oligonucleotide
  Target: ATXN1; (+) strand; PAM type: YTN; PAM sequence: CTG
ggtcttttctatctgtaaaa

SEQ ID NO: 259729 - DNA, 20 bp, Artificial Sequence
  Description of Artificial Sequence: Synthetic oligonucleotide
  Target: ATXN1; (+) strand; PAM type: YTN; PAM sequence: CTT
ttctatctgtaaaatatggt

SEQ ID NO: 259730 - DNA, 20 bp, Artificial Sequence
  Description of Artificial Sequence: Synthetic oligonucleotide
  Target: ATXN1; (+) strand; PAM type: YTN; PAM sequence: TTT
tctatctgtaaaatatggtt

SEQ ID NO: 259731 - DNA, 20 bp, Artificial Sequence
  Description of Artificial Sequence: Synthetic oligonucleotide
  Target: ATXN1; (+) strand; PAM type: YTN; PAM sequence: TTT
ctatctgtaaaatatggttg

SEQ ID NO: 259732 - DNA, 20 bp, Artificial Sequence
  Description of Artificial Sequence: Synthetic oligonucleotide
  Target: ATXN1; (+) strand; PAM type: YTN; PAM sequence: TTC
tatctgtaaaatatggttgc

SEQ ID NO: 259733 - DNA, 20 bp, Artificial Sequence
  Description of Artificial Sequence: Synthetic oligonucleotide
  Target: ATXN1; (+) strand; PAM type: YTN; PAM sequence: CTA
tctgtaaaatatggttgcaa

SEQ ID NO: 259734 - DNA, 20 bp, Artificial Sequence
  Description of Artificial Sequence: Synthetic oligonucleotide
  Target: ATXN1; (+) strand; PAM type: YTN; PAM sequence: CTG
taaaatatggttgcaaggct

SEQ ID NO: 259735 - DNA, 20 bp, Artificial Sequence
  Description of Artificial Sequence: Synthetic oligonucleotide
  Target: ATXN1; (+) strand; PAM type: YTN; PAM sequence: TTG
caaggctttcatggacaaga

SEQ ID NO: 259736 - DNA, 20 bp, Artificial Sequence
  Description of Artificial Sequence: Synthetic oligonucleotide
  Target: ATXN1; (+) strand; PAM type: YTN; PAM sequence: CTT
tcatggacaagacatggcct

SEQ ID NO: 259737 - DNA, 20 bp, Artificial Sequence
  Description of Artificial Sequence: Synthetic oligonucleotide
  Target: ATXN1; (+) strand; PAM type: YTN; PAM sequence: TTT
catggacaagacatggcctc

SEQ ID NO: 259738 - DNA, 20 bp, Artificial Sequence
  Description of Artificial Sequence: Synthetic oligonucleotide
  Target: ATXN1; (+) strand; PAM type: YTN; PAM sequence: TTC
atggacaagacatggcctct

SEQ ID NO: 259739 - DNA, 20 bp, Artificial Sequence
  Description of Artificial Sequence: Synthetic oligonucleotide
  Target: ATXN1; (+) strand; PAM type: YTN; PAM sequence: CTC
ttgtctctggtagaccaggc

SEQ ID NO: 259740 - DNA, 20 bp, Artificial Sequence
  Description of Artificial Sequence: Synthetic oligonucleotide
  Target: ATXN1; (+) strand; PAM type: YTN; PAM sequence: CTT
gtctctggtagaccaggcct

SEQ ID NO: 259741 - DNA, 20 bp, Artificial Sequence
  Description of Artificial Sequence: Synthetic oligonucleotide
  Target: ATXN1; (+) strand; PAM type: YTN; PAM sequence: TTG
tctctggtagaccaggcctt

SEQ ID NO: 259742 - DNA, 20 bp, Artificial Sequence
  Description of Artificial Sequence: Synthetic oligonucleotide
  Target: ATXN1; (+) strand; PAM type: YTN; PAM sequence: CTC
tggtagaccaggcctttttt

SEQ ID NO: 259743 - DNA, 20 bp, Artificial Sequence
  Description of Artificial Sequence: Synthetic oligonucleotide
  Target: ATXN1; (+) strand; PAM type: YTN; PAM sequence: CTG
gtagaccaggcctttttttt

SEQ ID NO: 259744 - DNA, 20 bp, Artificial Sequence
  Description of Artificial Sequence: Synthetic oligonucleotide
  Target: ATXN1; (+) strand; PAM type: YTN; PAM sequence: CTT
tttttttttttttctgagat

SEQ ID NO: 259745 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttctgagatg

SEQ ID NO: 259746 - DNA, 20 bp, Artificial Sequence
  Description of Artificial Sequence: Synthetic oligonucleotide
  Target: ATXN1; (+) strand; PAM type: YTN; PAM sequence: TTT
tttttttttttctgagatgt

SEQ ID NO: 259747 - DNA, 20 bp, Artificial Sequence
  Description of Artificial Sequence: Synthetic oligonucleotide
  Target: ATXN1; (+) strand; PAM type: YTN; PAM sequence: TTT
ttttttttttctgagatgta

SEQ ID NO: 259748 - DNA, 20 bp, Artificial Sequence
  Description of Artificial Sequence: Synthetic oligonucleotide
  Target: ATXN1; (+) strand; PAM type: YTN; PAM sequence: TTT
tttttttttctgagatgtag

SEQ ID NO: 259749 - DNA, 20 bp, Artificial Sequence
  Description of Artificial Sequence: Synthetic oligonucleotide
  Target: ATXN1; (+) strand; PAM type: YTN; PAM sequence: TTT
ttttttttctgagatgtagt

SEQ ID NO: 259750 - DNA, 20 bp, Artificial Sequence
  Description of Artificial Sequence: Synthetic oligonucleotide
  Target: ATXN1; (+) strand; PAM type: YTN; PAM sequence: TTT
tttttttctgagatgtagtt

SEQ ID NO: 259751 - DNA, 20 bp, Artificial Sequence
  Description of Artificial Sequence: Synthetic oligonucleotide
  Target: ATXN1; (+) strand; PAM type: YTN; PAM sequence: TTT
ttttttctgagatgtagttt

SEQ ID NO: 259752 - DNA, 20 bp, Artificial Sequence
  Description of Artificial Sequence: Synthetic oligonucleotide
  Target: ATXN1; (+) strand; PAM type: YTN; PAM sequence: TTT
tttttctgagatgtagtttt

SEQ ID NO: 259753 - DNA, 20 bp, Artificial Sequence
  Description of Artificial Sequence: Synthetic oligonucleotide
  Target: ATXN1; (+) strand; PAM type: YTN; PAM sequence: TTT
ttttctgagatgtagttttg

SEQ ID NO: 259754 - DNA, 20 bp, Artificial Sequence
  Description of Artificial Sequence: Synthetic oligonucleotide
  Target: ATXN1; (+) strand; PAM type: YTN; PAM sequence: TTT
tttctgagatgtagttttgc

SEQ ID NO: 259755 - DNA, 20 bp, Artificial Sequence
  Description of Artificial Sequence: Synthetic oligonucleotide
  Target: ATXN1; (+) strand; PAM type: YTN; PAM sequence: TTT
ttctgagatgtagttttgct

SEQ ID NO: 259756 - DNA, 20 bp, Artificial Sequence
  Description of Artificial Sequence: Synthetic oligonucleotide
  Target: ATXN1; (+) strand; PAM type: YTN; PAM sequence: TTT
tctgagatgtagttttgctc

SEQ ID NO: 259757 - DNA, 20 bp, Artificial Sequence
  Description of Artificial Sequence: Synthetic oligonucleotide
  Target: ATXN1; (+) strand; PAM type: YTN; PAM sequence: TTT
ctgagatgtagttttgctct

SEQ ID NO: 259758 - DNA, 20 bp, Artificial Sequence
  Description of Artificial Sequence: Synthetic oligonucleotide
  Target: ATXN1; (+) strand; PAM type: YTN; PAM sequence: TTC
tgagatgtagttttgctctt

SEQ ID NO: 259759 - DNA, 20 bp, Artificial Sequence
  Description of Artificial Sequence: Synthetic oligonucleotide
  Target: ATXN1; (+) strand; PAM type: YTN; PAM sequence: CTG
agatgtagttttgctcttgt

SEQ ID NO: 259760 - DNA, 20 bp, Artificial Sequence
  Description of Artificial Sequence: Synthetic oligonucleotide
  Target: ATXN1; (+) strand; PAM type: YTN; PAM sequence: TTT
tgctcttgtcacccaggctg

SEQ ID NO: 259761 - DNA, 20 bp, Artificial Sequence
  Description of Artificial Sequence: Synthetic oligonucleotide
  Target: ATXN1; (+) strand; PAM type: YTN; PAM sequence: TTT
gctcttgtcacccaggctgg

SEQ ID NO: 259762 - DNA, 20 bp, Artificial Sequence
  Description of Artificial Sequence: Synthetic oligonucleotide
  Target: ATXN1; (+) strand; PAM type: YTN; PAM sequence: TTG
ctcttgtcacccaggctgga

SEQ ID NO: 259763 - DNA, 20 bp, Artificial Sequence
  Description of Artificial Sequence: Synthetic oligonucleotide
  Target: ATXN1; (+) strand; PAM type: YTN; PAM sequence: CTC
ttgtcacccaggctggagtg

SEQ ID NO: 259764 - DNA, 20 bp, Artificial Sequence
  Description of Artificial Sequence: Synthetic oligonucleotide
  Target: ATXN1; (+) strand; PAM type: YTN; PAM sequence: CTT
gtcacccaggctggagtgca

SEQ ID NO: 259765 - DNA, 20 bp, Artificial Sequence
  Description of Artificial Sequence: Synthetic oligonucleotide
  Target: ATXN1; (+) strand; PAM type: YTN; PAM sequence: TTG
tcacccaggctggagtgcaa

SEQ ID NO: 259766 - DNA, 20 bp, Artificial Sequence
  Description of Artificial Sequence: Synthetic oligonucleotide
  Target: ATXN1; (+) strand; PAM type: YTN; PAM sequence: CTG
gagtgcaatggggcaatctc

SEQ ID NO: 259767 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcaacctctggc

SEQ ID NO: 259768 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctggctccca

SEQ ID NO: 259769 - DNA, 20 bp, Artificial Sequence
  Description of Artificial Sequence: Synthetic oligonucleotide
  Target: ATXN1; (+) strand; PAM type: YTN; PAM sequence: CTG
caacctctggctcccaggtt

SEQ ID NO: 259770 - DNA, 20 bp, Artificial Sequence
  Description of Artificial Sequence: Synthetic oligonucleotide
  Target: ATXN1; (+) strand; PAM type: YTN; PAM sequence: CTC
tggctcccaggttcaagtga

SEQ ID NO: 259771 - DNA, 20 bp, Artificial Sequence
  Description of Artificial Sequence: Synthetic oligonucleotide
  Target: ATXN1; (+) strand; PAM type: YTN; PAM sequence: CTG
gctcccaggttcaagtgatt

SEQ ID NO: 259772 - DNA, 20 bp, Artificial Sequence
  Description of Artificial Sequence: Synthetic oligonucleotide
  Target: ATXN1; (+) strand; PAM type: YTN; PAM sequence: CTC
ccaggttcaagtgattctcc

SEQ ID NO: 259773 - DNA, 20 bp, Artificial Sequence
  Description of Artificial Sequence: Synthetic oligonucleotide
  Target: ATXN1; (+) strand; PAM type: YTN; PAM sequence: TTC
aagtgattctcctgcctcag

SEQ ID NO: 259774 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctctggag

SEQ ID NO: 259775 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctctggagta

SEQ ID NO: 259776 - DNA, 20 bp, Artificial Sequence
  Description of Artificial Sequence: Synthetic oligonucleotide
  Target: ATXN1; (+) strand; PAM type: YTN; PAM sequence: CTG
cctcagcctctggagtagta

SEQ ID NO: 259777 - DNA, 20 bp, Artificial Sequence
  Description of Artificial Sequence: Synthetic oligonucleotide
  Target: ATXN1; (+) strand; PAM type: YTN; PAM sequence: CTC
agcctctggagtagtaggga

SEQ ID NO: 259778 - DNA, 20 bp, Artificial Sequence
  Description of Artificial Sequence: Synthetic oligonucleotide
  Target: ATXN1; (+) strand; PAM type: YTN; PAM sequence: CTC
tggagtagtagggattacag

SEQ ID NO: 259779 - DNA, 20 bp, Artificial Sequence
  Description of Artificial Sequence: Synthetic oligonucleotide
  Target: ATXN1; (+) strand; PAM type: YTN; PAM sequence: CTG
gagtagtagggattacaggc

SEQ ID NO: 259780 - DNA, 20 bp, Artificial Sequence
  Description of Artificial Sequence: Synthetic oligonucleotide
  Target: ATXN1; (+) strand; PAM type: YTN; PAM sequence: TTA
caggcgctcaccaccatgcc

SEQ ID NO: 259781 - DNA, 20 bp, Artificial Sequence
  Description of Artificial Sequence: Synthetic oligonucleotide
  Target: ATXN1; (+) strand; PAM type: YTN; PAM sequence: CTC
accaccatgcccagcacatt

SEQ ID NO: 259782 - DNA, 20 bp, Artificial Sequence
  Description of Artificial Sequence: Synthetic oligonucleotide
  Target: ATXN1; (+) strand; PAM type: YTN; PAM sequence: TTT
ttgtgtttttagttgcgacg

SEQ ID NO: 259783 - DNA, 20 bp, Artificial Sequence
  Description of Artificial Sequence: Synthetic oligonucleotide
  Target: ATXN1; (+) strand; PAM type: YTN; PAM sequence: TTT
tgtgtttttagttgcgacgg

SEQ ID NO: 259784 - DNA, 20 bp, Artificial Sequence
  Description of Artificial Sequence: Synthetic oligonucleotide
  Target: ATXN1; (+) strand; PAM type: YTN; PAM sequence: TTT
gtgtttttagttgcgacggg

SEQ ID NO: 259785 - DNA, 20 bp, Artificial Sequence
  Description of Artificial Sequence: Synthetic oligonucleotide
  Target: ATXN1; (+) strand; PAM type: YTN; PAM sequence: TTG
tgtttttagttgcgacgggg

SEQ ID NO: 259786 - DNA, 20 bp, Artificial Sequence
  Description of Artificial Sequence: Synthetic oligonucleotide
  Target: ATXN1; (+) strand; PAM type: YTN; PAM sequence: TTT
ttagttgcgacggggtttca

SEQ ID NO: 259787 - DNA, 20 bp, Artificial Sequence
  Description of Artificial Sequence: Synthetic oligonucleotide
  Target: ATXN1; (+) strand; PAM type: YTN; PAM sequence: TTT
tagttgcgacggggtttcac

SEQ ID NO: 259788 - DNA, 20 bp, Artificial Sequence
  Description of Artificial Sequence: Synthetic oligonucleotide
  Target: ATXN1; (+) strand; PAM type: YTN; PAM sequence: TTT
agttgcgacggggtttcacc

SEQ ID NO: 259789 - DNA, 20 bp, Artificial Sequence
  Description of Artificial Sequence: Synthetic oligonucleotide
  Target: ATXN1; (+) strand; PAM type: YTN; PAM sequence: TTA
gttgcgacggggtttcacca

SEQ ID NO: 259790 - DNA, 20 bp, Artificial Sequence
  Description of Artificial Sequence: Synthetic oligonucleotide
  Target: ATXN1; (+) strand; PAM type: YTN; PAM sequence: TTG
cgacggggtttcaccatgtt

SEQ ID NO: 259791 - DNA, 20 bp, Artificial Sequence
  Description of Artificial Sequence: Synthetic oligonucleotide
  Target: ATXN1; (+) strand; PAM type: YTN; PAM sequence: TTT
caccatgttggccaggctgg

SEQ ID NO: 259792 - DNA, 20 bp, Artificial Sequence
  Description of Artificial Sequence: Synthetic oligonucleotide
  Target: ATXN1; (+) strand; PAM type: YTN; PAM sequence: TTC
accatgttggccaggctggt

SEQ ID NO: 259793 - DNA, 20 bp, Artificial Sequence
  Description of Artificial Sequence: Synthetic oligonucleotide
  Target: ATXN1; (+) strand; PAM type: YTN; PAM sequence: TTG
gccaggctggtctcaaactc

SEQ ID NO: 259794 - DNA, 20 bp, Artificial Sequence
  Description of Artificial Sequence: Synthetic oligonucleotide
  Target: ATXN1; (+) strand; PAM type: YTN; PAM sequence: CTG
gtctcaaactcctgacctca

SEQ ID NO: 259795 - DNA, 20 bp, Artificial Sequence
  Description of Artificial Sequence: Synthetic oligonucleotide
  Target: ATXN1; (+) strand; PAM type: YTN; PAM sequence: CTC
aaactcctgacctcaggcga

SEQ ID NO: 259796 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggcgatccacc

SEQ ID NO: 259797 - DNA, 20 bp, Artificial Sequence
  Description of Artificial Sequence: Synthetic oligonucleotide
  Target: ATXN1; (+) strand; PAM type: YTN; PAM sequence: CTG
acctcaggcgatccacctgc

SEQ ID NO: 259798 - DNA, 20 bp, Artificial Sequence
  Description of Artificial Sequence: Synthetic oligonucleotide
  Target: ATXN1; (+) strand; PAM type: YTN; PAM sequence: CTC
aggcgatccacctgcctcgg

SEQ ID NO: 259799 - DNA, 20 bp, Artificial Sequence
  Description of Artificial Sequence: Synthetic oligonucleotide
  Target: ATXN1; (+) strand; PAM type: YTN; PAM sequence: CTG
cctcggcctcccaaagtgtt

SEQ ID NO: 259800 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaagtgttgaga

SEQ ID NO: 259801 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgttgagattatag

SEQ ID NO: 259802 - DNA, 20 bp, Artificial Sequence
  Description of Artificial Sequence: Synthetic oligonucleotide
  Target: ATXN1; (+) strand; PAM type: YTN; PAM sequence: TTG
agattatagacatgagccac

SEQ ID NO: 259803 - DNA, 20 bp, Artificial Sequence
  Description of Artificial Sequence: Synthetic oligonucleotide
  Target: ATXN1; (+) strand; PAM type: YTN; PAM sequence: TTA
tagacatgagccaccatgct

SEQ ID NO: 259804 - DNA, 20 bp, Artificial Sequence
  Description of Artificial Sequence: Synthetic oligonucleotide
  Target: ATXN1; (+) strand; PAM type: YTN; PAM sequence: CTC
agctgaccaggactagtaat

SEQ ID NO: 259805 - DNA, 20 bp, Artificial Sequence
  Description of Artificial Sequence: Synthetic oligonucleotide
  Target: ATXN1; (+) strand; PAM type: YTN; PAM sequence: CTG
accaggactagtaatagcaa

SEQ ID NO: 259806 - DNA, 20 bp, Artificial Sequence
  Description of Artificial Sequence: Synthetic oligonucleotide
  Target: ATXN1; (+) strand; PAM type: YTN; PAM sequence: CTA
gtaatagcaaatactgggtt

SEQ ID NO: 259807 - DNA, 20 bp, Artificial Sequence
  Description of Artificial Sequence: Synthetic oligonucleotide
  Target: ATXN1; (+) strand; PAM type: YTN; PAM sequence: CTG
ggttggtgcaaaagtaattg

SEQ ID NO: 259808 - DNA, 20 bp, Artificial Sequence
  Description of Artificial Sequence: Synthetic oligonucleotide
  Target: ATXN1; (+) strand; PAM type: YTN; PAM sequence: TTG
gtgcaaaagtaattgtggtt

SEQ ID NO: 259809 - DNA, 20 bp, Artificial Sequence
  Description of Artificial Sequence: Synthetic oligonucleotide
  Target: ATXN1; (+) strand; PAM type: YTN; PAM sequence: TTG
tggtttttgccattgaaagt

SEQ ID NO: 259810 - DNA, 20 bp, Artificial Sequence
  Description of Artificial Sequence: Synthetic oligonucleotide
  Target: ATXN1; (+) strand; PAM type: YTN; PAM sequence: TTT
ttgccattgaaagtaatggc

SEQ ID NO: 259811 - DNA, 20 bp, Artificial Sequence
  Description of Artificial Sequence: Synthetic oligonucleotide
  Target: ATXN1; (+) strand; PAM type: YTN; PAM sequence: TTT
tgccattgaaagtaatggca

SEQ ID NO: 259812 - DNA, 20 bp, Artificial Sequence
  Description of Artificial Sequence: Synthetic oligonucleotide
  Target: ATXN1; (+) strand; PAM type: YTN; PAM sequence: TTT
gccattgaaagtaatggcaa

SEQ ID NO: 259813 - DNA, 20 bp, Artificial Sequence
  Description of Artificial Sequence: Synthetic oligonucleotide
  Target: ATXN1; (+) strand; PAM type: YTN; PAM sequence: TTG
ccattgaaagtaatggcaaa

SEQ ID NO: 259814 - DNA, 20 bp, Artificial Sequence
  Description of Artificial Sequence: Synthetic oligonucleotide
  Target: ATXN1; (+) strand; PAM type: YTN; PAM sequence: TTG
aaagtaatggcaaaatcaca

SEQ ID NO: 259815 - DNA, 20 bp, Artificial Sequence
  Description of Artificial Sequence: Synthetic oligonucleotide
  Target: ATXN1; (+) strand; PAM type: YTN; PAM sequence: TTA
cttttgcaccaacataatat

SEQ ID NO: 259816 - DNA, 20 bp, Artificial Sequence
  Description of Artificial Sequence: Synthetic oligonucleotide
  Target: ATXN1; (+) strand; PAM type: YTN; PAM sequence: CTT
ttgcaccaacataatatttc

SEQ ID NO: 259817 - DNA, 20 bp, Artificial Sequence
  Description of Artificial Sequence: Synthetic oligonucleotide
  Target: ATXN1; (+) strand; PAM type: YTN; PAM sequence: TTT
tgcaccaacataatatttct

SEQ ID NO: 259818 - DNA, 20 bp, Artificial Sequence
  Description of Artificial Sequence: Synthetic oligonucleotide
  Target: ATXN1; (+) strand; PAM type: YTN; PAM sequence: TTT
gcaccaacataatatttctt

SEQ ID NO: 259819 - DNA, 20 bp, Artificial Sequence
  Description of Artificial Sequence: Synthetic oligonucleotide
  Target: ATXN1; (+) strand; PAM type: YTN; PAM sequence: TTG
caccaacataatatttctta

SEQ ID NO: 259820 - DNA, 20 bp, Artificial Sequence
  Description of Artificial Sequence: Synthetic oligonucleotide
  Target: ATXN1; (+) strand; PAM type: YTN; PAM sequence: TTT
cttaagcgcttgcactgttc

SEQ ID NO: 259821 - DNA, 20 bp, Artificial Sequence
  Description of Artificial Sequence: Synthetic oligonucleotide
  Target: ATXN1; (+) strand; PAM type: YTN; PAM sequence: TTC
ttaagcgcttgcactgttcc

SEQ ID NO: 259822 - DNA, 20 bp, Artificial Sequence
  Description of Artificial Sequence: Synthetic oligonucleotide
  Target: ATXN1; (+) strand; PAM type: YTN; PAM sequence: CTT
aagcgcttgcactgttccaa

SEQ ID NO: 259823 - DNA, 20 bp, Artificial Sequence
  Description of Artificial Sequence: Synthetic oligonucleotide
  Target: ATXN1; (+) strand; PAM type: YTN; PAM sequence: TTA
agcgcttgcactgttccaag

SEQ ID NO: 259824 - DNA, 20 bp, Artificial Sequence
  Description of Artificial Sequence: Synthetic oligonucleotide
  Target: ATXN1; (+) strand; PAM type: YTN; PAM sequence: CTT
gcactgttccaagagcttga

SEQ ID NO: 259825 - DNA, 20 bp, Artificial Sequence
  Description of Artificial Sequence: Synthetic oligonucleotide
  Target: ATXN1; (+) strand; PAM type: YTN; PAM sequence: TTG
cactgttccaagagcttgac

SEQ ID NO: 259826 - DNA, 20 bp, Artificial Sequence
  Description of Artificial Sequence: Synthetic oligonucleotide
  Target: ATXN1; (+) strand; PAM type: YTN; PAM sequence: CTG
ttccaagagcttgacattca

SEQ ID NO: 259827 - DNA, 20 bp, Artificial Sequence
  Description of Artificial Sequence: Synthetic oligonucleotide
  Target: ATXN1; (+) strand; PAM type: YTN; PAM sequence: TTC
caagagcttgacattcattt

SEQ ID NO: 259828 - DNA, 20 bp, Artificial Sequence
  Description of Artificial Sequence: Synthetic oligonucleotide
  Target: ATXN1; (+) strand; PAM type: YTN; PAM sequence: CTT
gacattcatttaattatcac

SEQ ID NO: 259829 - DNA, 20 bp, Artificial Sequence
  Description of Artificial Sequence: Synthetic oligonucleotide
  Target: ATXN1; (+) strand; PAM type: YTN; PAM sequence: TTG
acattcatttaattatcaca

SEQ ID NO: 259830 - DNA, 20 bp, Artificial Sequence
  Description of Artificial Sequence: Synthetic oligonucleotide
  Target: ATXN1; (+) strand; PAM type: YTN; PAM sequence: TTC
atttaattatcacaacaact

SEQ ID NO: 259831 - DNA, 20 bp, Artificial Sequence
  Description of Artificial Sequence: Synthetic oligonucleotide
  Target: ATXN1; (+) strand; PAM type: YTN; PAM sequence: TTT
aattatcacaacaacttttt

SEQ ID NO: 259832 - DNA, 20 bp, Artificial Sequence
  Description of Artificial Sequence: Synthetic oligonucleotide
  Target: ATXN1; (+) strand; PAM type: YTN; PAM sequence: TTA
attatcacaacaactttttg

SEQ ID NO: 259833 - DNA, 20 bp, Artificial Sequence
  Description of Artificial Sequence: Synthetic oligonucleotide
  Target: ATXN1; (+) strand; PAM type: YTN; PAM sequence: TTA
tcacaacaactttttgaggt

SEQ ID NO: 259834 - DNA, 20 bp, Artificial Sequence
  Description of Artificial Sequence: Synthetic oligonucleotide
  Target: ATXN1; (+) strand; PAM type: YTN; PAM sequence: CTT
tttgaggtagctatcattat

SEQ ID NO: 259835 - DNA, 20 bp, Artificial Sequence
  Description of Artificial Sequence: Synthetic oligonucleotide
  Target: ATXN1; (+) strand; PAM type: YTN; PAM sequence: TTT
ttgaggtagctatcattatt

SEQ ID NO: 259836 - DNA, 20 bp, Artificial Sequence
  Description of Artificial Sequence: Synthetic oligonucleotide
  Target: ATXN1; (+) strand; PAM type: YTN; PAM sequence: TTT
tgaggtagctatcattatta

SEQ ID NO: 259837 - DNA, 20 bp, Artificial Sequence
  Description of Artificial Sequence: Synthetic oligonucleotide
  Target: ATXN1; (+) strand; PAM type: YTN; PAM sequence: TTT
gaggtagctatcattattaa

SEQ ID NO: 259838 - DNA, 20 bp, Artificial Sequence
  Description of Artificial Sequence: Synthetic oligonucleotide
  Target: ATXN1; (+) strand; PAM type: YTN; PAM sequence: TTG
aggtagctatcattattaag

SEQ ID NO: 259839 - DNA, 20 bp, Artificial Sequence
  Description of Artificial Sequence: Synthetic oligonucleotide
  Target: ATXN1; (+) strand; PAM type: YTN; PAM sequence: CTA
tcattattaagccaagtttg

SEQ ID NO: 259840 - DNA, 20 bp, Artificial Sequence
  Description of Artificial Sequence: Synthetic oligonucleotide
  Target: ATXN1; (+) strand; PAM type: YTN; PAM sequence: TTA
ttaagccaagtttgcaaatg

SEQ ID NO: 259841 - DNA, 20 bp, Artificial Sequence
  Description of Artificial Sequence: Synthetic oligonucleotide
  Target: ATXN1; (+) strand; PAM type: YTN; PAM sequence: TTA
agccaagtttgcaaatgagg

SEQ ID NO: 259842 - DNA, 20 bp, Artificial Sequence
  Description of Artificial Sequence: Synthetic oligonucleotide
  Target: ATXN1; (+) strand; PAM type: YTN; PAM sequence: TTT
gcaaatgaggaaaggagaca

SEQ ID NO: 259843 - DNA, 20 bp, Artificial Sequence
  Description of Artificial Sequence: Synthetic oligonucleotide
  Target: ATXN1; (+) strand; PAM type: YTN; PAM sequence: TTG
caaatgaggaaaggagacag

SEQ ID NO: 259844 - DNA, 20 bp, Artificial Sequence
  Description of Artificial Sequence: Synthetic oligonucleotide
  Target: ATXN1; (+) strand; PAM type: YTN; PAM sequence: TTT
cagcacttaccccaattaca

SEQ ID NO: 259845 - DNA, 20 bp, Artificial Sequence
  Description of Artificial Sequence: Synthetic oligonucleotide
  Target: ATXN1; (+) strand; PAM type: YTN; PAM sequence: TTC
agcacttaccccaattacag

SEQ ID NO: 259846 - DNA, 20 bp, Artificial Sequence
  Description of Artificial Sequence: Synthetic oligonucleotide
  Target: ATXN1; (+) strand; PAM type: YTN; PAM sequence: CTT
accccaattacagcacaagc

SEQ ID NO: 259847 - DNA, 20 bp, Artificial Sequence
  Description of Artificial Sequence: Synthetic oligonucleotide
  Target: ATXN1; (+) strand; PAM type: YTN; PAM sequence: TTA
ccccaattacagcacaagct

SEQ ID NO: 259848 - DNA, 20 bp, Artificial Sequence
  Description of Artificial Sequence: Synthetic oligonucleotide
  Target: ATXN1; (+) strand; PAM type: YTN; PAM sequence: TTA
cagcacaagctgatgccaga

SEQ ID NO: 259849 - DNA, 20 bp, Artificial Sequence
  Description of Artificial Sequence: Synthetic oligonucleotide
  Target: ATXN1; (+) strand; PAM type: YTN; PAM sequence: CTG
atgccagagggagatttgaa

SEQ ID NO: 259850 - DNA, 20 bp, Artificial Sequence
  Description of Artificial Sequence: Synthetic oligonucleotide
  Target: ATXN1; (+) strand; PAM type: YTN; PAM sequence: TTT
gaacccaggctggctcactc

SEQ ID NO: 259851 - DNA, 20 bp, Artificial Sequence
  Description of Artificial Sequence: Synthetic oligonucleotide
  Target: ATXN1; (+) strand; PAM type: YTN; PAM sequence: TTG
aacccaggctggctcactcc

SEQ ID NO: 259852 - DNA, 20 bp, Artificial Sequence
  Description of Artificial Sequence: Synthetic oligonucleotide
  Target: ATXN1; (+) strand; PAM type: YTN; PAM sequence: CTG
gctcactccagctaacaccc

SEQ ID NO: 259853 - DNA, 20 bp, Artificial Sequence
  Description of Artificial Sequence: Synthetic oligonucleotide
  Target: ATXN1; (+) strand; PAM type: YTN; PAM sequence: CTC
actccagctaacacccaacc

SEQ ID NO: 259854 - DNA, 20 bp, Artificial Sequence
  Description of Artificial Sequence: Synthetic oligonucleotide
  Target: ATXN1; (+) strand; PAM type: YTN; PAM sequence: CTC
cagctaacacccaaccatca

SEQ ID NO: 259855 - DNA, 20 bp, Artificial Sequence
  Description of Artificial Sequence: Synthetic oligonucleotide
  Target: ATXN1; (+) strand; PAM type: YTN; PAM sequence: CTA
acacccaaccatcacatgca

SEQ ID NO: 259856 - DNA, 20 bp, Artificial Sequence
  Description of Artificial Sequence: Synthetic oligonucleotide
  Target: ATXN1; (+) strand; PAM type: YTN; PAM sequence: CTG
ctctgctaacacattcacac

SEQ ID NO: 259857 - DNA, 20 bp, Artificial Sequence
  Description of Artificial Sequence: Synthetic oligonucleotide
  Target: ATXN1; (+) strand; PAM type: YTN; PAM sequence: CTC
tgctaacacattcacacaac

SEQ ID NO: 259858 - DNA, 20 bp, Artificial Sequence
  Description of Artificial Sequence: Synthetic oligonucleotide
  Target: ATXN1; (+) strand; PAM type: YTN; PAM sequence: CTG
ctaacacattcacacaactc

SEQ ID NO: 259859 - DNA, 20 bp, Artificial Sequence
  Description of Artificial Sequence: Synthetic oligonucleotide
  Target: ATXN1; (+) strand; PAM type: YTN; PAM sequence: CTA
acacattcacacaactcact

SEQ ID NO: 259860 - DNA, 20 bp, Artificial Sequence
  Description of Artificial Sequence: Synthetic oligonucleotide
  Target: ATXN1; (+) strand; PAM type: YTN; PAM sequence: TTC
acacaactcactacacatca

SEQ ID NO: 259861 - DNA, 20 bp, Artificial Sequence
  Description of Artificial Sequence: Synthetic oligonucleotide
  Target: ATXN1; (+) strand; PAM type: YTN; PAM sequence: CTC
actacacatcaccagaccga

SEQ ID NO: 259862 - DNA, 20 bp, Artificial Sequence
  Description of Artificial Sequence: Synthetic oligonucleotide
  Target: ATXN1; (+) strand; PAM type: YTN; PAM sequence: CTA
cacatcaccagaccgacgtg

SEQ ID NO: 259863 - DNA, 20 bp, Artificial Sequence
  Description of Artificial Sequence: Synthetic oligonucleotide
  Target: ATXN1; (+) strand; PAM type: YTN; PAM sequence: CTT
tctcctaaccataaataata

SEQ ID NO: 259864 - DNA, 20 bp, Artificial Sequence
  Description of Artificial Sequence: Synthetic oligonucleotide
  Target: ATXN1; (+) strand; PAM type: YTN; PAM sequence: TTT
ctcctaaccataaataataa

SEQ ID NO: 259865 - DNA, 20 bp, Artificial Sequence
  Description of Artificial Sequence: Synthetic oligonucleotide
  Target: ATXN1; (+) strand; PAM type: YTN; PAM sequence: TTC
tcctaaccataaataataaa

SEQ ID NO: 259866 - DNA, 20 bp, Artificial Sequence
  Description of Artificial Sequence: Synthetic oligonucleotide
  Target: ATXN1; (+) strand; PAM type: YTN; PAM sequence: CTC
ctaaccataaataataaagg

SEQ ID NO: 259867 - DNA, 20 bp, Artificial Sequence
  Description of Artificial Sequence: Synthetic oligonucleotide
  Target: ATXN1; (+) strand; PAM type: YTN; PAM sequence: CTA
accataaataataaagggac

SEQ ID NO: 259868 - DNA, 20 bp, Artificial Sequence
  Description of Artificial Sequence: Synthetic oligonucleotide
  Target: ATXN1; (+) strand; PAM type: YTN; PAM sequence: CTC
agaagccccaagtggggaga

SEQ ID NO: 259869 - DNA, 20 bp, Artificial Sequence
  Description of Artificial Sequence: Synthetic oligonucleotide
  Target: ATXN1; (+) strand; PAM type: YTN; PAM sequence: TTA
atgggtttgcggttagaagg

SEQ ID NO: 259870 - DNA, 20 bp, Artificial Sequence
  Description of Artificial Sequence: Synthetic oligonucleotide
  Target: ATXN1; (+) strand; PAM type: YTN; PAM sequence: TTT
gcggttagaaggctttgcgg

SEQ ID NO: 259871 - DNA, 20 bp, Artificial Sequence
  Description of Artificial Sequence: Synthetic oligonucleotide
  Target: ATXN1; (+) strand; PAM type: YTN; PAM sequence: TTG
cggttagaaggctttgcgga

SEQ ID NO: 259872 - DNA, 20 bp, Artificial Sequence
  Description of Artificial Sequence: Synthetic oligonucleotide
  Target: ATXN1; (+) strand; PAM type: YTN; PAM sequence: TTA
gaaggctttgcggaagaggg

SEQ ID NO: 259873 - DNA, 20 bp, Artificial Sequence
  Description of Artificial Sequence: Synthetic oligonucleotide
  Target: ATXN1; (+) strand; PAM type: YTN; PAM sequence: CTT
tgcggaagaggggatgggag

SEQ ID NO: 259874 - DNA, 20 bp, Artificial Sequence
  Description of Artificial Sequence: Synthetic oligonucleotide
  Target: ATXN1; (+) strand; PAM type: YTN; PAM sequence: TTT
gcggaagaggggatgggagc

SEQ ID NO: 259875 - DNA, 20 bp, Artificial Sequence
  Description of Artificial Sequence: Synthetic oligonucleotide
  Target: ATXN1; (+) strand; PAM type: YTN; PAM sequence: TTG
cggaagaggggatgggagct

SEQ ID NO: 259876 - DNA, 20 bp, Artificial Sequence
  Description of Artificial Sequence: Synthetic oligonucleotide
  Target: ATXN1; (+) strand; PAM type: YTN; PAM sequence: CTG
ggccctgaagtagaggaagg

SEQ ID NO: 259877 - DNA, 20 bp, Artificial Sequence
  Description of Artificial Sequence: Synthetic oligonucleotide
  Target: ATXN1; (+) strand; PAM type: YTN; PAM sequence: CTG
aagtagaggaaggattttga

SEQ ID NO: 259878 - DNA, 20 bp, Artificial Sequence
  Description of Artificial Sequence: Synthetic oligonucleotide
  Target: ATXN1; (+) strand; PAM type: YTN; PAM sequence: TTT
tgacgggctgggtcagatgg

SEQ ID NO: 259879 - DNA, 20 bp, Artificial Sequence
  Description of Artificial Sequence: Synthetic oligonucleotide
  Target: ATXN1; (+) strand; PAM type: YTN; PAM sequence: TTT
gacgggctgggtcagatgga

SEQ ID NO: 259880 - DNA, 20 bp, Artificial Sequence
  Description of Artificial Sequence: Synthetic oligonucleotide
  Target: ATXN1; (+) strand; PAM type: YTN; PAM sequence: TTG
acgggctgggtcagatggag

SEQ ID NO: 259881 - DNA, 20 bp, Artificial Sequence
  Description of Artificial Sequence: Synthetic oligonucleotide
  Target: ATXN1; (+) strand; PAM type: YTN; PAM sequence: CTG
ggtcagatggagggaaatat

SEQ ID NO: 259882 - DNA, 20 bp, Artificial Sequence
  Description of Artificial Sequence: Synthetic oligonucleotide
  Target: ATXN1; (+) strand; PAM type: YTN; PAM sequence: TTA
gaattacaatgtgaagtaag

SEQ ID NO: 259883 - DNA, 20 bp, Artificial Sequence
  Description of Artificial Sequence: Synthetic oligonucleotide
  Target: ATXN1; (+) strand; PAM type: YTN; PAM sequence: TTA
caatgtgaagtaaggtttgg

SEQ ID NO: 259884 - DNA, 20 bp, Artificial Sequence
  Description of Artificial Sequence: Synthetic oligonucleotide
  Target: ATXN1; (+) strand; PAM type: YTN; PAM sequence: TTT
ggttgggacataggctgcca

SEQ ID NO: 259885 - DNA, 20 bp, Artificial Sequence
  Description of Artificial Sequence: Synthetic oligonucleotide
  Target: ATXN1; (+) strand; PAM type: YTN; PAM sequence: TTG
gttgggacataggctgccag

SEQ ID NO: 259886 - DNA, 20 bp, Artificial Sequence
  Description of Artificial Sequence: Synthetic oligonucleotide
  Target: ATXN1; (+) strand; PAM type: YTN; PAM sequence: TTG
ggacataggctgccagtgga

SEQ ID NO: 259887 - DNA, 20 bp, Artificial Sequence
  Description of Artificial Sequence: Synthetic oligonucleotide
  Target: ATXN1; (+) strand; PAM type: YTN; PAM sequence: CTG
ccagtggagcagtgggggcg

SEQ ID NO: 259888 - DNA, 20 bp, Artificial Sequence
  Description of Artificial Sequence: Synthetic oligonucleotide
  Target: ATXN1; (+) strand; PAM type: YTN; PAM sequence: CTG
ctggacaccctggcgacctg

SEQ ID NO: 259889 - DNA, 20 bp, Artificial Sequence
  Description of Artificial Sequence: Synthetic oligonucleotide
  Target: ATXN1; (+) strand; PAM type: YTN; PAM sequence: CTG
gacaccctggcgacctgttc

SEQ ID NO: 259890 - DNA, 20 bp, Artificial Sequence
  Description of Artificial Sequence: Synthetic oligonucleotide
  Target: ATXN1; (+) strand; PAM type: YTN; PAM sequence: CTG
gcgacctgttcctgcacctg

SEQ ID NO: 259891 - DNA, 20 bp, Artificial Sequence
  Description of Artificial Sequence: Synthetic oligonucleotide
  Target: ATXN1; (+) strand; PAM type: YTN; PAM sequence: CTG
ttcctgcacctgttccctcc

SEQ ID NO: 259892 - DNA, 20 bp, Artificial Sequence
  Description of Artificial Sequence: Synthetic oligonucleotide
  Target: ATXN1; (+) strand; PAM type: YTN; PAM sequence: TTC
ctgcacctgttccctcctca

SEQ ID NO: 259893 - DNA, 20 bp, Artificial Sequence
  Description of Artificial Sequence: Synthetic oligonucleotide
  Target: ATXN1; (+) strand; PAM type: YTN; PAM sequence: CTG
cacctgttccctcctcacta

SEQ ID NO: 259894 - DNA, 20 bp, Artificial Sequence
  Description of Artificial Sequence: Synthetic oligonucleotide
  Target: ATXN1; (+) strand; PAM type: YTN; PAM sequence: CTG
ttccctcctcactaggtgat

SEQ ID NO: 259895 - DNA, 20 bp, Artificial Sequence
  Description of Artificial Sequence: Synthetic oligonucleotide
  Target: ATXN1; (+) strand; PAM type: YTN; PAM sequence: TTC
cctcctcactaggtgatgga

SEQ ID NO: 259896 - DNA, 20 bp, Artificial Sequence
  Description of Artificial Sequence: Synthetic oligonucleotide
  Target: ATXN1; (+) strand; PAM type: YTN; PAM sequence: CTC
ctcactaggtgatggaggca

SEQ ID NO: 259897 - DNA, 20 bp, Artificial Sequence
  Description of Artificial Sequence: Synthetic oligonucleotide
  Target: ATXN1; (+) strand; PAM type: YTN; PAM sequence: CTC
actaggtgatggaggcagag

SEQ ID NO: 259898 - DNA, 20 bp, Artificial Sequence
  Description of Artificial Sequence: Synthetic oligonucleotide
  Target: ATXN1; (+) strand; PAM type: YTN; PAM sequence: CTA
ggtgatggaggcagagagga

SEQ ID NO: 259899 - DNA, 20 bp, Artificial Sequence
  Description of Artificial Sequence: Synthetic oligonucleotide
  Target: ATXN1; (+) strand; PAM type: YTN; PAM sequence: CTG
aagagaggagacatgagggc

SEQ ID NO: 259900 - DNA, 20 bp, Artificial Sequence
  Description of Artificial Sequence: Synthetic oligonucleotide
  Target: ATXN1; (+) strand; PAM type: YTN; PAM sequence: CTG
tgcggtggccctggtgcatc

SEQ ID NO: 259901 - DNA, 20 bp, Artificial Sequence
  Description of Artificial Sequence: Synthetic oligonucleotide
  Target: ATXN1; (+) strand; PAM type: YTN; PAM sequence: CTG
gtgcatcatttcctaagaac

SEQ ID NO: 259902 - DNA, 20 bp, Artificial Sequence
  Description of Artificial Sequence: Synthetic oligonucleotide
  Target: ATXN1; (+) strand; PAM type: YTN; PAM sequence: TTT
cctaagaaccctaaatttaa

SEQ ID NO: 259903 - DNA, 20 bp, Artificial Sequence
  Description of Artificial Sequence: Synthetic oligonucleotide
  Target: ATXN1; (+) strand; PAM type: YTN; PAM sequence: TTC
ctaagaaccctaaatttaaa

SEQ ID NO: 259904 - DNA, 20 bp, Artificial Sequence
  Description of Artificial Sequence: Synthetic oligonucleotide
  Target: ATXN1; (+) strand; PAM type: YTN; PAM sequence: CTA
agaaccctaaatttaaattc

SEQ ID NO: 259905 - DNA, 20 bp, Artificial Sequence
  Description of Artificial Sequence: Synthetic oligonucleotide
  Target: ATXN1; (+) strand; PAM type: YTN; PAM sequence: CTA
aatttaaattctctgcccta

SEQ ID NO: 259906 - DNA, 20 bp, Artificial Sequence
  Description of Artificial Sequence: Synthetic oligonucleotide
  Target: ATXN1; (+) strand; PAM type: YTN; PAM sequence: TTT
aaattctctgccctactatt

SEQ ID NO: 259907 - DNA, 20 bp, Artificial Sequence
  Description of Artificial Sequence: Synthetic oligonucleotide
  Target: ATXN1; (+) strand; PAM type: YTN; PAM sequence: TTA
aattctctgccctactattt

SEQ ID NO: 259908 - DNA, 20 bp, Artificial Sequence
  Description of Artificial Sequence: Synthetic oligonucleotide
  Target: ATXN1; (+) strand; PAM type: YTN; PAM sequence: TTC
tctgccctactatttcttcc

SEQ ID NO: 259909 - DNA, 20 bp, Artificial Sequence
  Description of Artificial Sequence: Synthetic oligonucleotide
  Target: ATXN1; (+) strand; PAM type: YTN; PAM sequence: CTC
tgccctactatttcttcccc

SEQ ID NO: 259910 - DNA, 20 bp, Artificial Sequence
  Description of Artificial Sequence: Synthetic oligonucleotide
  Target: ATXN1; (+) strand; PAM type: YTN; PAM sequence: CTG
ccctactatttcttccccat

SEQ ID NO: 259911 - DNA, 20 bp, Artificial Sequence
  Description of Artificial Sequence: Synthetic oligonucleotide
  Target: ATXN1; (+) strand; PAM type: YTN; PAM sequence: CTA
ctatttcttccccatagaca

SEQ ID NO: 259912 - DNA, 20 bp, Artificial Sequence
  Description of Artificial Sequence: Synthetic oligonucleotide
  Target: ATXN1; (+) strand; PAM type: YTN; PAM sequence: CTA
tttcttccccatagacagag

SEQ ID NO: 259913 - DNA, 20 bp, Artificial Sequence
  Description of Artificial Sequence: Synthetic oligonucleotide
  Target: ATXN1; (+) strand; PAM type: YTN; PAM sequence: TTT
cttccccatagacagagatc

SEQ ID NO: 259914 - DNA, 20 bp, Artificial Sequence
  Description of Artificial Sequence: Synthetic oligonucleotide
  Target: ATXN1; (+) strand; PAM type: YTN; PAM sequence: TTC
ttccccatagacagagatcc

SEQ ID NO: 259915 - DNA, 20 bp, Artificial Sequence
  Description of Artificial Sequence: Synthetic oligonucleotide
  Target: ATXN1; (+) strand; PAM type: YTN; PAM sequence: CTT
ccccatagacagagatccct

SEQ ID NO: 259916 - DNA, 20 bp, Artificial Sequence
  Description of Artificial Sequence: Synthetic oligonucleotide
  Target: ATXN1; (+) strand; PAM type: YTN; PAM sequence: TTC
cccatagacagagatccctt

SEQ ID NO: 259917 - DNA, 20 bp, Artificial Sequence
  Description of Artificial Sequence: Synthetic oligonucleotide
  Target: ATXN1; (+) strand; PAM type: YTN; PAM sequence: CTT
agttctttcaaactcctttt

SEQ ID NO: 259918 - DNA, 20 bp, Artificial Sequence
  Description of Artificial Sequence: Synthetic oligonucleotide
  Target: ATXN1; (+) strand; PAM type: YTN; PAM sequence: TTA
gttctttcaaactccttttt

SEQ ID NO: 259919 - DNA, 20 bp, Artificial Sequence
  Description of Artificial Sequence: Synthetic oligonucleotide
  Target: ATXN1; (+) strand; PAM type: YTN; PAM sequence: TTC
tttcaaactcctttttcctt

SEQ ID NO: 259920 - DNA, 20 bp, Artificial Sequence
  Description of Artificial Sequence: Synthetic oligonucleotide
  Target: ATXN1; (+) strand; PAM type: YTN; PAM sequence: CTT
tcaaactcctttttccttac

SEQ ID NO: 259921 - DNA, 20 bp, Artificial Sequence
  Description of Artificial Sequence: Synthetic oligonucleotide
  Target: ATXN1; (+) strand; PAM type: YTN; PAM sequence: TTT
caaactcctttttccttact

SEQ ID NO: 259922 - DNA, 20 bp, Artificial Sequence
  Description of Artificial Sequence: Synthetic oligonucleotide
  Target: ATXN1; (+) strand; PAM type: YTN; PAM sequence: TTC
aaactcctttttccttactg

SEQ ID NO: 259923 - DNA, 20 bp, Artificial Sequence
  Description of Artificial Sequence: Synthetic oligonucleotide
  Target: ATXN1; (+) strand; PAM type: YTN; PAM sequence: CTC
ctttttccttactgactgta

SEQ ID NO: 259924 - DNA, 20 bp, Artificial Sequence
  Description of Artificial Sequence: Synthetic oligonucleotide
  Target: ATXN1; (+) strand; PAM type: YTN; PAM sequence: CTT
tttccttactgactgtagag

SEQ ID NO: 259925 - DNA, 20 bp, Artificial Sequence
  Description of Artificial Sequence: Synthetic oligonucleotide
  Target: ATXN1; (+) strand; PAM type: YTN; PAM sequence: TTT
ttccttactgactgtagaga

SEQ ID NO: 259926 - DNA, 20 bp, Artificial Sequence
  Description of Artificial Sequence: Synthetic oligonucleotide
  Target: ATXN1; (+) strand; PAM type: YTN; PAM sequence: TTT
tccttactgactgtagagac

SEQ ID NO: 259927 - DNA, 20 bp, Artificial Sequence
  Description of Artificial Sequence: Synthetic oligonucleotide
  Target: ATXN1; (+) strand; PAM type: YTN; PAM sequence: TTT
ccttactgactgtagagacc

SEQ ID NO: 259928 - DNA, 20 bp, Artificial Sequence
  Description of Artificial Sequence: Synthetic oligonucleotide
  Target: ATXN1; (+) strand; PAM type: YTN; PAM sequence: TTC
cttactgactgtagagaccc

SEQ ID NO: 259929 - DNA, 20 bp, Artificial Sequence
  Description of Artificial Sequence: Synthetic oligonucleotide
  Target: ATXN1; (+) strand; PAM type: YTN; PAM sequence: CTT
actgactgtagagaccccaa

SEQ ID NO: 259930 - DNA, 20 bp, Artificial Sequence
  Description of Artificial Sequence: Synthetic oligonucleotide
  Target: ATXN1; (+) strand; PAM type: YTN; PAM sequence: TTA
ctgactgtagagaccccaag

SEQ ID NO: 259931 - DNA, 20 bp, Artificial Sequence
  Description of Artificial Sequence: Synthetic oligonucleotide
  Target: ATXN1; (+) strand; PAM type: YTN; PAM sequence: CTG
actgtagagaccccaagttt

SEQ ID NO: 259932 - DNA, 20 bp, Artificial Sequence
  Description of Artificial Sequence: Synthetic oligonucleotide
  Target: ATXN1; (+) strand; PAM type: YTN; PAM sequence: CTG
tagagaccccaagtttctca

SEQ ID NO: 259933 - DNA, 20 bp, Artificial Sequence
  Description of Artificial Sequence: Synthetic oligonucleotide
  Target: ATXN1; (+) strand; PAM type: YTN; PAM sequence: TTT
ctcactggcactgcaaaata

SEQ ID NO: 259934 - DNA, 20 bp, Artificial Sequence
  Description of Artificial Sequence: Synthetic oligonucleotide
  Target: ATXN1; (+) strand; PAM type: YTN; PAM sequence: TTC
tcactggcactgcaaaatat

SEQ ID NO: 259935 - DNA, 20 bp, Artificial Sequence
  Description of Artificial Sequence: Synthetic oligonucleotide
  Target: ATXN1; (+) strand; PAM type: YTN; PAM sequence: CTC
actggcactgcaaaatatat

SEQ ID NO: 259936 - DNA, 20 bp, Artificial Sequence
  Description of Artificial Sequence: Synthetic oligonucleotide
  Target: ATXN1; (+) strand; PAM type: YTN; PAM sequence: CTG
gcactgcaaaatatatgcag

SEQ ID NO: 259937 - DNA, 20 bp, Artificial Sequence
  Description of Artificial Sequence: Synthetic oligonucleotide
  Target: ATXN1; (+) strand; PAM type: YTN; PAM sequence: CTG
caaaatatatgcagaaattt

SEQ ID NO: 259938 - DNA, 20 bp, Artificial Sequence
  Description of Artificial Sequence: Synthetic oligonucleotide
  Target: ATXN1; (+) strand; PAM type: YTN; PAM sequence: TTT
gacagtgggtgataacagga

SEQ ID NO: 259939 - DNA, 20 bp, Artificial Sequence
  Description of Artificial Sequence: Synthetic oligonucleotide
  Target: ATXN1; (+) strand; PAM type: YTN; PAM sequence: TTG
acagtgggtgataacaggat

SEQ ID NO: 259940 - DNA, 20 bp, Artificial Sequence
  Description of Artificial Sequence: Synthetic oligonucleotide
  Target: ATXN1; (+) strand; PAM type: YTN; PAM sequence: TTT
ggagtccttttagcattaaa

SEQ ID NO: 259941 - DNA, 20 bp, Artificial Sequence
  Description of Artificial Sequence: Synthetic oligonucleotide
  Target: ATXN1; (+) strand; PAM type: YTN; PAM sequence: TTG
gagtccttttagcattaaaa

SEQ ID NO: 259942 - DNA, 20 bp, Artificial Sequence
  Description of Artificial Sequence: Synthetic oligonucleotide
  Target: ATXN1; (+) strand; PAM type: YTN; PAM sequence: CTT
ttagcattaaaaaaaaaaac

SEQ ID NO: 259943 - DNA, 20 bp, Artificial Sequence
  Description of Artificial Sequence: Synthetic oligonucleotide
  Target: ATXN1; (+) strand; PAM type: YTN; PAM sequence: TTT
tagcattaaaaaaaaaaaca

SEQ ID NO: 259944 - DNA, 20 bp, Artificial Sequence
  Description of Artificial Sequence: Synthetic oligonucleotide
  Target: ATXN1; (+) strand; PAM type: YTN; PAM sequence: TTT
agcattaaaaaaaaaaacaa

SEQ ID NO: 259945 - DNA, 20 bp, Artificial Sequence
  Description of Artificial Sequence: Synthetic oligonucleotide
  Target: ATXN1; (+) strand; PAM type: YTN; PAM sequence: TTA
gcattaaaaaaaaaaacaac

SEQ ID NO: 259946 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaaacaaccagtag

SEQ ID NO: 259947 - DNA, 20 bp, Artificial Sequence
  Description of Artificial Sequence: Synthetic oligonucleotide
  Target: ATXN1; (+) strand; PAM type: YTN; PAM sequence: TTT
tttgttcgtttttttttttt

SEQ ID NO: 259948 - DNA, 20 bp, Artificial Sequence
  Description of Artificial Sequence: Synthetic oligonucleotide
  Target: ATXN1; (+) strand; PAM type: YTN; PAM sequence: TTT
ttgttcgttttttttttttt

SEQ ID NO: 259949 - DNA, 20 bp, Artificial Sequence
  Description of Artificial Sequence: Synthetic oligonucleotide
  Target: ATXN1; (+) strand; PAM type: YTN; PAM sequence: TTT
tgttcgtttttttttttttt

SEQ ID NO: 259950 - DNA, 20 bp, Artificial Sequence
  Description of Artificial Sequence: Synthetic oligonucleotide
  Target: ATXN1; (+) strand; PAM type: YTN; PAM sequence: TTT
gttcgttttttttttttttt

SEQ ID NO: 259951 - DNA, 20 bp, Artificial Sequence
  Description of Artificial Sequence: Synthetic oligonucleotide
  Target: ATXN1; (+) strand; PAM type: YTN; PAM sequence: TTG
ttcgtttttttttttttttt

SEQ ID NO: 259952 - DNA, 20 bp, Artificial Sequence
  Description of Artificial Sequence: Synthetic oligonucleotide
  Target: ATXN1; (+) strand; PAM type: YTN; PAM sequence: TTC
gttttttttttttttttttg

SEQ ID NO: 259953 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttgagaa

SEQ ID NO: 259954 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgagaaa

SEQ ID NO: 259955 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgagaaag

SEQ ID NO: 259956 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgagaaaga

SEQ ID NO: 259957 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgagaaagag

SEQ ID NO: 259958 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgagaaagagt

SEQ ID NO: 259959 - DNA, 20 bp, Artificial Sequence
  Description of Artificial Sequence: Synthetic oligonucleotide
  Target: ATXN1; (+) strand; PAM type: YTN; PAM sequence: TTT
tttttttttgagaaagagtc

SEQ ID NO: 259960 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagaaagagtct

SEQ ID NO: 259961 - DNA, 20 bp, Artificial Sequence
  Description of Artificial Sequence: Synthetic oligonucleotide
  Target: ATXN1; (+) strand; PAM type: YTN; PAM sequence: TTT
tttttttgagaaagagtctc

SEQ ID NO: 259962 - DNA, 20 bp, Artificial Sequence
  Description of Artificial Sequence: Synthetic oligonucleotide
  Target: ATXN1; (+) strand; PAM type: YTN; PAM sequence: TTT
ttttttgagaaagagtctcc

SEQ ID NO: 259963 - DNA, 20 bp, Artificial Sequence
  Description of Artificial Sequence: Synthetic oligonucleotide
  Target: ATXN1; (+) strand; PAM type: YTN; PAM sequence: TTT
tttttgagaaagagtctcct

SEQ ID NO: 259964 - DNA, 20 bp, Artificial Sequence
  Description of Artificial Sequence: Synthetic oligonucleotide
  Target: ATXN1; (+) strand; PAM type: YTN; PAM sequence: TTT
ttttgagaaagagtctcctc

SEQ ID NO: 259965 - DNA, 20 bp, Artificial Sequence
  Description of Artificial Sequence: Synthetic oligonucleotide
  Target: ATXN1; (+) strand; PAM type: YTN; PAM sequence: TTT
tttgagaaagagtctcctcc

SEQ ID NO: 259966 - DNA, 20 bp, Artificial Sequence
  Description of Artificial Sequence: Synthetic oligonucleotide
  Target: ATXN1; (+) strand; PAM type: YTN; PAM sequence: TTT
ttgagaaagagtctcctcca

SEQ ID NO: 259967 - DNA, 20 bp, Artificial Sequence
  Description of Artificial Sequence: Synthetic oligonucleotide
  Target: ATXN1; (+) strand; PAM type: YTN; PAM sequence: TTT
tgagaaagagtctcctccag

SEQ ID NO: 259968 - DNA, 20 bp, Artificial Sequence
  Description of Artificial Sequence: Synthetic oligonucleotide
  Target: ATXN1; (+) strand; PAM type: YTN; PAM sequence: TTT
gagaaagagtctcctccagg

SEQ ID NO: 259969 - DNA, 20 bp, Artificial Sequence
  Description of Artificial Sequence: Synthetic oligonucleotide
  Target: ATXN1; (+) strand; PAM type: YTN; PAM sequence: TTG
agaaagagtctcctccaggc

SEQ ID NO: 259970 - DNA, 20 bp, Artificial Sequence
  Description of Artificial Sequence: Synthetic oligonucleotide
  Target: ATXN1; (+) strand; PAM type: YTN; PAM sequence: CTC
ctccaggctggagtgcagtg

SEQ ID NO: 259971 - DNA, 20 bp, Artificial Sequence
  Description of Artificial Sequence: Synthetic oligonucleotide
  Target: ATXN1; (+) strand; PAM type: YTN; PAM sequence: CTC
caggctggagtgcagtggta

SEQ ID NO: 259972 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggtacgatctc

SEQ ID NO: 259973 - DNA, 20 bp, Artificial Sequence
  Description of Artificial Sequence: Synthetic oligonucleotide
  Target: ATXN1; (+) strand; PAM type: YTN; PAM sequence: CTC
agctgactgcaacctccgcc

SEQ ID NO: 259974 - DNA, 20 bp, Artificial Sequence
  Description of Artificial Sequence: Synthetic oligonucleotide
  Target: ATXN1; (+) strand; PAM type: YTN; PAM sequence: CTG
actgcaacctccgcctccca

SEQ ID NO: 259975 - DNA, 20 bp, Artificial Sequence
  Description of Artificial Sequence: Synthetic oligonucleotide
  Target: ATXN1; (+) strand; PAM type: YTN; PAM sequence: CTG
caacctccgcctcccaggtt

SEQ ID NO: 259976 - DNA, 20 bp, Artificial Sequence
  Description of Artificial Sequence: Synthetic oligonucleotide
  Target: ATXN1; (+) strand; PAM type: YTN; PAM sequence: CTC
cgcctcccaggttcaagtga

SEQ ID NO: 259977 - DNA, 20 bp, Artificial Sequence
  Description of Artificial Sequence: Synthetic oligonucleotide
  Target: ATXN1; (+) strand; PAM type: YTN; PAM sequence: CTC
ccaggttcaagtgattctca

SEQ ID NO: 259978 - DNA, 20 bp, Artificial Sequence
  Description of Artificial Sequence: Synthetic oligonucleotide
  Target: ATXN1; (+) strand; PAM type: YTN; PAM sequence: TTC
aagtgattctcatgccttag

SEQ ID NO: 259979 - DNA, 20 bp, Artificial Sequence
  Description of Artificial Sequence: Synthetic oligonucleotide
  Target: ATXN1; (+) strand; PAM type: YTN; PAM sequence: TTC
tcatgccttagcctcccaag

SEQ ID NO: 259980 - DNA, 20 bp, Artificial Sequence
  Description of Artificial Sequence: Synthetic oligonucleotide
  Target: ATXN1; (+) strand; PAM type: YTN; PAM sequence: CTC
atgccttagcctcccaagta

SEQ ID NO: 259981 - DNA, 20 bp, Artificial Sequence
  Description of Artificial Sequence: Synthetic oligonucleotide
  Target: ATXN1; (+) strand; PAM type: YTN; PAM sequence: CTT
agcctcccaagtagctggga

SEQ ID NO: 259982 - DNA, 20 bp, Artificial Sequence
  Description of Artificial Sequence: Synthetic oligonucleotide
  Target: ATXN1; (+) strand; PAM type: YTN; PAM sequence: TTA
gcctcccaagtagctgggat

SEQ ID NO: 259983 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctgggattacag

SEQ ID NO: 259984 - DNA, 20 bp, Artificial Sequence
  Description of Artificial Sequence: Synthetic oligonucleotide
  Target: ATXN1; (+) strand; PAM type: YTN; PAM sequence: CTG
ggattacaggtgcccaccac

SEQ ID NO: 259985 - DNA, 20 bp, Artificial Sequence
  Description of Artificial Sequence: Synthetic oligonucleotide
  Target: ATXN1; (+) strand; PAM type: YTN; PAM sequence: TTA
caggtgcccaccaccacgcc

SEQ ID NO: 259986 - DNA, 20 bp, Artificial Sequence
  Description of Artificial Sequence: Synthetic oligonucleotide
  Target: ATXN1; (+) strand; PAM type: YTN; PAM sequence: CTG
gctaatttttgtatttttag

SEQ ID NO: 259987 - DNA, 20 bp, Artificial Sequence
  Description of Artificial Sequence: Synthetic oligonucleotide
  Target: ATXN1; (+) strand; PAM type: YTN; PAM sequence: CTA
atttttgtatttttagtaga

SEQ ID NO: 259988 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagata

SEQ ID NO: 259989 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagatag

SEQ ID NO: 259990 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagatagg

SEQ ID NO: 259991 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagataggg

SEQ ID NO: 259992 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatagggttttg

SEQ ID NO: 259993 - DNA, 20 bp, Artificial Sequence
  Description of Artificial Sequence: Synthetic oligonucleotide
  Target: ATXN1; (+) strand; PAM type: YTN; PAM sequence: TTT
tagtagagatagggttttgc

SEQ ID NO: 259994 - DNA, 20 bp, Artificial Sequence
  Description of Artificial Sequence: Synthetic oligonucleotide
  Target: ATXN1; (+) strand; PAM type: YTN; PAM sequence: TTT
agtagagatagggttttgcc

SEQ ID NO: 259995 - DNA, 20 bp, Artificial Sequence
  Description of Artificial Sequence: Synthetic oligonucleotide
  Target: ATXN1; (+) strand; PAM type: YTN; PAM sequence: TTA
gtagagatagggttttgcca

SEQ ID NO: 259996 - DNA, 20 bp, Artificial Sequence
  Description of Artificial Sequence: Synthetic oligonucleotide
  Target: ATXN1; (+) strand; PAM type: YTN; PAM sequence: TTT
tgccatgttggccaggctgg

SEQ ID NO: 259997 - DNA, 20 bp, Artificial Sequence
  Description of Artificial Sequence: Synthetic oligonucleotide
  Target: ATXN1; (+) strand; PAM type: YTN; PAM sequence: TTT
gccatgttggccaggctggt

SEQ ID NO: 259998 - DNA, 20 bp, Artificial Sequence
  Description of Artificial Sequence: Synthetic oligonucleotide
  Target: ATXN1; (+) strand; PAM type: YTN; PAM sequence: TTG
ccatgttggccaggctggtc

SEQ ID NO: 259999 - DNA, 20 bp, Artificial Sequence
  Description of Artificial Sequence: Synthetic oligonucleotide
  Target: ATXN1; (+) strand; PAM type: YTN; PAM sequence: TTG
gccaggctggtctcaaactc

SEQ ID NO: 260000 - DNA, 20 bp, Artificial Sequence
  Description of Artificial Sequence: Synthetic oligonucleotide
  Target: ATXN1; (+) strand; PAM type: YTN; PAM sequence: CTG
gtctcaaactcctggcctca

SEQ ID NO: 260001 - DNA, 20 bp, Artificial Sequence
  Description of Artificial Sequence: Synthetic oligonucleotide
  Target: ATXN1; (+) strand; PAM type: YTN; PAM sequence: CTC
aaactcctggcctcaggtga

SEQ ID NO: 260002 - DNA, 20 bp, Artificial Sequence
  Description of Artificial Sequence: Synthetic oligonucleotide
  Target: ATXN1; (+) strand; PAM type: YTN; PAM sequence: CTC
ctggcctcaggtgatccacc

SEQ ID NO: 260003 - DNA, 20 bp, Artificial Sequence
  Description of Artificial Sequence: Synthetic oligonucleotide
  Target: ATXN1; (+) strand; PAM type: YTN; PAM sequence: CTG
gcctcaggtgatccacccat

SEQ ID NO: 260004 - DNA, 20 bp, Artificial Sequence
  Description of Artificial Sequence: Synthetic oligonucleotide
  Target: ATXN1; (+) strand; PAM type: YTN; PAM sequence: CTC
aggtgatccacccatctcgg

SEQ ID NO: 260005 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaaatgctgaga

SEQ ID NO: 260006 - DNA, 20 bp, Artificial Sequence
  Description of Artificial Sequence: Synthetic oligonucleotide
  Target: ATXN1; (+) strand; PAM type: YTN; PAM sequence: CTC
ccaaaatgctgagattacag

SEQ ID NO: 260007 - DNA, 20 bp, Artificial Sequence
  Description of Artificial Sequence: Synthetic oligonucleotide
  Target: ATXN1; (+) strand; PAM type: YTN; PAM sequence: CTG
agattacaggtgtgagccac

SEQ ID NO: 260008 - DNA, 20 bp, Artificial Sequence
  Description of Artificial Sequence: Synthetic oligonucleotide
  Target: ATXN1; (+) strand; PAM type: YTN; PAM sequence: TTA
caggtgtgagccactgagcc

SEQ ID NO: 260009 - DNA, 20 bp, Artificial Sequence
  Description of Artificial Sequence: Synthetic oligonucleotide
  Target: ATXN1; (+) strand; PAM type: YTN; PAM sequence: CTG
agcctggctggagttttctc

SEQ ID NO: 260010 - DNA, 20 bp, Artificial Sequence
  Description of Artificial Sequence: Synthetic oligonucleotide
  Target: ATXN1; (+) strand; PAM type: YTN; PAM sequence: CTG
gctggagttttctcttatca

SEQ ID NO: 260011 - DNA, 20 bp, Artificial Sequence
  Description of Artificial Sequence: Synthetic oligonucleotide
  Target: ATXN1; (+) strand; PAM type: YTN; PAM sequence: CTG
gagttttctcttatcataga

SEQ ID NO: 260012 - DNA, 20 bp, Artificial Sequence
  Description of Artificial Sequence: Synthetic oligonucleotide
  Target: ATXN1; (+) strand; PAM type: YTN; PAM sequence: TTT
tctcttatcatagaagcatt

SEQ ID NO: 260013 - DNA, 20 bp, Artificial Sequence
  Description of Artificial Sequence: Synthetic oligonucleotide
  Target: ATXN1; (+) strand; PAM type: YTN; PAM sequence: TTT
ctcttatcatagaagcattc

SEQ ID NO: 260014 - DNA, 20 bp, Artificial Sequence
  Description of Artificial Sequence: Synthetic oligonucleotide
  Target: ATXN1; (+) strand; PAM type: YTN; PAM sequence: TTC
tcttatcatagaagcattct

SEQ ID NO: 260015 - DNA, 20 bp, Artificial Sequence
  Description of Artificial Sequence: Synthetic oligonucleotide
  Target: ATXN1; (+) strand; PAM type: YTN; PAM sequence: CTC
ttatcatagaagcattctgt

SEQ ID NO: 260016 - DNA, 20 bp, Artificial Sequence
  Description of Artificial Sequence: Synthetic oligonucleotide
  Target: ATXN1; (+) strand; PAM type: YTN; PAM sequence: CTT
atcatagaagcattctgtgt

SEQ ID NO: 260017 - DNA, 20 bp, Artificial Sequence
  Description of Artificial Sequence: Synthetic oligonucleotide
  Target: ATXN1; (+) strand; PAM type: YTN; PAM sequence: TTA
tcatagaagcattctgtgtt

SEQ ID NO: 260018 - DNA, 20 bp, Artificial Sequence
  Description of Artificial Sequence: Synthetic oligonucleotide
  Target: ATXN1; (+) strand; PAM type: YTN; PAM sequence: TTC
tgtgtttctatgagttttag

SEQ ID NO: 260019 - DNA, 20 bp, Artificial Sequence
  Description of Artificial Sequence: Synthetic oligonucleotide
  Target: ATXN1; (+) strand; PAM type: YTN; PAM sequence: CTG
tgtttctatgagttttaggc

SEQ ID NO: 260020 - DNA, 20 bp, Artificial Sequence
  Description of Artificial Sequence: Synthetic oligonucleotide
  Target: ATXN1; (+) strand; PAM type: YTN; PAM sequence: TTT
ctatgagttttaggcccatt

SEQ ID NO: 260021 - DNA, 20 bp, Artificial Sequence
  Description of Artificial Sequence: Synthetic oligonucleotide
  Target: ATXN1; (+) strand; PAM type: YTN; PAM sequence: TTC
tatgagttttaggcccattc

SEQ ID NO: 260022 - DNA, 20 bp, Artificial Sequence
  Description of Artificial Sequence: Synthetic oligonucleotide
  Target: ATXN1; (+) strand; PAM type: YTN; PAM sequence: CTA
tgagttttaggcccattcga

SEQ ID NO: 260023 - DNA, 20 bp, Artificial Sequence
  Description of Artificial Sequence: Synthetic oligonucleotide
  Target: ATXN1; (+) strand; PAM type: YTN; PAM sequence: TTT
taggcccattcgatccacat

SEQ ID NO: 260024 - DNA, 20 bp, Artificial Sequence
  Description of Artificial Sequence: Synthetic oligonucleotide
  Target: ATXN1; (+) strand; PAM type: YTN; PAM sequence: TTT
aggcccattcgatccacata

SEQ ID NO: 260025 - DNA, 20 bp, Artificial Sequence
  Description of Artificial Sequence: Synthetic oligonucleotide
  Target: ATXN1; (+) strand; PAM type: YTN; PAM sequence: TTA
ggcccattcgatccacataa

SEQ ID NO: 260026 - DNA, 20 bp, Artificial Sequence
  Description of Artificial Sequence: Synthetic oligonucleotide
  Target: ATXN1; (+) strand; PAM type: YTN; PAM sequence: TTC
gatccacataaaaaccgcag

SEQ ID NO: 260027 - DNA, 20 bp, Artificial Sequence
  Description of Artificial Sequence: Synthetic oligonucleotide
  Target: ATXN1; (+) strand; PAM type: YTN; PAM sequence: TTA
ccacctccctcttgacaaac

SEQ ID NO: 260028 - DNA, 20 bp, Artificial Sequence
  Description of Artificial Sequence: Synthetic oligonucleotide
  Target: ATXN1; (+) strand; PAM type: YTN; PAM sequence: CTC
cctcttgacaaacgggggca

SEQ ID NO: 260029 - DNA, 20 bp, Artificial Sequence
  Description of Artificial Sequence: Synthetic oligonucleotide
  Target: ATXN1; (+) strand; PAM type: YTN; PAM sequence: CTC
ttgacaaacgggggcatgga

SEQ ID NO: 260030 - DNA, 20 bp, Artificial Sequence
  Description of Artificial Sequence: Synthetic oligonucleotide
  Target: ATXN1; (+) strand; PAM type: YTN; PAM sequence: CTT
gacaaacgggggcatggagg

SEQ ID NO: 260031 - DNA, 20 bp, Artificial Sequence
  Description of Artificial Sequence: Synthetic oligonucleotide
  Target: ATXN1; (+) strand; PAM type: YTN; PAM sequence: TTG
acaaacgggggcatggaggc

SEQ ID NO: 260032 - DNA, 20 bp, Artificial Sequence
  Description of Artificial Sequence: Synthetic oligonucleotide
  Target: ATXN1; (+) strand; PAM type: YTN; PAM sequence: TTC
agtgattcttttctgaagat

SEQ ID NO: 260033 - DNA, 20 bp, Artificial Sequence
  Description of Artificial Sequence: Synthetic oligonucleotide
  Target: ATXN1; (+) strand; PAM type: YTN; PAM sequence: TTC
ttttctgaagatcacgtggt

SEQ ID NO: 260034 - DNA, 20 bp, Artificial Sequence
  Description of Artificial Sequence: Synthetic oligonucleotide
  Target: ATXN1; (+) strand; PAM type: YTN; PAM sequence: CTT
ttctgaagatcacgtggtga

SEQ ID NO: 260035 - DNA, 20 bp, Artificial Sequence
  Description of Artificial Sequence: Synthetic oligonucleotide
  Target: ATXN1; (+) strand; PAM type: YTN; PAM sequence: TTT
tctgaagatcacgtggtgac

SEQ ID NO: 260036 - DNA, 20 bp, Artificial Sequence
  Description of Artificial Sequence: Synthetic oligonucleotide
  Target: ATXN1; (+) strand; PAM type: YTN; PAM sequence: TTT
ctgaagatcacgtggtgact

SEQ ID NO: 260037 - DNA, 20 bp, Artificial Sequence
  Description of Artificial Sequence: Synthetic oligonucleotide
  Target: ATXN1; (+) strand; PAM type: YTN; PAM sequence: TTC
tgaagatcacgtggtgactg

SEQ ID NO: 260038 - DNA, 20 bp, Artificial Sequence
  Description of Artificial Sequence: Synthetic oligonucleotide
  Target: ATXN1; (+) strand; PAM type: YTN; PAM sequence: CTG
aagatcacgtggtgactgtg

SEQ ID NO: 260039 - DNA, 20 bp, Artificial Sequence
  Description of Artificial Sequence: Synthetic oligonucleotide
  Target: ATXN1; (+) strand; PAM type: YTN; PAM sequence: CTG
tgggacgtggagctcaaacc

SEQ ID NO: 260040 - DNA, 20 bp, Artificial Sequence
  Description of Artificial Sequence: Synthetic oligonucleotide
  Target: ATXN1; (+) strand; PAM type: YTN; PAM sequence: CTC
aaacccaagtctgtggattc

SEQ ID NO: 260041 - DNA, 20 bp, Artificial Sequence
  Description of Artificial Sequence: Synthetic oligonucleotide
  Target: ATXN1; (+) strand; PAM type: YTN; PAM sequence: CTG
tggattcctagctggaggca

SEQ ID NO: 260042 - DNA, 20 bp, Artificial Sequence
  Description of Artificial Sequence: Synthetic oligonucleotide
  Target: ATXN1; (+) strand; PAM type: YTN; PAM sequence: TTC
ctagctggaggcaaattcta

SEQ ID NO: 260043 - DNA, 20 bp, Artificial Sequence
  Description of Artificial Sequence: Synthetic oligonucleotide
  Target: ATXN1; (+) strand; PAM type: YTN; PAM sequence: CTA
gctggaggcaaattctacca

SEQ ID NO: 260044 - DNA, 20 bp, Artificial Sequence
  Description of Artificial Sequence: Synthetic oligonucleotide
  Target: ATXN1; (+) strand; PAM type: YTN; PAM sequence: CTG
gaggcaaattctaccacatc

SEQ ID NO: 260045 - DNA, 20 bp, Artificial Sequence
  Description of Artificial Sequence: Synthetic oligonucleotide
  Target: ATXN1; (+) strand; PAM type: YTN; PAM sequence: TTC
taccacatcacatttttaag

SEQ ID NO: 260046 - DNA, 20 bp, Artificial Sequence
  Description of Artificial Sequence: Synthetic oligonucleotide
  Target: ATXN1; (+) strand; PAM type: YTN; PAM sequence: CTA
ccacatcacatttttaagta

SEQ ID NO: 260047 - DNA, 20 bp, Artificial Sequence
  Description of Artificial Sequence: Synthetic oligonucleotide
  Target: ATXN1; (+) strand; PAM type: YTN; PAM sequence: TTT
ttaagtacacgtgcctgaaa

SEQ ID NO: 260048 - DNA, 20 bp, Artificial Sequence
  Description of Artificial Sequence: Synthetic oligonucleotide
  Target: ATXN1; (+) strand; PAM type: YTN; PAM sequence: TTT
taagtacacgtgcctgaaaa

SEQ ID NO: 260049 - DNA, 20 bp, Artificial Sequence
  Description of Artificial Sequence: Synthetic oligonucleotide
  Target: ATXN1; (+) strand; PAM type: YTN; PAM sequence: TTT
aagtacacgtgcctgaaaag

SEQ ID NO: 260050 - DNA, 20 bp, Artificial Sequence
  Description of Artificial Sequence: Synthetic oligonucleotide
  Target: ATXN1; (+) strand; PAM type: YTN; PAM sequence: TTA
agtacacgtgcctgaaaagc

SEQ ID NO: 260051 - DNA, 20 bp, Artificial Sequence
  Description of Artificial Sequence: Synthetic oligonucleotide
  Target: ATXN1; (+) strand; PAM type: YTN; PAM sequence: CTG
aaaagcttgccactcaggca

SEQ ID NO: 260052 - DNA, 20 bp, Artificial Sequence
  Description of Artificial Sequence: Synthetic oligonucleotide
  Target: ATXN1; (+) strand; PAM type: YTN; PAM sequence: CTT
gccactcaggcaaaatcaca

SEQ ID NO: 260053 - DNA, 20 bp, Artificial Sequence
  Description of Artificial Sequence: Synthetic oligonucleotide
  Target: ATXN1; (+) strand; PAM type: YTN; PAM sequence: TTG
ccactcaggcaaaatcacaa

SEQ ID NO: 260054 - DNA, 20 bp, Artificial Sequence
  Description of Artificial Sequence: Synthetic oligonucleotide
  Target: ATXN1; (+) strand; PAM type: YTN; PAM sequence: CTC
aggcaaaatcacaataagac

SEQ ID NO: 260055 - DNA, 20 bp, Artificial Sequence
  Description of Artificial Sequence: Synthetic oligonucleotide
  Target: ATXN1; (+) strand; PAM type: YTN; PAM sequence: CTC
agaatccgtaagcgactaaa

SEQ ID NO: 260056 - DNA, 20 bp, Artificial Sequence
  Description of Artificial Sequence: Synthetic oligonucleotide
  Target: ATXN1; (+) strand; PAM type: YTN; PAM sequence: CTA
aatttgcctggagtgacatt

SEQ ID NO: 260057 - DNA, 20 bp, Artificial Sequence
  Description of Artificial Sequence: Synthetic oligonucleotide
  Target: ATXN1; (+) strand; PAM type: YTN; PAM sequence: TTT
gcctggagtgacattatttt

SEQ ID NO: 260058 - DNA, 20 bp, Artificial Sequence
  Description of Artificial Sequence: Synthetic oligonucleotide
  Target: ATXN1; (+) strand; PAM type: YTN; PAM sequence: TTG
cctggagtgacattattttt

SEQ ID NO: 260059 - DNA, 20 bp, Artificial Sequence
  Description of Artificial Sequence: Synthetic oligonucleotide
  Target: ATXN1; (+) strand; PAM type: YTN; PAM sequence: CTG
gagtgacattatttttgtgg

SEQ ID NO: 260060 - DNA, 20 bp, Artificial Sequence
  Description of Artificial Sequence: Synthetic oligonucleotide
  Target: ATXN1; (+) strand; PAM type: YTN; PAM sequence: TTA
tttttgtggcgggtgttgag

SEQ ID NO: 260061 - DNA, 20 bp, Artificial Sequence
  Description of Artificial Sequence: Synthetic oligonucleotide
  Target: ATXN1; (+) strand; PAM type: YTN; PAM sequence: TTT
ttgtggcgggtgttgagact

SEQ ID NO: 260062 - DNA, 20 bp, Artificial Sequence
  Description of Artificial Sequence: Synthetic oligonucleotide
  Target: ATXN1; (+) strand; PAM type: YTN; PAM sequence: TTT
tgtggcgggtgttgagactg

SEQ ID NO: 260063 - DNA, 20 bp, Artificial Sequence
  Description of Artificial Sequence: Synthetic oligonucleotide
  Target: ATXN1; (+) strand; PAM type: YTN; PAM sequence: TTT
gtggcgggtgttgagactga

SEQ ID NO: 260064 - DNA, 20 bp, Artificial Sequence
  Description of Artificial Sequence: Synthetic oligonucleotide
  Target: ATXN1; (+) strand; PAM type: YTN; PAM sequence: TTG
tggcgggtgttgagactgag

SEQ ID NO: 260065 - DNA, 20 bp, Artificial Sequence
  Description of Artificial Sequence: Synthetic oligonucleotide
  Target: ATXN1; (+) strand; PAM type: YTN; PAM sequence: TTG
agactgagaatagagttaaa

SEQ ID NO: 260066 - DNA, 20 bp, Artificial Sequence
  Description of Artificial Sequence: Synthetic oligonucleotide
  Target: ATXN1; (+) strand; PAM type: YTN; PAM sequence: CTG
agaatagagttaaatgttag

SEQ ID NO: 260067 - DNA, 20 bp, Artificial Sequence
  Description of Artificial Sequence: Synthetic oligonucleotide
  Target: ATXN1; (+) strand; PAM type: YTN; PAM sequence: TTA
aatgttaggaaaaaaattct

SEQ ID NO: 260068 - DNA, 20 bp, Artificial Sequence
  Description of Artificial Sequence: Synthetic oligonucleotide
  Target: ATXN1; (+) strand; PAM type: YTN; PAM sequence: TTA
ggaaaaaaattctgaagttt

SEQ ID NO: 260069 - DNA, 20 bp, Artificial Sequence
  Description of Artificial Sequence: Synthetic oligonucleotide
  Target: ATXN1; (+) strand; PAM type: YTN; PAM sequence: TTC
tgaagtttactgatacattg

SEQ ID NO: 260070 - DNA, 20 bp, Artificial Sequence
  Description of Artificial Sequence: Synthetic oligonucleotide
  Target: ATXN1; (+) strand; PAM type: YTN; PAM sequence: CTG
aagtttactgatacattgct

SEQ ID NO: 260071 - DNA, 20 bp, Artificial Sequence
  Description of Artificial Sequence: Synthetic oligonucleotide
  Target: ATXN1; (+) strand; PAM type: YTN; PAM sequence: TTT
actgatacattgcttggacc

SEQ ID NO: 260072 - DNA, 20 bp, Artificial Sequence
  Description of Artificial Sequence: Synthetic oligonucleotide
  Target: ATXN1; (+) strand; PAM type: YTN; PAM sequence: TTA
ctgatacattgcttggaccc

SEQ ID NO: 260073 - DNA, 20 bp, Artificial Sequence
  Description of Artificial Sequence: Synthetic oligonucleotide
  Target: ATXN1; (+) strand; PAM type: YTN; PAM sequence: CTG
atacattgcttggaccccaa

SEQ ID NO: 260074 - DNA, 20 bp, Artificial Sequence
  Description of Artificial Sequence: Synthetic oligonucleotide
  Target: ATXN1; (+) strand; PAM type: YTN; PAM sequence: TTG
cttggaccccaaagtccctg

SEQ ID NO: 260075 - DNA, 20 bp, Artificial Sequence
  Description of Artificial Sequence: Synthetic oligonucleotide
  Target: ATXN1; (+) strand; PAM type: YTN; PAM sequence: CTT
ggaccccaaagtccctgcac

SEQ ID NO: 260076 - DNA, 20 bp, Artificial Sequence
  Description of Artificial Sequence: Synthetic oligonucleotide
  Target: ATXN1; (+) strand; PAM type: YTN; PAM sequence: TTG
gaccccaaagtccctgcact

SEQ ID NO: 260077 - DNA, 20 bp, Artificial Sequence
  Description of Artificial Sequence: Synthetic oligonucleotide
  Target: ATXN1; (+) strand; PAM type: YTN; PAM sequence: CTG
cactccttagacaagtgttg

SEQ ID NO: 260078 - DNA, 20 bp, Artificial Sequence
  Description of Artificial Sequence: Synthetic oligonucleotide
  Target: ATXN1; (+) strand; PAM type: YTN; PAM sequence: CTC
cttagacaagtgttggaggg

SEQ ID NO: 260079 - DNA, 20 bp, Artificial Sequence
  Description of Artificial Sequence: Synthetic oligonucleotide
  Target: ATXN1; (+) strand; PAM type: YTN; PAM sequence: CTT
agacaagtgttggagggaaa

SEQ ID NO: 260080 - DNA, 20 bp, Artificial Sequence
  Description of Artificial Sequence: Synthetic oligonucleotide
  Target: ATXN1; (+) strand; PAM type: YTN; PAM sequence: TTA
gacaagtgttggagggaaac

SEQ ID NO: 260081 - DNA, 20 bp, Artificial Sequence
  Description of Artificial Sequence: Synthetic oligonucleotide
  Target: ATXN1; (+) strand; PAM type: YTN; PAM sequence: TTG
gagggaaacggccacatcag

SEQ ID NO: 260082 - DNA, 20 bp, Artificial Sequence
  Description of Artificial Sequence: Synthetic oligonucleotide
  Target: ATXN1; (+) strand; PAM type: YTN; PAM sequence: TTT
atccactagtatactccaag

SEQ ID NO: 260083 - DNA, 20 bp, Artificial Sequence
  Description of Artificial Sequence: Synthetic oligonucleotide
  Target: ATXN1; (+) strand; PAM type: YTN; PAM sequence: TTA
tccactagtatactccaaga

SEQ ID NO: 260084 - DNA, 20 bp, Artificial Sequence
  Description of Artificial Sequence: Synthetic oligonucleotide
  Target: ATXN1; (+) strand; PAM type: YTN; PAM sequence: CTA
gtatactccaagatgtcgcg

SEQ ID NO: 260085 - DNA, 20 bp, Artificial Sequence
  Description of Artificial Sequence: Synthetic oligonucleotide
  Target: ATXN1; (+) strand; PAM type: YTN; PAM sequence: CTC
caagatgtcgcgagtccctg

SEQ ID NO: 260086 - DNA, 20 bp, Artificial Sequence
  Description of Artificial Sequence: Synthetic oligonucleotide
  Target: ATXN1; (+) strand; PAM type: YTN; PAM sequence: CTG
aatcccccacatctctgatt

SEQ ID NO: 260087 - DNA, 20 bp, Artificial Sequence
  Description of Artificial Sequence: Synthetic oligonucleotide
  Target: ATXN1; (+) strand; PAM type: YTN; PAM sequence: CTC
tgatttggtcttccagcaac

SEQ ID NO: 260088 - DNA, 20 bp, Artificial Sequence
  Description of Artificial Sequence: Synthetic oligonucleotide
  Target: ATXN1; (+) strand; PAM type: YTN; PAM sequence: CTG
atttggtcttccagcaacta

SEQ ID NO: 260089 - DNA, 20 bp, Artificial Sequence
  Description of Artificial Sequence: Synthetic oligonucleotide
  Target: ATXN1; (+) strand; PAM type: YTN; PAM sequence: TTT
ggtcttccagcaactattgg

SEQ ID NO: 260090 - DNA, 20 bp, Artificial Sequence
  Description of Artificial Sequence: Synthetic oligonucleotide
  Target: ATXN1; (+) strand; PAM type: YTN; PAM sequence: TTG
gtcttccagcaactattgga

SEQ ID NO: 260091 - DNA, 20 bp, Artificial Sequence
  Description of Artificial Sequence: Synthetic oligonucleotide
  Target: ATXN1; (+) strand; PAM type: YTN; PAM sequence: CTT
ccagcaactattggaataag

SEQ ID NO: 260092 - DNA, 20 bp, Artificial Sequence
  Description of Artificial Sequence: Synthetic oligonucleotide
  Target: ATXN1; (+) strand; PAM type: YTN; PAM sequence: TTC
cagcaactattggaataagg

SEQ ID NO: 260093 - DNA, 20 bp, Artificial Sequence
  Description of Artificial Sequence: Synthetic oligonucleotide
  Target: ATXN1; (+) strand; PAM type: YTN; PAM sequence: CTA
ttggaataaggctatatgat

SEQ ID NO: 260094 - DNA, 20 bp, Artificial Sequence
  Description of Artificial Sequence: Synthetic oligonucleotide
  Target: ATXN1; (+) strand; PAM type: YTN; PAM sequence: TTG
gaataaggctatatgatttg

SEQ ID NO: 260095 - DNA, 20 bp, Artificial Sequence
  Description of Artificial Sequence: Synthetic oligonucleotide
  Target: ATXN1; (+) strand; PAM type: YTN; PAM sequence: CTA
tatgatttgtgcaacaacaa

SEQ ID NO: 260096 - DNA, 20 bp, Artificial Sequence
  Description of Artificial Sequence: Synthetic oligonucleotide
  Target: ATXN1; (+) strand; PAM type: YTN; PAM sequence: TTT
gtgcaacaacaatgaaaaga

SEQ ID NO: 260097 - DNA, 20 bp, Artificial Sequence
  Description of Artificial Sequence: Synthetic oligonucleotide
  Target: ATXN1; (+) strand; PAM type: YTN; PAM sequence: TTG
tgcaacaacaatgaaaagaa

SEQ ID NO: 260098 - DNA, 20 bp, Artificial Sequence
  Description of Artificial Sequence: Synthetic oligonucleotide
  Target: ATXN1; (+) strand; PAM type: YTN; PAM sequence: CTG
cgaccactagttattaacag

SEQ ID NO: 260099 - DNA, 20 bp, Artificial Sequence
  Description of Artificial Sequence: Synthetic oligonucleotide
  Target: ATXN1; (+) strand; PAM type: YTN; PAM sequence: CTA
gttattaacagcccagcctg

SEQ ID NO: 260100 - DNA, 20 bp, Artificial Sequence
  Description of Artificial Sequence: Synthetic oligonucleotide
  Target: ATXN1; (+) strand; PAM type: YTN; PAM sequence: TTA
ttaacagcccagcctgtggt

SEQ ID NO: 260101 - DNA, 20 bp, Artificial Sequence
  Description of Artificial Sequence: Synthetic oligonucleotide
  Target: ATXN1; (+) strand; PAM type: YTN; PAM sequence: TTA
acagcccagcctgtggtaca

SEQ ID NO: 260102 - DNA, 20 bp, Artificial Sequence
  Description of Artificial Sequence: Synthetic oligonucleotide
  Target: ATXN1; (+) strand; PAM type: YTN; PAM sequence: CTG
tggtacacaaagctgacagt

SEQ ID NO: 260103 - DNA, 20 bp, Artificial Sequence
  Description of Artificial Sequence: Synthetic oligonucleotide
  Target: ATXN1; (+) strand; PAM type: YTN; PAM sequence: CTG
acagttattatgagtaatta

SEQ ID NO: 260104 - DNA, 20 bp, Artificial Sequence
  Description of Artificial Sequence: Synthetic oligonucleotide
  Target: ATXN1; (+) strand; PAM type: YTN; PAM sequence: TTA
ttatgagtaattagcacaaa

SEQ ID NO: 260105 - DNA, 20 bp, Artificial Sequence
  Description of Artificial Sequence: Synthetic oligonucleotide
  Target: ATXN1; (+) strand; PAM type: YTN; PAM sequence: TTA
tgagtaattagcacaaagga

SEQ ID NO: 260106 - DNA, 20 bp, Artificial Sequence
  Description of Artificial Sequence: Synthetic oligonucleotide
  Target: ATXN1; (+) strand; PAM type: YTN; PAM sequence: TTA
gcacaaaggaaggttctgta

SEQ ID NO: 260107 - DNA, 20 bp, Artificial Sequence
  Description of Artificial Sequence: Synthetic oligonucleotide
  Target: ATXN1; (+) strand; PAM type: YTN; PAM sequence: TTC
tgtatacacactatttccag

SEQ ID NO: 260108 - DNA, 20 bp, Artificial Sequence
  Description of Artificial Sequence: Synthetic oligonucleotide
  Target: ATXN1; (+) strand; PAM type: YTN; PAM sequence: CTG
tatacacactatttccagac

SEQ ID NO: 260109 - DNA, 20 bp, Artificial Sequence
  Description of Artificial Sequence: Synthetic oligonucleotide
  Target: ATXN1; (+) strand; PAM type: YTN; PAM sequence: CTA
tttccagacatgtttttgaa

SEQ ID NO: 260110 - DNA, 20 bp, Artificial Sequence
  Description of Artificial Sequence: Synthetic oligonucleotide
  Target: ATXN1; (+) strand; PAM type: YTN; PAM sequence: TTT
ccagacatgtttttgaaaca

SEQ ID NO: 260111 - DNA, 20 bp, Artificial Sequence
  Description of Artificial Sequence: Synthetic oligonucleotide
  Target: ATXN1; (+) strand; PAM type: YTN; PAM sequence: TTC
cagacatgtttttgaaacaa

SEQ ID NO: 260112 - DNA, 20 bp, Artificial Sequence
  Description of Artificial Sequence: Synthetic oligonucleotide
  Target: ATXN1; (+) strand; PAM type: YTN; PAM sequence: TTT
ttgaaacaagggctttgcct

SEQ ID NO: 260113 - DNA, 20 bp, Artificial Sequence
  Description of Artificial Sequence: Synthetic oligonucleotide
  Target: ATXN1; (+) strand; PAM type: YTN; PAM sequence: TTT
tgaaacaagggctttgcctt

SEQ ID NO: 260114 - DNA, 20 bp, Artificial Sequence
  Description of Artificial Sequence: Synthetic oligonucleotide
  Target: ATXN1; (+) strand; PAM type: YTN; PAM sequence: TTT
gaaacaagggctttgccttt

SEQ ID NO: 260115 - DNA, 20 bp, Artificial Sequence
  Description of Artificial Sequence: Synthetic oligonucleotide
  Target: ATXN1; (+) strand; PAM type: YTN; PAM sequence: TTG
aaacaagggctttgcctttt

SEQ ID NO: 260116 - DNA, 20 bp, Artificial Sequence
  Description of Artificial Sequence: Synthetic oligonucleotide
  Target: ATXN1; (+) strand; PAM type: YTN; PAM sequence: CTT
tgccttttaccaccaataat

SEQ ID NO: 260117 - DNA, 20 bp, Artificial Sequence
  Description of Artificial Sequence: Synthetic oligonucleotide
  Target: ATXN1; (+) strand; PAM type: YTN; PAM sequence: TTT
gccttttaccaccaataatt

SEQ ID NO: 260118 - DNA, 20 bp, Artificial Sequence
  Description of Artificial Sequence: Synthetic oligonucleotide
  Target: ATXN1; (+) strand; PAM type: YTN; PAM sequence: TTG
ccttttaccaccaataattt

SEQ ID NO: 260119 - DNA, 20 bp, Artificial Sequence
  Description of Artificial Sequence: Synthetic oligonucleotide
  Target: ATXN1; (+) strand; PAM type: YTN; PAM sequence: CTT
ttaccaccaataatttgtct

SEQ ID NO: 260120 - DNA, 20 bp, Artificial Sequence
  Description of Artificial Sequence: Synthetic oligonucleotide
  Target: ATXN1; (+) strand; PAM type: YTN; PAM sequence: TTT
taccaccaataatttgtctt

SEQ ID NO: 260121 - DNA, 20 bp, Artificial Sequence
  Description of Artificial Sequence: Synthetic oligonucleotide
  Target: ATXN1; (+) strand; PAM type: YTN; PAM sequence: TTT
accaccaataatttgtcttg

SEQ ID NO: 260122 - DNA, 20 bp, Artificial Sequence
  Description of Artificial Sequence: Synthetic oligonucleotide
  Target: ATXN1; (+) strand; PAM type: YTN; PAM sequence: TTA
ccaccaataatttgtcttgt

SEQ ID NO: 260123 - DNA, 20 bp, Artificial Sequence
  Description of Artificial Sequence: Synthetic oligonucleotide
  Target: ATXN1; (+) strand; PAM type: YTN; PAM sequence: TTT
gtcttgttgtatgttgttac

SEQ ID NO: 260124 - DNA, 20 bp, Artificial Sequence
  Description of Artificial Sequence: Synthetic oligonucleotide
  Target: ATXN1; (+) strand; PAM type: YTN; PAM sequence: TTG
tcttgttgtatgttgttact

SEQ ID NO: 260125 - DNA, 20 bp, Artificial Sequence
  Description of Artificial Sequence: Synthetic oligonucleotide
  Target: ATXN1; (+) strand; PAM type: YTN; PAM sequence: CTT
gttgtatgttgttacttaca

SEQ ID NO: 260126 - DNA, 20 bp, Artificial Sequence
  Description of Artificial Sequence: Synthetic oligonucleotide
  Target: ATXN1; (+) strand; PAM type: YTN; PAM sequence: TTG
ttgtatgttgttacttacac

SEQ ID NO: 260127 - DNA, 20 bp, Artificial Sequence
  Description of Artificial Sequence: Synthetic oligonucleotide
  Target: ATXN1; (+) strand; PAM type: YTN; PAM sequence: TTG
tatgttgttacttacacaga

SEQ ID NO: 260128 - DNA, 20 bp, Artificial Sequence
  Description of Artificial Sequence: Synthetic oligonucleotide
  Target: ATXN1; (+) strand; PAM type: YTN; PAM sequence: TTG
ttacttacacagatgttcca

SEQ ID NO: 260129 - DNA, 20 bp, Artificial Sequence
  Description of Artificial Sequence: Synthetic oligonucleotide
  Target: ATXN1; (+) strand; PAM type: YTN; PAM sequence: TTA
cttacacagatgttccatga

SEQ ID NO: 260130 - DNA, 20 bp, Artificial Sequence
  Description of Artificial Sequence: Synthetic oligonucleotide
  Target: ATXN1; (+) strand; PAM type: YTN; PAM sequence: CTT
acacagatgttccatgattt

SEQ ID NO: 260131 - DNA, 20 bp, Artificial Sequence
  Description of Artificial Sequence: Synthetic oligonucleotide
  Target: ATXN1; (+) strand; PAM type: YTN; PAM sequence: TTA
cacagatgttccatgatttt

SEQ ID NO: 260132 - DNA, 20 bp, Artificial Sequence
  Description of Artificial Sequence: Synthetic oligonucleotide
  Target: ATXN1; (+) strand; PAM type: YTN; PAM sequence: TTC
catgattttttgcatatggc

SEQ ID NO: 260133 - DNA, 20 bp, Artificial Sequence
  Description of Artificial Sequence: Synthetic oligonucleotide
  Target: ATXN1; (+) strand; PAM type: YTN; PAM sequence: TTT
tttgcatatggctcagccaa

SEQ ID NO: 260134 - DNA, 20 bp, Artificial Sequence
  Description of Artificial Sequence: Synthetic oligonucleotide
  Target: ATXN1; (+) strand; PAM type: YTN; PAM sequence: TTT
ttgcatatggctcagccaaa

SEQ ID NO: 260135 - DNA, 20 bp, Artificial Sequence
  Description of Artificial Sequence: Synthetic oligonucleotide
  Target: ATXN1; (+) strand; PAM type: YTN; PAM sequence: TTT
tgcatatggctcagccaaag

SEQ ID NO: 260136 - DNA, 20 bp, Artificial Sequence
  Description of Artificial Sequence: Synthetic oligonucleotide
  Target: ATXN1; (+) strand; PAM type: YTN; PAM sequence: TTT
gcatatggctcagccaaaga

SEQ ID NO: 260137 - DNA, 20 bp, Artificial Sequence
  Description of Artificial Sequence: Synthetic oligonucleotide
  Target: ATXN1; (+) strand; PAM type: YTN; PAM sequence: TTG
catatggctcagccaaagaa

SEQ ID NO: 260138 - DNA, 20 bp, Artificial Sequence
  Description of Artificial Sequence: Synthetic oligonucleotide
  Target: ATXN1; (+) strand; PAM type: YTN; PAM sequence: CTC
agccaaagaaagctttttcc

SEQ ID NO: 260139 - DNA, 20 bp, Artificial Sequence
  Description of Artificial Sequence: Synthetic oligonucleotide
  Target: ATXN1; (+) strand; PAM type: YTN; PAM sequence: CTT
tttccccttccatttttggg

SEQ ID NO: 260140 - DNA, 20 bp, Artificial Sequence
  Description of Artificial Sequence: Synthetic oligonucleotide
  Target: ATXN1; (+) strand; PAM type: YTN; PAM sequence: TTT
ttccccttccatttttggga

SEQ ID NO: 260141 - DNA, 20 bp, Artificial Sequence
  Description of Artificial Sequence: Synthetic oligonucleotide
  Target: ATXN1; (+) strand; PAM type: YTN; PAM sequence: TTT
tccccttccatttttgggaa

SEQ ID NO: 260142 - DNA, 20 bp, Artificial Sequence
  Description of Artificial Sequence: Synthetic oligonucleotide
  Target: ATXN1; (+) strand; PAM type: YTN; PAM sequence: TTT
ccccttccatttttgggaaa

SEQ ID NO: 260143 - DNA, 20 bp, Artificial Sequence
  Description of Artificial Sequence: Synthetic oligonucleotide
  Target: ATXN1; (+) strand; PAM type: YTN; PAM sequence: TTC
cccttccatttttgggaaag

SEQ ID NO: 260144 - DNA, 20 bp, Artificial Sequence
  Description of Artificial Sequence: Synthetic oligonucleotide
  Target: ATXN1; (+) strand; PAM type: YTN; PAM sequence: CTT
ccatttttgggaaagatgca

SEQ ID NO: 260145 - DNA, 20 bp, Artificial Sequence
  Description of Artificial Sequence: Synthetic oligonucleotide
  Target: ATXN1; (+) strand; PAM type: YTN; PAM sequence: TTC
catttttgggaaagatgcaa

SEQ ID NO: 260146 - DNA, 20 bp, Artificial Sequence
  Description of Artificial Sequence: Synthetic oligonucleotide
  Target: ATXN1; (+) strand; PAM type: YTN; PAM sequence: TTT
ttgggaaagatgcaactgac

SEQ ID NO: 260147 - DNA, 20 bp, Artificial Sequence
  Description of Artificial Sequence: Synthetic oligonucleotide
  Target: ATXN1; (+) strand; PAM type: YTN; PAM sequence: TTT
tgggaaagatgcaactgact

SEQ ID NO: 260148 - DNA, 20 bp, Artificial Sequence
  Description of Artificial Sequence: Synthetic oligonucleotide
  Target: ATXN1; (+) strand; PAM type: YTN; PAM sequence: TTT
gggaaagatgcaactgactg

SEQ ID NO: 260149 - DNA, 20 bp, Artificial Sequence
  Description of Artificial Sequence: Synthetic oligonucleotide
  Target: ATXN1; (+) strand; PAM type: YTN; PAM sequence: TTG
ggaaagatgcaactgactgt

SEQ ID NO: 260150 - DNA, 20 bp, Artificial Sequence
  Description of Artificial Sequence: Synthetic oligonucleotide
  Target: ATXN1; (+) strand; PAM type: YTN; PAM sequence: CTG
actgtgtaagggagaggaga

SEQ ID NO: 260151 - DNA, 20 bp, Artificial Sequence
  Description of Artificial Sequence: Synthetic oligonucleotide
  Target: ATXN1; (+) strand; PAM type: YTN; PAM sequence: CTG
tgtaagggagaggagaatgt

SEQ ID NO: 260152 - DNA, 20 bp, Artificial Sequence
  Description of Artificial Sequence: Synthetic oligonucleotide
  Target: ATXN1; (+) strand; PAM type: YTN; PAM sequence: CTA
gtttttacataatgtctatg

SEQ ID NO: 260153 - DNA, 20 bp, Artificial Sequence
  Description of Artificial Sequence: Synthetic oligonucleotide
  Target: ATXN1; (+) strand; PAM type: YTN; PAM sequence: TTT
ttacataatgtctatggcga

SEQ ID NO: 260154 - DNA, 20 bp, Artificial Sequence
  Description of Artificial Sequence: Synthetic oligonucleotide
  Target: ATXN1; (+) strand; PAM type: YTN; PAM sequence: TTT
tacataatgtctatggcgat

SEQ ID NO: 260155 - DNA, 20 bp, Artificial Sequence
  Description of Artificial Sequence: Synthetic oligonucleotide
  Target: ATXN1; (+) strand; PAM type: YTN; PAM sequence: TTT
acataatgtctatggcgatg

SEQ ID NO: 260156 - DNA, 20 bp, Artificial Sequence
  Description of Artificial Sequence: Synthetic oligonucleotide
  Target: ATXN1; (+) strand; PAM type: YTN; PAM sequence: TTA
cataatgtctatggcgatga

SEQ ID NO: 260157 - DNA, 20 bp, Artificial Sequence
  Description of Artificial Sequence: Synthetic oligonucleotide
  Target: ATXN1; (+) strand; PAM type: YTN; PAM sequence: CTA
tggcgatgataggggtgcag

SEQ ID NO: 260158 - DNA, 20 bp, Artificial Sequence
  Description of Artificial Sequence: Synthetic oligonucleotide
  Target: ATXN1; (+) strand; PAM type: YTN; PAM sequence: CTG
gtgctgctggtgtgtgtgtg

SEQ ID NO: 260159 - DNA, 20 bp, Artificial Sequence
  Description of Artificial Sequence: Synthetic oligonucleotide
  Target: ATXN1; (+) strand; PAM type: YTN; PAM sequence: CTG
ctggtgtgtgtgtgtgtgtg

SEQ ID NO: 260160 - DNA, 20 bp, Artificial Sequence
  Description of Artificial Sequence: Synthetic oligonucleotide
  Target: ATXN1; (+) strand; PAM type: YTN; PAM sequence: CTG
gtgtgtgtgtgtgtgtgcgc

SEQ ID NO: 260161 - DNA, 20 bp, Artificial Sequence
  Description of Artificial Sequence: Synthetic oligonucleotide
  Target: ATXN1; (+) strand; PAM type: YTN; PAM sequence: TTC
cccacccaatcttgccaacc

SEQ ID NO: 260162 - DNA, 20 bp, Artificial Sequence
  Description of Artificial Sequence: Synthetic oligonucleotide
  Target: ATXN1; (+) strand; PAM type: YTN; PAM sequence: CTT
gccaaccatatttcatctaa

SEQ ID NO: 260163 - DNA, 20 bp, Artificial Sequence
  Description of Artificial Sequence: Synthetic oligonucleotide
  Target: ATXN1; (+) strand; PAM type: YTN; PAM sequence: TTG
ccaaccatatttcatctaac

SEQ ID NO: 260164 - DNA, 20 bp, Artificial Sequence
  Description of Artificial Sequence: Synthetic oligonucleotide
  Target: ATXN1; (+) strand; PAM type: YTN; PAM sequence: TTT
catctaactctcttgactga

SEQ ID NO: 260165 - DNA, 20 bp, Artificial Sequence
  Description of Artificial Sequence: Synthetic oligonucleotide
  Target: ATXN1; (+) strand; PAM type: YTN; PAM sequence: TTC
atctaactctcttgactgag

SEQ ID NO: 260166 - DNA, 20 bp, Artificial Sequence
  Description of Artificial Sequence: Synthetic oligonucleotide
  Target: ATXN1; (+) strand; PAM type: YTN; PAM sequence: CTA
actctcttgactgagtcatt

SEQ ID NO: 260167 - DNA, 20 bp, Artificial Sequence
  Description of Artificial Sequence: Synthetic oligonucleotide
  Target: ATXN1; (+) strand; PAM type: YTN; PAM sequence: CTC
tcttgactgagtcattccta

SEQ ID NO: 260168 - DNA, 20 bp, Artificial Sequence
  Description of Artificial Sequence: Synthetic oligonucleotide
  Target: ATXN1; (+) strand; PAM type: YTN; PAM sequence: CTC
ttgactgagtcattcctatg

SEQ ID NO: 260169 - DNA, 20 bp, Artificial Sequence
  Description of Artificial Sequence: Synthetic oligonucleotide
  Target: ATXN1; (+) strand; PAM type: YTN; PAM sequence: CTT
gactgagtcattcctatggg

SEQ ID NO: 260170 - DNA, 20 bp, Artificial Sequence
  Description of Artificial Sequence: Synthetic oligonucleotide
  Target: ATXN1; (+) strand; PAM type: YTN; PAM sequence: TTG
actgagtcattcctatggga

SEQ ID NO: 260171 - DNA, 20 bp, Artificial Sequence
  Description of Artificial Sequence: Synthetic oligonucleotide
  Target: ATXN1; (+) strand; PAM type: YTN; PAM sequence: CTG
agtcattcctatgggattag

SEQ ID NO: 260172 - DNA, 20 bp, Artificial Sequence
  Description of Artificial Sequence: Synthetic oligonucleotide
  Target: ATXN1; (+) strand; PAM type: YTN; PAM sequence: TTC
ctatgggattagggagtact

SEQ ID NO: 260173 - DNA, 20 bp, Artificial Sequence
  Description of Artificial Sequence: Synthetic oligonucleotide
  Target: ATXN1; (+) strand; PAM type: YTN; PAM sequence: CTA
tgggattagggagtactgcg

SEQ ID NO: 260174 - DNA, 20 bp, Artificial Sequence
  Description of Artificial Sequence: Synthetic oligonucleotide
  Target: ATXN1; (+) strand; PAM type: YTN; PAM sequence: TTA
gggagtactgcgtacatcca

SEQ ID NO: 260175 - DNA, 20 bp, Artificial Sequence
  Description of Artificial Sequence: Synthetic oligonucleotide
  Target: ATXN1; (+) strand; PAM type: YTN; PAM sequence: CTG
cgtacatccaaggttcgtgg

SEQ ID NO: 260176 - DNA, 20 bp, Artificial Sequence
  Description of Artificial Sequence: Synthetic oligonucleotide
  Target: ATXN1; (+) strand; PAM type: YTN; PAM sequence: TTC
gtggtgtttgctgagataac

SEQ ID NO: 260177 - DNA, 20 bp, Artificial Sequence
  Description of Artificial Sequence: Synthetic oligonucleotide
  Target: ATXN1; (+) strand; PAM type: YTN; PAM sequence: TTT
gctgagataacacattatca

SEQ ID NO: 260178 - DNA, 20 bp, Artificial Sequence
  Description of Artificial Sequence: Synthetic oligonucleotide
  Target: ATXN1; (+) strand; PAM type: YTN; PAM sequence: TTG
ctgagataacacattatcaa

SEQ ID NO: 260179 - DNA, 20 bp, Artificial Sequence
  Description of Artificial Sequence: Synthetic oligonucleotide
  Target: ATXN1; (+) strand; PAM type: YTN; PAM sequence: CTG
agataacacattatcaaaag

SEQ ID NO: 260180 - DNA, 20 bp, Artificial Sequence
  Description of Artificial Sequence: Synthetic oligonucleotide
  Target: ATXN1; (+) strand; PAM type: YTN; PAM sequence: TTA
tcaaaagcctctctaaaaag

SEQ ID NO: 260181 - DNA, 20 bp, Artificial Sequence
  Description of Artificial Sequence: Synthetic oligonucleotide
  Target: ATXN1; (+) strand; PAM type: YTN; PAM sequence: CTC
tctaaaaagggttgaatatt

SEQ ID NO: 260182 - DNA, 20 bp, Artificial Sequence
  Description of Artificial Sequence: Synthetic oligonucleotide
  Target: ATXN1; (+) strand; PAM type: YTN; PAM sequence: CTC
taaaaagggttgaatattta

SEQ ID NO: 260183 - DNA, 20 bp, Artificial Sequence
  Description of Artificial Sequence: Synthetic oligonucleotide
  Target: ATXN1; (+) strand; PAM type: YTN; PAM sequence: CTA
aaaagggttgaatatttaca

SEQ ID NO: 260184 - DNA, 20 bp, Artificial Sequence
  Description of Artificial Sequence: Synthetic oligonucleotide
  Target: ATXN1; (+) strand; PAM type: YTN; PAM sequence: TTG
aatatttacagaagaaaaaa

SEQ ID NO: 260185 - DNA, 20 bp, Artificial Sequence
  Description of Artificial Sequence: Synthetic oligonucleotide
  Target: ATXN1; (+) strand; PAM type: YTN; PAM sequence: TTT
acagaagaaaaaagaggcgg

SEQ ID NO: 260186 - DNA, 20 bp, Artificial Sequence
  Description of Artificial Sequence: Synthetic oligonucleotide
  Target: ATXN1; (+) strand; PAM type: YTN; PAM sequence: TTA
cagaagaaaaaagaggcggg

SEQ ID NO: 260187 - DNA, 20 bp, Artificial Sequence
  Description of Artificial Sequence: Synthetic oligonucleotide
  Target: ATXN1; (+) strand; PAM type: YTN; PAM sequence: TTT
gagatttttttgttgttctt

SEQ ID NO: 260188 - DNA, 20 bp, Artificial Sequence
  Description of Artificial Sequence: Synthetic oligonucleotide
  Target: ATXN1; (+) strand; PAM type: YTN; PAM sequence: TTG
agatttttttgttgttcttt

SEQ ID NO: 260189 - DNA, 20 bp, Artificial Sequence
  Description of Artificial Sequence: Synthetic oligonucleotide
  Target: ATXN1; (+) strand; PAM type: YTN; PAM sequence: TTT
ttttgttgttctttcttggc

SEQ ID NO: 260190 - DNA, 20 bp, Artificial Sequence
  Description of Artificial Sequence: Synthetic oligonucleotide
  Target: ATXN1; (+) strand; PAM type: YTN; PAM sequence: TTT
tttgttgttctttcttggca

SEQ ID NO: 260191 - DNA, 20 bp, Artificial Sequence
  Description of Artificial Sequence: Synthetic oligonucleotide
  Target: ATXN1; (+) strand; PAM type: YTN; PAM sequence: TTT
ttgttgttctttcttggcag

SEQ ID NO: 260192 - DNA, 20 bp, Artificial Sequence
  Description of Artificial Sequence: Synthetic oligonucleotide
  Target: ATXN1; (+) strand; PAM type: YTN; PAM sequence: TTT
tgttgttctttcttggcagt

SEQ ID NO: 260193 - DNA, 20 bp, Artificial Sequence
  Description of Artificial Sequence: Synthetic oligonucleotide
  Target: ATXN1; (+) strand; PAM type: YTN; PAM sequence: TTT
gttgttctttcttggcagtc

SEQ ID NO: 260194 - DNA, 20 bp, Artificial Sequence
  Description of Artificial Sequence: Synthetic oligonucleotide
  Target: ATXN1; (+) strand; PAM type: YTN; PAM sequence: TTG
ttgttctttcttggcagtct

SEQ ID NO: 260195 - DNA, 20 bp, Artificial Sequence
  Description of Artificial Sequence: Synthetic oligonucleotide
  Target: ATXN1; (+) strand; PAM type: YTN; PAM sequence: TTG
ttctttcttggcagtcttta

SEQ ID NO: 260196 - DNA, 20 bp, Artificial Sequence
  Description of Artificial Sequence: Synthetic oligonucleotide
  Target: ATXN1; (+) strand; PAM type: YTN; PAM sequence: TTC
tttcttggcagtctttacaa

SEQ ID NO: 260197 - DNA, 20 bp, Artificial Sequence
  Description of Artificial Sequence: Synthetic oligonucleotide
  Target: ATXN1; (+) strand; PAM type: YTN; PAM sequence: CTT
tcttggcagtctttacaact

SEQ ID NO: 260198 - DNA, 20 bp, Artificial Sequence
  Description of Artificial Sequence: Synthetic oligonucleotide
  Target: ATXN1; (+) strand; PAM type: YTN; PAM sequence: TTT
cttggcagtctttacaactg

SEQ ID NO: 260199 - DNA, 20 bp, Artificial Sequence
  Description of Artificial Sequence: Synthetic oligonucleotide
  Target: ATXN1; (+) strand; PAM type: YTN; PAM sequence: TTC
ttggcagtctttacaactga

SEQ ID NO: 260200 - DNA, 20 bp, Artificial Sequence
  Description of Artificial Sequence: Synthetic oligonucleotide
  Target: ATXN1; (+) strand; PAM type: YTN; PAM sequence: CTT
ggcagtctttacaactgaca

SEQ ID NO: 260201 - DNA, 20 bp, Artificial Sequence
  Description of Artificial Sequence: Synthetic oligonucleotide
  Target: ATXN1; (+) strand; PAM type: YTN; PAM sequence: TTG
gcagtctttacaactgacaa

SEQ ID NO: 260202 - DNA, 20 bp, Artificial Sequence
  Description of Artificial Sequence: Synthetic oligonucleotide
  Target: ATXN1; (+) strand; PAM type: YTN; PAM sequence: CTT
tacaactgacaacagcagag

SEQ ID NO: 260203 - DNA, 20 bp, Artificial Sequence
  Description of Artificial Sequence: Synthetic oligonucleotide
  Target: ATXN1; (+) strand; PAM type: YTN; PAM sequence: TTT
acaactgacaacagcagagc

SEQ ID NO: 260204 - DNA, 20 bp, Artificial Sequence
  Description of Artificial Sequence: Synthetic oligonucleotide
  Target: ATXN1; (+) strand; PAM type: YTN; PAM sequence: TTA
caactgacaacagcagagcc

SEQ ID NO: 260205 - DNA, 20 bp, Artificial Sequence
  Description of Artificial Sequence: Synthetic oligonucleotide
  Target: ATXN1; (+) strand; PAM type: YTN; PAM sequence: CTG
acaacagcagagccctctca

SEQ ID NO: 260206 - DNA, 20 bp, Artificial Sequence
  Description of Artificial Sequence: Synthetic oligonucleotide
  Target: ATXN1; (+) strand; PAM type: YTN; PAM sequence: CTC
tcatgtttctatgaccttcc

SEQ ID NO: 260207 - DNA, 20 bp, Artificial Sequence
  Description of Artificial Sequence: Synthetic oligonucleotide
  Target: ATXN1; (+) strand; PAM type: YTN; PAM sequence: CTC
atgtttctatgaccttcctc

SEQ ID NO: 260208 - DNA, 20 bp, Artificial Sequence
  Description of Artificial Sequence: Synthetic oligonucleotide
  Target: ATXN1; (+) strand; PAM type: YTN; PAM sequence: TTT
ctatgaccttcctcagcaca

SEQ ID NO: 260209 - DNA, 20 bp, Artificial Sequence
  Description of Artificial Sequence: Synthetic oligonucleotide
  Target: ATXN1; (+) strand; PAM type: YTN; PAM sequence: TTC
tatgaccttcctcagcacag

SEQ ID NO: 260210 - DNA, 20 bp, Artificial Sequence
  Description of Artificial Sequence: Synthetic oligonucleotide
  Target: ATXN1; (+) strand; PAM type: YTN; PAM sequence: CTA
tgaccttcctcagcacagtc

SEQ ID NO: 260211 - DNA, 20 bp, Artificial Sequence
  Description of Artificial Sequence: Synthetic oligonucleotide
  Target: ATXN1; (+) strand; PAM type: YTN; PAM sequence: CTT
cctcagcacagtccggaatg

SEQ ID NO: 260212 - DNA, 20 bp, Artificial Sequence
  Description of Artificial Sequence: Synthetic oligonucleotide
  Target: ATXN1; (+) strand; PAM type: YTN; PAM sequence: TTC
ctcagcacagtccggaatgc

SEQ ID NO: 260213 - DNA, 20 bp, Artificial Sequence
  Description of Artificial Sequence: Synthetic oligonucleotide
  Target: ATXN1; (+) strand; PAM type: YTN; PAM sequence: CTC
agcacagtccggaatgcaca

SEQ ID NO: 260214 - DNA, 20 bp, Artificial Sequence
  Description of Artificial Sequence: Synthetic oligonucleotide
  Target: ATXN1; (+) strand; PAM type: YTN; PAM sequence: CTC
catgttttcttgggaaggag

SEQ ID NO: 260215 - DNA, 20 bp, Artificial Sequence
  Description of Artificial Sequence: Synthetic oligonucleotide
  Target: ATXN1; (+) strand; PAM type: YTN; PAM sequence: TTT
tcttgggaaggagggtctgt

SEQ ID NO: 260216 - DNA, 20 bp, Artificial Sequence
  Description of Artificial Sequence: Synthetic oligonucleotide
  Target: ATXN1; (+) strand; PAM type: YTN; PAM sequence: TTT
cttgggaaggagggtctgtg

SEQ ID NO: 260217 - DNA, 20 bp, Artificial Sequence
  Description of Artificial Sequence: Synthetic oligonucleotide
  Target: ATXN1; (+) strand; PAM type: YTN; PAM sequence: TTC
ttgggaaggagggtctgtgc

SEQ ID NO: 260218 - DNA, 20 bp, Artificial Sequence
  Description of Artificial Sequence: Synthetic oligonucleotide
  Target: ATXN1; (+) strand; PAM type: YTN; PAM sequence: CTT
gggaaggagggtctgtgcag

SEQ ID NO: 260219 - DNA, 20 bp, Artificial Sequence
  Description of Artificial Sequence: Synthetic oligonucleotide
  Target: ATXN1; (+) strand; PAM type: YTN; PAM sequence: TTG
ggaaggagggtctgtgcaga

SEQ ID NO: 260220 - DNA, 20 bp, Artificial Sequence
  Description of Artificial Sequence: Synthetic oligonucleotide
  Target: ATXN1; (+) strand; PAM type: YTN; PAM sequence: CTG
tgcagatgtggggttttttt

SEQ ID NO: 260221 - DNA, 20 bp, Artificial Sequence
  Description of Artificial Sequence: Synthetic oligonucleotide
  Target: ATXN1; (+) strand; PAM type: YTN; PAM sequence: TTT
ttttgggggaaatgggtgtg

SEQ ID NO: 260222 - DNA, 20 bp, Artificial Sequence
  Description of Artificial Sequence: Synthetic oligonucleotide
  Target: ATXN1; (+) strand; PAM type: YTN; PAM sequence: TTT
tttgggggaaatgggtgtgg

SEQ ID NO: 260223 - DNA, 20 bp, Artificial Sequence
  Description of Artificial Sequence: Synthetic oligonucleotide
  Target: ATXN1; (+) strand; PAM type: YTN; PAM sequence: TTT
ttgggggaaatgggtgtggg

SEQ ID NO: 260224 - DNA, 20 bp, Artificial Sequence
  Description of Artificial Sequence: Synthetic oligonucleotide
  Target: ATXN1; (+) strand; PAM type: YTN; PAM sequence: TTT
tgggggaaatgggtgtgggg

SEQ ID NO: 260225 - DNA, 20 bp, Artificial Sequence
  Description of Artificial Sequence: Synthetic oligonucleotide
  Target: ATXN1; (+) strand; PAM type: YTN; PAM sequence: TTT
gggggaaatgggtgtggggg

SEQ ID NO: 260226 - DNA, 20 bp, Artificial Sequence
  Description of Artificial Sequence: Synthetic oligonucleotide
  Target: ATXN1; (+) strand; PAM type: YTN; PAM sequence: TTG
ggggaaatgggtgtgggggt

SEQ ID NO: 260227 - DNA, 20 bp, Artificial Sequence
  Description of Artificial Sequence: Synthetic oligonucleotide
  Target: ATXN1; (+) strand; PAM type: YTN; PAM sequence: TTA
aatccaagcataccaggttt

SEQ ID NO: 260228 - DNA, 20 bp, Artificial Sequence
  Description of Artificial Sequence: Synthetic oligonucleotide
  Target: ATXN1; (+) strand; PAM type: YTN; PAM sequence: TTT
ttagaatagagaaatacaac

SEQ ID NO: 260229 - DNA, 20 bp, Artificial Sequence
  Description of Artificial Sequence: Synthetic oligonucleotide
  Target: ATXN1; (+) strand; PAM type: YTN; PAM sequence: TTT
tagaatagagaaatacaact

SEQ ID NO: 260230 - DNA, 20 bp, Artificial Sequence
  Description of Artificial Sequence: Synthetic oligonucleotide
  Target: ATXN1; (+) strand; PAM type: YTN; PAM sequence: TTT
agaatagagaaatacaactg

SEQ ID NO: 260231 - DNA, 20 bp, Artificial Sequence
  Description of Artificial Sequence: Synthetic oligonucleotide
  Target: ATXN1; (+) strand; PAM type: YTN; PAM sequence: TTA
gaatagagaaatacaactgg

SEQ ID NO: 260232 - DNA, 20 bp, Artificial Sequence
  Description of Artificial Sequence: Synthetic oligonucleotide
  Target: ATXN1; (+) strand; PAM type: YTN; PAM sequence: CTG
gctgaaattatcagggagga

SEQ ID NO: 260233 - DNA, 20 bp, Artificial Sequence
  Description of Artificial Sequence: Synthetic oligonucleotide
  Target: ATXN1; (+) strand; PAM type: YTN; PAM sequence: CTG
aaattatcagggaggaagag

SEQ ID NO: 260234 - DNA, 20 bp, Artificial Sequence
  Description of Artificial Sequence: Synthetic oligonucleotide
  Target: ATXN1; (+) strand; PAM type: YTN; PAM sequence: TTA
tcagggaggaagagcagact

SEQ ID NO: 260235 - DNA, 20 bp, Artificial Sequence
  Description of Artificial Sequence: Synthetic oligonucleotide
  Target: ATXN1; (+) strand; PAM type: YTN; PAM sequence: CTA
aaaaatatacatctctttta

SEQ ID NO: 260236 - DNA, 20 bp, Artificial Sequence
  Description of Artificial Sequence: Synthetic oligonucleotide
  Target: ATXN1; (+) strand; PAM type: YTN; PAM sequence: CTC
ttttattgcaataccaccaa

SEQ ID NO: 260237 - DNA, 20 bp, Artificial Sequence
  Description of Artificial Sequence: Synthetic oligonucleotide
  Target: ATXN1; (+) strand; PAM type: YTN; PAM sequence: CTT
ttattgcaataccaccaatt

SEQ ID NO: 260238 - DNA, 20 bp, Artificial Sequence
  Description of Artificial Sequence: Synthetic oligonucleotide
  Target: ATXN1; (+) strand; PAM type: YTN; PAM sequence: TTT
tattgcaataccaccaattg

SEQ ID NO: 260239 - DNA, 20 bp, Artificial Sequence
  Description of Artificial Sequence: Synthetic oligonucleotide
  Target: ATXN1; (+) strand; PAM type: YTN; PAM sequence: TTT
attgcaataccaccaattga

SEQ ID NO: 260240 - DNA, 20 bp, Artificial Sequence
  Description of Artificial Sequence: Synthetic oligonucleotide
  Target: ATXN1; (+) strand; PAM type: YTN; PAM sequence: TTA
ttgcaataccaccaattgag

SEQ ID NO: 260241 - DNA, 20 bp, Artificial Sequence
  Description of Artificial Sequence: Synthetic oligonucleotide
  Target: ATXN1; (+) strand; PAM type: YTN; PAM sequence: TTG
caataccaccaattgagaga

SEQ ID NO: 260242 - DNA, 20 bp, Artificial Sequence
  Description of Artificial Sequence: Synthetic oligonucleotide
  Target: ATXN1; (+) strand; PAM type: YTN; PAM sequence: TTG
agagaacattctgctggggg

SEQ ID NO: 260243 - DNA, 20 bp, Artificial Sequence
  Description of Artificial Sequence: Synthetic oligonucleotide
  Target: ATXN1; (+) strand; PAM type: YTN; PAM sequence: TTC
tgctgggggggatgtctgcc

SEQ ID NO: 260244 - DNA, 20 bp, Artificial Sequence
  Description of Artificial Sequence: Synthetic oligonucleotide
  Target: ATXN1; (+) strand; PAM type: YTN; PAM sequence: CTG
ctgggggggatgtctgccaa

SEQ ID NO: 260245 - DNA, 20 bp, Artificial Sequence
  Description of Artificial Sequence: Synthetic oligonucleotide
  Target: ATXN1; (+) strand; PAM type: YTN; PAM sequence: CTG
ggggggatgtctgccaagga

SEQ ID NO: 260246 - DNA, 20 bp, Artificial Sequence
  Description of Artificial Sequence: Synthetic oligonucleotide
  Target: ATXN1; (+) strand; PAM type: YTN; PAM sequence: CTG
ccaaggacttctaattcagt

SEQ ID NO: 260247 - DNA, 20 bp, Artificial Sequence
  Description of Artificial Sequence: Synthetic oligonucleotide
  Target: ATXN1; (+) strand; PAM type: YTN; PAM sequence: CTT
ctaattcagtttgttccacc

SEQ ID NO: 260248 - DNA, 20 bp, Artificial Sequence
  Description of Artificial Sequence: Synthetic oligonucleotide
  Target: ATXN1; (+) strand; PAM type: YTN; PAM sequence: TTC
taattcagtttgttccaccc

SEQ ID NO: 260249 - DNA, 20 bp, Artificial Sequence
  Description of Artificial Sequence: Synthetic oligonucleotide
  Target: ATXN1; (+) strand; PAM type: YTN; PAM sequence: CTA
attcagtttgttccacccgt

SEQ ID NO: 260250 - DNA, 20 bp, Artificial Sequence
  Description of Artificial Sequence: Synthetic oligonucleotide
  Target: ATXN1; (+) strand; PAM type: YTN; PAM sequence: TTC
agtttgttccacccgtttta

SEQ ID NO: 260251 - DNA, 20 bp, Artificial Sequence
  Description of Artificial Sequence: Synthetic oligonucleotide
  Target: ATXN1; (+) strand; PAM type: YTN; PAM sequence: TTT
gttccacccgttttattttt

SEQ ID NO: 260252 - DNA, 20 bp, Artificial Sequence
  Description of Artificial Sequence: Synthetic oligonucleotide
  Target: ATXN1; (+) strand; PAM type: YTN; PAM sequence: TTG
ttccacccgttttattttta

SEQ ID NO: 260253 - DNA, 20 bp, Artificial Sequence
  Description of Artificial Sequence: Synthetic oligonucleotide
  Target: ATXN1; (+) strand; PAM type: YTN; PAM sequence: TTC
cacccgttttatttttaaac

SEQ ID NO: 260254 - DNA, 20 bp, Artificial Sequence
  Description of Artificial Sequence: Synthetic oligonucleotide
  Target: ATXN1; (+) strand; PAM type: YTN; PAM sequence: TTT
tatttttaaactcgagtgca

SEQ ID NO: 260255 - DNA, 20 bp, Artificial Sequence
  Description of Artificial Sequence: Synthetic oligonucleotide
  Target: ATXN1; (+) strand; PAM type: YTN; PAM sequence: TTT
atttttaaactcgagtgcag

SEQ ID NO: 260256 - DNA, 20 bp, Artificial Sequence
  Description of Artificial Sequence: Synthetic oligonucleotide
  Target: ATXN1; (+) strand; PAM type: YTN; PAM sequence: TTA
tttttaaactcgagtgcaga

SEQ ID NO: 260257 - DNA, 20 bp, Artificial Sequence
  Description of Artificial Sequence: Synthetic oligonucleotide
  Target: ATXN1; (+) strand; PAM type: YTN; PAM sequence: TTT
ttaaactcgagtgcagattt

SEQ ID NO: 260258 - DNA, 20 bp, Artificial Sequence
  Description of Artificial Sequence: Synthetic oligonucleotide
  Target: ATXN1; (+) strand; PAM type: YTN; PAM sequence: TTT
taaactcgagtgcagatttt

SEQ ID NO: 260259 - DNA, 20 bp, Artificial Sequence
  Description of Artificial Sequence: Synthetic oligonucleotide
  Target: ATXN1; (+) strand; PAM type: YTN; PAM sequence: TTT
aaactcgagtgcagatttta

SEQ ID NO: 260260 - DNA, 20 bp, Artificial Sequence
  Description of Artificial Sequence: Synthetic oligonucleotide
  Target: ATXN1; (+) strand; PAM type: YTN; PAM sequence: TTA
aactcgagtgcagattttat

SEQ ID NO: 260261 - DNA, 20 bp, Artificial Sequence
  Description of Artificial Sequence: Synthetic oligonucleotide
  Target: ATXN1; (+) strand; PAM type: YTN; PAM sequence: CTC
gagtgcagattttattcctg

SEQ ID NO: 260262 - DNA, 20 bp, Artificial Sequence
  Description of Artificial Sequence: Synthetic oligonucleotide
  Target: ATXN1; (+) strand; PAM type: YTN; PAM sequence: TTT
tattcctggaatgttataag

SEQ ID NO: 260263 - DNA, 20 bp, Artificial Sequence
  Description of Artificial Sequence: Synthetic oligonucleotide
  Target: ATXN1; (+) strand; PAM type: YTN; PAM sequence: TTT
attcctggaatgttataaga

SEQ ID NO: 260264 - DNA, 20 bp, Artificial Sequence
  Description of Artificial Sequence: Synthetic oligonucleotide
  Target: ATXN1; (+) strand; PAM type: YTN; PAM sequence: TTA
ttcctggaatgttataagat

SEQ ID NO: 260265 - DNA, 20 bp, Artificial Sequence
  Description of Artificial Sequence: Synthetic oligonucleotide
  Target: ATXN1; (+) strand; PAM type: YTN; PAM sequence: TTC
ctggaatgttataagattgg

SEQ ID NO: 260266 - DNA, 20 bp, Artificial Sequence
  Description of Artificial Sequence: Synthetic oligonucleotide
  Target: ATXN1; (+) strand; PAM type: YTN; PAM sequence: CTG
gaatgttataagattggtgt

SEQ ID NO: 260267 - DNA, 20 bp, Artificial Sequence
  Description of Artificial Sequence: Synthetic oligonucleotide
  Target: ATXN1; (+) strand; PAM type: YTN; PAM sequence: TTA
taagattggtgtgggcagaa

SEQ ID NO: 260268 - DNA, 20 bp, Artificial Sequence
  Description of Artificial Sequence: Synthetic oligonucleotide
  Target: ATXN1; (+) strand; PAM type: YTN; PAM sequence: TTG
gtgtgggcagaaatgggcaa

SEQ ID NO: 260269 - DNA, 20 bp, Artificial Sequence
  Description of Artificial Sequence: Synthetic oligonucleotide
  Target: ATXN1; (+) strand; PAM type: YTN; PAM sequence: TTC
acttcagaagtgctttataa

SEQ ID NO: 260270 - DNA, 20 bp, Artificial Sequence
  Description of Artificial Sequence: Synthetic oligonucleotide
  Target: ATXN1; (+) strand; PAM type: YTN; PAM sequence: CTT
cagaagtgctttataacaac

SEQ ID NO: 260271 - DNA, 20 bp, Artificial Sequence
  Description of Artificial Sequence: Synthetic oligonucleotide
  Target: ATXN1; (+) strand; PAM type: YTN; PAM sequence: TTC
agaagtgctttataacaact

SEQ ID NO: 260272 - DNA, 20 bp, Artificial Sequence
  Description of Artificial Sequence: Synthetic oligonucleotide
  Target: ATXN1; (+) strand; PAM type: YTN; PAM sequence: CTT
tataacaacttggaaaagac

SEQ ID NO: 260273 - DNA, 20 bp, Artificial Sequence
  Description of Artificial Sequence: Synthetic oligonucleotide
  Target: ATXN1; (+) strand; PAM type: YTN; PAM sequence: TTT
ataacaacttggaaaagacc

SEQ ID NO: 260274 - DNA, 20 bp, Artificial Sequence
  Description of Artificial Sequence: Synthetic oligonucleotide
  Target: ATXN1; (+) strand; PAM type: YTN; PAM sequence: TTA
taacaacttggaaaagaccc

SEQ ID NO: 260275 - DNA, 20 bp, Artificial Sequence
  Description of Artificial Sequence: Synthetic oligonucleotide
  Target: ATXN1; (+) strand; PAM type: YTN; PAM sequence: CTT
ggaaaagaccctctaaaatt

SEQ ID NO: 260276 - DNA, 20 bp, Artificial Sequence
  Description of Artificial Sequence: Synthetic oligonucleotide
  Target: ATXN1; (+) strand; PAM type: YTN; PAM sequence: TTG
gaaaagaccctctaaaattc

SEQ ID NO: 260277 - DNA, 20 bp, Artificial Sequence
  Description of Artificial Sequence: Synthetic oligonucleotide
  Target: ATXN1; (+) strand; PAM type: YTN; PAM sequence: CTC
taaaattctccaagtacatt

SEQ ID NO: 260278 - DNA, 20 bp, Artificial Sequence
  Description of Artificial Sequence: Synthetic oligonucleotide
  Target: ATXN1; (+) strand; PAM type: YTN; PAM sequence: CTA
aaattctccaagtacatttt

SEQ ID NO: 260279 - DNA, 20 bp, Artificial Sequence
  Description of Artificial Sequence: Synthetic oligonucleotide
  Target: ATXN1; (+) strand; PAM type: YTN; PAM sequence: TTC
tccaagtacattttaggggt

SEQ ID NO: 260280 - DNA, 20 bp, Artificial Sequence
  Description of Artificial Sequence: Synthetic oligonucleotide
  Target: ATXN1; (+) strand; PAM type: YTN; PAM sequence: CTC
caagtacattttaggggtga

SEQ ID NO: 260281 - DNA, 20 bp, Artificial Sequence
  Description of Artificial Sequence: Synthetic oligonucleotide
  Target: ATXN1; (+) strand; PAM type: YTN; PAM sequence: TTT
taggggtgaagttcatttct

SEQ ID NO: 260282 - DNA, 20 bp, Artificial Sequence
  Description of Artificial Sequence: Synthetic oligonucleotide
  Target: ATXN1; (+) strand; PAM type: YTN; PAM sequence: TTT
aggggtgaagttcatttctc

SEQ ID NO: 260283 - DNA, 20 bp, Artificial Sequence
  Description of Artificial Sequence: Synthetic oligonucleotide
  Target: ATXN1; (+) strand; PAM type: YTN; PAM sequence: TTA
ggggtgaagttcatttctct

SEQ ID NO: 260284 - DNA, 20 bp, Artificial Sequence
  Description of Artificial Sequence: Synthetic oligonucleotide
  Target: ATXN1; (+) strand; PAM type: YTN; PAM sequence: TTC
atttctctcttttctgaaga

SEQ ID NO: 260285 - DNA, 20 bp, Artificial Sequence
  Description of Artificial Sequence: Synthetic oligonucleotide
  Target: ATXN1; (+) strand; PAM type: YTN; PAM sequence: TTT
ctctcttttctgaagaaagc

SEQ ID NO: 260286 - DNA, 20 bp, Artificial Sequence
  Description of Artificial Sequence: Synthetic oligonucleotide
  Target: ATXN1; (+) strand; PAM type: YTN; PAM sequence: TTC
tctcttttctgaagaaagct

SEQ ID NO: 260287 - DNA, 20 bp, Artificial Sequence
  Description of Artificial Sequence: Synthetic oligonucleotide
  Target: ATXN1; (+) strand; PAM type: YTN; PAM sequence: CTC
tcttttctgaagaaagctgc

SEQ ID NO: 260288 - DNA, 20 bp, Artificial Sequence
  Description of Artificial Sequence: Synthetic oligonucleotide
  Target: ATXN1; (+) strand; PAM type: YTN; PAM sequence: CTC
ttttctgaagaaagctgcct

SEQ ID NO: 260289 - DNA, 20 bp, Artificial Sequence
  Description of Artificial Sequence: Synthetic oligonucleotide
  Target: ATXN1; (+) strand; PAM type: YTN; PAM sequence: CTT
ttctgaagaaagctgccttg

SEQ ID NO: 260290 - DNA, 20 bp, Artificial Sequence
  Description of Artificial Sequence: Synthetic oligonucleotide
  Target: ATXN1; (+) strand; PAM type: YTN; PAM sequence: TTT
tctgaagaaagctgccttga

SEQ ID NO: 260291 - DNA, 20 bp, Artificial Sequence
  Description of Artificial Sequence: Synthetic oligonucleotide
  Target: ATXN1; (+) strand; PAM type: YTN; PAM sequence: TTT
ctgaagaaagctgccttgat

SEQ ID NO: 260292 - DNA, 20 bp, Artificial Sequence
  Description of Artificial Sequence: Synthetic oligonucleotide
  Target: ATXN1; (+) strand; PAM type: YTN; PAM sequence: TTC
tgaagaaagctgccttgatt

SEQ ID NO: 260293 - DNA, 20 bp, Artificial Sequence
  Description of Artificial Sequence: Synthetic oligonucleotide
  Target: ATXN1; (+) strand; PAM type: YTN; PAM sequence: CTG
aagaaagctgccttgatttt

SEQ ID NO: 260294 - DNA, 20 bp, Artificial Sequence
  Description of Artificial Sequence: Synthetic oligonucleotide
  Target: ATXN1; (+) strand; PAM type: YTN; PAM sequence: CTG
ccttgattttgcagaagtaa

SEQ ID NO: 260295 - DNA, 20 bp, Artificial Sequence
  Description of Artificial Sequence: Synthetic oligonucleotide
  Target: ATXN1; (+) strand; PAM type: YTN; PAM sequence: CTT
gattttgcagaagtaaaact

SEQ ID NO: 260296 - DNA, 20 bp, Artificial Sequence
  Description of Artificial Sequence: Synthetic oligonucleotide
  Target: ATXN1; (+) strand; PAM type: YTN; PAM sequence: TTG
attttgcagaagtaaaactc

SEQ ID NO: 260297 - DNA, 20 bp, Artificial Sequence
  Description of Artificial Sequence: Synthetic oligonucleotide
  Target: ATXN1; (+) strand; PAM type: YTN; PAM sequence: TTT
tgcagaagtaaaactcgagt

SEQ ID NO: 260298 - DNA, 20 bp, Artificial Sequence
  Description of Artificial Sequence: Synthetic oligonucleotide
  Target: ATXN1; (+) strand; PAM type: YTN; PAM sequence: TTT
gcagaagtaaaactcgagta

SEQ ID NO: 260299 - DNA, 20 bp, Artificial Sequence
  Description of Artificial Sequence: Synthetic oligonucleotide
  Target: ATXN1; (+) strand; PAM type: YTN; PAM sequence: TTG
cagaagtaaaactcgagtat

SEQ ID NO: 260300 - DNA, 20 bp, Artificial Sequence
  Description of Artificial Sequence: Synthetic oligonucleotide
  Target: ATXN1; (+) strand; PAM type: YTN; PAM sequence: CTC
gagtataattttgaaagcat

SEQ ID NO: 260301 - DNA, 20 bp, Artificial Sequence
  Description of Artificial Sequence: Synthetic oligonucleotide
  Target: ATXN1; (+) strand; PAM type: YTN; PAM sequence: TTT
tgaaagcatttcaaaatagt

SEQ ID NO: 260302 - DNA, 20 bp, Artificial Sequence
  Description of Artificial Sequence: Synthetic oligonucleotide
  Target: ATXN1; (+) strand; PAM type: YTN; PAM sequence: TTT
gaaagcatttcaaaatagtg

SEQ ID NO: 260303 - DNA, 20 bp, Artificial Sequence
  Description of Artificial Sequence: Synthetic oligonucleotide
  Target: ATXN1; (+) strand; PAM type: YTN; PAM sequence: TTG
aaagcatttcaaaatagtga

SEQ ID NO: 260304 - DNA, 20 bp, Artificial Sequence
  Description of Artificial Sequence: Synthetic oligonucleotide
  Target: ATXN1; (+) strand; PAM type: YTN; PAM sequence: TTT
caaaatagtgatgctatcta

SEQ ID NO: 260305 - DNA, 20 bp, Artificial Sequence
  Description of Artificial Sequence: Synthetic oligonucleotide
  Target: ATXN1; (+) strand; PAM type: YTN; PAM sequence: TTC
aaaatagtgatgctatctat

SEQ ID NO: 260306 - DNA, 20 bp, Artificial Sequence
  Description of Artificial Sequence: Synthetic oligonucleotide
  Target: ATXN1; (+) strand; PAM type: YTN; PAM sequence: CTA
tctattgggtatttaactat

SEQ ID NO: 260307 - DNA, 20 bp, Artificial Sequence
  Description of Artificial Sequence: Synthetic oligonucleotide
  Target: ATXN1; (+) strand; PAM type: YTN; PAM sequence: CTA
ttgggtatttaactattttc

SEQ ID NO: 260308 - DNA, 20 bp, Artificial Sequence
  Description of Artificial Sequence: Synthetic oligonucleotide
  Target: ATXN1; (+) strand; PAM type: YTN; PAM sequence: TTG
ggtatttaactattttccag

SEQ ID NO: 260309 - DNA, 20 bp, Artificial Sequence
  Description of Artificial Sequence: Synthetic oligonucleotide
  Target: ATXN1; (+) strand; PAM type: YTN; PAM sequence: TTT
aactattttccagggagtat

SEQ ID NO: 260310 - DNA, 20 bp, Artificial Sequence
  Description of Artificial Sequence: Synthetic oligonucleotide
  Target: ATXN1; (+) strand; PAM type: YTN; PAM sequence: TTA
actattttccagggagtatt

SEQ ID NO: 260311 - DNA, 20 bp, Artificial Sequence
  Description of Artificial Sequence: Synthetic oligonucleotide
  Target: ATXN1; (+) strand; PAM type: YTN; PAM sequence: CTA
ttttccagggagtattataa

SEQ ID NO: 260312 - DNA, 20 bp, Artificial Sequence
  Description of Artificial Sequence: Synthetic oligonucleotide
  Target: ATXN1; (+) strand; PAM type: YTN; PAM sequence: TTT
tccagggagtattataacaa

SEQ ID NO: 260313 - DNA, 20 bp, Artificial Sequence
  Description of Artificial Sequence: Synthetic oligonucleotide
  Target: ATXN1; (+) strand; PAM type: YTN; PAM sequence: TTT
ccagggagtattataacaat

SEQ ID NO: 260314 - DNA, 20 bp, Artificial Sequence
  Description of Artificial Sequence: Synthetic oligonucleotide
  Target: ATXN1; (+) strand; PAM type: YTN; PAM sequence: TTC
cagggagtattataacaatt

SEQ ID NO: 260315 - DNA, 20 bp, Artificial Sequence
  Description of Artificial Sequence: Synthetic oligonucleotide
  Target: ATXN1; (+) strand; PAM type: YTN; PAM sequence: TTA
taacaatttgcatagtctct

SEQ ID NO: 260316 - DNA, 20 bp, Artificial Sequence
  Description of Artificial Sequence: Synthetic oligonucleotide
  Target: ATXN1; (+) strand; PAM type: YTN; PAM sequence: TTT
gcatagtctctcatttaatt

SEQ ID NO: 260317 - DNA, 20 bp, Artificial Sequence
  Description of Artificial Sequence: Synthetic oligonucleotide
  Target: ATXN1; (+) strand; PAM type: YTN; PAM sequence: TTG
catagtctctcatttaattc

SEQ ID NO: 260318 - DNA, 20 bp, Artificial Sequence
  Description of Artificial Sequence: Synthetic oligonucleotide
  Target: ATXN1; (+) strand; PAM type: YTN; PAM sequence: CTC
tcatttaattctcacaacta

SEQ ID NO: 260319 - DNA, 20 bp, Artificial Sequence
  Description of Artificial Sequence: Synthetic oligonucleotide
  Target: ATXN1; (+) strand; PAM type: YTN; PAM sequence: CTC
atttaattctcacaactacc

SEQ ID NO: 260320 - DNA, 20 bp, Artificial Sequence
  Description of Artificial Sequence: Synthetic oligonucleotide
  Target: ATXN1; (+) strand; PAM type: YTN; PAM sequence: TTT
aattctcacaactacctcat

SEQ ID NO: 260321 - DNA, 20 bp, Artificial Sequence
  Description of Artificial Sequence: Synthetic oligonucleotide
  Target: ATXN1; (+) strand; PAM type: YTN; PAM sequence: TTA
attctcacaactacctcatc

SEQ ID NO: 260322 - DNA, 20 bp, Artificial Sequence
  Description of Artificial Sequence: Synthetic oligonucleotide
  Target: ATXN1; (+) strand; PAM type: YTN; PAM sequence: TTC
tcacaactacctcatcaccc

SEQ ID NO: 260323 - DNA, 20 bp, Artificial Sequence
  Description of Artificial Sequence: Synthetic oligonucleotide
  Target: ATXN1; (+) strand; PAM type: YTN; PAM sequence: CTC
acaactacctcatcaccccc

SEQ ID NO: 260324 - DNA, 20 bp, Artificial Sequence
  Description of Artificial Sequence: Synthetic oligonucleotide
  Target: ATXN1; (+) strand; PAM type: YTN; PAM sequence: CTA
cctcatcacccccatttacg

SEQ ID NO: 260325 - DNA, 20 bp, Artificial Sequence
  Description of Artificial Sequence: Synthetic oligonucleotide
  Target: ATXN1; (+) strand; PAM type: YTN; PAM sequence: CTC
atcacccccatttacgggca

SEQ ID NO: 260326 - DNA, 20 bp, Artificial Sequence
  Description of Artificial Sequence: Synthetic oligonucleotide
  Target: ATXN1; (+) strand; PAM type: YTN; PAM sequence: TTT
acgggcaagaaactaaggca

SEQ ID NO: 260327 - DNA, 20 bp, Artificial Sequence
  Description of Artificial Sequence: Synthetic oligonucleotide
  Target: ATXN1; (+) strand; PAM type: YTN; PAM sequence: TTA
cgggcaagaaactaaggcag

SEQ ID NO: 260328 - DNA, 20 bp, Artificial Sequence
  Description of Artificial Sequence: Synthetic oligonucleotide
  Target: ATXN1; (+) strand; PAM type: YTN; PAM sequence: CTA
aggcagggagaactgccaga

SEQ ID NO: 260329 - DNA, 20 bp, Artificial Sequence
  Description of Artificial Sequence: Synthetic oligonucleotide
  Target: ATXN1; (+) strand; PAM type: YTN; PAM sequence: CTG
ccagagttgagttcaaatcc

SEQ ID NO: 260330 - DNA, 20 bp, Artificial Sequence
  Description of Artificial Sequence: Synthetic oligonucleotide
  Target: ATXN1; (+) strand; PAM type: YTN; PAM sequence: TTG
agttcaaatccagatctcca

SEQ ID NO: 260331 - DNA, 20 bp, Artificial Sequence
  Description of Artificial Sequence: Synthetic oligonucleotide
  Target: ATXN1; (+) strand; PAM type: YTN; PAM sequence: TTC
aaatccagatctccacgata

SEQ ID NO: 260332 - DNA, 20 bp, Artificial Sequence
  Description of Artificial Sequence: Synthetic oligonucleotide
  Target: ATXN1; (+) strand; PAM type: YTN; PAM sequence: CTC
cacgatatcaaaatccttct

SEQ ID NO: 260333 - DNA, 20 bp, Artificial Sequence
  Description of Artificial Sequence: Synthetic oligonucleotide
  Target: ATXN1; (+) strand; PAM type: YTN; PAM sequence: CTT
cttcgccactatgcaactgt

SEQ ID NO: 260334 - DNA, 20 bp, Artificial Sequence
  Description of Artificial Sequence: Synthetic oligonucleotide
  Target: ATXN1; (+) strand; PAM type: YTN; PAM sequence: TTC
ttcgccactatgcaactgtg

SEQ ID NO: 260335 - DNA, 20 bp, Artificial Sequence
  Description of Artificial Sequence: Synthetic oligonucleotide
  Target: ATXN1; (+) strand; PAM type: YTN; PAM sequence: CTT
cgccactatgcaactgtgct

SEQ ID NO: 260336 - DNA, 20 bp, Artificial Sequence
  Description of Artificial Sequence: Synthetic oligonucleotide
  Target: ATXN1; (+) strand; PAM type: YTN; PAM sequence: TTC
gccactatgcaactgtgctt

SEQ ID NO: 260337 - DNA, 20 bp, Artificial Sequence
  Description of Artificial Sequence: Synthetic oligonucleotide
  Target: ATXN1; (+) strand; PAM type: YTN; PAM sequence: CTA
tgcaactgtgctttcgtgta

SEQ ID NO: 260338 - DNA, 20 bp, Artificial Sequence
  Description of Artificial Sequence: Synthetic oligonucleotide
  Target: ATXN1; (+) strand; PAM type: YTN; PAM sequence: CTG
tgctttcgtgtattcatatc

SEQ ID NO: 260339 - DNA, 20 bp, Artificial Sequence
  Description of Artificial Sequence: Synthetic oligonucleotide
  Target: ATXN1; (+) strand; PAM type: YTN; PAM sequence: CTT
tcgtgtattcatatccagga

SEQ ID NO: 260340 - DNA, 20 bp, Artificial Sequence
  Description of Artificial Sequence: Synthetic oligonucleotide
  Target: ATXN1; (+) strand; PAM type: YTN; PAM sequence: TTT
cgtgtattcatatccaggac

SEQ ID NO: 260341 - DNA, 20 bp, Artificial Sequence
  Description of Artificial Sequence: Synthetic oligonucleotide
  Target: ATXN1; (+) strand; PAM type: YTN; PAM sequence: TTC
gtgtattcatatccaggaca

SEQ ID NO: 260342 - DNA, 20 bp, Artificial Sequence
  Description of Artificial Sequence: Synthetic oligonucleotide
  Target: ATXN1; (+) strand; PAM type: YTN; PAM sequence: TTC
atatccaggacatcataaac

SEQ ID NO: 260343 - DNA, 20 bp, Artificial Sequence
  Description of Artificial Sequence: Synthetic oligonucleotide
  Target: ATXN1; (+) strand; PAM type: YTN; PAM sequence: CTA
tcaatacagacgatgtatta

SEQ ID NO: 260344 - DNA, 20 bp, Artificial Sequence
  Description of Artificial Sequence: Synthetic oligonucleotide
  Target: ATXN1; (+) strand; PAM type: YTN; PAM sequence: TTA
aataaatatacaacttggcc

SEQ ID NO: 260345 - DNA, 20 bp, Artificial Sequence
  Description of Artificial Sequence: Synthetic oligonucleotide
  Target: ATXN1; (+) strand; PAM type: YTN; PAM sequence: CTT
ggccatcaggctactattta

SEQ ID NO: 260346 - DNA, 20 bp, Artificial Sequence
  Description of Artificial Sequence: Synthetic oligonucleotide
  Target: ATXN1; (+) strand; PAM type: YTN; PAM sequence: TTG
gccatcaggctactatttat

SEQ ID NO: 260347 - DNA, 20 bp, Artificial Sequence
  Description of Artificial Sequence: Synthetic oligonucleotide
  Target: ATXN1; (+) strand; PAM type: YTN; PAM sequence: CTA
ctatttatcattctaacagg

SEQ ID NO: 260348 - DNA, 20 bp, Artificial Sequence
  Description of Artificial Sequence: Synthetic oligonucleotide
  Target: ATXN1; (+) strand; PAM type: YTN; PAM sequence: CTA
tttatcattctaacaggatg

SEQ ID NO: 260349 - DNA, 20 bp, Artificial Sequence
  Description of Artificial Sequence: Synthetic oligonucleotide
  Target: ATXN1; (+) strand; PAM type: YTN; PAM sequence: TTT
atcattctaacaggatgggg

SEQ ID NO: 260350 - DNA, 20 bp, Artificial Sequence
  Description of Artificial Sequence: Synthetic oligonucleotide
  Target: ATXN1; (+) strand; PAM type: YTN; PAM sequence: TTA
tcattctaacaggatggggg

SEQ ID NO: 260351 - DNA, 20 bp, Artificial Sequence
  Description of Artificial Sequence: Synthetic oligonucleotide
  Target: ATXN1; (+) strand; PAM type: YTN; PAM sequence: TTC
taacaggatgggggcaaaag

SEQ ID NO: 260352 - DNA, 20 bp, Artificial Sequence
  Description of Artificial Sequence: Synthetic oligonucleotide
  Target: ATXN1; (+) strand; PAM type: YTN; PAM sequence: CTA
acaggatgggggcaaaagca

SEQ ID NO: 260353 - DNA, 20 bp, Artificial Sequence
  Description of Artificial Sequence: Synthetic oligonucleotide
  Target: ATXN1; (+) strand; PAM type: YTN; PAM sequence: TTC
cttagcctgcttttctgatg

SEQ ID NO: 260354 - DNA, 20 bp, Artificial Sequence
  Description of Artificial Sequence: Synthetic oligonucleotide
  Target: ATXN1; (+) strand; PAM type: YTN; PAM sequence: CTT
agcctgcttttctgatgaga

SEQ ID NO: 260355 - DNA, 20 bp, Artificial Sequence
  Description of Artificial Sequence: Synthetic oligonucleotide
  Target: ATXN1; (+) strand; PAM type: YTN; PAM sequence: TTA
gcctgcttttctgatgagag

SEQ ID NO: 260356 - DNA, 20 bp, Artificial Sequence
  Description of Artificial Sequence: Synthetic oligonucleotide
  Target: ATXN1; (+) strand; PAM type: YTN; PAM sequence: CTG
cttttctgatgagagatcgc

SEQ ID NO: 260357 - DNA, 20 bp, Artificial Sequence
  Description of Artificial Sequence: Synthetic oligonucleotide
  Target: ATXN1; (+) strand; PAM type: YTN; PAM sequence: CTT
ttctgatgagagatcgcggg

SEQ ID NO: 260358 - DNA, 20 bp, Artificial Sequence
  Description of Artificial Sequence: Synthetic oligonucleotide
  Target: ATXN1; (+) strand; PAM type: YTN; PAM sequence: TTT
tctgatgagagatcgcgggg

SEQ ID NO: 260359 - DNA, 20 bp, Artificial Sequence
  Description of Artificial Sequence: Synthetic oligonucleotide
  Target: ATXN1; (+) strand; PAM type: YTN; PAM sequence: TTT
ctgatgagagatcgcggggg

SEQ ID NO: 260360 - DNA, 20 bp, Artificial Sequence
  Description of Artificial Sequence: Synthetic oligonucleotide
  Target: ATXN1; (+) strand; PAM type: YTN; PAM sequence: TTC
tgatgagagatcgcggggga

SEQ ID NO: 260361 - DNA, 20 bp, Artificial Sequence
  Description of Artificial Sequence: Synthetic oligonucleotide
  Target: ATXN1; (+) strand; PAM type: YTN; PAM sequence: CTG
atgagagatcgcgggggagc

SEQ ID NO: 260362 - DNA, 20 bp, Artificial Sequence
  Description of Artificial Sequence: Synthetic oligonucleotide
  Target: ATXN1; (+) strand; PAM type: YTN; PAM sequence: TTT
gcaaaagaggaccagtctct

SEQ ID NO: 260363 - DNA, 20 bp, Artificial Sequence
  Description of Artificial Sequence: Synthetic oligonucleotide
  Target: ATXN1; (+) strand; PAM type: YTN; PAM sequence: TTG
caaaagaggaccagtctctg

SEQ ID NO: 260364 - DNA, 20 bp, Artificial Sequence
  Description of Artificial Sequence: Synthetic oligonucleotide
  Target: ATXN1; (+) strand; PAM type: YTN; PAM sequence: CTC
tgcgcaggagttttggtggt

SEQ ID NO: 260365 - DNA, 20 bp, Artificial Sequence
  Description of Artificial Sequence: Synthetic oligonucleotide
  Target: ATXN1; (+) strand; PAM type: YTN; PAM sequence: CTG
cgcaggagttttggtggtaa

SEQ ID NO: 260366 - DNA, 20 bp, Artificial Sequence
  Description of Artificial Sequence: Synthetic oligonucleotide
  Target: ATXN1; (+) strand; PAM type: YTN; PAM sequence: TTT
tggtggtaaacatgtgaggg

SEQ ID NO: 260367 - DNA, 20 bp, Artificial Sequence
  Description of Artificial Sequence: Synthetic oligonucleotide
  Target: ATXN1; (+) strand; PAM type: YTN; PAM sequence: TTT
ggtggtaaacatgtgagggt

SEQ ID NO: 260368 - DNA, 20 bp, Artificial Sequence
  Description of Artificial Sequence: Synthetic oligonucleotide
  Target: ATXN1; (+) strand; PAM type: YTN; PAM sequence: TTG
gtggtaaacatgtgagggta

SEQ ID NO: 260369 - DNA, 20 bp, Artificial Sequence
  Description of Artificial Sequence: Synthetic oligonucleotide
  Target: ATXN1; (+) strand; PAM type: YTN; PAM sequence: CTA
tttattttgaaataccaaat

SEQ ID NO: 260370 - DNA, 20 bp, Artificial Sequence
  Description of Artificial Sequence: Synthetic oligonucleotide
  Target: ATXN1; (+) strand; PAM type: YTN; PAM sequence: TTT
attttgaaataccaaatggt

SEQ ID NO: 260371 - DNA, 20 bp, Artificial Sequence
  Description of Artificial Sequence: Synthetic oligonucleotide
  Target: ATXN1; (+) strand; PAM type: YTN; PAM sequence: TTA
ttttgaaataccaaatggta

SEQ ID NO: 260372 - DNA, 20 bp, Artificial Sequence
  Description of Artificial Sequence: Synthetic oligonucleotide
  Target: ATXN1; (+) strand; PAM type: YTN; PAM sequence: TTT
tgaaataccaaatggtacta

SEQ ID NO: 260373 - DNA, 20 bp, Artificial Sequence
  Description of Artificial Sequence: Synthetic oligonucleotide
  Target: ATXN1; (+) strand; PAM type: YTN; PAM sequence: TTT
gaaataccaaatggtactaa

SEQ ID NO: 260374 - DNA, 20 bp, Artificial Sequence
  Description of Artificial Sequence: Synthetic oligonucleotide
  Target: ATXN1; (+) strand; PAM type: YTN; PAM sequence: TTG
aaataccaaatggtactaat

SEQ ID NO: 260375 - DNA, 20 bp, Artificial Sequence
  Description of Artificial Sequence: Synthetic oligonucleotide
  Target: ATXN1; (+) strand; PAM type: YTN; PAM sequence: CTA
atataaaaacttgttcaacc

SEQ ID NO: 260376 - DNA, 20 bp, Artificial Sequence
  Description of Artificial Sequence: Synthetic oligonucleotide
  Target: ATXN1; (+) strand; PAM type: YTN; PAM sequence: CTT
gttcaacctactttggcaac

SEQ ID NO: 260377 - DNA, 20 bp, Artificial Sequence
  Description of Artificial Sequence: Synthetic oligonucleotide
  Target: ATXN1; (+) strand; PAM type: YTN; PAM sequence: TTG
ttcaacctactttggcaaca

SEQ ID NO: 260378 - DNA, 20 bp, Artificial Sequence
  Description of Artificial Sequence: Synthetic oligonucleotide
  Target: ATXN1; (+) strand; PAM type: YTN; PAM sequence: TTC
aacctactttggcaacatta

SEQ ID NO: 260379 - DNA, 20 bp, Artificial Sequence
  Description of Artificial Sequence: Synthetic oligonucleotide
  Target: ATXN1; (+) strand; PAM type: YTN; PAM sequence: CTA
ctttggcaacattaaatatg

SEQ ID NO: 260380 - DNA, 20 bp, Artificial Sequence
  Description of Artificial Sequence: Synthetic oligonucleotide
  Target: ATXN1; (+) strand; PAM type: YTN; PAM sequence: CTT
tggcaacattaaatatgaag

SEQ ID NO: 260381 - DNA, 20 bp, Artificial Sequence
  Description of Artificial Sequence: Synthetic oligonucleotide
  Target: ATXN1; (+) strand; PAM type: YTN; PAM sequence: TTT
ggcaacattaaatatgaagg

SEQ ID NO: 260382 - DNA, 20 bp, Artificial Sequence
  Description of Artificial Sequence: Synthetic oligonucleotide
  Target: ATXN1; (+) strand; PAM type: YTN; PAM sequence: TTG
gcaacattaaatatgaaggg

SEQ ID NO: 260383 - DNA, 20 bp, Artificial Sequence
  Description of Artificial Sequence: Synthetic oligonucleotide
  Target: ATXN1; (+) strand; PAM type: YTN; PAM sequence: TTA
aatatgaagggaatgtacct

SEQ ID NO: 260384 - DNA, 20 bp, Artificial Sequence
  Description of Artificial Sequence: Synthetic oligonucleotide
  Target: ATXN1; (+) strand; PAM type: YTN; PAM sequence: CTT
cttcccctcctccaaaagta

SEQ ID NO: 260385 - DNA, 20 bp, Artificial Sequence
  Description of Artificial Sequence: Synthetic oligonucleotide
  Target: ATXN1; (+) strand; PAM type: YTN; PAM sequence: TTC
ttcccctcctccaaaagtat

SEQ ID NO: 260386 - DNA, 20 bp, Artificial Sequence
  Description of Artificial Sequence: Synthetic oligonucleotide
  Target: ATXN1; (+) strand; PAM type: YTN; PAM sequence: CTT
cccctcctccaaaagtattt

SEQ ID NO: 260387 - DNA, 20 bp, Artificial Sequence
  Description of Artificial Sequence: Synthetic oligonucleotide
  Target: ATXN1; (+) strand; PAM type: YTN; PAM sequence: TTC
ccctcctccaaaagtattta

SEQ ID NO: 260388 - DNA, 20 bp, Artificial Sequence
  Description of Artificial Sequence: Synthetic oligonucleotide
  Target: ATXN1; (+) strand; PAM type: YTN; PAM sequence: CTC
ctccaaaagtatttacttca

SEQ ID NO: 260389 - DNA, 20 bp, Artificial Sequence
  Description of Artificial Sequence: Synthetic oligonucleotide
  Target: ATXN1; (+) strand; PAM type: YTN; PAM sequence: CTC
caaaagtatttacttcaaaa

SEQ ID NO: 260390 - DNA, 20 bp, Artificial Sequence
  Description of Artificial Sequence: Synthetic oligonucleotide
  Target: ATXN1; (+) strand; PAM type: YTN; PAM sequence: TTT
acttcaaaaatcgatttcct

SEQ ID NO: 260391 - DNA, 20 bp, Artificial Sequence
  Description of Artificial Sequence: Synthetic oligonucleotide
  Target: ATXN1; (+) strand; PAM type: YTN; PAM sequence: TTA
cttcaaaaatcgatttcctc

SEQ ID NO: 260392 - DNA, 20 bp, Artificial Sequence
  Description of Artificial Sequence: Synthetic oligonucleotide
  Target: ATXN1; (+) strand; PAM type: YTN; PAM sequence: CTT
caaaaatcgatttcctctgt

SEQ ID NO: 260393 - DNA, 20 bp, Artificial Sequence
  Description of Artificial Sequence: Synthetic oligonucleotide
  Target: ATXN1; (+) strand; PAM type: YTN; PAM sequence: TTC
aaaaatcgatttcctctgtc

SEQ ID NO: 260394 - DNA, 20 bp, Artificial Sequence
  Description of Artificial Sequence: Synthetic oligonucleotide
  Target: ATXN1; (+) strand; PAM type: YTN; PAM sequence: TTT
cctctgtcactggttattgc

SEQ ID NO: 260395 - DNA, 20 bp, Artificial Sequence
  Description of Artificial Sequence: Synthetic oligonucleotide
  Target: ATXN1; (+) strand; PAM type: YTN; PAM sequence: TTC
ctctgtcactggttattgct

SEQ ID NO: 260396 - DNA, 20 bp, Artificial Sequence
  Description of Artificial Sequence: Synthetic oligonucleotide
  Target: ATXN1; (+) strand; PAM type: YTN; PAM sequence: CTC
tgtcactggttattgctgca

SEQ ID NO: 260397 - DNA, 20 bp, Artificial Sequence
  Description of Artificial Sequence: Synthetic oligonucleotide
  Target: ATXN1; (+) strand; PAM type: YTN; PAM sequence: CTG
tcactggttattgctgcatt

SEQ ID NO: 260398 - DNA, 20 bp, Artificial Sequence
  Description of Artificial Sequence: Synthetic oligonucleotide
  Target: ATXN1; (+) strand; PAM type: YTN; PAM sequence: CTG
gttattgctgcattttgctc

SEQ ID NO: 260399 - DNA, 20 bp, Artificial Sequence
  Description of Artificial Sequence: Synthetic oligonucleotide
  Target: ATXN1; (+) strand; PAM type: YTN; PAM sequence: TTA
ttgctgcattttgctcagtg

SEQ ID NO: 260400 - DNA, 20 bp, Artificial Sequence
  Description of Artificial Sequence: Synthetic oligonucleotide
  Target: ATXN1; (+) strand; PAM type: YTN; PAM sequence: TTG
ctgcattttgctcagtggtt

SEQ ID NO: 260401 - DNA, 20 bp, Artificial Sequence
  Description of Artificial Sequence: Synthetic oligonucleotide
  Target: ATXN1; (+) strand; PAM type: YTN; PAM sequence: CTG
cattttgctcagtggttctg

SEQ ID NO: 260402 - DNA, 20 bp, Artificial Sequence
  Description of Artificial Sequence: Synthetic oligonucleotide
  Target: ATXN1; (+) strand; PAM type: YTN; PAM sequence: TTT
tgctcagtggttctgagaaa

SEQ ID NO: 260403 - DNA, 20 bp, Artificial Sequence
  Description of Artificial Sequence: Synthetic oligonucleotide
  Target: ATXN1; (+) strand; PAM type: YTN; PAM sequence: TTT
gctcagtggttctgagaaac

SEQ ID NO: 260404 - DNA, 20 bp, Artificial Sequence
  Description of Artificial Sequence: Synthetic oligonucleotide
  Target: ATXN1; (+) strand; PAM type: YTN; PAM sequence: TTG
ctcagtggttctgagaaacc

SEQ ID NO: 260405 - DNA, 20 bp, Artificial Sequence
  Description of Artificial Sequence: Synthetic oligonucleotide
  Target: ATXN1; (+) strand; PAM type: YTN; PAM sequence: CTC
agtggttctgagaaaccgca

SEQ ID NO: 260406 - DNA, 20 bp, Artificial Sequence
  Description of Artificial Sequence: Synthetic oligonucleotide
  Target: ATXN1; (+) strand; PAM type: YTN; PAM sequence: TTC
tgagaaaccgcatggaaaat

SEQ ID NO: 260407 - DNA, 20 bp, Artificial Sequence
  Description of Artificial Sequence: Synthetic oligonucleotide
  Target: ATXN1; (+) strand; PAM type: YTN; PAM sequence: CTG
agaaaccgcatggaaaatca

SEQ ID NO: 260408 - DNA, 20 bp, Artificial Sequence
  Description of Artificial Sequence: Synthetic oligonucleotide
  Target: ATXN1; (+) strand; PAM type: YTN; PAM sequence: TTA
cactcgttaaattgaccctg

SEQ ID NO: 260409 - DNA, 20 bp, Artificial Sequence
  Description of Artificial Sequence: Synthetic oligonucleotide
  Target: ATXN1; (+) strand; PAM type: YTN; PAM sequence: CTC
gttaaattgaccctgcaggg

SEQ ID NO: 260410 - DNA, 20 bp, Artificial Sequence
  Description of Artificial Sequence: Synthetic oligonucleotide
  Target: ATXN1; (+) strand; PAM type: YTN; PAM sequence: TTA
aattgaccctgcagggctct

SEQ ID NO: 260411 - DNA, 20 bp, Artificial Sequence
  Description of Artificial Sequence: Synthetic oligonucleotide
  Target: ATXN1; (+) strand; PAM type: YTN; PAM sequence: TTG
accctgcagggctctaccac

SEQ ID NO: 260412 - DNA, 20 bp, Artificial Sequence
  Description of Artificial Sequence: Synthetic oligonucleotide
  Target: ATXN1; (+) strand; PAM type: YTN; PAM sequence: CTG
cagggctctaccaccagtac

SEQ ID NO: 260413 - DNA, 20 bp, Artificial Sequence
  Description of Artificial Sequence: Synthetic oligonucleotide
  Target: ATXN1; (+) strand; PAM type: YTN; PAM sequence: CTC
taccaccagtacatgcatca

SEQ ID NO: 260414 - DNA, 20 bp, Artificial Sequence
  Description of Artificial Sequence: Synthetic oligonucleotide
  Target: ATXN1; (+) strand; PAM type: YTN; PAM sequence: CTA
ccaccagtacatgcatcatc

SEQ ID NO: 260415 - DNA, 20 bp, Artificial Sequence
  Description of Artificial Sequence: Synthetic oligonucleotide
  Target: ATXN1; (+) strand; PAM type: YTN; PAM sequence: CTG
ccaggctcatgctgagaata

SEQ ID NO: 260416 - DNA, 20 bp, Artificial Sequence
  Description of Artificial Sequence: Synthetic oligonucleotide
  Target: ATXN1; (+) strand; PAM type: YTN; PAM sequence: CTC
atgctgagaatatcatcatg

SEQ ID NO: 260417 - DNA, 20 bp, Artificial Sequence
  Description of Artificial Sequence: Synthetic oligonucleotide
  Target: ATXN1; (+) strand; PAM type: YTN; PAM sequence: CTG
agaatatcatcatgaaatca

SEQ ID NO: 260418 - DNA, 20 bp, Artificial Sequence
  Description of Artificial Sequence: Synthetic oligonucleotide
  Target: ATXN1; (+) strand; PAM type: YTN; PAM sequence: CTC
tctgttccatagctcatttg

SEQ ID NO: 260419 - DNA, 20 bp, Artificial Sequence
  Description of Artificial Sequence: Synthetic oligonucleotide
  Target: ATXN1; (+) strand; PAM type: YTN; PAM sequence: CTC
tgttccatagctcatttgca

SEQ ID NO: 260420 - DNA, 20 bp, Artificial Sequence
  Description of Artificial Sequence: Synthetic oligonucleotide
  Target: ATXN1; (+) strand; PAM type: YTN; PAM sequence: CTG
ttccatagctcatttgcatg

SEQ ID NO: 260421 - DNA, 20 bp, Artificial Sequence
  Description of Artificial Sequence: Synthetic oligonucleotide
  Target: ATXN1; (+) strand; PAM type: YTN; PAM sequence: TTC
catagctcatttgcatggtt

SEQ ID NO: 260422 - DNA, 20 bp, Artificial Sequence
  Description of Artificial Sequence: Synthetic oligonucleotide
  Target: ATXN1; (+) strand; PAM type: YTN; PAM sequence: CTC
atttgcatggttttcattgg

SEQ ID NO: 260423 - DNA, 20 bp, Artificial Sequence
  Description of Artificial Sequence: Synthetic oligonucleotide
  Target: ATXN1; (+) strand; PAM type: YTN; PAM sequence: TTT
gcatggttttcattggtttt

SEQ ID NO: 260424 - DNA, 20 bp, Artificial Sequence
  Description of Artificial Sequence: Synthetic oligonucleotide
  Target: ATXN1; (+) strand; PAM type: YTN; PAM sequence: TTG
catggttttcattggttttg

SEQ ID NO: 260425 - DNA, 20 bp, Artificial Sequence
  Description of Artificial Sequence: Synthetic oligonucleotide
  Target: ATXN1; (+) strand; PAM type: YTN; PAM sequence: TTT
tcattggttttgtagaacct

SEQ ID NO: 260426 - DNA, 20 bp, Artificial Sequence
  Description of Artificial Sequence: Synthetic oligonucleotide
  Target: ATXN1; (+) strand; PAM type: YTN; PAM sequence: TTT
cattggttttgtagaacctc

SEQ ID NO: 260427 - DNA, 20 bp, Artificial Sequence
  Description of Artificial Sequence: Synthetic oligonucleotide
  Target: ATXN1; (+) strand; PAM type: YTN; PAM sequence: TTC
attggttttgtagaacctct

SEQ ID NO: 260428 - DNA, 20 bp, Artificial Sequence
  Description of Artificial Sequence: Synthetic oligonucleotide
  Target: ATXN1; (+) strand; PAM type: YTN; PAM sequence: TTG
gttttgtagaacctctatac

SEQ ID NO: 260429 - DNA, 20 bp, Artificial Sequence
  Description of Artificial Sequence: Synthetic oligonucleotide
  Target: ATXN1; (+) strand; PAM type: YTN; PAM sequence: TTT
tgtagaacctctatactaaa

SEQ ID NO: 260430 - DNA, 20 bp, Artificial Sequence
  Description of Artificial Sequence: Synthetic oligonucleotide
  Target: ATXN1; (+) strand; PAM type: YTN; PAM sequence: TTT
gtagaacctctatactaaat

SEQ ID NO: 260431 - DNA, 20 bp, Artificial Sequence
  Description of Artificial Sequence: Synthetic oligonucleotide
  Target: ATXN1; (+) strand; PAM type: YTN; PAM sequence: TTG
tagaacctctatactaaatg

SEQ ID NO: 260432 - DNA, 20 bp, Artificial Sequence
  Description of Artificial Sequence: Synthetic oligonucleotide
  Target: ATXN1; (+) strand; PAM type: YTN; PAM sequence: CTC
tatactaaatgtcaatttcc

SEQ ID NO: 260433 - DNA, 20 bp, Artificial Sequence
  Description of Artificial Sequence: Synthetic oligonucleotide
  Target: ATXN1; (+) strand; PAM type: YTN; PAM sequence: CTA
tactaaatgtcaatttcctt

SEQ ID NO: 260434 - DNA, 20 bp, Artificial Sequence
  Description of Artificial Sequence: Synthetic oligonucleotide
  Target: ATXN1; (+) strand; PAM type: YTN; PAM sequence: CTA
aatgtcaatttccttttctt

SEQ ID NO: 260435 - DNA, 20 bp, Artificial Sequence
  Description of Artificial Sequence: Synthetic oligonucleotide
  Target: ATXN1; (+) strand; PAM type: YTN; PAM sequence: TTT
ccttttctttcctaaagctt

SEQ ID NO: 260436 - DNA, 20 bp, Artificial Sequence
  Description of Artificial Sequence: Synthetic oligonucleotide
  Target: ATXN1; (+) strand; PAM type: YTN; PAM sequence: TTC
cttttctttcctaaagctta

SEQ ID NO: 260437 - DNA, 20 bp, Artificial Sequence
  Description of Artificial Sequence: Synthetic oligonucleotide
  Target: ATXN1; (+) strand; PAM type: YTN; PAM sequence: CTT
ttctttcctaaagcttatta

SEQ ID NO: 260438 - DNA, 20 bp, Artificial Sequence
  Description of Artificial Sequence: Synthetic oligonucleotide
  Target: ATXN1; (+) strand; PAM type: YTN; PAM sequence: TTT
tctttcctaaagcttattag

SEQ ID NO: 260439 - DNA, 20 bp, Artificial Sequence
  Description of Artificial Sequence: Synthetic oligonucleotide
  Target: ATXN1; (+) strand; PAM type: YTN; PAM sequence: TTT
ctttcctaaagcttattagc

SEQ ID NO: 260440 - DNA, 20 bp, Artificial Sequence
  Description of Artificial Sequence: Synthetic oligonucleotide
  Target: ATXN1; (+) strand; PAM type: YTN; PAM sequence: TTC
tttcctaaagcttattagct

SEQ ID NO: 260441 - DNA, 20 bp, Artificial Sequence
  Description of Artificial Sequence: Synthetic oligonucleotide
  Target: ATXN1; (+) strand; PAM type: YTN; PAM sequence: CTT
tcctaaagcttattagctgt

SEQ ID NO: 260442 - DNA, 20 bp, Artificial Sequence
  Description of Artificial Sequence: Synthetic oligonucleotide
  Target: ATXN1; (+) strand; PAM type: YTN; PAM sequence: TTT
cctaaagcttattagctgtg

SEQ ID NO: 260443 - DNA, 20 bp, Artificial Sequence
  Description of Artificial Sequence: Synthetic oligonucleotide
  Target: ATXN1; (+) strand; PAM type: YTN; PAM sequence: TTC
ctaaagcttattagctgtgt

SEQ ID NO: 260444 - DNA, 20 bp, Artificial Sequence
  Description of Artificial Sequence: Synthetic oligonucleotide
  Target: ATXN1; (+) strand; PAM type: YTN; PAM sequence: CTA
aagcttattagctgtgtgtg

SEQ ID NO: 260445 - DNA, 20 bp, Artificial Sequence
  Description of Artificial Sequence: Synthetic oligonucleotide
  Target: ATXN1; (+) strand; PAM type: YTN; PAM sequence: CTT
attagctgtgtgtgatgttt

SEQ ID NO: 260446 - DNA, 20 bp, Artificial Sequence
  Description of Artificial Sequence: Synthetic oligonucleotide
  Target: ATXN1; (+) strand; PAM type: YTN; PAM sequence: TTA
ttagctgtgtgtgatgttta

SEQ ID NO: 260447 - DNA, 20 bp, Artificial Sequence
  Description of Artificial Sequence: Synthetic oligonucleotide
  Target: ATXN1; (+) strand; PAM type: YTN; PAM sequence: TTA
gctgtgtgtgatgtttacag

SEQ ID NO: 260448 - DNA, 20 bp, Artificial Sequence
  Description of Artificial Sequence: Synthetic oligonucleotide
  Target: ATXN1; (+) strand; PAM type: YTN; PAM sequence: CTG
tgtgtgatgtttacagcttg

SEQ ID NO: 260449 - DNA, 20 bp, Artificial Sequence
  Description of Artificial Sequence: Synthetic oligonucleotide
  Target: ATXN1; (+) strand; PAM type: YTN; PAM sequence: TTT
acagcttgaagaccaaacag

SEQ ID NO: 260450 - DNA, 20 bp, Artificial Sequence
  Description of Artificial Sequence: Synthetic oligonucleotide
  Target: ATXN1; (+) strand; PAM type: YTN; PAM sequence: TTA
cagcttgaagaccaaacaga

SEQ ID NO: 260451 - DNA, 20 bp, Artificial Sequence
  Description of Artificial Sequence: Synthetic oligonucleotide
  Target: ATXN1; (+) strand; PAM type: YTN; PAM sequence: CTT
gaagaccaaacagatttaat

SEQ ID NO: 260452 - DNA, 20 bp, Artificial Sequence
  Description of Artificial Sequence: Synthetic oligonucleotide
  Target: ATXN1; (+) strand; PAM type: YTN; PAM sequence: TTG
aagaccaaacagatttaata

SEQ ID NO: 260453 - DNA, 20 bp, Artificial Sequence
  Description of Artificial Sequence: Synthetic oligonucleotide
  Target: ATXN1; (+) strand; PAM type: YTN; PAM sequence: TTT
aatagttaaaacatttaaac

SEQ ID NO: 260454 - DNA, 20 bp, Artificial Sequence
  Description of Artificial Sequence: Synthetic oligonucleotide
  Target: ATXN1; (+) strand; PAM type: YTN; PAM sequence: TTA
atagttaaaacatttaaact

SEQ ID NO: 260455 - DNA, 20 bp, Artificial Sequence
  Description of Artificial Sequence: Synthetic oligonucleotide
  Target: ATXN1; (+) strand; PAM type: YTN; PAM sequence: TTA
aaacatttaaactatataat

SEQ ID NO: 260456 - DNA, 20 bp, Artificial Sequence
  Description of Artificial Sequence: Synthetic oligonucleotide
  Target: ATXN1; (+) strand; PAM type: YTN; PAM sequence: TTT
aaactatataatttaaaagc

SEQ ID NO: 260457 - DNA, 20 bp, Artificial Sequence
  Description of Artificial Sequence: Synthetic oligonucleotide
  Target: ATXN1; (+) strand; PAM type: YTN; PAM sequence: TTA
aactatataatttaaaagca

SEQ ID NO: 260458 - DNA, 20 bp, Artificial Sequence
  Description of Artificial Sequence: Synthetic oligonucleotide
  Target: ATXN1; (+) strand; PAM type: YTN; PAM sequence: CTA
tataatttaaaagcatgcaa

SEQ ID NO: 260459 - DNA, 20 bp, Artificial Sequence
  Description of Artificial Sequence: Synthetic oligonucleotide
  Target: ATXN1; (+) strand; PAM type: YTN; PAM sequence: TTT
aaaagcatgcaaggaagagg

SEQ ID NO: 260460 - DNA, 20 bp, Artificial Sequence
  Description of Artificial Sequence: Synthetic oligonucleotide
  Target: ATXN1; (+) strand; PAM type: YTN; PAM sequence: TTA
aaagcatgcaaggaagaggg

SEQ ID NO: 260461 - DNA, 20 bp, Artificial Sequence
  Description of Artificial Sequence: Synthetic oligonucleotide
  Target: ATXN1; (+) strand; PAM type: YTN; PAM sequence: CTC
tgatgtagatcaaacatgta

SEQ ID NO: 260462 - DNA, 20 bp, Artificial Sequence
  Description of Artificial Sequence: Synthetic oligonucleotide
  Target: ATXN1; (+) strand; PAM type: YTN; PAM sequence: CTG
atgtagatcaaacatgtaga

SEQ ID NO: 260463 - DNA, 20 bp, Artificial Sequence
  Description of Artificial Sequence: Synthetic oligonucleotide
  Target: ATXN1; (+) strand; PAM type: YTN; PAM sequence: TTT
gtgctgttaaaatatgcttt

SEQ ID NO: 260464 - DNA, 20 bp, Artificial Sequence
  Description of Artificial Sequence: Synthetic oligonucleotide
  Target: ATXN1; (+) strand; PAM type: YTN; PAM sequence: TTG
tgctgttaaaatatgctttc

SEQ ID NO: 260465 - DNA, 20 bp, Artificial Sequence
  Description of Artificial Sequence: Synthetic oligonucleotide
  Target: ATXN1; (+) strand; PAM type: YTN; PAM sequence: CTG
ttaaaatatgctttccaagt

SEQ ID NO: 260466 - DNA, 20 bp, Artificial Sequence
  Description of Artificial Sequence: Synthetic oligonucleotide
  Target: ATXN1; (+) strand; PAM type: YTN; PAM sequence: TTA
aaatatgctttccaagtttg

SEQ ID NO: 260467 - DNA, 20 bp, Artificial Sequence
  Description of Artificial Sequence: Synthetic oligonucleotide
  Target: ATXN1; (+) strand; PAM type: YTN; PAM sequence: CTT
tccaagtttggaagatgcgg

SEQ ID NO: 260468 - DNA, 20 bp, Artificial Sequence
  Description of Artificial Sequence: Synthetic oligonucleotide
  Target: ATXN1; (+) strand; PAM type: YTN; PAM sequence: TTT
ccaagtttggaagatgcgga

SEQ ID NO: 260469 - DNA, 20 bp, Artificial Sequence
  Description of Artificial Sequence: Synthetic oligonucleotide
  Target: ATXN1; (+) strand; PAM type: YTN; PAM sequence: TTC
caagtttggaagatgcggag

SEQ ID NO: 260470 - DNA, 20 bp, Artificial Sequence
  Description of Artificial Sequence: Synthetic oligonucleotide
  Target: ATXN1; (+) strand; PAM type: YTN; PAM sequence: TTT
ggaagatgcggaggcctcat

SEQ ID NO: 260471 - DNA, 20 bp, Artificial Sequence
  Description of Artificial Sequence: Synthetic oligonucleotide
  Target: ATXN1; (+) strand; PAM type: YTN; PAM sequence: TTG
gaagatgcggaggcctcatg

SEQ ID NO: 260472 - DNA, 20 bp, Artificial Sequence
  Description of Artificial Sequence: Synthetic oligonucleotide
  Target: ATXN1; (+) strand; PAM type: YTN; PAM sequence: CTC
atgcatgtctgtgcacacat

SEQ ID NO: 260473 - DNA, 20 bp, Artificial Sequence
  Description of Artificial Sequence: Synthetic oligonucleotide
  Target: ATXN1; (+) strand; PAM type: YTN; PAM sequence: CTG
tgcacacataagcaccacca

SEQ ID NO: 260474 - DNA, 20 bp, Artificial Sequence
  Description of Artificial Sequence: Synthetic oligonucleotide
  Target: ATXN1; (+) strand; PAM type: YTN; PAM sequence: TTT
gcttaacctatttctttttt

SEQ ID NO: 260475 - DNA, 20 bp, Artificial Sequence
  Description of Artificial Sequence: Synthetic oligonucleotide
  Target: ATXN1; (+) strand; PAM type: YTN; PAM sequence: TTG
cttaacctatttcttttttc

SEQ ID NO: 260476 - DNA, 20 bp, Artificial Sequence
  Description of Artificial Sequence: Synthetic oligonucleotide
  Target: ATXN1; (+) strand; PAM type: YTN; PAM sequence: CTT
aacctatttcttttttcttt

SEQ ID NO: 260477 - DNA, 20 bp, Artificial Sequence
  Description of Artificial Sequence: Synthetic oligonucleotide
  Target: ATXN1; (+) strand; PAM type: YTN; PAM sequence: TTA
acctatttcttttttctttt

SEQ ID NO: 260478 - DNA, 20 bp, Artificial Sequence
  Description of Artificial Sequence: Synthetic oligonucleotide
  Target: ATXN1; (+) strand; PAM type: YTN; PAM sequence: CTA
tttcttttttcttttcttct

SEQ ID NO: 260479 - DNA, 20 bp, Artificial Sequence
  Description of Artificial Sequence: Synthetic oligonucleotide
  Target: ATXN1; (+) strand; PAM type: YTN; PAM sequence: TTT
cttttttcttttcttctctt

SEQ ID NO: 260480 - DNA, 20 bp, Artificial Sequence
  Description of Artificial Sequence: Synthetic oligonucleotide
  Target: ATXN1; (+) strand; PAM type: YTN; PAM sequence: TTC
ttttttcttttcttctcttc

SEQ ID NO: 260481 - DNA, 20 bp, Artificial Sequence
  Description of Artificial Sequence: Synthetic oligonucleotide
  Target: ATXN1; (+) strand; PAM type: YTN; PAM sequence: CTT
ttttcttttcttctcttctt

SEQ ID NO: 260482 - DNA, 20 bp, Artificial Sequence
  Description of Artificial Sequence: Synthetic oligonucleotide
  Target: ATXN1; (+) strand; PAM type: YTN; PAM sequence: TTT
tttcttttcttctcttcttc

SEQ ID NO: 260483 - DNA, 20 bp, Artificial Sequence
  Description of Artificial Sequence: Synthetic oligonucleotide
  Target: ATXN1; (+) strand; PAM type: YTN; PAM sequence: TTT
ttcttttcttctcttcttct

SEQ ID NO: 260484 - DNA, 20 bp, Artificial Sequence
  Description of Artificial Sequence: Synthetic oligonucleotide
  Target: ATXN1; (+) strand; PAM type: YTN; PAM sequence: TTT
tcttttcttctcttcttctt

SEQ ID NO: 260485 - DNA, 20 bp, Artificial Sequence
  Description of Artificial Sequence: Synthetic oligonucleotide
  Target: ATXN1; (+) strand; PAM type: YTN; PAM sequence: TTT
cttttcttctcttcttcttc

SEQ ID NO: 260486 - DNA, 20 bp, Artificial Sequence
  Description of Artificial Sequence: Synthetic oligonucleotide
  Target: ATXN1; (+) strand; PAM type: YTN; PAM sequence: TTC
ttttcttctcttcttcttct

SEQ ID NO: 260487 - DNA, 20 bp, Artificial Sequence
  Description of Artificial Sequence: Synthetic oligonucleotide
  Target: ATXN1; (+) strand; PAM type: YTN; PAM sequence: CTT
ttcttctcttcttcttcttc

SEQ ID NO: 260488 - DNA, 20 bp, Artificial Sequence
  Description of Artificial Sequence: Synthetic oligonucleotide
  Target: ATXN1; (+) strand; PAM type: YTN; PAM sequence: TTT
tcttctcttcttcttcttct

SEQ ID NO: 260489 - DNA, 20 bp, Artificial Sequence
  Description of Artificial Sequence: Synthetic oligonucleotide
  Target: ATXN1; (+) strand; PAM type: YTN; PAM sequence: TTT
cttctcttcttcttcttctt

SEQ ID NO: 260490 - DNA, 20 bp, Artificial Sequence
  Description of Artificial Sequence: Synthetic oligonucleotide
  Target: ATXN1; (+) strand; PAM type: YTN; PAM sequence: TTC
ttctcttcttcttcttcttt

SEQ ID NO: 260491 - DNA, 20 bp, Artificial Sequence
  Description of Artificial Sequence: Synthetic oligonucleotide
  Target: ATXN1; (+) strand; PAM type: YTN; PAM sequence: CTT
ctcttcttcttcttcttttt

SEQ ID NO: 260492 - DNA, 20 bp, Artificial Sequence
  Description of Artificial Sequence: Synthetic oligonucleotide
  Target: ATXN1; (+) strand; PAM type: YTN; PAM sequence: TTC
tcttcttcttcttctttttt

SEQ ID NO: 260493 - DNA, 20 bp, Artificial Sequence
  Description of Artificial Sequence: Synthetic oligonucleotide
  Target: ATXN1; (+) strand; PAM type: YTN; PAM sequence: CTC
ttcttcttcttctttttttt

SEQ ID NO: 260494 - DNA, 20 bp, Artificial Sequence
  Description of Artificial Sequence: Synthetic oligonucleotide
  Target: ATXN1; (+) strand; PAM type: YTN; PAM sequence: CTT
cttcttcttctttttttttt

SEQ ID NO: 260495 - DNA, 20 bp, Artificial Sequence
  Description of Artificial Sequence: Synthetic oligonucleotide
  Target: ATXN1; (+) strand; PAM type: YTN; PAM sequence: TTC
ttcttcttcttttttttttt

SEQ ID NO: 260496 - DNA, 20 bp, Artificial Sequence
  Description of Artificial Sequence: Synthetic oligonucleotide
  Target: ATXN1; (+) strand; PAM type: YTN; PAM sequence: CTT
cttcttcttttttttttttg

SEQ ID NO: 260497 - DNA, 20 bp, Artificial Sequence
  Description of Artificial Sequence: Synthetic oligonucleotide
  Target: ATXN1; (+) strand; PAM type: YTN; PAM sequence: TTC
ttcttcttttttttttttgc

SEQ ID NO: 260498 - DNA, 20 bp, Artificial Sequence
  Description of Artificial Sequence: Synthetic oligonucleotide
  Target: ATXN1; (+) strand; PAM type: YTN; PAM sequence: CTT
cttcttttttttttttgcaa

SEQ ID NO: 260499 - DNA, 20 bp, Artificial Sequence
  Description of Artificial Sequence: Synthetic oligonucleotide
  Target: ATXN1; (+) strand; PAM type: YTN; PAM sequence: TTC
ttcttttttttttttgcaat

SEQ ID NO: 260500 - DNA, 20 bp, Artificial Sequence
  Description of Artificial Sequence: Synthetic oligonucleotide
  Target: ATXN1; (+) strand; PAM type: YTN; PAM sequence: CTT
cttttttttttttgcaatga

SEQ ID NO: 260501 - DNA, 20 bp, Artificial Sequence
  Description of Artificial Sequence: Synthetic oligonucleotide
  Target: ATXN1; (+) strand; PAM type: YTN; PAM sequence: TTC
ttttttttttttgcaatgat

SEQ ID NO: 260502 - DNA, 20 bp, Artificial Sequence
  Description of Artificial Sequence: Synthetic oligonucleotide
  Target: ATXN1; (+) strand; PAM type: YTN; PAM sequence: CTT
ttttttttttgcaatgatct

SEQ ID NO: 260503 - DNA, 20 bp, Artificial Sequence
  Description of Artificial Sequence: Synthetic oligonucleotide
  Target: ATXN1; (+) strand; PAM type: YTN; PAM sequence: TTT
tttttttttgcaatgatcta

SEQ ID NO: 260504 - DNA, 20 bp, Artificial Sequence
  Description of Artificial Sequence: Synthetic oligonucleotide
  Target: ATXN1; (+) strand; PAM type: YTN; PAM sequence: TTT
ttttttttgcaatgatctag

SEQ ID NO: 260505 - DNA, 20 bp, Artificial Sequence
  Description of Artificial Sequence: Synthetic oligonucleotide
  Target: ATXN1; (+) strand; PAM type: YTN; PAM sequence: TTT
tttttttgcaatgatctaga

SEQ ID NO: 260506 - DNA, 20 bp, Artificial Sequence
  Description of Artificial Sequence: Synthetic oligonucleotide
  Target: ATXN1; (+) strand; PAM type: YTN; PAM sequence: TTT
ttttttgcaatgatctagaa

SEQ ID NO: 260507 - DNA, 20 bp, Artificial Sequence
  Description of Artificial Sequence: Synthetic oligonucleotide
  Target: ATXN1; (+) strand; PAM type: YTN; PAM sequence: TTT
tttttgcaatgatctagaag

SEQ ID NO: 260508 - DNA, 20 bp, Artificial Sequence
  Description of Artificial Sequence: Synthetic oligonucleotide
  Target: ATXN1; (+) strand; PAM type: YTN; PAM sequence: TTT
ttttgcaatgatctagaaga

SEQ ID NO: 260509 - DNA, 20 bp, Artificial Sequence
  Description of Artificial Sequence: Synthetic oligonucleotide
  Target: ATXN1; (+) strand; PAM type: YTN; PAM sequence: TTT
tttgcaatgatctagaagaa

SEQ ID NO: 260510 - DNA, 20 bp, Artificial Sequence
  Description of Artificial Sequence: Synthetic oligonucleotide
  Target: ATXN1; (+) strand; PAM type: YTN; PAM sequence: TTT
ttgcaatgatctagaagaag

SEQ ID NO: 260511 - DNA, 20 bp, Artificial Sequence
  Description of Artificial Sequence: Synthetic oligonucleotide
  Target: ATXN1; (+) strand; PAM type: YTN; PAM sequence: TTT
tgcaatgatctagaagaagc

SEQ ID NO: 260512 - DNA, 20 bp, Artificial Sequence
  Description of Artificial Sequence: Synthetic oligonucleotide
  Target: ATXN1; (+) strand; PAM type: YTN; PAM sequence: TTT
gcaatgatctagaagaagca

SEQ ID NO: 260513 - DNA, 20 bp, Artificial Sequence
  Description of Artificial Sequence: Synthetic oligonucleotide
  Target: ATXN1; (+) strand; PAM type: YTN; PAM sequence: TTG
caatgatctagaagaagcag

SEQ ID NO: 260514 - DNA, 20 bp, Artificial Sequence
  Description of Artificial Sequence: Synthetic oligonucleotide
  Target: ATXN1; (+) strand; PAM type: YTN; PAM sequence: CTA
gaagaagcagagacatttgc

SEQ ID NO: 260515 - DNA, 20 bp, Artificial Sequence
  Description of Artificial Sequence: Synthetic oligonucleotide
  Target: ATXN1; (+) strand; PAM type: YTN; PAM sequence: TTT
gcttataaactatgaagggc

SEQ ID NO: 260516 - DNA, 20 bp, Artificial Sequence
  Description of Artificial Sequence: Synthetic oligonucleotide
  Target: ATXN1; (+) strand; PAM type: YTN; PAM sequence: TTG
cttataaactatgaagggct

SEQ ID NO: 260517 - DNA, 20 bp, Artificial Sequence
  Description of Artificial Sequence: Synthetic oligonucleotide
  Target: ATXN1; (+) strand; PAM type: YTN; PAM sequence: CTT
ataaactatgaagggcttga

SEQ ID NO: 260518 - DNA, 20 bp, Artificial Sequence
  Description of Artificial Sequence: Synthetic oligonucleotide
  Target: ATXN1; (+) strand; PAM type: YTN; PAM sequence: TTA
taaactatgaagggcttgaa

SEQ ID NO: 260519 - DNA, 20 bp, Artificial Sequence
  Description of Artificial Sequence: Synthetic oligonucleotide
  Target: ATXN1; (+) strand; PAM type: YTN; PAM sequence: CTA
tgaagggcttgaacccagcc

SEQ ID NO: 260520 - DNA, 20 bp, Artificial Sequence
  Description of Artificial Sequence: Synthetic oligonucleotide
  Target: ATXN1; (+) strand; PAM type: YTN; PAM sequence: CTT
gaacccagccactgagtaca

SEQ ID NO: 260521 - DNA, 20 bp, Artificial Sequence
  Description of Artificial Sequence: Synthetic oligonucleotide
  Target: ATXN1; (+) strand; PAM type: YTN; PAM sequence: TTG
aacccagccactgagtacac

SEQ ID NO: 260522 - DNA, 20 bp, Artificial Sequence
  Description of Artificial Sequence: Synthetic oligonucleotide
  Target: ATXN1; (+) strand; PAM type: YTN; PAM sequence: CTG
agtacacattttactcacaa

SEQ ID NO: 260523 - DNA, 20 bp, Artificial Sequence
  Description of Artificial Sequence: Synthetic oligonucleotide
  Target: ATXN1; (+) strand; PAM type: YTN; PAM sequence: TTT
tactcacaatgaaatctgca

SEQ ID NO: 260524 - DNA, 20 bp, Artificial Sequence
  Description of Artificial Sequence: Synthetic oligonucleotide
  Target: ATXN1; (+) strand; PAM type: YTN; PAM sequence: TTT
actcacaatgaaatctgcat

SEQ ID NO: 260525 - DNA, 20 bp, Artificial Sequence
  Description of Artificial Sequence: Synthetic oligonucleotide
  Target: ATXN1; (+) strand; PAM type: YTN; PAM sequence: TTA
ctcacaatgaaatctgcatg

SEQ ID NO: 260526 - DNA, 20 bp, Artificial Sequence
  Description of Artificial Sequence: Synthetic oligonucleotide
  Target: ATXN1; (+) strand; PAM type: YTN; PAM sequence: CTC
acaatgaaatctgcatggaa

SEQ ID NO: 260527 - DNA, 20 bp, Artificial Sequence
  Description of Artificial Sequence: Synthetic oligonucleotide
  Target: ATXN1; (+) strand; PAM type: YTN; PAM sequence: CTG
catggaagcctgccaatgtc

SEQ ID NO: 260528 - DNA, 20 bp, Artificial Sequence
  Description of Artificial Sequence: Synthetic oligonucleotide
  Target: ATXN1; (+) strand; PAM type: YTN; PAM sequence: CTG
ccaatgtctgggctgacatt

SEQ ID NO: 260529 - DNA, 20 bp, Artificial Sequence
  Description of Artificial Sequence: Synthetic oligonucleotide
  Target: ATXN1; (+) strand; PAM type: YTN; PAM sequence: CTG
ggctgacattcaaacattcc

SEQ ID NO: 260530 - DNA, 20 bp, Artificial Sequence
  Description of Artificial Sequence: Synthetic oligonucleotide
  Target: ATXN1; (+) strand; PAM type: YTN; PAM sequence: CTG
acattcaaacattccaagtt

SEQ ID NO: 260531 - DNA, 20 bp, Artificial Sequence
  Description of Artificial Sequence: Synthetic oligonucleotide
  Target: ATXN1; (+) strand; PAM type: YTN; PAM sequence: TTC
aaacattccaagtttctatg

SEQ ID NO: 260532 - DNA, 20 bp, Artificial Sequence
  Description of Artificial Sequence: Synthetic oligonucleotide
  Target: ATXN1; (+) strand; PAM type: YTN; PAM sequence: TTC
caagtttctatgtatttcaa

SEQ ID NO: 260533 - DNA, 20 bp, Artificial Sequence
  Description of Artificial Sequence: Synthetic oligonucleotide
  Target: ATXN1; (+) strand; PAM type: YTN; PAM sequence: TTT
ctatgtatttcaatctctca

SEQ ID NO: 260534 - DNA, 20 bp, Artificial Sequence
  Description of Artificial Sequence: Synthetic oligonucleotide
  Target: ATXN1; (+) strand; PAM type: YTN; PAM sequence: TTC
tatgtatttcaatctctcaa

SEQ ID NO: 260535 - DNA, 20 bp, Artificial Sequence
  Description of Artificial Sequence: Synthetic oligonucleotide
  Target: ATXN1; (+) strand; PAM type: YTN; PAM sequence: CTA
tgtatttcaatctctcaaaa

SEQ ID NO: 260536 - DNA, 20 bp, Artificial Sequence
  Description of Artificial Sequence: Synthetic oligonucleotide
  Target: ATXN1; (+) strand; PAM type: YTN; PAM sequence: TTT
caatctctcaaaactaatgt

SEQ ID NO: 260537 - DNA, 20 bp, Artificial Sequence
  Description of Artificial Sequence: Synthetic oligonucleotide
  Target: ATXN1; (+) strand; PAM type: YTN; PAM sequence: TTC
aatctctcaaaactaatgtt

SEQ ID NO: 260538 - DNA, 20 bp, Artificial Sequence
  Description of Artificial Sequence: Synthetic oligonucleotide
  Target: ATXN1; (+) strand; PAM type: YTN; PAM sequence: CTC
tcaaaactaatgttttaaaa

SEQ ID NO: 260539 - DNA, 20 bp, Artificial Sequence
  Description of Artificial Sequence: Synthetic oligonucleotide
  Target: ATXN1; (+) strand; PAM type: YTN; PAM sequence: CTC
aaaactaatgttttaaaact

SEQ ID NO: 260540 - DNA, 20 bp, Artificial Sequence
  Description of Artificial Sequence: Synthetic oligonucleotide
  Target: ATXN1; (+) strand; PAM type: YTN; PAM sequence: CTA
atgttttaaaactcttgata

SEQ ID NO: 260541 - DNA, 20 bp, Artificial Sequence
  Description of Artificial Sequence: Synthetic oligonucleotide
  Target: ATXN1; (+) strand; PAM type: YTN; PAM sequence: TTT
taaaactcttgatattttct

SEQ ID NO: 260542 - DNA, 20 bp, Artificial Sequence
  Description of Artificial Sequence: Synthetic oligonucleotide
  Target: ATXN1; (+) strand; PAM type: YTN; PAM sequence: TTT
aaaactcttgatattttctg

SEQ ID NO: 260543 - DNA, 20 bp, Artificial Sequence
  Description of Artificial Sequence: Synthetic oligonucleotide
  Target: ATXN1; (+) strand; PAM type: YTN; PAM sequence: TTA
aaactcttgatattttctga

SEQ ID NO: 260544 - DNA, 20 bp, Artificial Sequence
  Description of Artificial Sequence: Synthetic oligonucleotide
  Target: ATXN1; (+) strand; PAM type: YTN; PAM sequence: CTC
ttgatattttctgaggcact

SEQ ID NO: 260545 - DNA, 20 bp, Artificial Sequence
  Description of Artificial Sequence: Synthetic oligonucleotide
  Target: ATXN1; (+) strand; PAM type: YTN; PAM sequence: CTT
gatattttctgaggcactac

SEQ ID NO: 260546 - DNA, 20 bp, Artificial Sequence
  Description of Artificial Sequence: Synthetic oligonucleotide
  Target: ATXN1; (+) strand; PAM type: YTN; PAM sequence: TTG
atattttctgaggcactaca

SEQ ID NO: 260547 - DNA, 20 bp, Artificial Sequence
  Description of Artificial Sequence: Synthetic oligonucleotide
  Target: ATXN1; (+) strand; PAM type: YTN; PAM sequence: TTT
tctgaggcactacacagttc

SEQ ID NO: 260548 - DNA, 20 bp, Artificial Sequence
  Description of Artificial Sequence: Synthetic oligonucleotide
  Target: ATXN1; (+) strand; PAM type: YTN; PAM sequence: TTT
ctgaggcactacacagttca

SEQ ID NO: 260549 - DNA, 20 bp, Artificial Sequence
  Description of Artificial Sequence: Synthetic oligonucleotide
  Target: ATXN1; (+) strand; PAM type: YTN; PAM sequence: TTC
tgaggcactacacagttcaa

SEQ ID NO: 260550 - DNA, 20 bp, Artificial Sequence
  Description of Artificial Sequence: Synthetic oligonucleotide
  Target: ATXN1; (+) strand; PAM type: YTN; PAM sequence: CTG
aggcactacacagttcaatc

SEQ ID NO: 260551 - DNA, 20 bp, Artificial Sequence
  Description of Artificial Sequence: Synthetic oligonucleotide
  Target: ATXN1; (+) strand; PAM type: YTN; PAM sequence: CTA
cacagttcaatcctcacctc

SEQ ID NO: 260552 - DNA, 20 bp, Artificial Sequence
  Description of Artificial Sequence: Synthetic oligonucleotide
  Target: ATXN1; (+) strand; PAM type: YTN; PAM sequence: TTC
aatcctcacctctcagttca

SEQ ID NO: 260553 - DNA, 20 bp, Artificial Sequence
  Description of Artificial Sequence: Synthetic oligonucleotide
  Target: ATXN1; (+) strand; PAM type: YTN; PAM sequence: CTC
acctctcagttcagagtgaa

SEQ ID NO: 260554 - DNA, 20 bp, Artificial Sequence
  Description of Artificial Sequence: Synthetic oligonucleotide
  Target: ATXN1; (+) strand; PAM type: YTN; PAM sequence: CTC
tcagttcagagtgaatatac

SEQ ID NO: 260555 - DNA, 20 bp, Artificial Sequence
  Description of Artificial Sequence: Synthetic oligonucleotide
  Target: ATXN1; (+) strand; PAM type: YTN; PAM sequence: CTC
agttcagagtgaatatacag

SEQ ID NO: 260556 - DNA, 20 bp, Artificial Sequence
  Description of Artificial Sequence: Synthetic oligonucleotide
  Target: ATXN1; (+) strand; PAM type: YTN; PAM sequence: TTC
agagtgaatatacagcaata

SEQ ID NO: 260557 - DNA, 20 bp, Artificial Sequence
  Description of Artificial Sequence: Synthetic oligonucleotide
  Target: ATXN1; (+) strand; PAM type: YTN; PAM sequence: TTC
tgcttgaaagaagtgcaaag

SEQ ID NO: 260558 - DNA, 20 bp, Artificial Sequence
  Description of Artificial Sequence: Synthetic oligonucleotide
  Target: ATXN1; (+) strand; PAM type: YTN; PAM sequence: CTG
cttgaaagaagtgcaaagaa

SEQ ID NO: 260559 - DNA, 20 bp, Artificial Sequence
  Description of Artificial Sequence: Synthetic oligonucleotide
  Target: ATXN1; (+) strand; PAM type: YTN; PAM sequence: CTT
gaaagaagtgcaaagaaggt

SEQ ID NO: 260560 - DNA, 20 bp, Artificial Sequence
  Description of Artificial Sequence: Synthetic oligonucleotide
  Target: ATXN1; (+) strand; PAM type: YTN; PAM sequence: TTG
aaagaagtgcaaagaaggtc

SEQ ID NO: 260561 - DNA, 20 bp, Artificial Sequence
  Description of Artificial Sequence: Synthetic oligonucleotide
  Target: ATXN1; (+) strand; PAM type: YTN; PAM sequence: CTT
ttgctgtgcagcatgtagct

SEQ ID NO: 260562 - DNA, 20 bp, Artificial Sequence
  Description of Artificial Sequence: Synthetic oligonucleotide
  Target: ATXN1; (+) strand; PAM type: YTN; PAM sequence: TTT
tgctgtgcagcatgtagctc

SEQ ID NO: 260563 - DNA, 20 bp, Artificial Sequence
  Description of Artificial Sequence: Synthetic oligonucleotide
  Target: ATXN1; (+) strand; PAM type: YTN; PAM sequence: TTT
gctgtgcagcatgtagctcg

SEQ ID NO: 260564 - DNA, 20 bp, Artificial Sequence
  Description of Artificial Sequence: Synthetic oligonucleotide
  Target: ATXN1; (+) strand; PAM type: YTN; PAM sequence: TTG
ctgtgcagcatgtagctcga

SEQ ID NO: 260565 - DNA, 20 bp, Artificial Sequence
  Description of Artificial Sequence: Synthetic oligonucleotide
  Target: ATXN1; (+) strand; PAM type: YTN; PAM sequence: CTG
tgcagcatgtagctcgatct

SEQ ID NO: 260566 - DNA, 20 bp, Artificial Sequence
  Description of Artificial Sequence: Synthetic oligonucleotide
  Target: ATXN1; (+) strand; PAM type: YTN; PAM sequence: CTC
gatctaccgcaacaatacaa

SEQ ID NO: 260567 - DNA, 20 bp, Artificial Sequence
  Description of Artificial Sequence: Synthetic oligonucleotide
  Target: ATXN1; (+) strand; PAM type: YTN; PAM sequence: CTA
ccgcaacaatacaatgaata

SEQ ID NO: 260568 - DNA, 20 bp, Artificial Sequence
  Description of Artificial Sequence: Synthetic oligonucleotide
  Target: ATXN1; (+) strand; PAM type: YTN; PAM sequence: TTA
tgggttttgtattattattt

SEQ ID NO: 260569 - DNA, 20 bp, Artificial Sequence
  Description of Artificial Sequence: Synthetic oligonucleotide
  Target: ATXN1; (+) strand; PAM type: YTN; PAM sequence: TTT
tgtattattattttcctttg

SEQ ID NO: 260570 - DNA, 20 bp, Artificial Sequence
  Description of Artificial Sequence: Synthetic oligonucleotide
  Target: ATXN1; (+) strand; PAM type: YTN; PAM sequence: TTT
gtattattattttcctttgt

SEQ ID NO: 260571 - DNA, 20 bp, Artificial Sequence
  Description of Artificial Sequence: Synthetic oligonucleotide
  Target: ATXN1; (+) strand; PAM type: YTN; PAM sequence: TTG
tattattattttcctttgtg

SEQ ID NO: 260572 - DNA, 20 bp, Artificial Sequence
  Description of Artificial Sequence: Synthetic oligonucleotide
  Target: ATXN1; (+) strand; PAM type: YTN; PAM sequence: TTA
ttattttcctttgtgcatca

SEQ ID NO: 260573 - DNA, 20 bp, Artificial Sequence
  Description of Artificial Sequence: Synthetic oligonucleotide
  Target: ATXN1; (+) strand; PAM type: YTN; PAM sequence: TTA
ttttcctttgtgcatcagat

SEQ ID NO: 260574 - DNA, 20 bp, Artificial Sequence
  Description of Artificial Sequence: Synthetic oligonucleotide
  Target: ATXN1; (+) strand; PAM type: YTN; PAM sequence: TTT
tcctttgtgcatcagatcta

SEQ ID NO: 260575 - DNA, 20 bp, Artificial Sequence
  Description of Artificial Sequence: Synthetic oligonucleotide
  Target: ATXN1; (+) strand; PAM type: YTN; PAM sequence: TTT
cctttgtgcatcagatctag

SEQ ID NO: 260576 - DNA, 20 bp, Artificial Sequence
  Description of Artificial Sequence: Synthetic oligonucleotide
  Target: ATXN1; (+) strand; PAM type: YTN; PAM sequence: TTC
ctttgtgcatcagatctaga

SEQ ID NO: 260577 - DNA, 20 bp, Artificial Sequence
  Description of Artificial Sequence: Synthetic oligonucleotide
  Target: ATXN1; (+) strand; PAM type: YTN; PAM sequence: CTT
tgtgcatcagatctagaaac

SEQ ID NO: 260578 - DNA, 20 bp, Artificial Sequence
  Description of Artificial Sequence: Synthetic oligonucleotide
  Target: ATXN1; (+) strand; PAM type: YTN; PAM sequence: TTT
gtgcatcagatctagaaaca

SEQ ID NO: 260579 - DNA, 20 bp, Artificial Sequence
  Description of Artificial Sequence: Synthetic oligonucleotide
  Target: ATXN1; (+) strand; PAM type: YTN; PAM sequence: TTG
tgcatcagatctagaaacag

SEQ ID NO: 260580 - DNA, 20 bp, Artificial Sequence
  Description of Artificial Sequence: Synthetic oligonucleotide
  Target: ATXN1; (+) strand; PAM type: YTN; PAM sequence: CTA
gaaacagggtgagaaaagaa

SEQ ID NO: 260581 - DNA, 20 bp, Artificial Sequence
  Description of Artificial Sequence: Synthetic oligonucleotide
  Target: ATXN1; (+) strand; PAM type: YTN; PAM sequence: TTG
aagaaatcttttaaaaatct

SEQ ID NO: 260582 - DNA, 20 bp, Artificial Sequence
  Description of Artificial Sequence: Synthetic oligonucleotide
  Target: ATXN1; (+) strand; PAM type: YTN; PAM sequence: CTT
ttaaaaatctataaatattt

SEQ ID NO: 260583 - DNA, 20 bp, Artificial Sequence
  Description of Artificial Sequence: Synthetic oligonucleotide
  Target: ATXN1; (+) strand; PAM type: YTN; PAM sequence: TTT
taaaaatctataaatattta

SEQ ID NO: 260584 - DNA, 20 bp, Artificial Sequence
  Description of Artificial Sequence: Synthetic oligonucleotide
  Target: ATXN1; (+) strand; PAM type: YTN; PAM sequence: TTT
aaaaatctataaatatttaa

SEQ ID NO: 260585 - DNA, 20 bp, Artificial Sequence
  Description of Artificial Sequence: Synthetic oligonucleotide
  Target: ATXN1; (+) strand; PAM type: YTN; PAM sequence: TTA
aaaatctataaatatttaaa

SEQ ID NO: 260586 - DNA, 20 bp, Artificial Sequence
  Description of Artificial Sequence: Synthetic oligonucleotide
  Target: ATXN1; (+) strand; PAM type: YTN; PAM sequence: CTA
taaatatttaaatattagtt

SEQ ID NO: 260587 - DNA, 20 bp, Artificial Sequence
  Description of Artificial Sequence: Synthetic oligonucleotide
  Target: ATXN1; (+) strand; PAM type: YTN; PAM sequence: TTT
aaatattagttacatagtag

SEQ ID NO: 260588 - DNA, 20 bp, Artificial Sequence
  Description of Artificial Sequence: Synthetic oligonucleotide
  Target: ATXN1; (+) strand; PAM type: YTN; PAM sequence: TTA
aatattagttacatagtaga

SEQ ID NO: 260589 - DNA, 20 bp, Artificial Sequence
  Description of Artificial Sequence: Synthetic oligonucleotide
  Target: ATXN1; (+) strand; PAM type: YTN; PAM sequence: TTA
gttacatagtagacaatgtc

SEQ ID NO: 260590 - DNA, 20 bp, Artificial Sequence
  Description of Artificial Sequence: Synthetic oligonucleotide
  Target: ATXN1; (+) strand; PAM type: YTN; PAM sequence: TTA
catagtagacaatgtcctat

SEQ ID NO: 260591 - DNA, 20 bp, Artificial Sequence
  Description of Artificial Sequence: Synthetic oligonucleotide
  Target: ATXN1; (+) strand; PAM type: YTN; PAM sequence: CTA
tagccatgctttatggaata

SEQ ID NO: 260592 - DNA, 20 bp, Artificial Sequence
  Description of Artificial Sequence: Synthetic oligonucleotide
  Target: ATXN1; (+) strand; PAM type: YTN; PAM sequence: CTT
tatggaataaagcatagaat

SEQ ID NO: 260593 - DNA, 20 bp, Artificial Sequence
  Description of Artificial Sequence: Synthetic oligonucleotide
  Target: ATXN1; (+) strand; PAM type: YTN; PAM sequence: TTT
atggaataaagcatagaatc

SEQ ID NO: 260594 - DNA, 20 bp, Artificial Sequence
  Description of Artificial Sequence: Synthetic oligonucleotide
  Target: ATXN1; (+) strand; PAM type: YTN; PAM sequence: TTA
tggaataaagcatagaatct

SEQ ID NO: 260595 - DNA, 20 bp, Artificial Sequence
  Description of Artificial Sequence: Synthetic oligonucleotide
  Target: ATXN1; (+) strand; PAM type: YTN; PAM sequence: CTT
ttgcatttcatgtggcatct

SEQ ID NO: 260596 - DNA, 20 bp, Artificial Sequence
  Description of Artificial Sequence: Synthetic oligonucleotide
  Target: ATXN1; (+) strand; PAM type: YTN; PAM sequence: TTT
tgcatttcatgtggcatctg

SEQ ID NO: 260597 - DNA, 20 bp, Artificial Sequence
  Description of Artificial Sequence: Synthetic oligonucleotide
  Target: ATXN1; (+) strand; PAM type: YTN; PAM sequence: TTT
gcatttcatgtggcatctga

SEQ ID NO: 260598 - DNA, 20 bp, Artificial Sequence
  Description of Artificial Sequence: Synthetic oligonucleotide
  Target: ATXN1; (+) strand; PAM type: YTN; PAM sequence: TTG
catttcatgtggcatctgag

SEQ ID NO: 260599 - DNA, 20 bp, Artificial Sequence
  Description of Artificial Sequence: Synthetic oligonucleotide
  Target: ATXN1; (+) strand; PAM type: YTN; PAM sequence: TTT
catgtggcatctgagtacat

SEQ ID NO: 260600 - DNA, 20 bp, Artificial Sequence
  Description of Artificial Sequence: Synthetic oligonucleotide
  Target: ATXN1; (+) strand; PAM type: YTN; PAM sequence: TTC
atgtggcatctgagtacatt

SEQ ID NO: 260601 - DNA, 20 bp, Artificial Sequence
  Description of Artificial Sequence: Synthetic oligonucleotide
  Target: ATXN1; (+) strand; PAM type: YTN; PAM sequence: CTG
agtacattatctactgctac

SEQ ID NO: 260602 - DNA, 20 bp, Artificial Sequence
  Description of Artificial Sequence: Synthetic oligonucleotide
  Target: ATXN1; (+) strand; PAM type: YTN; PAM sequence: TTA
tctactgctactagttatta

SEQ ID NO: 260603 - DNA, 20 bp, Artificial Sequence
  Description of Artificial Sequence: Synthetic oligonucleotide
  Target: ATXN1; (+) strand; PAM type: YTN; PAM sequence: CTA
ctgctactagttattagttc

SEQ ID NO: 260604 - DNA, 20 bp, Artificial Sequence
  Description of Artificial Sequence: Synthetic oligonucleotide
  Target: ATXN1; (+) strand; PAM type: YTN; PAM sequence: CTG
ctactagttattagttcaca

SEQ ID NO: 260605 - DNA, 20 bp, Artificial Sequence
  Description of Artificial Sequence: Synthetic oligonucleotide
  Target: ATXN1; (+) strand; PAM type: YTN; PAM sequence: CTA
ctagttattagttcacagct

SEQ ID NO: 260606 - DNA, 20 bp, Artificial Sequence
  Description of Artificial Sequence: Synthetic oligonucleotide
  Target: ATXN1; (+) strand; PAM type: YTN; PAM sequence: CTA
gttattagttcacagctctg

SEQ ID NO: 260607 - DNA, 20 bp, Artificial Sequence
  Description of Artificial Sequence: Synthetic oligonucleotide
  Target: ATXN1; (+) strand; PAM type: YTN; PAM sequence: TTA
ttagttcacagctctgccaa

SEQ ID NO: 260608 - DNA, 20 bp, Artificial Sequence
  Description of Artificial Sequence: Synthetic oligonucleotide
  Target: ATXN1; (+) strand; PAM type: YTN; PAM sequence: TTA
gttcacagctctgccaagag

SEQ ID NO: 260609 - DNA, 20 bp, Artificial Sequence
  Description of Artificial Sequence: Synthetic oligonucleotide
  Target: ATXN1; (+) strand; PAM type: YTN; PAM sequence: TTC
acagctctgccaagaggtaa

SEQ ID NO: 260610 - DNA, 20 bp, Artificial Sequence
  Description of Artificial Sequence: Synthetic oligonucleotide
  Target: ATXN1; (+) strand; PAM type: YTN; PAM sequence: CTC
tgccaagaggtaattggtga

SEQ ID NO: 260611 - DNA, 20 bp, Artificial Sequence
  Description of Artificial Sequence: Synthetic oligonucleotide
  Target: ATXN1; (+) strand; PAM type: YTN; PAM sequence: CTG
ccaagaggtaattggtgatc

SEQ ID NO: 260612 - DNA, 20 bp, Artificial Sequence
  Description of Artificial Sequence: Synthetic oligonucleotide
  Target: ATXN1; (+) strand; PAM type: YTN; PAM sequence: TTG
gtgatccacaccttctgaat

SEQ ID NO: 260613 - DNA, 20 bp, Artificial Sequence
  Description of Artificial Sequence: Synthetic oligonucleotide
  Target: ATXN1; (+) strand; PAM type: YTN; PAM sequence: CTT
ctgaatacttctttttggga

SEQ ID NO: 260614 - DNA, 20 bp, Artificial Sequence
  Description of Artificial Sequence: Synthetic oligonucleotide
  Target: ATXN1; (+) strand; PAM type: YTN; PAM sequence: TTC
tgaatacttctttttgggaa

SEQ ID NO: 260615 - DNA, 20 bp, Artificial Sequence
  Description of Artificial Sequence: Synthetic oligonucleotide
  Target: ATXN1; (+) strand; PAM type: YTN; PAM sequence: CTG
aatacttctttttgggaact

SEQ ID NO: 260616 - DNA, 20 bp, Artificial Sequence
  Description of Artificial Sequence: Synthetic oligonucleotide
  Target: ATXN1; (+) strand; PAM type: YTN; PAM sequence: CTT
ctttttgggaactttagcac

SEQ ID NO: 260617 - DNA, 20 bp, Artificial Sequence
  Description of Artificial Sequence: Synthetic oligonucleotide
  Target: ATXN1; (+) strand; PAM type: YTN; PAM sequence: TTC
tttttgggaactttagcaca

SEQ ID NO: 260618 - DNA, 20 bp, Artificial Sequence
  Description of Artificial Sequence: Synthetic oligonucleotide
  Target: ATXN1; (+) strand; PAM type: YTN; PAM sequence: CTT
tttgggaactttagcacaat

SEQ ID NO: 260619 - DNA, 20 bp, Artificial Sequence
  Description of Artificial Sequence: Synthetic oligonucleotide
  Target: ATXN1; (+) strand; PAM type: YTN; PAM sequence: TTT
ttgggaactttagcacaatt

SEQ ID NO: 260620 - DNA, 20 bp, Artificial Sequence
  Description of Artificial Sequence: Synthetic oligonucleotide
  Target: ATXN1; (+) strand; PAM type: YTN; PAM sequence: TTT
tgggaactttagcacaatta

SEQ ID NO: 260621 - DNA, 20 bp, Artificial Sequence
  Description of Artificial Sequence: Synthetic oligonucleotide
  Target: ATXN1; (+) strand; PAM type: YTN; PAM sequence: TTT
gggaactttagcacaattag

SEQ ID NO: 260622 - DNA, 20 bp, Artificial Sequence
  Description of Artificial Sequence: Synthetic oligonucleotide
  Target: ATXN1; (+) strand; PAM type: YTN; PAM sequence: TTG
ggaactttagcacaattagc

SEQ ID NO: 260623 - DNA, 20 bp, Artificial Sequence
  Description of Artificial Sequence: Synthetic oligonucleotide
  Target: ATXN1; (+) strand; PAM type: YTN; PAM sequence: CTT
tagcacaattagctgatacc

SEQ ID NO: 260624 - DNA, 20 bp, Artificial Sequence
  Description of Artificial Sequence: Synthetic oligonucleotide
  Target: ATXN1; (+) strand; PAM type: YTN; PAM sequence: TTT
agcacaattagctgatacct

SEQ ID NO: 260625 - DNA, 20 bp, Artificial Sequence
  Description of Artificial Sequence: Synthetic oligonucleotide
  Target: ATXN1; (+) strand; PAM type: YTN; PAM sequence: TTA
gcacaattagctgatacctc

SEQ ID NO: 260626 - DNA, 20 bp, Artificial Sequence
  Description of Artificial Sequence: Synthetic oligonucleotide
  Target: ATXN1; (+) strand; PAM type: YTN; PAM sequence: TTA
gctgatacctcaaatttcac

SEQ ID NO: 260627 - DNA, 20 bp, Artificial Sequence
  Description of Artificial Sequence: Synthetic oligonucleotide
  Target: ATXN1; (+) strand; PAM type: YTN; PAM sequence: CTG
atacctcaaatttcacctgg

SEQ ID NO: 260628 - DNA, 20 bp, Artificial Sequence
  Description of Artificial Sequence: Synthetic oligonucleotide
  Target: ATXN1; (+) strand; PAM type: YTN; PAM sequence: CTC
aaatttcacctggaccgcaa

SEQ ID NO: 260629 - DNA, 20 bp, Artificial Sequence
  Description of Artificial Sequence: Synthetic oligonucleotide
  Target: ATXN1; (+) strand; PAM type: YTN; PAM sequence: TTT
cacctggaccgcaacagaaa

SEQ ID NO: 260630 - DNA, 20 bp, Artificial Sequence
  Description of Artificial Sequence: Synthetic oligonucleotide
  Target: ATXN1; (+) strand; PAM type: YTN; PAM sequence: TTC
acctggaccgcaacagaaac

SEQ ID NO: 260631 - DNA, 20 bp, Artificial Sequence
  Description of Artificial Sequence: Synthetic oligonucleotide
  Target: ATXN1; (+) strand; PAM type: YTN; PAM sequence: CTG
gaccgcaacagaaacagctg

SEQ ID NO: 260632 - DNA, 20 bp, Artificial Sequence
  Description of Artificial Sequence: Synthetic oligonucleotide
  Target: ATXN1; (+) strand; PAM type: YTN; PAM sequence: CTG
ttcaacattaaattaaattt

SEQ ID NO: 260633 - DNA, 20 bp, Artificial Sequence
  Description of Artificial Sequence: Synthetic oligonucleotide
  Target: ATXN1; (+) strand; PAM type: YTN; PAM sequence: TTC
aacattaaattaaattttat

SEQ ID NO: 260634 - DNA, 20 bp, Artificial Sequence
  Description of Artificial Sequence: Synthetic oligonucleotide
  Target: ATXN1; (+) strand; PAM type: YTN; PAM sequence: TTA
aattaaattttatagttgtt

SEQ ID NO: 260635 - DNA, 20 bp, Artificial Sequence
  Description of Artificial Sequence: Synthetic oligonucleotide
  Target: ATXN1; (+) strand; PAM type: YTN; PAM sequence: TTA
aattttatagttgttggctt

SEQ ID NO: 260636 - DNA, 20 bp, Artificial Sequence
  Description of Artificial Sequence: Synthetic oligonucleotide
  Target: ATXN1; (+) strand; PAM type: YTN; PAM sequence: TTT
tatagttgttggctttaagg

SEQ ID NO: 260637 - DNA, 20 bp, Artificial Sequence
  Description of Artificial Sequence: Synthetic oligonucleotide
  Target: ATXN1; (+) strand; PAM type: YTN; PAM sequence: TTT
atagttgttggctttaagga

SEQ ID NO: 260638 - DNA, 20 bp, Artificial Sequence
  Description of Artificial Sequence: Synthetic oligonucleotide
  Target: ATXN1; (+) strand; PAM type: YTN; PAM sequence: TTA
tagttgttggctttaaggag

SEQ ID NO: 260639 - DNA, 20 bp, Artificial Sequence
  Description of Artificial Sequence: Synthetic oligonucleotide
  Target: ATXN1; (+) strand; PAM type: YTN; PAM sequence: TTG
ttggctttaaggaggataag

SEQ ID NO: 260640 - DNA, 20 bp, Artificial Sequence
  Description of Artificial Sequence: Synthetic oligonucleotide
  Target: ATXN1; (+) strand; PAM type: YTN; PAM sequence: TTG
gctttaaggaggataagaag

SEQ ID NO: 260641 - DNA, 20 bp, Artificial Sequence
  Description of Artificial Sequence: Synthetic oligonucleotide
  Target: ATXN1; (+) strand; PAM type: YTN; PAM sequence: CTT
taaggaggataagaagaact

SEQ ID NO: 260642 - DNA, 20 bp, Artificial Sequence
  Description of Artificial Sequence: Synthetic oligonucleotide
  Target: ATXN1; (+) strand; PAM type: YTN; PAM sequence: TTT
aaggaggataagaagaactg

SEQ ID NO: 260643 - DNA, 20 bp, Artificial Sequence
  Description of Artificial Sequence: Synthetic oligonucleotide
  Target: ATXN1; (+) strand; PAM type: YTN; PAM sequence: TTA
aggaggataagaagaactga

SEQ ID NO: 260644 - DNA, 20 bp, Artificial Sequence
  Description of Artificial Sequence: Synthetic oligonucleotide
  Target: ATXN1; (+) strand; PAM type: YTN; PAM sequence: CTG
agtgctccaaggagatttta

SEQ ID NO: 260645 - DNA, 20 bp, Artificial Sequence
  Description of Artificial Sequence: Synthetic oligonucleotide
  Target: ATXN1; (+) strand; PAM type: YTN; PAM sequence: CTC
caaggagattttagaggtgg

SEQ ID NO: 260646 - DNA, 20 bp, Artificial Sequence
  Description of Artificial Sequence: Synthetic oligonucleotide
  Target: ATXN1; (+) strand; PAM type: YTN; PAM sequence: TTT
tagaggtgggcaaaaaacag

SEQ ID NO: 260647 - DNA, 20 bp, Artificial Sequence
  Description of Artificial Sequence: Synthetic oligonucleotide
  Target: ATXN1; (+) strand; PAM type: YTN; PAM sequence: TTT
agaggtgggcaaaaaacagc

SEQ ID NO: 260648 - DNA, 20 bp, Artificial Sequence
  Description of Artificial Sequence: Synthetic oligonucleotide
  Target: ATXN1; (+) strand; PAM type: YTN; PAM sequence: TTA
gaggtgggcaaaaaacagca

SEQ ID NO: 260649 - DNA, 20 bp, Artificial Sequence
  Description of Artificial Sequence: Synthetic oligonucleotide
  Target: ATXN1; (+) strand; PAM type: YTN; PAM sequence: CTG
cccctacaagcaaagagaga

SEQ ID NO: 260650 - DNA, 20 bp, Artificial Sequence
  Description of Artificial Sequence: Synthetic oligonucleotide
  Target: ATXN1; (+) strand; PAM type: YTN; PAM sequence: CTA
caagcaaagagagatgtccc

SEQ ID NO: 260651 - DNA, 20 bp, Artificial Sequence
  Description of Artificial Sequence: Synthetic oligonucleotide
  Target: ATXN1; (+) strand; PAM type: YTN; PAM sequence: CTC
ctggttaagcacccctttgt

SEQ ID NO: 260652 - DNA, 20 bp, Artificial Sequence
  Description of Artificial Sequence: Synthetic oligonucleotide
  Target: ATXN1; (+) strand; PAM type: YTN; PAM sequence: CTG
gttaagcacccctttgtcac

SEQ ID NO: 260653 - DNA, 20 bp, Artificial Sequence
  Description of Artificial Sequence: Synthetic oligonucleotide
  Target: ATXN1; (+) strand; PAM type: YTN; PAM sequence: TTA
agcacccctttgtcacgtgc

SEQ ID NO: 260654 - DNA, 20 bp, Artificial Sequence
  Description of Artificial Sequence: Synthetic oligonucleotide
  Target: ATXN1; (+) strand; PAM type: YTN; PAM sequence: CTT
tgtcacgtgcagcccagagg

SEQ ID NO: 260655 - DNA, 20 bp, Artificial Sequence
  Description of Artificial Sequence: Synthetic oligonucleotide
  Target: ATXN1; (+) strand; PAM type: YTN; PAM sequence: TTT
gtcacgtgcagcccagagga

SEQ ID NO: 260656 - DNA, 20 bp, Artificial Sequence
  Description of Artificial Sequence: Synthetic oligonucleotide
  Target: ATXN1; (+) strand; PAM type: YTN; PAM sequence: TTG
tcacgtgcagcccagaggaa

SEQ ID NO: 260657 - DNA, 20 bp, Artificial Sequence
  Description of Artificial Sequence: Synthetic oligonucleotide
  Target: ATXN1; (+) strand; PAM type: YTN; PAM sequence: TTG
tgataaagcatcatttgaaa

SEQ ID NO: 260658 - DNA, 20 bp, Artificial Sequence
  Description of Artificial Sequence: Synthetic oligonucleotide
  Target: ATXN1; (+) strand; PAM type: YTN; PAM sequence: TTT
gaaagttttaatgccgttgg

SEQ ID NO: 260659 - DNA, 20 bp, Artificial Sequence
  Description of Artificial Sequence: Synthetic oligonucleotide
  Target: ATXN1; (+) strand; PAM type: YTN; PAM sequence: TTG
aaagttttaatgccgttggg

SEQ ID NO: 260660 - DNA, 20 bp, Artificial Sequence
  Description of Artificial Sequence: Synthetic oligonucleotide
  Target: ATXN1; (+) strand; PAM type: YTN; PAM sequence: TTT
taatgccgttggggctacaa

SEQ ID NO: 260661 - DNA, 20 bp, Artificial Sequence
  Description of Artificial Sequence: Synthetic oligonucleotide
  Target: ATXN1; (+) strand; PAM type: YTN; PAM sequence: TTT
aatgccgttggggctacaag

SEQ ID NO: 260662 - DNA, 20 bp, Artificial Sequence
  Description of Artificial Sequence: Synthetic oligonucleotide
  Target: ATXN1; (+) strand; PAM type: YTN; PAM sequence: TTA
atgccgttggggctacaagc

SEQ ID NO: 260663 - DNA, 20 bp, Artificial Sequence
  Description of Artificial Sequence: Synthetic oligonucleotide
  Target: ATXN1; (+) strand; PAM type: YTN; PAM sequence: TTG
gggctacaagcacattgtct

SEQ ID NO: 260664 - DNA, 20 bp, Artificial Sequence
  Description of Artificial Sequence: Synthetic oligonucleotide
  Target: ATXN1; (+) strand; PAM type: YTN; PAM sequence: CTA
caagcacattgtcttgatgg

SEQ ID NO: 260665 - DNA, 20 bp, Artificial Sequence
  Description of Artificial Sequence: Synthetic oligonucleotide
  Target: ATXN1; (+) strand; PAM type: YTN; PAM sequence: TTG
tcttgatggaattcagctgt

SEQ ID NO: 260666 - DNA, 20 bp, Artificial Sequence
  Description of Artificial Sequence: Synthetic oligonucleotide
  Target: ATXN1; (+) strand; PAM type: YTN; PAM sequence: CTT
gatggaattcagctgtacag

SEQ ID NO: 260667 - DNA, 20 bp, Artificial Sequence
  Description of Artificial Sequence: Synthetic oligonucleotide
  Target: ATXN1; (+) strand; PAM type: YTN; PAM sequence: TTG
atggaattcagctgtacagc

SEQ ID NO: 260668 - DNA, 20 bp, Artificial Sequence
  Description of Artificial Sequence: Synthetic oligonucleotide
  Target: ATXN1; (+) strand; PAM type: YTN; PAM sequence: TTC
agctgtacagctccttactg

SEQ ID NO: 260669 - DNA, 20 bp, Artificial Sequence
  Description of Artificial Sequence: Synthetic oligonucleotide
  Target: ATXN1; (+) strand; PAM type: YTN; PAM sequence: CTG
tacagctccttactgtcaaa

SEQ ID NO: 260670 - DNA, 20 bp, Artificial Sequence
  Description of Artificial Sequence: Synthetic oligonucleotide
  Target: ATXN1; (+) strand; PAM type: YTN; PAM sequence: CTC
cttactgtcaaatacgatcc

SEQ ID NO: 260671 - DNA, 20 bp, Artificial Sequence
  Description of Artificial Sequence: Synthetic oligonucleotide
  Target: ATXN1; (+) strand; PAM type: YTN; PAM sequence: CTT
actgtcaaatacgatccatt

SEQ ID NO: 260672 - DNA, 20 bp, Artificial Sequence
  Description of Artificial Sequence: Synthetic oligonucleotide
  Target: ATXN1; (+) strand; PAM type: YTN; PAM sequence: TTA
ctgtcaaatacgatccattc

SEQ ID NO: 260673 - DNA, 20 bp, Artificial Sequence
  Description of Artificial Sequence: Synthetic oligonucleotide
  Target: ATXN1; (+) strand; PAM type: YTN; PAM sequence: CTG
tcaaatacgatccattctgt

SEQ ID NO: 260674 - DNA, 20 bp, Artificial Sequence
  Description of Artificial Sequence: Synthetic oligonucleotide
  Target: ATXN1; (+) strand; PAM type: YTN; PAM sequence: TTC
tgttttaaattcctttaact

SEQ ID NO: 260675 - DNA, 20 bp, Artificial Sequence
  Description of Artificial Sequence: Synthetic oligonucleotide
  Target: ATXN1; (+) strand; PAM type: YTN; PAM sequence: CTG
ttttaaattcctttaactgt

SEQ ID NO: 260676 - DNA, 20 bp, Artificial Sequence
  Description of Artificial Sequence: Synthetic oligonucleotide
  Target: ATXN1; (+) strand; PAM type: YTN; PAM sequence: TTT
taaattcctttaactgtgac

SEQ ID NO: 260677 - DNA, 20 bp, Artificial Sequence
  Description of Artificial Sequence: Synthetic oligonucleotide
  Target: ATXN1; (+) strand; PAM type: YTN; PAM sequence: TTT
aaattcctttaactgtgaca

SEQ ID NO: 260678 - DNA, 20 bp, Artificial Sequence
  Description of Artificial Sequence: Synthetic oligonucleotide
  Target: ATXN1; (+) strand; PAM type: YTN; PAM sequence: TTA
aattcctttaactgtgacag

SEQ ID NO: 260679 - DNA, 20 bp, Artificial Sequence
  Description of Artificial Sequence: Synthetic oligonucleotide
  Target: ATXN1; (+) strand; PAM type: YTN; PAM sequence: TTC
ctttaactgtgacaggcagc

SEQ ID NO: 260680 - DNA, 20 bp, Artificial Sequence
  Description of Artificial Sequence: Synthetic oligonucleotide
  Target: ATXN1; (+) strand; PAM type: YTN; PAM sequence: CTT
taactgtgacaggcagcatg

SEQ ID NO: 260681 - DNA, 20 bp, Artificial Sequence
  Description of Artificial Sequence: Synthetic oligonucleotide
  Target: ATXN1; (+) strand; PAM type: YTN; PAM sequence: TTT
aactgtgacaggcagcatga

SEQ ID NO: 260682 - DNA, 20 bp, Artificial Sequence
  Description of Artificial Sequence: Synthetic oligonucleotide
  Target: ATXN1; (+) strand; PAM type: YTN; PAM sequence: TTA
actgtgacaggcagcatgat

SEQ ID NO: 260683 - DNA, 20 bp, Artificial Sequence
  Description of Artificial Sequence: Synthetic oligonucleotide
  Target: ATXN1; (+) strand; PAM type: YTN; PAM sequence: CTG
tgacaggcagcatgatgaaa

SEQ ID NO: 260684 - DNA, 20 bp, Artificial Sequence
  Description of Artificial Sequence: Synthetic oligonucleotide
  Target: ATXN1; (+) strand; PAM type: YTN; PAM sequence: TTA
agtgcatgaaacagaacaaa

SEQ ID NO: 260685 - DNA, 20 bp, Artificial Sequence
  Description of Artificial Sequence: Synthetic oligonucleotide
  Target: ATXN1; (+) strand; PAM type: YTN; PAM sequence: CTC
aaaggaaggccagaaatagt

SEQ ID NO: 260686 - DNA, 20 bp, Artificial Sequence
  Description of Artificial Sequence: Synthetic oligonucleotide
  Target: ATXN1; (+) strand; PAM type: YTN; PAM sequence: CTG
cagacctgggtctcagcagc

SEQ ID NO: 260687 - DNA, 20 bp, Artificial Sequence
  Description of Artificial Sequence: Synthetic oligonucleotide
  Target: ATXN1; (+) strand; PAM type: YTN; PAM sequence: CTG
ggtctcagcagctccgccca

SEQ ID NO: 260688 - DNA, 20 bp, Artificial Sequence
  Description of Artificial Sequence: Synthetic oligonucleotide
  Target: ATXN1; (+) strand; PAM type: YTN; PAM sequence: CTC
agcagctccgcccaggagtt

SEQ ID NO: 260689 - DNA, 20 bp, Artificial Sequence
  Description of Artificial Sequence: Synthetic oligonucleotide
  Target: ATXN1; (+) strand; PAM type: YTN; PAM sequence: CTC
cgcccaggagttcctgccgg

SEQ ID NO: 260690 - DNA, 20 bp, Artificial Sequence
  Description of Artificial Sequence: Synthetic oligonucleotide
  Target: ATXN1; (+) strand; PAM type: YTN; PAM sequence: TTC
ctgccggagctcaggcgagc

SEQ ID NO: 260691 - DNA, 20 bp, Artificial Sequence
  Description of Artificial Sequence: Synthetic oligonucleotide
  Target: ATXN1; (+) strand; PAM type: YTN; PAM sequence: CTG
ccggagctcaggcgagccac

SEQ ID NO: 260692 - DNA, 20 bp, Artificial Sequence
  Description of Artificial Sequence: Synthetic oligonucleotide
  Target: ATXN1; (+) strand; PAM type: YTN; PAM sequence: CTC
aggcgagccacggatcggct

SEQ ID NO: 260693 - DNA, 20 bp, Artificial Sequence
  Description of Artificial Sequence: Synthetic oligonucleotide
  Target: ATXN1; (+) strand; PAM type: YTN; PAM sequence: CTC
tgtgccgctacctcctcacc

SEQ ID NO: 260694 - DNA, 20 bp, Artificial Sequence
  Description of Artificial Sequence: Synthetic oligonucleotide
  Target: ATXN1; (+) strand; PAM type: YTN; PAM sequence: CTG
tgccgctacctcctcacctg

SEQ ID NO: 260695 - DNA, 20 bp, Artificial Sequence
  Description of Artificial Sequence: Synthetic oligonucleotide
  Target: ATXN1; (+) strand; PAM type: YTN; PAM sequence: CTA
cctcctcacctgccaaacga

SEQ ID NO: 260696 - DNA, 20 bp, Artificial Sequence
  Description of Artificial Sequence: Synthetic oligonucleotide
  Target: ATXN1; (+) strand; PAM type: YTN; PAM sequence: CTC
ctcacctgccaaacgagggt

SEQ ID NO: 260697 - DNA, 20 bp, Artificial Sequence
  Description of Artificial Sequence: Synthetic oligonucleotide
  Target: ATXN1; (+) strand; PAM type: YTN; PAM sequence: CTC
acctgccaaacgagggtcac

SEQ ID NO: 260698 - DNA, 20 bp, Artificial Sequence
  Description of Artificial Sequence: Synthetic oligonucleotide
  Target: ATXN1; (+) strand; PAM type: YTN; PAM sequence: CTG
ccaaacgagggtcacgacgc

SEQ ID NO: 260699 - DNA, 20 bp, Artificial Sequence
  Description of Artificial Sequence: Synthetic oligonucleotide
  Target: ATXN1; (+) strand; PAM type: YTN; PAM sequence: CTC
taacctcagagaatttttgt

SEQ ID NO: 260700 - DNA, 20 bp, Artificial Sequence
  Description of Artificial Sequence: Synthetic oligonucleotide
  Target: ATXN1; (+) strand; PAM type: YTN; PAM sequence: CTA
acctcagagaatttttgtga

SEQ ID NO: 260701 - DNA, 20 bp, Artificial Sequence
  Description of Artificial Sequence: Synthetic oligonucleotide
  Target: ATXN1; (+) strand; PAM type: YTN; PAM sequence: CTC
agagaatttttgtgaaattg

SEQ ID NO: 260702 - DNA, 20 bp, Artificial Sequence
  Description of Artificial Sequence: Synthetic oligonucleotide
  Target: ATXN1; (+) strand; PAM type: YTN; PAM sequence: TTT
ttgtgaaattgagaaactta

SEQ ID NO: 260703 - DNA, 20 bp, Artificial Sequence
  Description of Artificial Sequence: Synthetic oligonucleotide
  Target: ATXN1; (+) strand; PAM type: YTN; PAM sequence: TTT
tgtgaaattgagaaacttac

SEQ ID NO: 260704 - DNA, 20 bp, Artificial Sequence
  Description of Artificial Sequence: Synthetic oligonucleotide
  Target: ATXN1; (+) strand; PAM type: YTN; PAM sequence: TTT
gtgaaattgagaaacttaca

SEQ ID NO: 260705 - DNA, 20 bp, Artificial Sequence
  Description of Artificial Sequence: Synthetic oligonucleotide
  Target: ATXN1; (+) strand; PAM type: YTN; PAM sequence: TTG
tgaaattgagaaacttacaa

SEQ ID NO: 260706 - DNA, 20 bp, Artificial Sequence
  Description of Artificial Sequence: Synthetic oligonucleotide
  Target: ATXN1; (+) strand; PAM type: YTN; PAM sequence: TTG
agaaacttacaacaagcact

SEQ ID NO: 260707 - DNA, 20 bp, Artificial Sequence
  Description of Artificial Sequence: Synthetic oligonucleotide
  Target: ATXN1; (+) strand; PAM type: YTN; PAM sequence: CTT
acaacaagcactcagcaaac

SEQ ID NO: 260708 - DNA, 20 bp, Artificial Sequence
  Description of Artificial Sequence: Synthetic oligonucleotide
  Target: ATXN1; (+) strand; PAM type: YTN; PAM sequence: TTA
caacaagcactcagcaaaca

SEQ ID NO: 260709 - DNA, 20 bp, Artificial Sequence
  Description of Artificial Sequence: Synthetic oligonucleotide
  Target: ATXN1; (+) strand; PAM type: YTN; PAM sequence: CTC
agcaaacatggatgccaaac

SEQ ID NO: 260710 - DNA, 20 bp, Artificial Sequence
  Description of Artificial Sequence: Synthetic oligonucleotide
  Target: ATXN1; (+) strand; PAM type: YTN; PAM sequence: CTA
ttatctcataattcaatgtg

SEQ ID NO: 260711 - DNA, 20 bp, Artificial Sequence
  Description of Artificial Sequence: Synthetic oligonucleotide
  Target: ATXN1; (+) strand; PAM type: YTN; PAM sequence: TTA
tctcataattcaatgtgccc

SEQ ID NO: 260712 - DNA, 20 bp, Artificial Sequence
  Description of Artificial Sequence: Synthetic oligonucleotide
  Target: ATXN1; (+) strand; PAM type: YTN; PAM sequence: CTC
ataattcaatgtgcccaaat

SEQ ID NO: 260713 - DNA, 20 bp, Artificial Sequence
  Description of Artificial Sequence: Synthetic oligonucleotide
  Target: ATXN1; (+) strand; PAM type: YTN; PAM sequence: TTC
aatgtgcccaaatcagactg

SEQ ID NO: 260714 - DNA, 20 bp, Artificial Sequence
  Description of Artificial Sequence: Synthetic oligonucleotide
  Target: ATXN1; (+) strand; PAM type: YTN; PAM sequence: CTG
aaacaagtaaaaccccaaat

SEQ ID NO: 260715 - DNA, 20 bp, Artificial Sequence
  Description of Artificial Sequence: Synthetic oligonucleotide
  Target: ATXN1; (+) strand; PAM type: YTN; PAM sequence: TTA
atttgacaccatatgctatg

SEQ ID NO: 260716 - DNA, 20 bp, Artificial Sequence
  Description of Artificial Sequence: Synthetic oligonucleotide
  Target: ATXN1; (+) strand; PAM type: YTN; PAM sequence: TTT
gacaccatatgctatgggtt

SEQ ID NO: 260717 - DNA, 20 bp, Artificial Sequence
  Description of Artificial Sequence: Synthetic oligonucleotide
  Target: ATXN1; (+) strand; PAM type: YTN; PAM sequence: TTG
acaccatatgctatgggtta

SEQ ID NO: 260718 - DNA, 20 bp, Artificial Sequence
  Description of Artificial Sequence: Synthetic oligonucleotide
  Target: ATXN1; (+) strand; PAM type: YTN; PAM sequence: CTA
tgggttacattttccaaaag

SEQ ID NO: 260719 - DNA, 20 bp, Artificial Sequence
  Description of Artificial Sequence: Synthetic oligonucleotide
  Target: ATXN1; (+) strand; PAM type: YTN; PAM sequence: TTA
cattttccaaaagccttcgg

SEQ ID NO: 260720 - DNA, 20 bp, Artificial Sequence
  Description of Artificial Sequence: Synthetic oligonucleotide
  Target: ATXN1; (+) strand; PAM type: YTN; PAM sequence: TTT
tccaaaagccttcggaaatt

SEQ ID NO: 260721 - DNA, 20 bp, Artificial Sequence
  Description of Artificial Sequence: Synthetic oligonucleotide
  Target: ATXN1; (+) strand; PAM type: YTN; PAM sequence: TTT
ccaaaagccttcggaaattg

SEQ ID NO: 260722 - DNA, 20 bp, Artificial Sequence
  Description of Artificial Sequence: Synthetic oligonucleotide
  Target: ATXN1; (+) strand; PAM type: YTN; PAM sequence: TTC
caaaagccttcggaaattgg

SEQ ID NO: 260723 - DNA, 20 bp, Artificial Sequence
  Description of Artificial Sequence: Synthetic oligonucleotide
  Target: ATXN1; (+) strand; PAM type: YTN; PAM sequence: CTT
cggaaattggcatttataat

SEQ ID NO: 260724 - DNA, 20 bp, Artificial Sequence
  Description of Artificial Sequence: Synthetic oligonucleotide
  Target: ATXN1; (+) strand; PAM type: YTN; PAM sequence: TTC
ggaaattggcatttataata

SEQ ID NO: 260725 - DNA, 20 bp, Artificial Sequence
  Description of Artificial Sequence: Synthetic oligonucleotide
  Target: ATXN1; (+) strand; PAM type: YTN; PAM sequence: TTG
gcatttataatatttgtggg

SEQ ID NO: 260726 - DNA, 20 bp, Artificial Sequence
  Description of Artificial Sequence: Synthetic oligonucleotide
  Target: ATXN1; (+) strand; PAM type: YTN; PAM sequence: TTT
ataatatttgtgggttcatc

SEQ ID NO: 260727 - DNA, 20 bp, Artificial Sequence
  Description of Artificial Sequence: Synthetic oligonucleotide
  Target: ATXN1; (+) strand; PAM type: YTN; PAM sequence: TTA
taatatttgtgggttcatcc

SEQ ID NO: 260728 - DNA, 20 bp, Artificial Sequence
  Description of Artificial Sequence: Synthetic oligonucleotide
  Target: ATXN1; (+) strand; PAM type: YTN; PAM sequence: TTT
gtgggttcatccttctccat

SEQ ID NO: 260729 - DNA, 20 bp, Artificial Sequence
  Description of Artificial Sequence: Synthetic oligonucleotide
  Target: ATXN1; (+) strand; PAM type: YTN; PAM sequence: TTG
tgggttcatccttctccatg

SEQ ID NO: 260730 - DNA, 20 bp, Artificial Sequence
  Description of Artificial Sequence: Synthetic oligonucleotide
  Target: ATXN1; (+) strand; PAM type: YTN; PAM sequence: TTC
atccttctccatgtacagaa

SEQ ID NO: 260731 - DNA, 20 bp, Artificial Sequence
  Description of Artificial Sequence: Synthetic oligonucleotide
  Target: ATXN1; (+) strand; PAM type: YTN; PAM sequence: CTT
ctccatgtacagaaacatgt

SEQ ID NO: 260732 - DNA, 20 bp, Artificial Sequence
  Description of Artificial Sequence: Synthetic oligonucleotide
  Target: ATXN1; (+) strand; PAM type: YTN; PAM sequence: TTC
tccatgtacagaaacatgtg

SEQ ID NO: 260733 - DNA, 20 bp, Artificial Sequence
  Description of Artificial Sequence: Synthetic oligonucleotide
  Target: ATXN1; (+) strand; PAM type: YTN; PAM sequence: CTC
catgtacagaaacatgtgca

SEQ ID NO: 260734 - DNA, 20 bp, Artificial Sequence
  Description of Artificial Sequence: Synthetic oligonucleotide
  Target: ATXN1; (+) strand; PAM type: YTN; PAM sequence: TTA
agtcttaattatctagtgga

SEQ ID NO: 260735 - DNA, 20 bp, Artificial Sequence
  Description of Artificial Sequence: Synthetic oligonucleotide
  Target: ATXN1; (+) strand; PAM type: YTN; PAM sequence: CTT
aattatctagtggaagatta

SEQ ID NO: 260736 - DNA, 20 bp, Artificial Sequence
  Description of Artificial Sequence: Synthetic oligonucleotide
  Target: ATXN1; (+) strand; PAM type: YTN; PAM sequence: TTA
attatctagtggaagattat

SEQ ID NO: 260737 - DNA, 20 bp, Artificial Sequence
  Description of Artificial Sequence: Synthetic oligonucleotide
  Target: ATXN1; (+) strand; PAM type: YTN; PAM sequence: TTA
tctagtggaagattatccaa

SEQ ID NO: 260738 - DNA, 20 bp, Artificial Sequence
  Description of Artificial Sequence: Synthetic oligonucleotide
  Target: ATXN1; (+) strand; PAM type: YTN; PAM sequence: CTA
gtggaagattatccaagatt

SEQ ID NO: 260739 - DNA, 20 bp, Artificial Sequence
  Description of Artificial Sequence: Synthetic oligonucleotide
  Target: ATXN1; (+) strand; PAM type: YTN; PAM sequence: TTA
tccaagattcttactgtttc

SEQ ID NO: 260740 - DNA, 20 bp, Artificial Sequence
  Description of Artificial Sequence: Synthetic oligonucleotide
  Target: ATXN1; (+) strand; PAM type: YTN; PAM sequence: TTC
ttactgtttctcccttttcc

SEQ ID NO: 260741 - DNA, 20 bp, Artificial Sequence
  Description of Artificial Sequence: Synthetic oligonucleotide
  Target: ATXN1; (+) strand; PAM type: YTN; PAM sequence: CTT
actgtttctcccttttcctg

SEQ ID NO: 260742 - DNA, 20 bp, Artificial Sequence
  Description of Artificial Sequence: Synthetic oligonucleotide
  Target: ATXN1; (+) strand; PAM type: YTN; PAM sequence: TTA
ctgtttctcccttttcctgt

SEQ ID NO: 260743 - DNA, 20 bp, Artificial Sequence
  Description of Artificial Sequence: Synthetic oligonucleotide
  Target: ATXN1; (+) strand; PAM type: YTN; PAM sequence: CTG
tttctcccttttcctgttgc

SEQ ID NO: 260744 - DNA, 20 bp, Artificial Sequence
  Description of Artificial Sequence: Synthetic oligonucleotide
  Target: ATXN1; (+) strand; PAM type: YTN; PAM sequence: TTT
ctcccttttcctgttgccca

SEQ ID NO: 260745 - DNA, 20 bp, Artificial Sequence
  Description of Artificial Sequence: Synthetic oligonucleotide
  Target: ATXN1; (+) strand; PAM type: YTN; PAM sequence: TTC
tcccttttcctgttgcccat

SEQ ID NO: 260746 - DNA, 20 bp, Artificial Sequence
  Description of Artificial Sequence: Synthetic oligonucleotide
  Target: ATXN1; (+) strand; PAM type: YTN; PAM sequence: CTC
ccttttcctgttgcccattt

SEQ ID NO: 260747 - DNA, 20 bp, Artificial Sequence
  Description of Artificial Sequence: Synthetic oligonucleotide
  Target: ATXN1; (+) strand; PAM type: YTN; PAM sequence: CTT
ttcctgttgcccatttttag

SEQ ID NO: 260748 - DNA, 20 bp, Artificial Sequence
  Description of Artificial Sequence: Synthetic oligonucleotide
  Target: ATXN1; (+) strand; PAM type: YTN; PAM sequence: TTT
tcctgttgcccatttttagc

SEQ ID NO: 260749 - DNA, 20 bp, Artificial Sequence
  Description of Artificial Sequence: Synthetic oligonucleotide
  Target: ATXN1; (+) strand; PAM type: YTN; PAM sequence: TTT
cctgttgcccatttttagcc

SEQ ID NO: 260750 - DNA, 20 bp, Artificial Sequence
  Description of Artificial Sequence: Synthetic oligonucleotide
  Target: ATXN1; (+) strand; PAM type: YTN; PAM sequence: TTC
ctgttgcccatttttagcct

SEQ ID NO: 260751 - DNA, 20 bp, Artificial Sequence
  Description of Artificial Sequence: Synthetic oligonucleotide
  Target: ATXN1; (+) strand; PAM type: YTN; PAM sequence: CTG
ttgcccatttttagcctttt

SEQ ID NO: 260752 - DNA, 20 bp, Artificial Sequence
  Description of Artificial Sequence: Synthetic oligonucleotide
  Target: ATXN1; (+) strand; PAM type: YTN; PAM sequence: TTG
cccatttttagccttttttg

SEQ ID NO: 260753 - DNA, 20 bp, Artificial Sequence
  Description of Artificial Sequence: Synthetic oligonucleotide
  Target: ATXN1; (+) strand; PAM type: YTN; PAM sequence: TTT
ttagccttttttggcaattc

SEQ ID NO: 260754 - DNA, 20 bp, Artificial Sequence
  Description of Artificial Sequence: Synthetic oligonucleotide
  Target: ATXN1; (+) strand; PAM type: YTN; PAM sequence: TTT
tagccttttttggcaattcc

SEQ ID NO: 260755 - DNA, 20 bp, Artificial Sequence
  Description of Artificial Sequence: Synthetic oligonucleotide
  Target: ATXN1; (+) strand; PAM type: YTN; PAM sequence: TTT
agccttttttggcaattcct

SEQ ID NO: 260756 - DNA, 20 bp, Artificial Sequence
  Description of Artificial Sequence: Synthetic oligonucleotide
  Target: ATXN1; (+) strand; PAM type: YTN; PAM sequence: TTA
gccttttttggcaattcctc

SEQ ID NO: 260757 - DNA, 20 bp, Artificial Sequence
  Description of Artificial Sequence: Synthetic oligonucleotide
  Target: ATXN1; (+) strand; PAM type: YTN; PAM sequence: CTT
ttttggcaattcctccacta

SEQ ID NO: 260758 - DNA, 20 bp, Artificial Sequence
  Description of Artificial Sequence: Synthetic oligonucleotide
  Target: ATXN1; (+) strand; PAM type: YTN; PAM sequence: TTT
tttggcaattcctccactat

SEQ ID NO: 260759 - DNA, 20 bp, Artificial Sequence
  Description of Artificial Sequence: Synthetic oligonucleotide
  Target: ATXN1; (+) strand; PAM type: YTN; PAM sequence: TTT
ttggcaattcctccactatt

SEQ ID NO: 260760 - DNA, 20 bp, Artificial Sequence
  Description of Artificial Sequence: Synthetic oligonucleotide
  Target: ATXN1; (+) strand; PAM type: YTN; PAM sequence: TTT
tggcaattcctccactatta

SEQ ID NO: 260761 - DNA, 20 bp, Artificial Sequence
  Description of Artificial Sequence: Synthetic oligonucleotide
  Target: ATXN1; (+) strand; PAM type: YTN; PAM sequence: TTT
ggcaattcctccactattaa

SEQ ID NO: 260762 - DNA, 20 bp, Artificial Sequence
  Description of Artificial Sequence: Synthetic oligonucleotide
  Target: ATXN1; (+) strand; PAM type: YTN; PAM sequence: TTG
gcaattcctccactattaaa

SEQ ID NO: 260763 - DNA, 20 bp, Artificial Sequence
  Description of Artificial Sequence: Synthetic oligonucleotide
  Target: ATXN1; (+) strand; PAM type: YTN; PAM sequence: TTC
ctccactattaaagaaaaga

SEQ ID NO: 260764 - DNA, 20 bp, Artificial Sequence
  Description of Artificial Sequence: Synthetic oligonucleotide
  Target: ATXN1; (+) strand; PAM type: YTN; PAM sequence: CTC
cactattaaagaaaagagat

SEQ ID NO: 260765 - DNA, 20 bp, Artificial Sequence
  Description of Artificial Sequence: Synthetic oligonucleotide
  Target: ATXN1; (+) strand; PAM type: YTN; PAM sequence: CTA
ttaaagaaaagagatggcat

SEQ ID NO: 260766 - DNA, 20 bp, Artificial Sequence
  Description of Artificial Sequence: Synthetic oligonucleotide
  Target: ATXN1; (+) strand; PAM type: YTN; PAM sequence: TTA
aagaaaagagatggcatgca

SEQ ID NO: 260767 - DNA, 20 bp, Artificial Sequence
  Description of Artificial Sequence: Synthetic oligonucleotide
  Target: ATXN1; (+) strand; PAM type: YTN; PAM sequence: CTT
tccttcttcactgtaatttc

SEQ ID NO: 260768 - DNA, 20 bp, Artificial Sequence
  Description of Artificial Sequence: Synthetic oligonucleotide
  Target: ATXN1; (+) strand; PAM type: YTN; PAM sequence: TTT
ccttcttcactgtaatttca

SEQ ID NO: 260769 - DNA, 20 bp, Artificial Sequence
  Description of Artificial Sequence: Synthetic oligonucleotide
  Target: ATXN1; (+) strand; PAM type: YTN; PAM sequence: TTC
cttcttcactgtaatttcaa

SEQ ID NO: 260770 - DNA, 20 bp, Artificial Sequence
  Description of Artificial Sequence: Synthetic oligonucleotide
  Target: ATXN1; (+) strand; PAM type: YTN; PAM sequence: CTT
cttcactgtaatttcaatta

SEQ ID NO: 260771 - DNA, 20 bp, Artificial Sequence
  Description of Artificial Sequence: Synthetic oligonucleotide
  Target: ATXN1; (+) strand; PAM type: YTN; PAM sequence: TTC
ttcactgtaatttcaattat

SEQ ID NO: 260772 - DNA, 20 bp, Artificial Sequence
  Description of Artificial Sequence: Synthetic oligonucleotide
  Target: ATXN1; (+) strand; PAM type: YTN; PAM sequence: CTT
cactgtaatttcaattatct

SEQ ID NO: 260773 - DNA, 20 bp, Artificial Sequence
  Description of Artificial Sequence: Synthetic oligonucleotide
  Target: ATXN1; (+) strand; PAM type: YTN; PAM sequence: TTC
actgtaatttcaattatctg

SEQ ID NO: 260774 - DNA, 20 bp, Artificial Sequence
  Description of Artificial Sequence: Synthetic oligonucleotide
  Target: ATXN1; (+) strand; PAM type: YTN; PAM sequence: CTG
taatttcaattatctgtgct

SEQ ID NO: 260775 - DNA, 20 bp, Artificial Sequence
  Description of Artificial Sequence: Synthetic oligonucleotide
  Target: ATXN1; (+) strand; PAM type: YTN; PAM sequence: TTT
caattatctgtgctacctca

SEQ ID NO: 260776 - DNA, 20 bp, Artificial Sequence
  Description of Artificial Sequence: Synthetic oligonucleotide
  Target: ATXN1; (+) strand; PAM type: YTN; PAM sequence: TTC
aattatctgtgctacctcag

SEQ ID NO: 260777 - DNA, 20 bp, Artificial Sequence
  Description of Artificial Sequence: Synthetic oligonucleotide
  Target: ATXN1; (+) strand; PAM type: YTN; PAM sequence: TTA
tctgtgctacctcagcctcc

SEQ ID NO: 260778 - DNA, 20 bp, Artificial Sequence
  Description of Artificial Sequence: Synthetic oligonucleotide
  Target: ATXN1; (+) strand; PAM type: YTN; PAM sequence: CTG
tgctacctcagcctccgttg

SEQ ID NO: 260779 - DNA, 20 bp, Artificial Sequence
  Description of Artificial Sequence: Synthetic oligonucleotide
  Target: ATXN1; (+) strand; PAM type: YTN; PAM sequence: CTA
cctcagcctccgttggcatg

SEQ ID NO: 260780 - DNA, 20 bp, Artificial Sequence
  Description of Artificial Sequence: Synthetic oligonucleotide
  Target: ATXN1; (+) strand; PAM type: YTN; PAM sequence: CTC
agcctccgttggcatggatg

SEQ ID NO: 260781 - DNA, 20 bp, Artificial Sequence
  Description of Artificial Sequence: Synthetic oligonucleotide
  Target: ATXN1; (+) strand; PAM type: YTN; PAM sequence: CTC
cgttggcatggatgggcgag

SEQ ID NO: 260782 - DNA, 20 bp, Artificial Sequence
  Description of Artificial Sequence: Synthetic oligonucleotide
  Target: ATXN1; (+) strand; PAM type: YTN; PAM sequence: TTG
gcatggatgggcgaggaggt

SEQ ID NO: 260783 - DNA, 20 bp, Artificial Sequence
  Description of Artificial Sequence: Synthetic oligonucleotide
  Target: ATXN1; (+) strand; PAM type: YTN; PAM sequence: CTA
tctttgtcctcagaattgga

SEQ ID NO: 260784 - DNA, 20 bp, Artificial Sequence
  Description of Artificial Sequence: Synthetic oligonucleotide
  Target: ATXN1; (+) strand; PAM type: YTN; PAM sequence: CTT
tgtcctcagaattggatgga

SEQ ID NO: 260785 - DNA, 20 bp, Artificial Sequence
  Description of Artificial Sequence: Synthetic oligonucleotide
  Target: ATXN1; (+) strand; PAM type: YTN; PAM sequence: TTT
gtcctcagaattggatggaa

SEQ ID NO: 260786 - DNA, 20 bp, Artificial Sequence
  Description of Artificial Sequence: Synthetic oligonucleotide
  Target: ATXN1; (+) strand; PAM type: YTN; PAM sequence: TTG
tcctcagaattggatggaaa

SEQ ID NO: 260787 - DNA, 20 bp, Artificial Sequence
  Description of Artificial Sequence: Synthetic oligonucleotide
  Target: ATXN1; (+) strand; PAM type: YTN; PAM sequence: CTC
agaattggatggaaaacatt

SEQ ID NO: 260788 - DNA, 20 bp, Artificial Sequence
  Description of Artificial Sequence: Synthetic oligonucleotide
  Target: ATXN1; (+) strand; PAM type: YTN; PAM sequence: TTG
gatggaaaacattcatctgt

SEQ ID NO: 260789 - DNA, 20 bp, Artificial Sequence
  Description of Artificial Sequence: Synthetic oligonucleotide
  Target: ATXN1; (+) strand; PAM type: YTN; PAM sequence: TTC
atctgtgttattgggaaatg

SEQ ID NO: 260790 - DNA, 20 bp, Artificial Sequence
  Description of Artificial Sequence: Synthetic oligonucleotide
  Target: ATXN1; (+) strand; PAM type: YTN; PAM sequence: CTG
tgttattgggaaatgatgtg

SEQ ID NO: 260791 - DNA, 20 bp, Artificial Sequence
  Description of Artificial Sequence: Synthetic oligonucleotide
  Target: ATXN1; (+) strand; PAM type: YTN; PAM sequence: TTA
ttgggaaatgatgtgaactt

SEQ ID NO: 260792 - DNA, 20 bp, Artificial Sequence
  Description of Artificial Sequence: Synthetic oligonucleotide
  Target: ATXN1; (+) strand; PAM type: YTN; PAM sequence: TTG
ggaaatgatgtgaacttaat

SEQ ID NO: 260793 - DNA, 20 bp, Artificial Sequence
  Description of Artificial Sequence: Synthetic oligonucleotide
  Target: ATXN1; (+) strand; PAM type: YTN; PAM sequence: CTT
aatttctctttcccttctaa

SEQ ID NO: 260794 - DNA, 20 bp, Artificial Sequence
  Description of Artificial Sequence: Synthetic oligonucleotide
  Target: ATXN1; (+) strand; PAM type: YTN; PAM sequence: TTA
atttctctttcccttctaaa

SEQ ID NO: 260795 - DNA, 20 bp, Artificial Sequence
  Description of Artificial Sequence: Synthetic oligonucleotide
  Target: ATXN1; (+) strand; PAM type: YTN; PAM sequence: TTT
ctctttcccttctaaaactt

SEQ ID NO: 260796 - DNA, 20 bp, Artificial Sequence
  Description of Artificial Sequence: Synthetic oligonucleotide
  Target: ATXN1; (+) strand; PAM type: YTN; PAM sequence: TTC
tctttcccttctaaaacttt

SEQ ID NO: 260797 - DNA, 20 bp, Artificial Sequence
  Description of Artificial Sequence: Synthetic oligonucleotide
  Target: ATXN1; (+) strand; PAM type: YTN; PAM sequence: CTC
tttcccttctaaaactttgc

SEQ ID NO: 260798 - DNA, 20 bp, Artificial Sequence
  Description of Artificial Sequence: Synthetic oligonucleotide
  Target: ATXN1; (+) strand; PAM type: YTN; PAM sequence: CTT
tcccttctaaaactttgctt

SEQ ID NO: 260799 - DNA, 20 bp, Artificial Sequence
  Description of Artificial Sequence: Synthetic oligonucleotide
  Target: ATXN1; (+) strand; PAM type: YTN; PAM sequence: TTT
cccttctaaaactttgctta

SEQ ID NO: 260800 - DNA, 20 bp, Artificial Sequence
  Description of Artificial Sequence: Synthetic oligonucleotide
  Target: ATXN1; (+) strand; PAM type: YTN; PAM sequence: TTC
ccttctaaaactttgcttac

SEQ ID NO: 260801 - DNA, 20 bp, Artificial Sequence
  Description of Artificial Sequence: Synthetic oligonucleotide
  Target: ATXN1; (+) strand; PAM type: YTN; PAM sequence: CTT
ctaaaactttgcttactgaa

SEQ ID NO: 260802 - DNA, 20 bp, Artificial Sequence
  Description of Artificial Sequence: Synthetic oligonucleotide
  Target: ATXN1; (+) strand; PAM type: YTN; PAM sequence: TTC
taaaactttgcttactgaat

SEQ ID NO: 260803 - DNA, 20 bp, Artificial Sequence
  Description of Artificial Sequence: Synthetic oligonucleotide
  Target: ATXN1; (+) strand; PAM type: YTN; PAM sequence: CTA
aaactttgcttactgaatgg

SEQ ID NO: 260804 - DNA, 20 bp, Artificial Sequence
  Description of Artificial Sequence: Synthetic oligonucleotide
  Target: ATXN1; (+) strand; PAM type: YTN; PAM sequence: CTT
tgcttactgaatggaaatgt

SEQ ID NO: 260805 - DNA, 20 bp, Artificial Sequence
  Description of Artificial Sequence: Synthetic oligonucleotide
  Target: ATXN1; (+) strand; PAM type: YTN; PAM sequence: TTT
gcttactgaatggaaatgtt

SEQ ID NO: 260806 - DNA, 20 bp, Artificial Sequence
  Description of Artificial Sequence: Synthetic oligonucleotide
  Target: ATXN1; (+) strand; PAM type: YTN; PAM sequence: TTG
cttactgaatggaaatgttc

SEQ ID NO: 260807 - DNA, 20 bp, Artificial Sequence
  Description of Artificial Sequence: Synthetic oligonucleotide
  Target: ATXN1; (+) strand; PAM type: YTN; PAM sequence: CTT
actgaatggaaatgttcctg

SEQ ID NO: 260808 - DNA, 20 bp, Artificial Sequence
  Description of Artificial Sequence: Synthetic oligonucleotide
  Target: ATXN1; (+) strand; PAM type: YTN; PAM sequence: TTA
ctgaatggaaatgttcctga

SEQ ID NO: 260809 - DNA, 20 bp, Artificial Sequence
  Description of Artificial Sequence: Synthetic oligonucleotide
  Target: ATXN1; (+) strand; PAM type: YTN; PAM sequence: CTG
aatggaaatgttcctgagat

SEQ ID NO: 260810 - DNA, 20 bp, Artificial Sequence
  Description of Artificial Sequence: Synthetic oligonucleotide
  Target: ATXN1; (+) strand; PAM type: YTN; PAM sequence: TTC
ctgagatctgtttatttggt

SEQ ID NO: 260811 - DNA, 20 bp, Artificial Sequence
  Description of Artificial Sequence: Synthetic oligonucleotide
  Target: ATXN1; (+) strand; PAM type: YTN; PAM sequence: CTG
agatctgtttatttggttct

SEQ ID NO: 260812 - DNA, 20 bp, Artificial Sequence
  Description of Artificial Sequence: Synthetic oligonucleotide
  Target: ATXN1; (+) strand; PAM type: YTN; PAM sequence: CTG
tttatttggttctatattta

SEQ ID NO: 260813 - DNA, 20 bp, Artificial Sequence
  Description of Artificial Sequence: Synthetic oligonucleotide
  Target: ATXN1; (+) strand; PAM type: YTN; PAM sequence: TTT
atttggttctatatttatgt

SEQ ID NO: 260814 - DNA, 20 bp, Artificial Sequence
  Description of Artificial Sequence: Synthetic oligonucleotide
  Target: ATXN1; (+) strand; PAM type: YTN; PAM sequence: TTA
tttggttctatatttatgta

SEQ ID NO: 260815 - DNA, 20 bp, Artificial Sequence
  Description of Artificial Sequence: Synthetic oligonucleotide
  Target: ATXN1; (+) strand; PAM type: YTN; PAM sequence: TTT
ggttctatatttatgtacct

SEQ ID NO: 260816 - DNA, 20 bp, Artificial Sequence
  Description of Artificial Sequence: Synthetic oligonucleotide
  Target: ATXN1; (+) strand; PAM type: YTN; PAM sequence: TTG
gttctatatttatgtacctc

SEQ ID NO: 260817 - DNA, 20 bp, Artificial Sequence
  Description of Artificial Sequence: Synthetic oligonucleotide
  Target: ATXN1; (+) strand; PAM type: YTN; PAM sequence: TTC
tatatttatgtacctccctt

SEQ ID NO: 260818 - DNA, 20 bp, Artificial Sequence
  Description of Artificial Sequence: Synthetic oligonucleotide
  Target: ATXN1; (+) strand; PAM type: YTN; PAM sequence: CTA
tatttatgtacctccctttt

SEQ ID NO: 260819 - DNA, 20 bp, Artificial Sequence
  Description of Artificial Sequence: Synthetic oligonucleotide
  Target: ATXN1; (+) strand; PAM type: YTN; PAM sequence: TTT
atgtacctcccttttaaaat

SEQ ID NO: 260820 - DNA, 20 bp, Artificial Sequence
  Description of Artificial Sequence: Synthetic oligonucleotide
  Target: ATXN1; (+) strand; PAM type: YTN; PAM sequence: TTA
tgtacctcccttttaaaata

SEQ ID NO: 260821 - DNA, 20 bp, Artificial Sequence
  Description of Artificial Sequence: Synthetic oligonucleotide
  Target: ATXN1; (+) strand; PAM type: YTN; PAM sequence: CTC
ccttttaaaatagagaatac

SEQ ID NO: 260822 - DNA, 20 bp, Artificial Sequence
  Description of Artificial Sequence: Synthetic oligonucleotide
  Target: ATXN1; (+) strand; PAM type: YTN; PAM sequence: CTT
ttaaaatagagaatacatgt

SEQ ID NO: 260823 - DNA, 20 bp, Artificial Sequence
  Description of Artificial Sequence: Synthetic oligonucleotide
  Target: ATXN1; (+) strand; PAM type: YTN; PAM sequence: TTT
taaaatagagaatacatgtt

SEQ ID NO: 260824 - DNA, 20 bp, Artificial Sequence
  Description of Artificial Sequence: Synthetic oligonucleotide
  Target: ATXN1; (+) strand; PAM type: YTN; PAM sequence: TTT
aaaatagagaatacatgtta

SEQ ID NO: 260825 - DNA, 20 bp, Artificial Sequence
  Description of Artificial Sequence: Synthetic oligonucleotide
  Target: ATXN1; (+) strand; PAM type: YTN; PAM sequence: TTA
aaatagagaatacatgttaa

SEQ ID NO: 260826 - DNA, 20 bp, Artificial Sequence
  Description of Artificial Sequence: Synthetic oligonucleotide
  Target: ATXN1; (+) strand; PAM type: YTN; PAM sequence: TTA
atgtttctttgatgactcag

SEQ ID NO: 260827 - DNA, 20 bp, Artificial Sequence
  Description of Artificial Sequence: Synthetic oligonucleotide
  Target: ATXN1; (+) strand; PAM type: YTN; PAM sequence: TTT
ctttgatgactcagtgtgta

SEQ ID NO: 260828 - DNA, 20 bp, Artificial Sequence
  Description of Artificial Sequence: Synthetic oligonucleotide
  Target: ATXN1; (+) strand; PAM type: YTN; PAM sequence: TTC
tttgatgactcagtgtgtat

SEQ ID NO: 260829 - DNA, 20 bp, Artificial Sequence
  Description of Artificial Sequence: Synthetic oligonucleotide
  Target: ATXN1; (+) strand; PAM type: YTN; PAM sequence: CTT
tgatgactcagtgtgtatta

SEQ ID NO: 260830 - DNA, 20 bp, Artificial Sequence
  Description of Artificial Sequence: Synthetic oligonucleotide
  Target: ATXN1; (+) strand; PAM type: YTN; PAM sequence: TTT
gatgactcagtgtgtattat

SEQ ID NO: 260831 - DNA, 20 bp, Artificial Sequence
  Description of Artificial Sequence: Synthetic oligonucleotide
  Target: ATXN1; (+) strand; PAM type: YTN; PAM sequence: TTG
atgactcagtgtgtattatc

SEQ ID NO: 260832 - DNA, 20 bp, Artificial Sequence
  Description of Artificial Sequence: Synthetic oligonucleotide
  Target: ATXN1; (+) strand; PAM type: YTN; PAM sequence: CTC
agtgtgtattatcggtaaca

SEQ ID NO: 260833 - DNA, 20 bp, Artificial Sequence
  Description of Artificial Sequence: Synthetic oligonucleotide
  Target: ATXN1; (+) strand; PAM type: YTN; PAM sequence: TTA
tcggtaacagtccattcatg

SEQ ID NO: 260834 - DNA, 20 bp, Artificial Sequence
  Description of Artificial Sequence: Synthetic oligonucleotide
  Target: ATXN1; (+) strand; PAM type: YTN; PAM sequence: TTC
atgatgttgccataccacac

SEQ ID NO: 260835 - DNA, 20 bp, Artificial Sequence
  Description of Artificial Sequence: Synthetic oligonucleotide
  Target: ATXN1; (+) strand; PAM type: YTN; PAM sequence: TTG
ccataccacacagcataatt

SEQ ID NO: 260836 - DNA, 20 bp, Artificial Sequence
  Description of Artificial Sequence: Synthetic oligonucleotide
  Target: ATXN1; (+) strand; PAM type: YTN; PAM sequence: TTT
tctatctgcttctgattgat

SEQ ID NO: 260837 - DNA, 20 bp, Artificial Sequence
  Description of Artificial Sequence: Synthetic oligonucleotide
  Target: ATXN1; (+) strand; PAM type: YTN; PAM sequence: TTT
ctatctgcttctgattgatt

SEQ ID NO: 260838 - DNA, 20 bp, Artificial Sequence
  Description of Artificial Sequence: Synthetic oligonucleotide
  Target: ATXN1; (+) strand; PAM type: YTN; PAM sequence: TTC
tatctgcttctgattgattc

SEQ ID NO: 260839 - DNA, 20 bp, Artificial Sequence
  Description of Artificial Sequence: Synthetic oligonucleotide
  Target: ATXN1; (+) strand; PAM type: YTN; PAM sequence: CTA
tctgcttctgattgattctt

SEQ ID NO: 260840 - DNA, 20 bp, Artificial Sequence
  Description of Artificial Sequence: Synthetic oligonucleotide
  Target: ATXN1; (+) strand; PAM type: YTN; PAM sequence: CTG
cttctgattgattcttcatt

SEQ ID NO: 260841 - DNA, 20 bp, Artificial Sequence
  Description of Artificial Sequence: Synthetic oligonucleotide
  Target: ATXN1; (+) strand; PAM type: YTN; PAM sequence: CTT
ctgattgattcttcattctc

SEQ ID NO: 260842 - DNA, 20 bp, Artificial Sequence
  Description of Artificial Sequence: Synthetic oligonucleotide
  Target: ATXN1; (+) strand; PAM type: YTN; PAM sequence: TTC
tgattgattcttcattctcc

SEQ ID NO: 260843 - DNA, 20 bp, Artificial Sequence
  Description of Artificial Sequence: Synthetic oligonucleotide
  Target: ATXN1; (+) strand; PAM type: YTN; PAM sequence: CTG
attgattcttcattctccct

SEQ ID NO: 260844 - DNA, 20 bp, Artificial Sequence
  Description of Artificial Sequence: Synthetic oligonucleotide
  Target: ATXN1; (+) strand; PAM type: YTN; PAM sequence: TTG
attcttcattctcccttgat

SEQ ID NO: 260845 - DNA, 20 bp, Artificial Sequence
  Description of Artificial Sequence: Synthetic oligonucleotide
  Target: ATXN1; (+) strand; PAM type: YTN; PAM sequence: TTC
ttcattctcccttgatctca

SEQ ID NO: 260846 - DNA, 20 bp, Artificial Sequence
  Description of Artificial Sequence: Synthetic oligonucleotide
  Target: ATXN1; (+) strand; PAM type: YTN; PAM sequence: CTT
cattctcccttgatctcagt

SEQ ID NO: 260847 - DNA, 20 bp, Artificial Sequence
  Description of Artificial Sequence: Synthetic oligonucleotide
  Target: ATXN1; (+) strand; PAM type: YTN; PAM sequence: TTC
attctcccttgatctcagtt

SEQ ID NO: 260848 - DNA, 20 bp, Artificial Sequence
  Description of Artificial Sequence: Synthetic oligonucleotide
  Target: ATXN1; (+) strand; PAM type: YTN; PAM sequence: TTC
tcccttgatctcagtttgtc

SEQ ID NO: 260849 - DNA, 20 bp, Artificial Sequence
  Description of Artificial Sequence: Synthetic oligonucleotide
  Target: ATXN1; (+) strand; PAM type: YTN; PAM sequence: CTC
ccttgatctcagtttgtcat

SEQ ID NO: 260850 - DNA, 20 bp, Artificial Sequence
  Description of Artificial Sequence: Synthetic oligonucleotide
  Target: ATXN1; (+) strand; PAM type: YTN; PAM sequence: CTT
gatctcagtttgtcatttaa

SEQ ID NO: 260851 - DNA, 20 bp, Artificial Sequence
  Description of Artificial Sequence: Synthetic oligonucleotide
  Target: ATXN1; (+) strand; PAM type: YTN; PAM sequence: TTG
atctcagtttgtcatttaat

SEQ ID NO: 260852 - DNA, 20 bp, Artificial Sequence
  Description of Artificial Sequence: Synthetic oligonucleotide
  Target: ATXN1; (+) strand; PAM type: YTN; PAM sequence: CTC
agtttgtcatttaatacatc

SEQ ID NO: 260853 - DNA, 20 bp, Artificial Sequence
  Description of Artificial Sequence: Synthetic oligonucleotide
  Target: ATXN1; (+) strand; PAM type: YTN; PAM sequence: TTT
gtcatttaatacatctaagt

SEQ ID NO: 260854 - DNA, 20 bp, Artificial Sequence
  Description of Artificial Sequence: Synthetic oligonucleotide
  Target: ATXN1; (+) strand; PAM type: YTN; PAM sequence: TTG
tcatttaatacatctaagtt

SEQ ID NO: 260855 - DNA, 20 bp, Artificial Sequence
  Description of Artificial Sequence: Synthetic oligonucleotide
  Target: ATXN1; (+) strand; PAM type: YTN; PAM sequence: TTT
aatacatctaagtttttcac

SEQ ID NO: 260856 - DNA, 20 bp, Artificial Sequence
  Description of Artificial Sequence: Synthetic oligonucleotide
  Target: ATXN1; (+) strand; PAM type: YTN; PAM sequence: TTA
atacatctaagtttttcact

SEQ ID NO: 260857 - DNA, 20 bp, Artificial Sequence
  Description of Artificial Sequence: Synthetic oligonucleotide
  Target: ATXN1; (+) strand; PAM type: YTN; PAM sequence: CTA
agtttttcactcaacaaatc

SEQ ID NO: 260858 - DNA, 20 bp, Artificial Sequence
  Description of Artificial Sequence: Synthetic oligonucleotide
  Target: ATXN1; (+) strand; PAM type: YTN; PAM sequence: TTT
ttcactcaacaaatcaaata

SEQ ID NO: 260859 - DNA, 20 bp, Artificial Sequence
  Description of Artificial Sequence: Synthetic oligonucleotide
  Target: ATXN1; (+) strand; PAM type: YTN; PAM sequence: TTT
tcactcaacaaatcaaatac

SEQ ID NO: 260860 - DNA, 20 bp, Artificial Sequence
  Description of Artificial Sequence: Synthetic oligonucleotide
  Target: ATXN1; (+) strand; PAM type: YTN; PAM sequence: TTT
cactcaacaaatcaaatact

SEQ ID NO: 260861 - DNA, 20 bp, Artificial Sequence
  Description of Artificial Sequence: Synthetic oligonucleotide
  Target: ATXN1; (+) strand; PAM type: YTN; PAM sequence: TTC
actcaacaaatcaaatactg

SEQ ID NO: 260862 - DNA, 20 bp, Artificial Sequence
  Description of Artificial Sequence: Synthetic oligonucleotide
  Target: ATXN1; (+) strand; PAM type: YTN; PAM sequence: CTC
aacaaatcaaatactgatgg

SEQ ID NO: 260863 - DNA, 20 bp, Artificial Sequence
  Description of Artificial Sequence: Synthetic oligonucleotide
  Target: ATXN1; (+) strand; PAM type: YTN; PAM sequence: CTG
atggagaatctgctatacac

SEQ ID NO: 260864 - DNA, 20 bp, Artificial Sequence
  Description of Artificial Sequence: Synthetic oligonucleotide
  Target: ATXN1; (+) strand; PAM type: YTN; PAM sequence: CTG
ctatacaccaggcactgtgc

SEQ ID NO: 260865 - DNA, 20 bp, Artificial Sequence
  Description of Artificial Sequence: Synthetic oligonucleotide
  Target: ATXN1; (+) strand; PAM type: YTN; PAM sequence: CTA
tacaccaggcactgtgctgc

SEQ ID NO: 260866 - DNA, 20 bp, Artificial Sequence
  Description of Artificial Sequence: Synthetic oligonucleotide
  Target: ATXN1; (+) strand; PAM type: YTN; PAM sequence: CTG
tgctgctaggagctgaggat

SEQ ID NO: 260867 - DNA, 20 bp, Artificial Sequence
  Description of Artificial Sequence: Synthetic oligonucleotide
  Target: ATXN1; (+) strand; PAM type: YTN; PAM sequence: CTG
ctaggagctgaggattgaac

SEQ ID NO: 260868 - DNA, 20 bp, Artificial Sequence
  Description of Artificial Sequence: Synthetic oligonucleotide
  Target: ATXN1; (+) strand; PAM type: YTN; PAM sequence: CTA
ggagctgaggattgaacggg

SEQ ID NO: 260869 - DNA, 20 bp, Artificial Sequence
  Description of Artificial Sequence: Synthetic oligonucleotide
  Target: ATXN1; (+) strand; PAM type: YTN; PAM sequence: CTG
aggattgaacggggagaaac

SEQ ID NO: 260870 - DNA, 20 bp, Artificial Sequence
  Description of Artificial Sequence: Synthetic oligonucleotide
  Target: ATXN1; (+) strand; PAM type: YTN; PAM sequence: TTG
aacggggagaaacaggaagc

SEQ ID NO: 260871 - DNA, 20 bp, Artificial Sequence
  Description of Artificial Sequence: Synthetic oligonucleotide
  Target: ATXN1; (+) strand; PAM type: YTN; PAM sequence: CTC
cctgctctcatagtgcttct

SEQ ID NO: 260872 - DNA, 20 bp, Artificial Sequence
  Description of Artificial Sequence: Synthetic oligonucleotide
  Target: ATXN1; (+) strand; PAM type: YTN; PAM sequence: CTG
ctctcatagtgcttcttagt

SEQ ID NO: 260873 - DNA, 20 bp, Artificial Sequence
  Description of Artificial Sequence: Synthetic oligonucleotide
  Target: ATXN1; (+) strand; PAM type: YTN; PAM sequence: CTC
tcatagtgcttcttagttgg

SEQ ID NO: 260874 - DNA, 20 bp, Artificial Sequence
  Description of Artificial Sequence: Synthetic oligonucleotide
  Target: ATXN1; (+) strand; PAM type: YTN; PAM sequence: CTC
atagtgcttcttagttgggg

SEQ ID NO: 260875 - DNA, 20 bp, Artificial Sequence
  Description of Artificial Sequence: Synthetic oligonucleotide
  Target: ATXN1; (+) strand; PAM type: YTN; PAM sequence: CTT
cttagttggggagaaaagac

SEQ ID NO: 260876 - DNA, 20 bp, Artificial Sequence
  Description of Artificial Sequence: Synthetic oligonucleotide
  Target: ATXN1; (+) strand; PAM type: YTN; PAM sequence: TTC
ttagttggggagaaaagaca

SEQ ID NO: 260877 - DNA, 20 bp, Artificial Sequence
  Description of Artificial Sequence: Synthetic oligonucleotide
  Target: ATXN1; (+) strand; PAM type: YTN; PAM sequence: CTT
agttggggagaaaagacatt

SEQ ID NO: 260878 - DNA, 20 bp, Artificial Sequence
  Description of Artificial Sequence: Synthetic oligonucleotide
  Target: ATXN1; (+) strand; PAM type: YTN; PAM sequence: TTA
gttggggagaaaagacattc

SEQ ID NO: 260879 - DNA, 20 bp, Artificial Sequence
  Description of Artificial Sequence: Synthetic oligonucleotide
  Target: ATXN1; (+) strand; PAM type: YTN; PAM sequence: TTG
gggagaaaagacattcatga

SEQ ID NO: 260880 - DNA, 20 bp, Artificial Sequence
  Description of Artificial Sequence: Synthetic oligonucleotide
  Target: ATXN1; (+) strand; PAM type: YTN; PAM sequence: TTC
atgatataatcacataaata

SEQ ID NO: 260881 - DNA, 20 bp, Artificial Sequence
  Description of Artificial Sequence: Synthetic oligonucleotide
  Target: ATXN1; (+) strand; PAM type: YTN; PAM sequence: CTA
tttttatatgtaaaaaatgt

SEQ ID NO: 260882 - DNA, 20 bp, Artificial Sequence
  Description of Artificial Sequence: Synthetic oligonucleotide
  Target: ATXN1; (+) strand; PAM type: YTN; PAM sequence: TTT
ttatatgtaaaaaatgttgt

SEQ ID NO: 260883 - DNA, 20 bp, Artificial Sequence
  Description of Artificial Sequence: Synthetic oligonucleotide
  Target: ATXN1; (+) strand; PAM type: YTN; PAM sequence: TTT
tatatgtaaaaaatgttgtc

SEQ ID NO: 260884 - DNA, 20 bp, Artificial Sequence
  Description of Artificial Sequence: Synthetic oligonucleotide
  Target: ATXN1; (+) strand; PAM type: YTN; PAM sequence: TTT
atatgtaaaaaatgttgtca

SEQ ID NO: 260885 - DNA, 20 bp, Artificial Sequence
  Description of Artificial Sequence: Synthetic oligonucleotide
  Target: ATXN1; (+) strand; PAM type: YTN; PAM sequence: TTA
tatgtaaaaaatgttgtcaa

SEQ ID NO: 260886 - DNA, 20 bp, Artificial Sequence
  Description of Artificial Sequence: Synthetic oligonucleotide
  Target: ATXN1; (+) strand; PAM type: YTN; PAM sequence: TTG
tcaaagaaaagaacggggtg

SEQ ID NO: 260887 - DNA, 20 bp, Artificial Sequence
  Description of Artificial Sequence: Synthetic oligonucleotide
  Target: ATXN1; (+) strand; PAM type: YTN; PAM sequence: TTG
gaagaggtgtaaaaactcca

SEQ ID NO: 260888 - DNA, 20 bp, Artificial Sequence
  Description of Artificial Sequence: Synthetic oligonucleotide
  Target: ATXN1; (+) strand; PAM type: YTN; PAM sequence: CTC
cagagaagctgtggctccta

SEQ ID NO: 260889 - DNA, 20 bp, Artificial Sequence
  Description of Artificial Sequence: Synthetic oligonucleotide
  Target: ATXN1; (+) strand; PAM type: YTN; PAM sequence: CTG
tggctcctagaaagaaggta

SEQ ID NO: 260890 - DNA, 20 bp, Artificial Sequence
  Description of Artificial Sequence: Synthetic oligonucleotide
  Target: ATXN1; (+) strand; PAM type: YTN; PAM sequence: CTC
ctagaaagaaggtaggtttt

SEQ ID NO: 260891 - DNA, 20 bp, Artificial Sequence
  Description of Artificial Sequence: Synthetic oligonucleotide
  Target: ATXN1; (+) strand; PAM type: YTN; PAM sequence: CTA
gaaagaaggtaggttttagg

SEQ ID NO: 260892 - DNA, 20 bp, Artificial Sequence
  Description of Artificial Sequence: Synthetic oligonucleotide
  Target: ATXN1; (+) strand; PAM type: YTN; PAM sequence: TTT
taggactagaatggtgatag

SEQ ID NO: 260893 - DNA, 20 bp, Artificial Sequence
  Description of Artificial Sequence: Synthetic oligonucleotide
  Target: ATXN1; (+) strand; PAM type: YTN; PAM sequence: TTT
aggactagaatggtgatagt

SEQ ID NO: 260894 - DNA, 20 bp, Artificial Sequence
  Description of Artificial Sequence: Synthetic oligonucleotide
  Target: ATXN1; (+) strand; PAM type: YTN; PAM sequence: TTA
ggactagaatggtgatagtg

SEQ ID NO: 260895 - DNA, 20 bp, Artificial Sequence
  Description of Artificial Sequence: Synthetic oligonucleotide
  Target: ATXN1; (+) strand; PAM type: YTN; PAM sequence: CTA
gaatggtgatagtgggccgg

SEQ ID NO: 260896 - DNA, 20 bp, Artificial Sequence
  Description of Artificial Sequence: Synthetic oligonucleotide
  Target: ATXN1; (+) strand; PAM type: YTN; PAM sequence: TTC
gaaagacactgaggagattg

SEQ ID NO: 260897 - DNA, 20 bp, Artificial Sequence
  Description of Artificial Sequence: Synthetic oligonucleotide
  Target: ATXN1; (+) strand; PAM type: YTN; PAM sequence: CTG
aggagattgcatcagtagga

SEQ ID NO: 260898 - DNA, 20 bp, Artificial Sequence
  Description of Artificial Sequence: Synthetic oligonucleotide
  Target: ATXN1; (+) strand; PAM type: YTN; PAM sequence: TTG
catcagtaggacttggtgac

SEQ ID NO: 260899 - DNA, 20 bp, Artificial Sequence
  Description of Artificial Sequence: Synthetic oligonucleotide
  Target: ATXN1; (+) strand; PAM type: YTN; PAM sequence: CTT
ggtgacacattagatgcaga

SEQ ID NO: 260900 - DNA, 20 bp, Artificial Sequence
  Description of Artificial Sequence: Synthetic oligonucleotide
  Target: ATXN1; (+) strand; PAM type: YTN; PAM sequence: TTG
gtgacacattagatgcagag

SEQ ID NO: 260901 - DNA, 20 bp, Artificial Sequence
  Description of Artificial Sequence: Synthetic oligonucleotide
  Target: ATXN1; (+) strand; PAM type: YTN; PAM sequence: TTA
gatgcagaggaagagggaca

SEQ ID NO: 260902 - DNA, 20 bp, Artificial Sequence
  Description of Artificial Sequence: Synthetic oligonucleotide
  Target: ATXN1; (+) strand; PAM type: YTN; PAM sequence: CTT
caaggaggacttttaggcat

SEQ ID NO: 260903 - DNA, 20 bp, Artificial Sequence
  Description of Artificial Sequence: Synthetic oligonucleotide
  Target: ATXN1; (+) strand; PAM type: YTN; PAM sequence: TTC
aaggaggacttttaggcatc

SEQ ID NO: 260904 - DNA, 20 bp, Artificial Sequence
  Description of Artificial Sequence: Synthetic oligonucleotide
  Target: ATXN1; (+) strand; PAM type: YTN; PAM sequence: CTT
ttaggcatctgtcttgggta

SEQ ID NO: 260905 - DNA, 20 bp, Artificial Sequence
  Description of Artificial Sequence: Synthetic oligonucleotide
  Target: ATXN1; (+) strand; PAM type: YTN; PAM sequence: TTT
taggcatctgtcttgggtaa

SEQ ID NO: 260906 - DNA, 20 bp, Artificial Sequence
  Description of Artificial Sequence: Synthetic oligonucleotide
  Target: ATXN1; (+) strand; PAM type: YTN; PAM sequence: TTT
aggcatctgtcttgggtaac

SEQ ID NO: 260907 - DNA, 20 bp, Artificial Sequence
  Description of Artificial Sequence: Synthetic oligonucleotide
  Target: ATXN1; (+) strand; PAM type: YTN; PAM sequence: TTA
ggcatctgtcttgggtaact

SEQ ID NO: 260908 - DNA, 20 bp, Artificial Sequence
  Description of Artificial Sequence: Synthetic oligonucleotide
  Target: ATXN1; (+) strand; PAM type: YTN; PAM sequence: CTG
tcttgggtaactagatgatg

SEQ ID NO: 260909 - DNA, 20 bp, Artificial Sequence
  Description of Artificial Sequence: Synthetic oligonucleotide
  Target: ATXN1; (+) strand; PAM type: YTN; PAM sequence: CTT
gggtaactagatgatgccaa

SEQ ID NO: 260910 - DNA, 20 bp, Artificial Sequence
  Description of Artificial Sequence: Synthetic oligonucleotide
  Target: ATXN1; (+) strand; PAM type: YTN; PAM sequence: TTG
ggtaactagatgatgccaat

SEQ ID NO: 260911 - DNA, 20 bp, Artificial Sequence
  Description of Artificial Sequence: Synthetic oligonucleotide
  Target: ATXN1; (+) strand; PAM type: YTN; PAM sequence: CTA
gatgatgccaatggctgaga

SEQ ID NO: 260912 - DNA, 20 bp, Artificial Sequence
  Description of Artificial Sequence: Synthetic oligonucleotide
  Target: ATXN1; (+) strand; PAM type: YTN; PAM sequence: CTG
agatggggaattcttgggta

SEQ ID NO: 260913 - DNA, 20 bp, Artificial Sequence
  Description of Artificial Sequence: Synthetic oligonucleotide
  Target: ATXN1; (+) strand; PAM type: YTN; PAM sequence: TTC
ttgggtagatgaggtttggt

SEQ ID NO: 260914 - DNA, 20 bp, Artificial Sequence
  Description of Artificial Sequence: Synthetic oligonucleotide
  Target: ATXN1; (+) strand; PAM type: YTN; PAM sequence: CTT
gggtagatgaggtttggtgg

SEQ ID NO: 260915 - DNA, 20 bp, Artificial Sequence
  Description of Artificial Sequence: Synthetic oligonucleotide
  Target: ATXN1; (+) strand; PAM type: YTN; PAM sequence: TTG
ggtagatgaggtttggtggg

SEQ ID NO: 260916 - DNA, 20 bp, Artificial Sequence
  Description of Artificial Sequence: Synthetic oligonucleotide
  Target: ATXN1; (+) strand; PAM type: YTN; PAM sequence: TTT
ggtgggatggtgattgttat

SEQ ID NO: 260917 - DNA, 20 bp, Artificial Sequence
  Description of Artificial Sequence: Synthetic oligonucleotide
  Target: ATXN1; (+) strand; PAM type: YTN; PAM sequence: TTG
gtgggatggtgattgttata

SEQ ID NO: 260918 - DNA, 20 bp, Artificial Sequence
  Description of Artificial Sequence: Synthetic oligonucleotide
  Target: ATXN1; (+) strand; PAM type: YTN; PAM sequence: TTG
ttataactttgactttgaac

SEQ ID NO: 260919 - DNA, 20 bp, Artificial Sequence
  Description of Artificial Sequence: Synthetic oligonucleotide
  Target: ATXN1; (+) strand; PAM type: YTN; PAM sequence: TTA
taactttgactttgaacgtg

SEQ ID NO: 260920 - DNA, 20 bp, Artificial Sequence
  Description of Artificial Sequence: Synthetic oligonucleotide
  Target: ATXN1; (+) strand; PAM type: YTN; PAM sequence: CTT
tgactttgaacgtgctgagt

SEQ ID NO: 260921 - DNA, 20 bp, Artificial Sequence
  Description of Artificial Sequence: Synthetic oligonucleotide
  Target: ATXN1; (+) strand; PAM type: YTN; PAM sequence: TTT
gactttgaacgtgctgagtt

SEQ ID NO: 260922 - DNA, 20 bp, Artificial Sequence
  Description of Artificial Sequence: Synthetic oligonucleotide
  Target: ATXN1; (+) strand; PAM type: YTN; PAM sequence: TTG
actttgaacgtgctgagttc

SEQ ID NO: 260923 - DNA, 20 bp, Artificial Sequence
  Description of Artificial Sequence: Synthetic oligonucleotide
  Target: ATXN1; (+) strand; PAM type: YTN; PAM sequence: CTT
tgaacgtgctgagttcaggt

SEQ ID NO: 260924 - DNA, 20 bp, Artificial Sequence
  Description of Artificial Sequence: Synthetic oligonucleotide
  Target: ATXN1; (+) strand; PAM type: YTN; PAM sequence: TTT
gaacgtgctgagttcaggtg

SEQ ID NO: 260925 - DNA, 20 bp, Artificial Sequence
  Description of Artificial Sequence: Synthetic oligonucleotide
  Target: ATXN1; (+) strand; PAM type: YTN; PAM sequence: TTG
aacgtgctgagttcaggtga

SEQ ID NO: 260926 - DNA, 20 bp, Artificial Sequence
  Description of Artificial Sequence: Synthetic oligonucleotide
  Target: ATXN1; (+) strand; PAM type: YTN; PAM sequence: CTG
agttcaggtgacattgtgat

SEQ ID NO: 260927 - DNA, 20 bp, Artificial Sequence
  Description of Artificial Sequence: Synthetic oligonucleotide
  Target: ATXN1; (+) strand; PAM type: YTN; PAM sequence: TTC
aggtgacattgtgatacccc

SEQ ID NO: 260928 - DNA, 20 bp, Artificial Sequence
  Description of Artificial Sequence: Synthetic oligonucleotide
  Target: ATXN1; (+) strand; PAM type: YTN; PAM sequence: TTG
tgataccccaaaggaggtgc

SEQ ID NO: 260929 - DNA, 20 bp, Artificial Sequence
  Description of Artificial Sequence: Synthetic oligonucleotide
  Target: ATXN1; (+) strand; PAM type: YTN; PAM sequence: CTG
gagacacaggcccgaagatg

SEQ ID NO: 260930 - DNA, 20 bp, Artificial Sequence
  Description of Artificial Sequence: Synthetic oligonucleotide
  Target: ATXN1; (+) strand; PAM type: YTN; PAM sequence: CTG
gcctagaaacatggatgcag

SEQ ID NO: 260931 - DNA, 20 bp, Artificial Sequence
  Description of Artificial Sequence: Synthetic oligonucleotide
  Target: ATXN1; (+) strand; PAM type: YTN; PAM sequence: CTA
gaaacatggatgcaggagtc

SEQ ID NO: 260932 - DNA, 20 bp, Artificial Sequence
  Description of Artificial Sequence: Synthetic oligonucleotide
  Target: ATXN1; (+) strand; PAM type: YTN; PAM sequence: CTG
tgagtttggatgagatcatc

SEQ ID NO: 260933 - DNA, 20 bp, Artificial Sequence
  Description of Artificial Sequence: Synthetic oligonucleotide
  Target: ATXN1; (+) strand; PAM type: YTN; PAM sequence: TTT
ggatgagatcatctagcaga

SEQ ID NO: 260934 - DNA, 20 bp, Artificial Sequence
  Description of Artificial Sequence: Synthetic oligonucleotide
  Target: ATXN1; (+) strand; PAM type: YTN; PAM sequence: TTG
gatgagatcatctagcagaa

SEQ ID NO: 260935 - DNA, 20 bp, Artificial Sequence
  Description of Artificial Sequence: Synthetic oligonucleotide
  Target: ATXN1; (+) strand; PAM type: YTN; PAM sequence: CTA
gcagaacacttaagtggaga

SEQ ID NO: 260936 - DNA, 20 bp, Artificial Sequence
  Description of Artificial Sequence: Synthetic oligonucleotide
  Target: ATXN1; (+) strand; PAM type: YTN; PAM sequence: CTT
aagtggagaagcaaagtggt

SEQ ID NO: 260937 - DNA, 20 bp, Artificial Sequence
  Description of Artificial Sequence: Synthetic oligonucleotide
  Target: ATXN1; (+) strand; PAM type: YTN; PAM sequence: TTA
agtggagaagcaaagtggtc

SEQ ID NO: 260938 - DNA, 20 bp, Artificial Sequence
  Description of Artificial Sequence: Synthetic oligonucleotide
  Target: ATXN1; (+) strand; PAM type: YTN; PAM sequence: CTA
gagactaagccatgaggaac

SEQ ID NO: 260939 - DNA, 20 bp, Artificial Sequence
  Description of Artificial Sequence: Synthetic oligonucleotide
  Target: ATXN1; (+) strand; PAM type: YTN; PAM sequence: CTA
agccatgaggaactccaaca

SEQ ID NO: 260940 - DNA, 20 bp, Artificial Sequence
  Description of Artificial Sequence: Synthetic oligonucleotide
  Target: ATXN1; (+) strand; PAM type: YTN; PAM sequence: CTC
caacacttagaggcgtagaa

SEQ ID NO: 260941 - DNA, 20 bp, Artificial Sequence
  Description of Artificial Sequence: Synthetic oligonucleotide
  Target: ATXN1; (+) strand; PAM type: YTN; PAM sequence: CTT
agaggcgtagaaagcaggta

SEQ ID NO: 260942 - DNA, 20 bp, Artificial Sequence
  Description of Artificial Sequence: Synthetic oligonucleotide
  Target: ATXN1; (+) strand; PAM type: YTN; PAM sequence: TTA
gaggcgtagaaagcaggtag

SEQ ID NO: 260943 - DNA, 20 bp, Artificial Sequence
  Description of Artificial Sequence: Synthetic oligonucleotide
  Target: ATXN1; (+) strand; PAM type: YTN; PAM sequence: CTG
aagacttaggaaggaggggc

SEQ ID NO: 260944 - DNA, 20 bp, Artificial Sequence
  Description of Artificial Sequence: Synthetic oligonucleotide
  Target: ATXN1; (+) strand; PAM type: YTN; PAM sequence: CTT
aggaaggaggggccagaaag

SEQ ID NO: 260945 - DNA, 20 bp, Artificial Sequence
  Description of Artificial Sequence: Synthetic oligonucleotide
  Target: ATXN1; (+) strand; PAM type: YTN; PAM sequence: TTA
ggaaggaggggccagaaagg

SEQ ID NO: 260946 - DNA, 20 bp, Artificial Sequence
  Description of Artificial Sequence: Synthetic oligonucleotide
  Target: ATXN1; (+) strand; PAM type: YTN; PAM sequence: TTC
aggaagccaagggaggaagg

SEQ ID NO: 260947 - DNA, 20 bp, Artificial Sequence
  Description of Artificial Sequence: Synthetic oligonucleotide
  Target: ATXN1; (+) strand; PAM type: YTN; PAM sequence: TTT
agacaggagggggagagcag

SEQ ID NO: 260948 - DNA, 20 bp, Artificial Sequence
  Description of Artificial Sequence: Synthetic oligonucleotide
  Target: ATXN1; (+) strand; PAM type: YTN; PAM sequence: TTA
gacaggagggggagagcaga

SEQ ID NO: 260949 - DNA, 20 bp, Artificial Sequence
  Description of Artificial Sequence: Synthetic oligonucleotide
  Target: ATXN1; (+) strand; PAM type: YTN; PAM sequence: TTG
gcaaagctgtggagaaagtg

SEQ ID NO: 260950 - DNA, 20 bp, Artificial Sequence
  Description of Artificial Sequence: Synthetic oligonucleotide
  Target: ATXN1; (+) strand; PAM type: YTN; PAM sequence: CTG
tggagaaagtgagatgagaa

SEQ ID NO: 260951 - DNA, 20 bp, Artificial Sequence
  Description of Artificial Sequence: Synthetic oligonucleotide
  Target: ATXN1; (+) strand; PAM type: YTN; PAM sequence: CTC
ctattaaaaacacacaactg

SEQ ID NO: 260952 - DNA, 20 bp, Artificial Sequence
  Description of Artificial Sequence: Synthetic oligonucleotide
  Target: ATXN1; (+) strand; PAM type: YTN; PAM sequence: CTA
ttaaaaacacacaactggtc

SEQ ID NO: 260953 - DNA, 20 bp, Artificial Sequence
  Description of Artificial Sequence: Synthetic oligonucleotide
  Target: ATXN1; (+) strand; PAM type: YTN; PAM sequence: TTA
aaaacacacaactggtccaa

SEQ ID NO: 260954 - DNA, 20 bp, Artificial Sequence
  Description of Artificial Sequence: Synthetic oligonucleotide
  Target: ATXN1; (+) strand; PAM type: YTN; PAM sequence: CTG
gtccaatgacatgggatggc

SEQ ID NO: 260955 - DNA, 20 bp, Artificial Sequence
  Description of Artificial Sequence: Synthetic oligonucleotide
  Target: ATXN1; (+) strand; PAM type: YTN; PAM sequence: CTG
atgaccaagcaggagacagg

SEQ ID NO: 260956 - DNA, 20 bp, Artificial Sequence
  Description of Artificial Sequence: Synthetic oligonucleotide
  Target: ATXN1; (+) strand; PAM type: YTN; PAM sequence: CTG
aagccagctaaggaatgtcc

SEQ ID NO: 260957 - DNA, 20 bp, Artificial Sequence
  Description of Artificial Sequence: Synthetic oligonucleotide
  Target: ATXN1; (+) strand; PAM type: YTN; PAM sequence: CTA
aggaatgtcctcgggccatc

SEQ ID NO: 260958 - DNA, 20 bp, Artificial Sequence
  Description of Artificial Sequence: Synthetic oligonucleotide
  Target: ATXN1; (+) strand; PAM type: YTN; PAM sequence: CTC
gggccatctcctagcggagg

SEQ ID NO: 260959 - DNA, 20 bp, Artificial Sequence
  Description of Artificial Sequence: Synthetic oligonucleotide
  Target: ATXN1; (+) strand; PAM type: YTN; PAM sequence: CTC
ctagcggaggcggtagagcc

SEQ ID NO: 260960 - DNA, 20 bp, Artificial Sequence
  Description of Artificial Sequence: Synthetic oligonucleotide
  Target: ATXN1; (+) strand; PAM type: YTN; PAM sequence: CTA
gcggaggcggtagagccgtg

SEQ ID NO: 260961 - DNA, 20 bp, Artificial Sequence
  Description of Artificial Sequence: Synthetic oligonucleotide
  Target: ATXN1; (+) strand; PAM type: YTN; PAM sequence: TTG
aaggtacaggaagtggactg

SEQ ID NO: 260962 - DNA, 20 bp, Artificial Sequence
  Description of Artificial Sequence: Synthetic oligonucleotide
  Target: ATXN1; (+) strand; PAM type: YTN; PAM sequence: CTG
ttagggcccaggttcccctt

SEQ ID NO: 260963 - DNA, 20 bp, Artificial Sequence
  Description of Artificial Sequence: Synthetic oligonucleotide
  Target: ATXN1; (+) strand; PAM type: YTN; PAM sequence: TTA
gggcccaggttccccttaac

SEQ ID NO: 260964 - DNA, 20 bp, Artificial Sequence
  Description of Artificial Sequence: Synthetic oligonucleotide
  Target: ATXN1; (+) strand; PAM type: YTN; PAM sequence: TTC
cccttaaccatgagacctga

SEQ ID NO: 260965 - DNA, 20 bp, Artificial Sequence
  Description of Artificial Sequence: Synthetic oligonucleotide
  Target: ATXN1; (+) strand; PAM type: YTN; PAM sequence: CTT
aaccatgagacctgaagcaa

SEQ ID NO: 260966 - DNA, 20 bp, Artificial Sequence
  Description of Artificial Sequence: Synthetic oligonucleotide
  Target: ATXN1; (+) strand; PAM type: YTN; PAM sequence: TTA
accatgagacctgaagcaag

SEQ ID NO: 260967 - DNA, 20 bp, Artificial Sequence
  Description of Artificial Sequence: Synthetic oligonucleotide
  Target: ATXN1; (+) strand; PAM type: YTN; PAM sequence: CTG
aagcaagttactttatttct

SEQ ID NO: 260968 - DNA, 20 bp, Artificial Sequence
  Description of Artificial Sequence: Synthetic oligonucleotide
  Target: ATXN1; (+) strand; PAM type: YTN; PAM sequence: TTA
ctttatttctctagggctca

SEQ ID NO: 260969 - DNA, 20 bp, Artificial Sequence
  Description of Artificial Sequence: Synthetic oligonucleotide
  Target: ATXN1; (+) strand; PAM type: YTN; PAM sequence: CTT
tatttctctagggctcaatt

SEQ ID NO: 260970 - DNA, 20 bp, Artificial Sequence
  Description of Artificial Sequence: Synthetic oligonucleotide
  Target: ATXN1; (+) strand; PAM type: YTN; PAM sequence: TTT
atttctctagggctcaattt

SEQ ID NO: 260971 - DNA, 20 bp, Artificial Sequence
  Description of Artificial Sequence: Synthetic oligonucleotide
  Target: ATXN1; (+) strand; PAM type: YTN; PAM sequence: TTA
tttctctagggctcaatttt

SEQ ID NO: 260972 - DNA, 20 bp, Artificial Sequence
  Description of Artificial Sequence: Synthetic oligonucleotide
  Target: ATXN1; (+) strand; PAM type: YTN; PAM sequence: TTT
ctctagggctcaattttctc

SEQ ID NO: 260973 - DNA, 20 bp, Artificial Sequence
  Description of Artificial Sequence: Synthetic oligonucleotide
  Target: ATXN1; (+) strand; PAM type: YTN; PAM sequence: TTC
tctagggctcaattttctca

SEQ ID NO: 260974 - DNA, 20 bp, Artificial Sequence
  Description of Artificial Sequence: Synthetic oligonucleotide
  Target: ATXN1; (+) strand; PAM type: YTN; PAM sequence: CTC
tagggctcaattttctcacc

SEQ ID NO: 260975 - DNA, 20 bp, Artificial Sequence
  Description of Artificial Sequence: Synthetic oligonucleotide
  Target: ATXN1; (+) strand; PAM type: YTN; PAM sequence: CTA
gggctcaattttctcacctg

SEQ ID NO: 260976 - DNA, 20 bp, Artificial Sequence
  Description of Artificial Sequence: Synthetic oligonucleotide
  Target: ATXN1; (+) strand; PAM type: YTN; PAM sequence: CTC
aattttctcacctgtaaaac

SEQ ID NO: 260977 - DNA, 20 bp, Artificial Sequence
  Description of Artificial Sequence: Synthetic oligonucleotide
  Target: ATXN1; (+) strand; PAM type: YTN; PAM sequence: TTT
tctcacctgtaaaacaagag

SEQ ID NO: 260978 - DNA, 20 bp, Artificial Sequence
  Description of Artificial Sequence: Synthetic oligonucleotide
  Target: ATXN1; (+) strand; PAM type: YTN; PAM sequence: TTT
ctcacctgtaaaacaagagt

SEQ ID NO: 260979 - DNA, 20 bp, Artificial Sequence
  Description of Artificial Sequence: Synthetic oligonucleotide
  Target: ATXN1; (+) strand; PAM type: YTN; PAM sequence: TTC
tcacctgtaaaacaagagta

SEQ ID NO: 260980 - DNA, 20 bp, Artificial Sequence
  Description of Artificial Sequence: Synthetic oligonucleotide
  Target: ATXN1; (+) strand; PAM type: YTN; PAM sequence: CTC
acctgtaaaacaagagtaac

SEQ ID NO: 260981 - DNA, 20 bp, Artificial Sequence
  Description of Artificial Sequence: Synthetic oligonucleotide
  Target: ATXN1; (+) strand; PAM type: YTN; PAM sequence: CTG
taaaacaagagtaacagtgc

SEQ ID NO: 260982 - DNA, 20 bp, Artificial Sequence
  Description of Artificial Sequence: Synthetic oligonucleotide
  Target: ATXN1; (+) strand; PAM type: YTN; PAM sequence: CTC
acctactaggttgctgtgag

SEQ ID NO: 260983 - DNA, 20 bp, Artificial Sequence
  Description of Artificial Sequence: Synthetic oligonucleotide
  Target: ATXN1; (+) strand; PAM type: YTN; PAM sequence: CTA
ctaggttgctgtgaggttct

SEQ ID NO: 260984 - DNA, 20 bp, Artificial Sequence
  Description of Artificial Sequence: Synthetic oligonucleotide
  Target: ATXN1; (+) strand; PAM type: YTN; PAM sequence: CTA
ggttgctgtgaggttctttt

SEQ ID NO: 260985 - DNA, 20 bp, Artificial Sequence
  Description of Artificial Sequence: Synthetic oligonucleotide
  Target: ATXN1; (+) strand; PAM type: YTN; PAM sequence: TTG
ctgtgaggttctttttcttt

SEQ ID NO: 260986 - DNA, 20 bp, Artificial Sequence
  Description of Artificial Sequence: Synthetic oligonucleotide
  Target: ATXN1; (+) strand; PAM type: YTN; PAM sequence: CTG
tgaggttctttttctttttc

SEQ ID NO: 260987 - DNA, 20 bp, Artificial Sequence
  Description of Artificial Sequence: Synthetic oligonucleotide
  Target: ATXN1; (+) strand; PAM type: YTN; PAM sequence: TTC
tttttctttttctttttttt

SEQ ID NO: 260988 - DNA, 20 bp, Artificial Sequence
  Description of Artificial Sequence: Synthetic oligonucleotide
  Target: ATXN1; (+) strand; PAM type: YTN; PAM sequence: CTT
tttctttttctttttttttt

SEQ ID NO: 260989 - DNA, 20 bp, Artificial Sequence
  Description of Artificial Sequence: Synthetic oligonucleotide
  Target: ATXN1; (+) strand; PAM type: YTN; PAM sequence: TTT
ttctttttcttttttttttg

SEQ ID NO: 260990 - DNA, 20 bp, Artificial Sequence
  Description of Artificial Sequence: Synthetic oligonucleotide
  Target: ATXN1; (+) strand; PAM type: YTN; PAM sequence: TTT
tctttttcttttttttttgg

SEQ ID NO: 260991 - DNA, 20 bp, Artificial Sequence
  Description of Artificial Sequence: Synthetic oligonucleotide
  Target: ATXN1; (+) strand; PAM type: YTN; PAM sequence: TTT
ctttttcttttttttttgga

SEQ ID NO: 260992 - DNA, 20 bp, Artificial Sequence
  Description of Artificial Sequence: Synthetic oligonucleotide
  Target: ATXN1; (+) strand; PAM type: YTN; PAM sequence: TTC
tttttcttttttttttggag

SEQ ID NO: 260993 - DNA, 20 bp, Artificial Sequence
  Description of Artificial Sequence: Synthetic oligonucleotide
  Target: ATXN1; (+) strand; PAM type: YTN; PAM sequence: CTT
tttcttttttttttggagac

SEQ ID NO: 260994 - DNA, 20 bp, Artificial Sequence
  Description of Artificial Sequence: Synthetic oligonucleotide
  Target: ATXN1; (+) strand; PAM type: YTN; PAM sequence: TTT
ttcttttttttttggagaca

SEQ ID NO: 260995 - DNA, 20 bp, Artificial Sequence
  Description of Artificial Sequence: Synthetic oligonucleotide
  Target: ATXN1; (+) strand; PAM type: YTN; PAM sequence: TTT
tcttttttttttggagacag

SEQ ID NO: 260996 - DNA, 20 bp, Artificial Sequence
  Description of Artificial Sequence: Synthetic oligonucleotide
  Target: ATXN1; (+) strand; PAM type: YTN; PAM sequence: TTT
cttttttttttggagacaga

SEQ ID NO: 260997 - DNA, 20 bp, Artificial Sequence
  Description of Artificial Sequence: Synthetic oligonucleotide
  Target: ATXN1; (+) strand; PAM type: YTN; PAM sequence: TTC
ttttttttttggagacagag

SEQ ID NO: 260998 - DNA, 20 bp, Artificial Sequence
  Description of Artificial Sequence: Synthetic oligonucleotide
  Target: ATXN1; (+) strand; PAM type: YTN; PAM sequence: CTT
ttttttttggagacagagtc

SEQ ID NO: 260999 - DNA, 20 bp, Artificial Sequence
  Description of Artificial Sequence: Synthetic oligonucleotide
  Target: ATXN1; (+) strand; PAM type: YTN; PAM sequence: TTT
tttttttggagacagagtct

SEQ ID NO: 261000 - DNA, 20 bp, Artificial Sequence
  Description of Artificial Sequence: Synthetic oligonucleotide
  Target: ATXN1; (+) strand; PAM type: YTN; PAM sequence: TTT
ttttttggagacagagtctc

SEQ ID NO: 261001 - DNA, 20 bp, Artificial Sequence
  Description of Artificial Sequence: Synthetic oligonucleotide
  Target: ATXN1; (+) strand; PAM type: YTN; PAM sequence: TTT
tttttggagacagagtctca

SEQ ID NO: 261002 - DNA, 20 bp, Artificial Sequence
  Description of Artificial Sequence: Synthetic oligonucleotide
  Target: ATXN1; (+) strand; PAM type: YTN; PAM sequence: TTT
ttttggagacagagtctcac

SEQ ID NO: 261003 - DNA, 20 bp, Artificial Sequence
  Description of Artificial Sequence: Synthetic oligonucleotide
  Target: ATXN1; (+) strand; PAM type: YTN; PAM sequence: TTT
tttggagacagagtctcact

SEQ ID NO: 261004 - DNA, 20 bp, Artificial Sequence
  Description of Artificial Sequence: Synthetic oligonucleotide
  Target: ATXN1; (+) strand; PAM type: YTN; PAM sequence: TTT
ttggagacagagtctcactc

SEQ ID NO: 261005 - DNA, 20 bp, Artificial Sequence
  Description of Artificial Sequence: Synthetic oligonucleotide
  Target: ATXN1; (+) strand; PAM type: YTN; PAM sequence: TTT
tggagacagagtctcactct

SEQ ID NO: 261006 - DNA, 20 bp, Artificial Sequence
  Description of Artificial Sequence: Synthetic oligonucleotide
  Target: ATXN1; (+) strand; PAM type: YTN; PAM sequence: TTT
ggagacagagtctcactctg

SEQ ID NO: 261007 - DNA, 20 bp, Artificial Sequence
  Description of Artificial Sequence: Synthetic oligonucleotide
  Target: ATXN1; (+) strand; PAM type: YTN; PAM sequence: TTG
gagacagagtctcactctgt

SEQ ID NO: 261008 - DNA, 20 bp, Artificial Sequence
  Description of Artificial Sequence: Synthetic oligonucleotide
  Target: ATXN1; (+) strand; PAM type: YTN; PAM sequence: CTC
actctgtcacccaggctgga

SEQ ID NO: 261009 - DNA, 20 bp, Artificial Sequence
  Description of Artificial Sequence: Synthetic oligonucleotide
  Target: ATXN1; (+) strand; PAM type: YTN; PAM sequence: CTC
tgtcacccaggctggagtgc

SEQ ID NO: 261010 - DNA, 20 bp, Artificial Sequence
  Description of Artificial Sequence: Synthetic oligonucleotide
  Target: ATXN1; (+) strand; PAM type: YTN; PAM sequence: CTG
tcacccaggctggagtgcag

SEQ ID NO: 261011 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggtgcaatctt

SEQ ID NO: 261012 - DNA, 20 bp, Artificial Sequence
  Description of Artificial Sequence: Synthetic oligonucleotide
  Target: ATXN1; (+) strand; PAM type: YTN; PAM sequence: CTT
ggctcactgcaatctccacc

SEQ ID NO: 261013 - DNA, 20 bp, Artificial Sequence
  Description of Artificial Sequence: Synthetic oligonucleotide
  Target: ATXN1; (+) strand; PAM type: YTN; PAM sequence: TTG
gctcactgcaatctccacct

SEQ ID NO: 261014 - DNA, 20 bp, Artificial Sequence
  Description of Artificial Sequence: Synthetic oligonucleotide
  Target: ATXN1; (+) strand; PAM type: YTN; PAM sequence: CTC
actgcaatctccacctcccg

SEQ ID NO: 261015 - DNA, 20 bp, Artificial Sequence
  Description of Artificial Sequence: Synthetic oligonucleotide
  Target: ATXN1; (+) strand; PAM type: YTN; PAM sequence: CTG
caatctccacctcccgggtt

SEQ ID NO: 261016 - DNA, 20 bp, Artificial Sequence
  Description of Artificial Sequence: Synthetic oligonucleotide
  Target: ATXN1; (+) strand; PAM type: YTN; PAM sequence: CTC
cacctcccgggttccagcta

SEQ ID NO: 261017 - DNA, 20 bp, Artificial Sequence
  Description of Artificial Sequence: Synthetic oligonucleotide
  Target: ATXN1; (+) strand; PAM type: YTN; PAM sequence: CTC
ccgggttccagctattctcc

SEQ ID NO: 261018 - DNA, 20 bp, Artificial Sequence
  Description of Artificial Sequence: Synthetic oligonucleotide
  Target: ATXN1; (+) strand; PAM type: YTN; PAM sequence: TTC
cagctattctcctgccttag

SEQ ID NO: 261019 - DNA, 20 bp, Artificial Sequence
  Description of Artificial Sequence: Synthetic oligonucleotide
  Target: ATXN1; (+) strand; PAM type: YTN; PAM sequence: CTA
ttctcctgccttagcctcct

SEQ ID NO: 261020 - DNA, 20 bp, Artificial Sequence
  Description of Artificial Sequence: Synthetic oligonucleotide
  Target: ATXN1; (+) strand; PAM type: YTN; PAM sequence: TTC
tcctgccttagcctcctgag

SEQ ID NO: 261021 - DNA, 20 bp, Artificial Sequence
  Description of Artificial Sequence: Synthetic oligonucleotide
  Target: ATXN1; (+) strand; PAM type: YTN; PAM sequence: CTC
ctgccttagcctcctgagtg

SEQ ID NO: 261022 - DNA, 20 bp, Artificial Sequence
  Description of Artificial Sequence: Synthetic oligonucleotide
  Target: ATXN1; (+) strand; PAM type: YTN; PAM sequence: CTG
ccttagcctcctgagtggct

SEQ ID NO: 261023 - DNA, 20 bp, Artificial Sequence
  Description of Artificial Sequence: Synthetic oligonucleotide
  Target: ATXN1; (+) strand; PAM type: YTN; PAM sequence: CTT
agcctcctgagtggctggga

SEQ ID NO: 261024 - DNA, 20 bp, Artificial Sequence
  Description of Artificial Sequence: Synthetic oligonucleotide
  Target: ATXN1; (+) strand; PAM type: YTN; PAM sequence: TTA
gcctcctgagtggctgggac

SEQ ID NO: 261025 - DNA, 20 bp, Artificial Sequence
  Description of Artificial Sequence: Synthetic oligonucleotide
  Target: ATXN1; (+) strand; PAM type: YTN; PAM sequence: CTC
ctgagtggctgggactacag

SEQ ID NO: 261026 - DNA, 20 bp, Artificial Sequence
  Description of Artificial Sequence: Synthetic oligonucleotide
  Target: ATXN1; (+) strand; PAM type: YTN; PAM sequence: CTG
agtggctgggactacaggcg

SEQ ID NO: 261027 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcgcctgccac

SEQ ID NO: 261028 - DNA, 20 bp, Artificial Sequence
  Description of Artificial Sequence: Synthetic oligonucleotide
  Target: ATXN1; (+) strand; PAM type: YTN; PAM sequence: CTA
caggcgcctgccaccacaac

SEQ ID NO: 261029 - DNA, 20 bp, Artificial Sequence
  Description of Artificial Sequence: Synthetic oligonucleotide
  Target: ATXN1; (+) strand; PAM type: YTN; PAM sequence: CTG
ccaccacaactggctaattt

SEQ ID NO: 261030 - DNA, 20 bp, Artificial Sequence
  Description of Artificial Sequence: Synthetic oligonucleotide
  Target: ATXN1; (+) strand; PAM type: YTN; PAM sequence: CTG
gctaatttttgtatttttag

SEQ ID NO: 261031 - DNA, 20 bp, Artificial Sequence
  Description of Artificial Sequence: Synthetic oligonucleotide
  Target: ATXN1; (+) strand; PAM type: YTN; PAM sequence: CTA
atttttgtatttttagtaga

SEQ ID NO: 261032 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagatg

SEQ ID NO: 261033 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagatgg

SEQ ID NO: 261034 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagatggg

SEQ ID NO: 261035 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagatgggg

SEQ ID NO: 261036 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatggggtttca

SEQ ID NO: 261037 - DNA, 20 bp, Artificial Sequence
  Description of Artificial Sequence: Synthetic oligonucleotide
  Target: ATXN1; (+) strand; PAM type: YTN; PAM sequence: TTT
tagtagagatggggtttcac

SEQ ID NO: 261038 - DNA, 20 bp, Artificial Sequence
  Description of Artificial Sequence: Synthetic oligonucleotide
  Target: ATXN1; (+) strand; PAM type: YTN; PAM sequence: TTT
agtagagatggggtttcacc

SEQ ID NO: 261039 - DNA, 20 bp, Artificial Sequence
  Description of Artificial Sequence: Synthetic oligonucleotide
  Target: ATXN1; (+) strand; PAM type: YTN; PAM sequence: TTA
gtagagatggggtttcacca

SEQ ID NO: 261040 - DNA, 20 bp, Artificial Sequence
  Description of Artificial Sequence: Synthetic oligonucleotide
  Target: ATXN1; (+) strand; PAM type: YTN; PAM sequence: TTT
caccacgttggccagcctgg

SEQ ID NO: 261041 - DNA, 20 bp, Artificial Sequence
  Description of Artificial Sequence: Synthetic oligonucleotide
  Target: ATXN1; (+) strand; PAM type: YTN; PAM sequence: TTC
accacgttggccagcctgga

SEQ ID NO: 261042 - DNA, 20 bp, Artificial Sequence
  Description of Artificial Sequence: Synthetic oligonucleotide
  Target: ATXN1; (+) strand; PAM type: YTN; PAM sequence: TTG
gccagcctggactcaaactc

SEQ ID NO: 261043 - DNA, 20 bp, Artificial Sequence
  Description of Artificial Sequence: Synthetic oligonucleotide
  Target: ATXN1; (+) strand; PAM type: YTN; PAM sequence: CTG
gactcaaactcctgacctca

SEQ ID NO: 261044 - DNA, 20 bp, Artificial Sequence
  Description of Artificial Sequence: Synthetic oligonucleotide
  Target: ATXN1; (+) strand; PAM type: YTN; PAM sequence: CTC
aaactcctgacctcaggtga

SEQ ID NO: 261045 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggtgatctgcc

SEQ ID NO: 261046 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatctgcctgc

SEQ ID NO: 261047 - DNA, 20 bp, Artificial Sequence
  Description of Artificial Sequence: Synthetic oligonucleotide
  Target: ATXN1; (+) strand; PAM type: YTN; PAM sequence: CTC
aggtgatctgcctgcttcag

SEQ ID NO: 261048 - DNA, 20 bp, Artificial Sequence
  Description of Artificial Sequence: Synthetic oligonucleotide
  Target: ATXN1; (+) strand; PAM type: YTN; PAM sequence: CTG
cctgcttcagcctcccaaag

SEQ ID NO: 261049 - DNA, 20 bp, Artificial Sequence
  Description of Artificial Sequence: Synthetic oligonucleotide
  Target: ATXN1; (+) strand; PAM type: YTN; PAM sequence: CTG
cttcagcctcccaaagtgct

SEQ ID NO: 261050 - DNA, 20 bp, Artificial Sequence
  Description of Artificial Sequence: Synthetic oligonucleotide
  Target: ATXN1; (+) strand; PAM type: YTN; PAM sequence: CTT
cagcctcccaaagtgctggg

SEQ ID NO: 261051 - DNA, 20 bp, Artificial Sequence
  Description of Artificial Sequence: Synthetic oligonucleotide
  Target: ATXN1; (+) strand; PAM type: YTN; PAM sequence: TTC
agcctcccaaagtgctggga

SEQ ID NO: 261052 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 261053 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgtgagccac

SEQ ID NO: 261054 - DNA, 20 bp, Artificial Sequence
  Description of Artificial Sequence: Synthetic oligonucleotide
  Target: ATXN1; (+) strand; PAM type: YTN; PAM sequence: TTA
caggcgtgagccaccacacc

SEQ ID NO: 261055 - DNA, 20 bp, Artificial Sequence
  Description of Artificial Sequence: Synthetic oligonucleotide
  Target: ATXN1; (+) strand; PAM type: YTN; PAM sequence: CTG
gccttctgtgaggttcttaa

SEQ ID NO: 261056 - DNA, 20 bp, Artificial Sequence
  Description of Artificial Sequence: Synthetic oligonucleotide
  Target: ATXN1; (+) strand; PAM type: YTN; PAM sequence: CTT
ctgtgaggttcttaacatgt

SEQ ID NO: 261057 - DNA, 20 bp, Artificial Sequence
  Description of Artificial Sequence: Synthetic oligonucleotide
  Target: ATXN1; (+) strand; PAM type: YTN; PAM sequence: TTC
tgtgaggttcttaacatgta

SEQ ID NO: 261058 - DNA, 20 bp, Artificial Sequence
  Description of Artificial Sequence: Synthetic oligonucleotide
  Target: ATXN1; (+) strand; PAM type: YTN; PAM sequence: CTG
tgaggttcttaacatgtaag

SEQ ID NO: 261059 - DNA, 20 bp, Artificial Sequence
  Description of Artificial Sequence: Synthetic oligonucleotide
  Target: ATXN1; (+) strand; PAM type: YTN; PAM sequence: TTC
ttaacatgtaagccacttag

SEQ ID NO: 261060 - DNA, 20 bp, Artificial Sequence
  Description of Artificial Sequence: Synthetic oligonucleotide
  Target: ATXN1; (+) strand; PAM type: YTN; PAM sequence: CTT
aacatgtaagccacttagcc

SEQ ID NO: 261061 - DNA, 20 bp, Artificial Sequence
  Description of Artificial Sequence: Synthetic oligonucleotide
  Target: ATXN1; (+) strand; PAM type: YTN; PAM sequence: TTA
acatgtaagccacttagccc

SEQ ID NO: 261062 - DNA, 20 bp, Artificial Sequence
  Description of Artificial Sequence: Synthetic oligonucleotide
  Target: ATXN1; (+) strand; PAM type: YTN; PAM sequence: CTT
agcccagtggctgactcata

SEQ ID NO: 261063 - DNA, 20 bp, Artificial Sequence
  Description of Artificial Sequence: Synthetic oligonucleotide
  Target: ATXN1; (+) strand; PAM type: YTN; PAM sequence: TTA
gcccagtggctgactcatag

SEQ ID NO: 261064 - DNA, 20 bp, Artificial Sequence
  Description of Artificial Sequence: Synthetic oligonucleotide
  Target: ATXN1; (+) strand; PAM type: YTN; PAM sequence: CTG
actcatagtagttgctgaat

SEQ ID NO: 261065 - DNA, 20 bp, Artificial Sequence
  Description of Artificial Sequence: Synthetic oligonucleotide
  Target: ATXN1; (+) strand; PAM type: YTN; PAM sequence: CTC
atagtagttgctgaataaat

SEQ ID NO: 261066 - DNA, 20 bp, Artificial Sequence
  Description of Artificial Sequence: Synthetic oligonucleotide
  Target: ATXN1; (+) strand; PAM type: YTN; PAM sequence: TTG
ctgaataaatgctaatttta

SEQ ID NO: 261067 - DNA, 20 bp, Artificial Sequence
  Description of Artificial Sequence: Synthetic oligonucleotide
  Target: ATXN1; (+) strand; PAM type: YTN; PAM sequence: CTG
aataaatgctaattttatat

SEQ ID NO: 261068 - DNA, 20 bp, Artificial Sequence
  Description of Artificial Sequence: Synthetic oligonucleotide
  Target: ATXN1; (+) strand; PAM type: YTN; PAM sequence: CTA
attttatattaacaccctca

SEQ ID NO: 261069 - DNA, 20 bp, Artificial Sequence
  Description of Artificial Sequence: Synthetic oligonucleotide
  Target: ATXN1; (+) strand; PAM type: YTN; PAM sequence: TTT
tatattaacaccctcataac

SEQ ID NO: 261070 - DNA, 20 bp, Artificial Sequence
  Description of Artificial Sequence: Synthetic oligonucleotide
  Target: ATXN1; (+) strand; PAM type: YTN; PAM sequence: TTT
atattaacaccctcataacc

SEQ ID NO: 261071 - DNA, 20 bp, Artificial Sequence
  Description of Artificial Sequence: Synthetic oligonucleotide
  Target: ATXN1; (+) strand; PAM type: YTN; PAM sequence: TTA
tattaacaccctcataaccc

SEQ ID NO: 261072 - DNA, 20 bp, Artificial Sequence
  Description of Artificial Sequence: Synthetic oligonucleotide
  Target: ATXN1; (+) strand; PAM type: YTN; PAM sequence: TTA
acaccctcataacccattaa

SEQ ID NO: 261073 - DNA, 20 bp, Artificial Sequence
  Description of Artificial Sequence: Synthetic oligonucleotide
  Target: ATXN1; (+) strand; PAM type: YTN; PAM sequence: CTC
ataacccattaaatcaatat

SEQ ID NO: 261074 - DNA, 20 bp, Artificial Sequence
  Description of Artificial Sequence: Synthetic oligonucleotide
  Target: ATXN1; (+) strand; PAM type: YTN; PAM sequence: TTA
aatcaatatttattgagcat

SEQ ID NO: 261075 - DNA, 20 bp, Artificial Sequence
  Description of Artificial Sequence: Synthetic oligonucleotide
  Target: ATXN1; (+) strand; PAM type: YTN; PAM sequence: TTT
attgagcatccatctgccag

SEQ ID NO: 261076 - DNA, 20 bp, Artificial Sequence
  Description of Artificial Sequence: Synthetic oligonucleotide
  Target: ATXN1; (+) strand; PAM type: YTN; PAM sequence: TTA
ttgagcatccatctgccagg

SEQ ID NO: 261077 - DNA, 20 bp, Artificial Sequence
  Description of Artificial Sequence: Synthetic oligonucleotide
  Target: ATXN1; (+) strand; PAM type: YTN; PAM sequence: TTG
agcatccatctgccaggcac

SEQ ID NO: 261078 - DNA, 20 bp, Artificial Sequence
  Description of Artificial Sequence: Synthetic oligonucleotide
  Target: ATXN1; (+) strand; PAM type: YTN; PAM sequence: CTG
ccaggcactgtactagatgc

SEQ ID NO: 261079 - DNA, 20 bp, Artificial Sequence
  Description of Artificial Sequence: Synthetic oligonucleotide
  Target: ATXN1; (+) strand; PAM type: YTN; PAM sequence: CTG
tactagatgctgacaaagac

SEQ ID NO: 261080 - DNA, 20 bp, Artificial Sequence
  Description of Artificial Sequence: Synthetic oligonucleotide
  Target: ATXN1; (+) strand; PAM type: YTN; PAM sequence: CTA
gatgctgacaaagacacccc

SEQ ID NO: 261081 - DNA, 20 bp, Artificial Sequence
  Description of Artificial Sequence: Synthetic oligonucleotide
  Target: ATXN1; (+) strand; PAM type: YTN; PAM sequence: CTG
acaaagacacccccaacaac

SEQ ID NO: 261082 - DNA, 20 bp, Artificial Sequence
  Description of Artificial Sequence: Synthetic oligonucleotide
  Target: ATXN1; (+) strand; PAM type: YTN; PAM sequence: TTA
cctatcctcatggaaataaa

SEQ ID NO: 261083 - DNA, 20 bp, Artificial Sequence
  Description of Artificial Sequence: Synthetic oligonucleotide
  Target: ATXN1; (+) strand; PAM type: YTN; PAM sequence: CTA
tcctcatggaaataaaagat

SEQ ID NO: 261084 - DNA, 20 bp, Artificial Sequence
  Description of Artificial Sequence: Synthetic oligonucleotide
  Target: ATXN1; (+) strand; PAM type: YTN; PAM sequence: CTC
atggaaataaaagatttata

SEQ ID NO: 261085 - DNA, 20 bp, Artificial Sequence
  Description of Artificial Sequence: Synthetic oligonucleotide
  Target: ATXN1; (+) strand; PAM type: YTN; PAM sequence: TTT
ataatgaagtattttccatt

SEQ ID NO: 261086 - DNA, 20 bp, Artificial Sequence
  Description of Artificial Sequence: Synthetic oligonucleotide
  Target: ATXN1; (+) strand; PAM type: YTN; PAM sequence: TTA
taatgaagtattttccatta

SEQ ID NO: 261087 - DNA, 20 bp, Artificial Sequence
  Description of Artificial Sequence: Synthetic oligonucleotide
  Target: ATXN1; (+) strand; PAM type: YTN; PAM sequence: TTT
tccattaaatggtgatagat

SEQ ID NO: 261088 - DNA, 20 bp, Artificial Sequence
  Description of Artificial Sequence: Synthetic oligonucleotide
  Target: ATXN1; (+) strand; PAM type: YTN; PAM sequence: TTT
ccattaaatggtgatagatg

SEQ ID NO: 261089 - DNA, 20 bp, Artificial Sequence
  Description of Artificial Sequence: Synthetic oligonucleotide
  Target: ATXN1; (+) strand; PAM type: YTN; PAM sequence: TTC
cattaaatggtgatagatgc

SEQ ID NO: 261090 - DNA, 20 bp, Artificial Sequence
  Description of Artificial Sequence: Synthetic oligonucleotide
  Target: ATXN1; (+) strand; PAM type: YTN; PAM sequence: TTA
aatggtgatagatgctaaaa

SEQ ID NO: 261091 - DNA, 20 bp, Artificial Sequence
  Description of Artificial Sequence: Synthetic oligonucleotide
  Target: ATXN1; (+) strand; PAM type: YTN; PAM sequence: CTA
aaaagttaagcagaaaaggg

SEQ ID NO: 261092 - DNA, 20 bp, Artificial Sequence
  Description of Artificial Sequence: Synthetic oligonucleotide
  Target: ATXN1; (+) strand; PAM type: YTN; PAM sequence: TTA
agcagaaaagggggctaggg

SEQ ID NO: 261093 - DNA, 20 bp, Artificial Sequence
  Description of Artificial Sequence: Synthetic oligonucleotide
  Target: ATXN1; (+) strand; PAM type: YTN; PAM sequence: CTA
gggtggtggtctggtgacca

SEQ ID NO: 261094 - DNA, 20 bp, Artificial Sequence
  Description of Artificial Sequence: Synthetic oligonucleotide
  Target: ATXN1; (+) strand; PAM type: YTN; PAM sequence: CTG
gtgaccattttttcaagctt

SEQ ID NO: 261095 - DNA, 20 bp, Artificial Sequence
  Description of Artificial Sequence: Synthetic oligonucleotide
  Target: ATXN1; (+) strand; PAM type: YTN; PAM sequence: TTT
tttcaagcttgtcagtcaaa

SEQ ID NO: 261096 - DNA, 20 bp, Artificial Sequence
  Description of Artificial Sequence: Synthetic oligonucleotide
  Target: ATXN1; (+) strand; PAM type: YTN; PAM sequence: TTT
ttcaagcttgtcagtcaaaa

SEQ ID NO: 261097 - DNA, 20 bp, Artificial Sequence
  Description of Artificial Sequence: Synthetic oligonucleotide
  Target: ATXN1; (+) strand; PAM type: YTN; PAM sequence: TTT
tcaagcttgtcagtcaaaaa

SEQ ID NO: 261098 - DNA, 20 bp, Artificial Sequence
  Description of Artificial Sequence: Synthetic oligonucleotide
  Target: ATXN1; (+) strand; PAM type: YTN; PAM sequence: TTT
caagcttgtcagtcaaaaaa

SEQ ID NO: 261099 - DNA, 20 bp, Artificial Sequence
  Description of Artificial Sequence: Synthetic oligonucleotide
  Target: ATXN1; (+) strand; PAM type: YTN; PAM sequence: TTC
aagcttgtcagtcaaaaaag

SEQ ID NO: 261100 - DNA, 20 bp, Artificial Sequence
  Description of Artificial Sequence: Synthetic oligonucleotide
  Target: ATXN1; (+) strand; PAM type: YTN; PAM sequence: CTT
gtcagtcaaaaaagacctca

SEQ ID NO: 261101 - DNA, 20 bp, Artificial Sequence
  Description of Artificial Sequence: Synthetic oligonucleotide
  Target: ATXN1; (+) strand; PAM type: YTN; PAM sequence: TTG
tcagtcaaaaaagacctcac

SEQ ID NO: 261102 - DNA, 20 bp, Artificial Sequence
  Description of Artificial Sequence: Synthetic oligonucleotide
  Target: ATXN1; (+) strand; PAM type: YTN; PAM sequence: CTC
acagagacagtaacttttgg

SEQ ID NO: 261103 - DNA, 20 bp, Artificial Sequence
  Description of Artificial Sequence: Synthetic oligonucleotide
  Target: ATXN1; (+) strand; PAM type: YTN; PAM sequence: CTT
ttggggaaaagcctgaagaa

SEQ ID NO: 261104 - DNA, 20 bp, Artificial Sequence
  Description of Artificial Sequence: Synthetic oligonucleotide
  Target: ATXN1; (+) strand; PAM type: YTN; PAM sequence: TTT
tggggaaaagcctgaagaaa

SEQ ID NO: 261105 - DNA, 20 bp, Artificial Sequence
  Description of Artificial Sequence: Synthetic oligonucleotide
  Target: ATXN1; (+) strand; PAM type: YTN; PAM sequence: TTT
ggggaaaagcctgaagaaag

SEQ ID NO: 261106 - DNA, 20 bp, Artificial Sequence
  Description of Artificial Sequence: Synthetic oligonucleotide
  Target: ATXN1; (+) strand; PAM type: YTN; PAM sequence: TTG
gggaaaagcctgaagaaagg

SEQ ID NO: 261107 - DNA, 20 bp, Artificial Sequence
  Description of Artificial Sequence: Synthetic oligonucleotide
  Target: ATXN1; (+) strand; PAM type: YTN; PAM sequence: CTG
aagaaagggaaatagaaagc

SEQ ID NO: 261108 - DNA, 20 bp, Artificial Sequence
  Description of Artificial Sequence: Synthetic oligonucleotide
  Target: ATXN1; (+) strand; PAM type: YTN; PAM sequence: CTG
ggggaagagccttcctgaca

SEQ ID NO: 261109 - DNA, 20 bp, Artificial Sequence
  Description of Artificial Sequence: Synthetic oligonucleotide
  Target: ATXN1; (+) strand; PAM type: YTN; PAM sequence: CTT
cctgacagaaagaacagaag

SEQ ID NO: 261110 - DNA, 20 bp, Artificial Sequence
  Description of Artificial Sequence: Synthetic oligonucleotide
  Target: ATXN1; (+) strand; PAM type: YTN; PAM sequence: TTC
ctgacagaaagaacagaagg

SEQ ID NO: 261111 - DNA, 20 bp, Artificial Sequence
  Description of Artificial Sequence: Synthetic oligonucleotide
  Target: ATXN1; (+) strand; PAM type: YTN; PAM sequence: CTG
acagaaagaacagaaggtac

SEQ ID NO: 261112 - DNA, 20 bp, Artificial Sequence
  Description of Artificial Sequence: Synthetic oligonucleotide
  Target: ATXN1; (+) strand; PAM type: YTN; PAM sequence: CTG
gggtgggctcctgtgtggtg

SEQ ID NO: 261113 - DNA, 20 bp, Artificial Sequence
  Description of Artificial Sequence: Synthetic oligonucleotide
  Target: ATXN1; (+) strand; PAM type: YTN; PAM sequence: CTC
ctgtgtggtgtgttggagga

SEQ ID NO: 261114 - DNA, 20 bp, Artificial Sequence
  Description of Artificial Sequence: Synthetic oligonucleotide
  Target: ATXN1; (+) strand; PAM type: YTN; PAM sequence: CTG
tgtggtgtgttggaggaaca

SEQ ID NO: 261115 - DNA, 20 bp, Artificial Sequence
  Description of Artificial Sequence: Synthetic oligonucleotide
  Target: ATXN1; (+) strand; PAM type: YTN; PAM sequence: TTG
gaggaacaccatcgaggtgg

SEQ ID NO: 261116 - DNA, 20 bp, Artificial Sequence
  Description of Artificial Sequence: Synthetic oligonucleotide
  Target: ATXN1; (+) strand; PAM type: YTN; PAM sequence: TTC
ctggcactgagtaaaggggg

SEQ ID NO: 261117 - DNA, 20 bp, Artificial Sequence
  Description of Artificial Sequence: Synthetic oligonucleotide
  Target: ATXN1; (+) strand; PAM type: YTN; PAM sequence: CTG
gcactgagtaaagggggtgg

SEQ ID NO: 261118 - DNA, 20 bp, Artificial Sequence
  Description of Artificial Sequence: Synthetic oligonucleotide
  Target: ATXN1; (+) strand; PAM type: YTN; PAM sequence: CTG
agtaaagggggtggggagca

SEQ ID NO: 261119 - DNA, 20 bp, Artificial Sequence
  Description of Artificial Sequence: Synthetic oligonucleotide
  Target: ATXN1; (+) strand; PAM type: YTN; PAM sequence: TTC
tttgagccacaataaagtct

SEQ ID NO: 261120 - DNA, 20 bp, Artificial Sequence
  Description of Artificial Sequence: Synthetic oligonucleotide
  Target: ATXN1; (+) strand; PAM type: YTN; PAM sequence: CTT
tgagccacaataaagtctga

SEQ ID NO: 261121 - DNA, 20 bp, Artificial Sequence
  Description of Artificial Sequence: Synthetic oligonucleotide
  Target: ATXN1; (+) strand; PAM type: YTN; PAM sequence: TTT
gagccacaataaagtctgag

SEQ ID NO: 261122 - DNA, 20 bp, Artificial Sequence
  Description of Artificial Sequence: Synthetic oligonucleotide
  Target: ATXN1; (+) strand; PAM type: YTN; PAM sequence: TTG
agccacaataaagtctgagg

SEQ ID NO: 261123 - DNA, 20 bp, Artificial Sequence
  Description of Artificial Sequence: Synthetic oligonucleotide
  Target: ATXN1; (+) strand; PAM type: YTN; PAM sequence: CTG
aggtccttactctgagtgag

SEQ ID NO: 261124 - DNA, 20 bp, Artificial Sequence
  Description of Artificial Sequence: Synthetic oligonucleotide
  Target: ATXN1; (+) strand; PAM type: YTN; PAM sequence: CTT
actctgagtgagctgagagg

SEQ ID NO: 261125 - DNA, 20 bp, Artificial Sequence
  Description of Artificial Sequence: Synthetic oligonucleotide
  Target: ATXN1; (+) strand; PAM type: YTN; PAM sequence: TTA
ctctgagtgagctgagaggc

SEQ ID NO: 261126 - DNA, 20 bp, Artificial Sequence
  Description of Artificial Sequence: Synthetic oligonucleotide
  Target: ATXN1; (+) strand; PAM type: YTN; PAM sequence: CTC
tgagtgagctgagaggcact

SEQ ID NO: 261127 - DNA, 20 bp, Artificial Sequence
  Description of Artificial Sequence: Synthetic oligonucleotide
  Target: ATXN1; (+) strand; PAM type: YTN; PAM sequence: CTG
agtgagctgagaggcactgg

SEQ ID NO: 261128 - DNA, 20 bp, Artificial Sequence
  Description of Artificial Sequence: Synthetic oligonucleotide
  Target: ATXN1; (+) strand; PAM type: YTN; PAM sequence: CTG
agaggcactggagggttttg

SEQ ID NO: 261129 - DNA, 20 bp, Artificial Sequence
  Description of Artificial Sequence: Synthetic oligonucleotide
  Target: ATXN1; (+) strand; PAM type: YTN; PAM sequence: CTG
gagggttttgatcagaggag

SEQ ID NO: 261130 - DNA, 20 bp, Artificial Sequence
  Description of Artificial Sequence: Synthetic oligonucleotide
  Target: ATXN1; (+) strand; PAM type: YTN; PAM sequence: TTT
tgatcagaggaggtacaggg

SEQ ID NO: 261131 - DNA, 20 bp, Artificial Sequence
  Description of Artificial Sequence: Synthetic oligonucleotide
  Target: ATXN1; (+) strand; PAM type: YTN; PAM sequence: TTT
gatcagaggaggtacagggt

SEQ ID NO: 261132 - DNA, 20 bp, Artificial Sequence
  Description of Artificial Sequence: Synthetic oligonucleotide
  Target: ATXN1; (+) strand; PAM type: YTN; PAM sequence: TTG
atcagaggaggtacagggtc

SEQ ID NO: 261133 - DNA, 20 bp, Artificial Sequence
  Description of Artificial Sequence: Synthetic oligonucleotide
  Target: ATXN1; (+) strand; PAM type: YTN; PAM sequence: CTG
gactacattttcaccagttc

SEQ ID NO: 261134 - DNA, 20 bp, Artificial Sequence
  Description of Artificial Sequence: Synthetic oligonucleotide
  Target: ATXN1; (+) strand; PAM type: YTN; PAM sequence: CTA
cattttcaccagttcatgct

SEQ ID NO: 261135 - DNA, 20 bp, Artificial Sequence
  Description of Artificial Sequence: Synthetic oligonucleotide
  Target: ATXN1; (+) strand; PAM type: YTN; PAM sequence: TTT
tcaccagttcatgctggctg

SEQ ID NO: 261136 - DNA, 20 bp, Artificial Sequence
  Description of Artificial Sequence: Synthetic oligonucleotide
  Target: ATXN1; (+) strand; PAM type: YTN; PAM sequence: TTT
caccagttcatgctggctgt

SEQ ID NO: 261137 - DNA, 20 bp, Artificial Sequence
  Description of Artificial Sequence: Synthetic oligonucleotide
  Target: ATXN1; (+) strand; PAM type: YTN; PAM sequence: TTC
accagttcatgctggctgtt

SEQ ID NO: 261138 - DNA, 20 bp, Artificial Sequence
  Description of Artificial Sequence: Synthetic oligonucleotide
  Target: ATXN1; (+) strand; PAM type: YTN; PAM sequence: TTC
atgctggctgttgcatggag

SEQ ID NO: 261139 - DNA, 20 bp, Artificial Sequence
  Description of Artificial Sequence: Synthetic oligonucleotide
  Target: ATXN1; (+) strand; PAM type: YTN; PAM sequence: CTG
gctgttgcatggaggagata

SEQ ID NO: 261140 - DNA, 20 bp, Artificial Sequence
  Description of Artificial Sequence: Synthetic oligonucleotide
  Target: ATXN1; (+) strand; PAM type: YTN; PAM sequence: CTG
ttgcatggaggagatattct

SEQ ID NO: 261141 - DNA, 20 bp, Artificial Sequence
  Description of Artificial Sequence: Synthetic oligonucleotide
  Target: ATXN1; (+) strand; PAM type: YTN; PAM sequence: TTG
catggaggagatattctgag

SEQ ID NO: 261142 - DNA, 20 bp, Artificial Sequence
  Description of Artificial Sequence: Synthetic oligonucleotide
  Target: ATXN1; (+) strand; PAM type: YTN; PAM sequence: TTC
tgagaagaagcagagagact

SEQ ID NO: 261143 - DNA, 20 bp, Artificial Sequence
  Description of Artificial Sequence: Synthetic oligonucleotide
  Target: ATXN1; (+) strand; PAM type: YTN; PAM sequence: CTG
agaagaagcagagagactac

SEQ ID NO: 261144 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggttactgatgaa

SEQ ID NO: 261145 - DNA, 20 bp, Artificial Sequence
  Description of Artificial Sequence: Synthetic oligonucleotide
  Target: ATXN1; (+) strand; PAM type: YTN; PAM sequence: CTC
aggaggttactgatgaactc

SEQ ID NO: 261146 - DNA, 20 bp, Artificial Sequence
  Description of Artificial Sequence: Synthetic oligonucleotide
  Target: ATXN1; (+) strand; PAM type: YTN; PAM sequence: TTA
ctgatgaactccagccaaga

SEQ ID NO: 261147 - DNA, 20 bp, Artificial Sequence
  Description of Artificial Sequence: Synthetic oligonucleotide
  Target: ATXN1; (+) strand; PAM type: YTN; PAM sequence: CTG
atgaactccagccaagagat

SEQ ID NO: 261148 - DNA, 20 bp, Artificial Sequence
  Description of Artificial Sequence: Synthetic oligonucleotide
  Target: ATXN1; (+) strand; PAM type: YTN; PAM sequence: CTC
cagccaagagatggtggcac

SEQ ID NO: 261149 - DNA, 20 bp, Artificial Sequence
  Description of Artificial Sequence: Synthetic oligonucleotide
  Target: ATXN1; (+) strand; PAM type: YTN; PAM sequence: TTG
tgtaggagaaaaagaggcat

SEQ ID NO: 261150 - DNA, 20 bp, Artificial Sequence
  Description of Artificial Sequence: Synthetic oligonucleotide
  Target: ATXN1; (+) strand; PAM type: YTN; PAM sequence: CTG
tggcctgagtaactggaagg

SEQ ID NO: 261151 - DNA, 20 bp, Artificial Sequence
  Description of Artificial Sequence: Synthetic oligonucleotide
  Target: ATXN1; (+) strand; PAM type: YTN; PAM sequence: CTG
agtaactggaaggagatggg

SEQ ID NO: 261152 - DNA, 20 bp, Artificial Sequence
  Description of Artificial Sequence: Synthetic oligonucleotide
  Target: ATXN1; (+) strand; PAM type: YTN; PAM sequence: CTG
gaaggagatgggaaggcagt

SEQ ID NO: 261153 - DNA, 20 bp, Artificial Sequence
  Description of Artificial Sequence: Synthetic oligonucleotide
  Target: ATXN1; (+) strand; PAM type: YTN; PAM sequence: TTG
gggtagaatatcaagagttc

SEQ ID NO: 261154 - DNA, 20 bp, Artificial Sequence
  Description of Artificial Sequence: Synthetic oligonucleotide
  Target: ATXN1; (+) strand; PAM type: YTN; PAM sequence: TTC
atcccactgaaggcagttaa

SEQ ID NO: 261155 - DNA, 20 bp, Artificial Sequence
  Description of Artificial Sequence: Synthetic oligonucleotide
  Target: ATXN1; (+) strand; PAM type: YTN; PAM sequence: CTG
aaggcagttaagagacagtg

SEQ ID NO: 261156 - DNA, 20 bp, Artificial Sequence
  Description of Artificial Sequence: Synthetic oligonucleotide
  Target: ATXN1; (+) strand; PAM type: YTN; PAM sequence: TTA
agagacagtgggatatgcaa

SEQ ID NO: 261157 - DNA, 20 bp, Artificial Sequence
  Description of Artificial Sequence: Synthetic oligonucleotide
  Target: ATXN1; (+) strand; PAM type: YTN; PAM sequence: CTG
aggttcaaagaaaaggccca

SEQ ID NO: 261158 - DNA, 20 bp, Artificial Sequence
  Description of Artificial Sequence: Synthetic oligonucleotide
  Target: ATXN1; (+) strand; PAM type: YTN; PAM sequence: TTC
aaagaaaaggcccaggctgg

SEQ ID NO: 261159 - DNA, 20 bp, Artificial Sequence
  Description of Artificial Sequence: Synthetic oligonucleotide
  Target: ATXN1; (+) strand; PAM type: YTN; PAM sequence: CTG
gagaaggtgtcagttttgag

SEQ ID NO: 261160 - DNA, 20 bp, Artificial Sequence
  Description of Artificial Sequence: Synthetic oligonucleotide
  Target: ATXN1; (+) strand; PAM type: YTN; PAM sequence: TTT
tgagatggtttgaaggcatc

SEQ ID NO: 261161 - DNA, 20 bp, Artificial Sequence
  Description of Artificial Sequence: Synthetic oligonucleotide
  Target: ATXN1; (+) strand; PAM type: YTN; PAM sequence: TTT
gagatggtttgaaggcatca

SEQ ID NO: 261162 - DNA, 20 bp, Artificial Sequence
  Description of Artificial Sequence: Synthetic oligonucleotide
  Target: ATXN1; (+) strand; PAM type: YTN; PAM sequence: TTG
agatggtttgaaggcatcaa

SEQ ID NO: 261163 - DNA, 20 bp, Artificial Sequence
  Description of Artificial Sequence: Synthetic oligonucleotide
  Target: ATXN1; (+) strand; PAM type: YTN; PAM sequence: TTT
gaaggcatcaacaaaaaaca

SEQ ID NO: 261164 - DNA, 20 bp, Artificial Sequence
  Description of Artificial Sequence: Synthetic oligonucleotide
  Target: ATXN1; (+) strand; PAM type: YTN; PAM sequence: TTG
aaggcatcaacaaaaaacag

SEQ ID NO: 261165 - DNA, 20 bp, Artificial Sequence
  Description of Artificial Sequence: Synthetic oligonucleotide
  Target: ATXN1; (+) strand; PAM type: YTN; PAM sequence: TTT
gaggactgagccctgaggct

SEQ ID NO: 261166 - DNA, 20 bp, Artificial Sequence
  Description of Artificial Sequence: Synthetic oligonucleotide
  Target: ATXN1; (+) strand; PAM type: YTN; PAM sequence: TTG
aggactgagccctgaggctc

SEQ ID NO: 261167 - DNA, 20 bp, Artificial Sequence
  Description of Artificial Sequence: Synthetic oligonucleotide
  Target: ATXN1; (+) strand; PAM type: YTN; PAM sequence: CTG
agccctgaggctctctcaca

SEQ ID NO: 261168 - DNA, 20 bp, Artificial Sequence
  Description of Artificial Sequence: Synthetic oligonucleotide
  Target: ATXN1; (+) strand; PAM type: YTN; PAM sequence: CTG
aggctctctcacatttggaa

SEQ ID NO: 261169 - DNA, 20 bp, Artificial Sequence
  Description of Artificial Sequence: Synthetic oligonucleotide
  Target: ATXN1; (+) strand; PAM type: YTN; PAM sequence: CTC
tctcacatttggaaaccaga

SEQ ID NO: 261170 - DNA, 20 bp, Artificial Sequence
  Description of Artificial Sequence: Synthetic oligonucleotide
  Target: ATXN1; (+) strand; PAM type: YTN; PAM sequence: CTC
tcacatttggaaaccagagg

SEQ ID NO: 261171 - DNA, 20 bp, Artificial Sequence
  Description of Artificial Sequence: Synthetic oligonucleotide
  Target: ATXN1; (+) strand; PAM type: YTN; PAM sequence: CTC
acatttggaaaccagaggct

SEQ ID NO: 261172 - DNA, 20 bp, Artificial Sequence
  Description of Artificial Sequence: Synthetic oligonucleotide
  Target: ATXN1; (+) strand; PAM type: YTN; PAM sequence: TTT
ggaaaccagaggctgctact

SEQ ID NO: 261173 - DNA, 20 bp, Artificial Sequence
  Description of Artificial Sequence: Synthetic oligonucleotide
  Target: ATXN1; (+) strand; PAM type: YTN; PAM sequence: TTG
gaaaccagaggctgctactt

SEQ ID NO: 261174 - DNA, 20 bp, Artificial Sequence
  Description of Artificial Sequence: Synthetic oligonucleotide
  Target: ATXN1; (+) strand; PAM type: YTN; PAM sequence: CTG
ctactttccgctactttcca

SEQ ID NO: 261175 - DNA, 20 bp, Artificial Sequence
  Description of Artificial Sequence: Synthetic oligonucleotide
  Target: ATXN1; (+) strand; PAM type: YTN; PAM sequence: CTA
ctttccgctactttccactc

SEQ ID NO: 261176 - DNA, 20 bp, Artificial Sequence
  Description of Artificial Sequence: Synthetic oligonucleotide
  Target: ATXN1; (+) strand; PAM type: YTN; PAM sequence: CTT
tccgctactttccactctga

SEQ ID NO: 261177 - DNA, 20 bp, Artificial Sequence
  Description of Artificial Sequence: Synthetic oligonucleotide
  Target: ATXN1; (+) strand; PAM type: YTN; PAM sequence: TTT
ccgctactttccactctgat

SEQ ID NO: 261178 - DNA, 20 bp, Artificial Sequence
  Description of Artificial Sequence: Synthetic oligonucleotide
  Target: ATXN1; (+) strand; PAM type: YTN; PAM sequence: TTC
cgctactttccactctgatt

SEQ ID NO: 261179 - DNA, 20 bp, Artificial Sequence
  Description of Artificial Sequence: Synthetic oligonucleotide
  Target: ATXN1; (+) strand; PAM type: YTN; PAM sequence: CTA
ctttccactctgattgttcc

SEQ ID NO: 261180 - DNA, 20 bp, Artificial Sequence
  Description of Artificial Sequence: Synthetic oligonucleotide
  Target: ATXN1; (+) strand; PAM type: YTN; PAM sequence: CTT
tccactctgattgttccact

SEQ ID NO: 261181 - DNA, 20 bp, Artificial Sequence
  Description of Artificial Sequence: Synthetic oligonucleotide
  Target: ATXN1; (+) strand; PAM type: YTN; PAM sequence: TTT
ccactctgattgttccactt

SEQ ID NO: 261182 - DNA, 20 bp, Artificial Sequence
  Description of Artificial Sequence: Synthetic oligonucleotide
  Target: ATXN1; (+) strand; PAM type: YTN; PAM sequence: TTC
cactctgattgttccacttg

SEQ ID NO: 261183 - DNA, 20 bp, Artificial Sequence
  Description of Artificial Sequence: Synthetic oligonucleotide
  Target: ATXN1; (+) strand; PAM type: YTN; PAM sequence: CTC
tgattgttccacttgtgatt

SEQ ID NO: 261184 - DNA, 20 bp, Artificial Sequence
  Description of Artificial Sequence: Synthetic oligonucleotide
  Target: ATXN1; (+) strand; PAM type: YTN; PAM sequence: CTG
attgttccacttgtgattag

SEQ ID NO: 261185 - DNA, 20 bp, Artificial Sequence
  Description of Artificial Sequence: Synthetic oligonucleotide
  Target: ATXN1; (+) strand; PAM type: YTN; PAM sequence: TTG
ttccacttgtgattaggctg

SEQ ID NO: 261186 - DNA, 20 bp, Artificial Sequence
  Description of Artificial Sequence: Synthetic oligonucleotide
  Target: ATXN1; (+) strand; PAM type: YTN; PAM sequence: TTC
cacttgtgattaggctgtat

SEQ ID NO: 261187 - DNA, 20 bp, Artificial Sequence
  Description of Artificial Sequence: Synthetic oligonucleotide
  Target: ATXN1; (+) strand; PAM type: YTN; PAM sequence: CTT
gtgattaggctgtatcggct

SEQ ID NO: 261188 - DNA, 20 bp, Artificial Sequence
  Description of Artificial Sequence: Synthetic oligonucleotide
  Target: ATXN1; (+) strand; PAM type: YTN; PAM sequence: TTG
tgattaggctgtatcggctg

SEQ ID NO: 261189 - DNA, 20 bp, Artificial Sequence
  Description of Artificial Sequence: Synthetic oligonucleotide
  Target: ATXN1; (+) strand; PAM type: YTN; PAM sequence: TTA
ggctgtatcggctgtgggtg

SEQ ID NO: 261190 - DNA, 20 bp, Artificial Sequence
  Description of Artificial Sequence: Synthetic oligonucleotide
  Target: ATXN1; (+) strand; PAM type: YTN; PAM sequence: CTG
tatcggctgtgggtgggagt

SEQ ID NO: 261191 - DNA, 20 bp, Artificial Sequence
  Description of Artificial Sequence: Synthetic oligonucleotide
  Target: ATXN1; (+) strand; PAM type: YTN; PAM sequence: CTG
tgggtgggagtgcgtatcag

SEQ ID NO: 261192 - DNA, 20 bp, Artificial Sequence
  Description of Artificial Sequence: Synthetic oligonucleotide
  Target: ATXN1; (+) strand; PAM type: YTN; PAM sequence: CTA
cttgatgcggataagttcca

SEQ ID NO: 261193 - DNA, 20 bp, Artificial Sequence
  Description of Artificial Sequence: Synthetic oligonucleotide
  Target: ATXN1; (+) strand; PAM type: YTN; PAM sequence: CTT
gatgcggataagttccatcc

SEQ ID NO: 261194 - DNA, 20 bp, Artificial Sequence
  Description of Artificial Sequence: Synthetic oligonucleotide
  Target: ATXN1; (+) strand; PAM type: YTN; PAM sequence: TTG
atgcggataagttccatcca

SEQ ID NO: 261195 - DNA, 20 bp, Artificial Sequence
  Description of Artificial Sequence: Synthetic oligonucleotide
  Target: ATXN1; (+) strand; PAM type: YTN; PAM sequence: TTC
catccactggcaaacccaaa

SEQ ID NO: 261196 - DNA, 20 bp, Artificial Sequence
  Description of Artificial Sequence: Synthetic oligonucleotide
  Target: ATXN1; (+) strand; PAM type: YTN; PAM sequence: CTG
gcaaacccaaaagctacaca

SEQ ID NO: 261197 - DNA, 20 bp, Artificial Sequence
  Description of Artificial Sequence: Synthetic oligonucleotide
  Target: ATXN1; (+) strand; PAM type: YTN; PAM sequence: CTA
cacatgtctacatgggaagg

SEQ ID NO: 261198 - DNA, 20 bp, Artificial Sequence
  Description of Artificial Sequence: Synthetic oligonucleotide
  Target: ATXN1; (+) strand; PAM type: YTN; PAM sequence: CTA
catgggaagggctgtgcggc

SEQ ID NO: 261199 - DNA, 20 bp, Artificial Sequence
  Description of Artificial Sequence: Synthetic oligonucleotide
  Target: ATXN1; (+) strand; PAM type: YTN; PAM sequence: CTG
tgcggcacaggtgcacagca

SEQ ID NO: 261200 - DNA, 20 bp, Artificial Sequence
  Description of Artificial Sequence: Synthetic oligonucleotide
  Target: ATXN1; (+) strand; PAM type: YTN; PAM sequence: CTC
agcgctcttcccctgatgtt

SEQ ID NO: 261201 - DNA, 20 bp, Artificial Sequence
  Description of Artificial Sequence: Synthetic oligonucleotide
  Target: ATXN1; (+) strand; PAM type: YTN; PAM sequence: CTC
ttcccctgatgtttctgctc

SEQ ID NO: 261202 - DNA, 20 bp, Artificial Sequence
  Description of Artificial Sequence: Synthetic oligonucleotide
  Target: ATXN1; (+) strand; PAM type: YTN; PAM sequence: CTT
cccctgatgtttctgctctt

SEQ ID NO: 261203 - DNA, 20 bp, Artificial Sequence
  Description of Artificial Sequence: Synthetic oligonucleotide
  Target: ATXN1; (+) strand; PAM type: YTN; PAM sequence: TTC
ccctgatgtttctgctcttc

SEQ ID NO: 261204 - DNA, 20 bp, Artificial Sequence
  Description of Artificial Sequence: Synthetic oligonucleotide
  Target: ATXN1; (+) strand; PAM type: YTN; PAM sequence: CTG
atgtttctgctcttcccatg

SEQ ID NO: 261205 - DNA, 20 bp, Artificial Sequence
  Description of Artificial Sequence: Synthetic oligonucleotide
  Target: ATXN1; (+) strand; PAM type: YTN; PAM sequence: TTT
ctgctcttcccatgcactaa

SEQ ID NO: 261206 - DNA, 20 bp, Artificial Sequence
  Description of Artificial Sequence: Synthetic oligonucleotide
  Target: ATXN1; (+) strand; PAM type: YTN; PAM sequence: TTC
tgctcttcccatgcactaag

SEQ ID NO: 261207 - DNA, 20 bp, Artificial Sequence
  Description of Artificial Sequence: Synthetic oligonucleotide
  Target: ATXN1; (+) strand; PAM type: YTN; PAM sequence: CTG
ctcttcccatgcactaagga

SEQ ID NO: 261208 - DNA, 20 bp, Artificial Sequence
  Description of Artificial Sequence: Synthetic oligonucleotide
  Target: ATXN1; (+) strand; PAM type: YTN; PAM sequence: CTC
ttcccatgcactaaggagct

SEQ ID NO: 261209 - DNA, 20 bp, Artificial Sequence
  Description of Artificial Sequence: Synthetic oligonucleotide
  Target: ATXN1; (+) strand; PAM type: YTN; PAM sequence: CTT
cccatgcactaaggagctga

SEQ ID NO: 261210 - DNA, 20 bp, Artificial Sequence
  Description of Artificial Sequence: Synthetic oligonucleotide
  Target: ATXN1; (+) strand; PAM type: YTN; PAM sequence: TTC
ccatgcactaaggagctgag

SEQ ID NO: 261211 - DNA, 20 bp, Artificial Sequence
  Description of Artificial Sequence: Synthetic oligonucleotide
  Target: ATXN1; (+) strand; PAM type: YTN; PAM sequence: CTA
aggagctgagcaaacagcaa

SEQ ID NO: 261212 - DNA, 20 bp, Artificial Sequence
  Description of Artificial Sequence: Synthetic oligonucleotide
  Target: ATXN1; (+) strand; PAM type: YTN; PAM sequence: CTG
agcaaacagcaagtcagaag

SEQ ID NO: 261213 - DNA, 20 bp, Artificial Sequence
  Description of Artificial Sequence: Synthetic oligonucleotide
  Target: ATXN1; (+) strand; PAM type: YTN; PAM sequence: CTG
ggaattaaaaggacaactta

SEQ ID NO: 261214 - DNA, 20 bp, Artificial Sequence
  Description of Artificial Sequence: Synthetic oligonucleotide
  Target: ATXN1; (+) strand; PAM type: YTN; PAM sequence: TTA
aaaggacaacttataacctt

SEQ ID NO: 261215 - DNA, 20 bp, Artificial Sequence
  Description of Artificial Sequence: Synthetic oligonucleotide
  Target: ATXN1; (+) strand; PAM type: YTN; PAM sequence: CTT
ataaccttactgttctgcca

SEQ ID NO: 261216 - DNA, 20 bp, Artificial Sequence
  Description of Artificial Sequence: Synthetic oligonucleotide
  Target: ATXN1; (+) strand; PAM type: YTN; PAM sequence: TTA
taaccttactgttctgccaa

SEQ ID NO: 261217 - DNA, 20 bp, Artificial Sequence
  Description of Artificial Sequence: Synthetic oligonucleotide
  Target: ATXN1; (+) strand; PAM type: YTN; PAM sequence: CTT
actgttctgccaaattccta

SEQ ID NO: 261218 - DNA, 20 bp, Artificial Sequence
  Description of Artificial Sequence: Synthetic oligonucleotide
  Target: ATXN1; (+) strand; PAM type: YTN; PAM sequence: TTA
ctgttctgccaaattcctac

SEQ ID NO: 261219 - DNA, 20 bp, Artificial Sequence
  Description of Artificial Sequence: Synthetic oligonucleotide
  Target: ATXN1; (+) strand; PAM type: YTN; PAM sequence: CTG
ttctgccaaattcctacaga

SEQ ID NO: 261220 - DNA, 20 bp, Artificial Sequence
  Description of Artificial Sequence: Synthetic oligonucleotide
  Target: ATXN1; (+) strand; PAM type: YTN; PAM sequence: TTC
tgccaaattcctacagaact

SEQ ID NO: 261221 - DNA, 20 bp, Artificial Sequence
  Description of Artificial Sequence: Synthetic oligonucleotide
  Target: ATXN1; (+) strand; PAM type: YTN; PAM sequence: CTG
ccaaattcctacagaactga

SEQ ID NO: 261222 - DNA, 20 bp, Artificial Sequence
  Description of Artificial Sequence: Synthetic oligonucleotide
  Target: ATXN1; (+) strand; PAM type: YTN; PAM sequence: TTC
ctacagaactgataagactc

SEQ ID NO: 261223 - DNA, 20 bp, Artificial Sequence
  Description of Artificial Sequence: Synthetic oligonucleotide
  Target: ATXN1; (+) strand; PAM type: YTN; PAM sequence: CTA
cagaactgataagactccct

SEQ ID NO: 261224 - DNA, 20 bp, Artificial Sequence
  Description of Artificial Sequence: Synthetic oligonucleotide
  Target: ATXN1; (+) strand; PAM type: YTN; PAM sequence: CTG
ataagactccctggatactt

SEQ ID NO: 261225 - DNA, 20 bp, Artificial Sequence
  Description of Artificial Sequence: Synthetic oligonucleotide
  Target: ATXN1; (+) strand; PAM type: YTN; PAM sequence: CTC
cctggatacttttgttgtat

SEQ ID NO: 261226 - DNA, 20 bp, Artificial Sequence
  Description of Artificial Sequence: Synthetic oligonucleotide
  Target: ATXN1; (+) strand; PAM type: YTN; PAM sequence: CTG
gatacttttgttgtattatt

SEQ ID NO: 261227 - DNA, 20 bp, Artificial Sequence
  Description of Artificial Sequence: Synthetic oligonucleotide
  Target: ATXN1; (+) strand; PAM type: YTN; PAM sequence: CTT
ttgttgtattattttctaac

SEQ ID NO: 261228 - DNA, 20 bp, Artificial Sequence
  Description of Artificial Sequence: Synthetic oligonucleotide
  Target: ATXN1; (+) strand; PAM type: YTN; PAM sequence: TTT
tgttgtattattttctaaca

SEQ ID NO: 261229 - DNA, 20 bp, Artificial Sequence
  Description of Artificial Sequence: Synthetic oligonucleotide
  Target: ATXN1; (+) strand; PAM type: YTN; PAM sequence: TTT
gttgtattattttctaacag

SEQ ID NO: 261230 - DNA, 20 bp, Artificial Sequence
  Description of Artificial Sequence: Synthetic oligonucleotide
  Target: ATXN1; (+) strand; PAM type: YTN; PAM sequence: TTG
ttgtattattttctaacaga

SEQ ID NO: 261231 - DNA, 20 bp, Artificial Sequence
  Description of Artificial Sequence: Synthetic oligonucleotide
  Target: ATXN1; (+) strand; PAM type: YTN; PAM sequence: TTG
tattattttctaacagaaaa

SEQ ID NO: 261232 - DNA, 20 bp, Artificial Sequence
  Description of Artificial Sequence: Synthetic oligonucleotide
  Target: ATXN1; (+) strand; PAM type: YTN; PAM sequence: TTA
ttttctaacagaaaacatag

SEQ ID NO: 261233 - DNA, 20 bp, Artificial Sequence
  Description of Artificial Sequence: Synthetic oligonucleotide
  Target: ATXN1; (+) strand; PAM type: YTN; PAM sequence: TTT
tctaacagaaaacatagata

SEQ ID NO: 261234 - DNA, 20 bp, Artificial Sequence
  Description of Artificial Sequence: Synthetic oligonucleotide
  Target: ATXN1; (+) strand; PAM type: YTN; PAM sequence: TTT
ctaacagaaaacatagataa

SEQ ID NO: 261235 - DNA, 20 bp, Artificial Sequence
  Description of Artificial Sequence: Synthetic oligonucleotide
  Target: ATXN1; (+) strand; PAM type: YTN; PAM sequence: TTC
taacagaaaacatagataat

SEQ ID NO: 261236 - DNA, 20 bp, Artificial Sequence
  Description of Artificial Sequence: Synthetic oligonucleotide
  Target: ATXN1; (+) strand; PAM type: YTN; PAM sequence: CTA
acagaaaacatagataatcc

SEQ ID NO: 261237 - DNA, 20 bp, Artificial Sequence
  Description of Artificial Sequence: Synthetic oligonucleotide
  Target: ATXN1; (+) strand; PAM type: YTN; PAM sequence: CTC
cttgtgtctcttcctgcttt

SEQ ID NO: 261238 - DNA, 20 bp, Artificial Sequence
  Description of Artificial Sequence: Synthetic oligonucleotide
  Target: ATXN1; (+) strand; PAM type: YTN; PAM sequence: CTT
gtgtctcttcctgctttaat

SEQ ID NO: 261239 - DNA, 20 bp, Artificial Sequence
  Description of Artificial Sequence: Synthetic oligonucleotide
  Target: ATXN1; (+) strand; PAM type: YTN; PAM sequence: TTG
tgtctcttcctgctttaatt

SEQ ID NO: 261240 - DNA, 20 bp, Artificial Sequence
  Description of Artificial Sequence: Synthetic oligonucleotide
  Target: ATXN1; (+) strand; PAM type: YTN; PAM sequence: CTC
ttcctgctttaattataatt

SEQ ID NO: 261241 - DNA, 20 bp, Artificial Sequence
  Description of Artificial Sequence: Synthetic oligonucleotide
  Target: ATXN1; (+) strand; PAM type: YTN; PAM sequence: CTT
cctgctttaattataatttg

SEQ ID NO: 261242 - DNA, 20 bp, Artificial Sequence
  Description of Artificial Sequence: Synthetic oligonucleotide
  Target: ATXN1; (+) strand; PAM type: YTN; PAM sequence: TTC
ctgctttaattataatttga

SEQ ID NO: 261243 - DNA, 20 bp, Artificial Sequence
  Description of Artificial Sequence: Synthetic oligonucleotide
  Target: ATXN1; (+) strand; PAM type: YTN; PAM sequence: CTG
ctttaattataatttgatta

SEQ ID NO: 261244 - DNA, 20 bp, Artificial Sequence
  Description of Artificial Sequence: Synthetic oligonucleotide
  Target: ATXN1; (+) strand; PAM type: YTN; PAM sequence: CTT
taattataatttgattaact

SEQ ID NO: 261245 - DNA, 20 bp, Artificial Sequence
  Description of Artificial Sequence: Synthetic oligonucleotide
  Target: ATXN1; (+) strand; PAM type: YTN; PAM sequence: TTT
aattataatttgattaactt

SEQ ID NO: 261246 - DNA, 20 bp, Artificial Sequence
  Description of Artificial Sequence: Synthetic oligonucleotide
  Target: ATXN1; (+) strand; PAM type: YTN; PAM sequence: TTA
attataatttgattaactta

SEQ ID NO: 261247 - DNA, 20 bp, Artificial Sequence
  Description of Artificial Sequence: Synthetic oligonucleotide
  Target: ATXN1; (+) strand; PAM type: YTN; PAM sequence: TTA
taatttgattaacttacaaa

SEQ ID NO: 261248 - DNA, 20 bp, Artificial Sequence
  Description of Artificial Sequence: Synthetic oligonucleotide
  Target: ATXN1; (+) strand; PAM type: YTN; PAM sequence: TTT
gattaacttacaaattattg

SEQ ID NO: 261249 - DNA, 20 bp, Artificial Sequence
  Description of Artificial Sequence: Synthetic oligonucleotide
  Target: ATXN1; (+) strand; PAM type: YTN; PAM sequence: TTG
attaacttacaaattattgg

SEQ ID NO: 261250 - DNA, 20 bp, Artificial Sequence
  Description of Artificial Sequence: Synthetic oligonucleotide
  Target: ATXN1; (+) strand; PAM type: YTN; PAM sequence: TTA
acttacaaattattggtatt

SEQ ID NO: 261251 - DNA, 20 bp, Artificial Sequence
  Description of Artificial Sequence: Synthetic oligonucleotide
  Target: ATXN1; (+) strand; PAM type: YTN; PAM sequence: CTT
acaaattattggtattccct

SEQ ID NO: 261252 - DNA, 20 bp, Artificial Sequence
  Description of Artificial Sequence: Synthetic oligonucleotide
  Target: ATXN1; (+) strand; PAM type: YTN; PAM sequence: TTA
caaattattggtattccctt

SEQ ID NO: 261253 - DNA, 20 bp, Artificial Sequence
  Description of Artificial Sequence: Synthetic oligonucleotide
  Target: ATXN1; (+) strand; PAM type: YTN; PAM sequence: TTA
ttggtattcccttttgttcc

SEQ ID NO: 261254 - DNA, 20 bp, Artificial Sequence
  Description of Artificial Sequence: Synthetic oligonucleotide
  Target: ATXN1; (+) strand; PAM type: YTN; PAM sequence: TTG
gtattcccttttgttccagc

SEQ ID NO: 261255 - DNA, 20 bp, Artificial Sequence
  Description of Artificial Sequence: Synthetic oligonucleotide
  Target: ATXN1; (+) strand; PAM type: YTN; PAM sequence: TTC
ccttttgttccagcccattt

SEQ ID NO: 261256 - DNA, 20 bp, Artificial Sequence
  Description of Artificial Sequence: Synthetic oligonucleotide
  Target: ATXN1; (+) strand; PAM type: YTN; PAM sequence: CTT
ttgttccagcccatttgagg

SEQ ID NO: 261257 - DNA, 20 bp, Artificial Sequence
  Description of Artificial Sequence: Synthetic oligonucleotide
  Target: ATXN1; (+) strand; PAM type: YTN; PAM sequence: TTT
tgttccagcccatttgagga

SEQ ID NO: 261258 - DNA, 20 bp, Artificial Sequence
  Description of Artificial Sequence: Synthetic oligonucleotide
  Target: ATXN1; (+) strand; PAM type: YTN; PAM sequence: TTT
gttccagcccatttgaggat

SEQ ID NO: 261259 - DNA, 20 bp, Artificial Sequence
  Description of Artificial Sequence: Synthetic oligonucleotide
  Target: ATXN1; (+) strand; PAM type: YTN; PAM sequence: TTG
ttccagcccatttgaggata

SEQ ID NO: 261260 - DNA, 20 bp, Artificial Sequence
  Description of Artificial Sequence: Synthetic oligonucleotide
  Target: ATXN1; (+) strand; PAM type: YTN; PAM sequence: TTC
cagcccatttgaggatataa

SEQ ID NO: 261261 - DNA, 20 bp, Artificial Sequence
  Description of Artificial Sequence: Synthetic oligonucleotide
  Target: ATXN1; (+) strand; PAM type: YTN; PAM sequence: TTT
gaggatataatttctcttca

SEQ ID NO: 261262 - DNA, 20 bp, Artificial Sequence
  Description of Artificial Sequence: Synthetic oligonucleotide
  Target: ATXN1; (+) strand; PAM type: YTN; PAM sequence: TTG
aggatataatttctcttcat

SEQ ID NO: 261263 - DNA, 20 bp, Artificial Sequence
  Description of Artificial Sequence: Synthetic oligonucleotide
  Target: ATXN1; (+) strand; PAM type: YTN; PAM sequence: TTT
ctcttcatctcttcctaaat

SEQ ID NO: 261264 - DNA, 20 bp, Artificial Sequence
  Description of Artificial Sequence: Synthetic oligonucleotide
  Target: ATXN1; (+) strand; PAM type: YTN; PAM sequence: TTC
tcttcatctcttcctaaatg

SEQ ID NO: 261265 - DNA, 20 bp, Artificial Sequence
  Description of Artificial Sequence: Synthetic oligonucleotide
  Target: ATXN1; (+) strand; PAM type: YTN; PAM sequence: CTC
ttcatctcttcctaaatgca

SEQ ID NO: 261266 - DNA, 20 bp, Artificial Sequence
  Description of Artificial Sequence: Synthetic oligonucleotide
  Target: ATXN1; (+) strand; PAM type: YTN; PAM sequence: CTT
catctcttcctaaatgcata

SEQ ID NO: 261267 - DNA, 20 bp, Artificial Sequence
  Description of Artificial Sequence: Synthetic oligonucleotide
  Target: ATXN1; (+) strand; PAM type: YTN; PAM sequence: TTC
atctcttcctaaatgcataa

SEQ ID NO: 261268 - DNA, 20 bp, Artificial Sequence
  Description of Artificial Sequence: Synthetic oligonucleotide
  Target: ATXN1; (+) strand; PAM type: YTN; PAM sequence: CTC
ttcctaaatgcataagttgg

SEQ ID NO: 261269 - DNA, 20 bp, Artificial Sequence
  Description of Artificial Sequence: Synthetic oligonucleotide
  Target: ATXN1; (+) strand; PAM type: YTN; PAM sequence: CTT
cctaaatgcataagttggct

SEQ ID NO: 261270 - DNA, 20 bp, Artificial Sequence
  Description of Artificial Sequence: Synthetic oligonucleotide
  Target: ATXN1; (+) strand; PAM type: YTN; PAM sequence: TTC
ctaaatgcataagttggctc

SEQ ID NO: 261271 - DNA, 20 bp, Artificial Sequence
  Description of Artificial Sequence: Synthetic oligonucleotide
  Target: ATXN1; (+) strand; PAM type: YTN; PAM sequence: CTA
aatgcataagttggctcagc

SEQ ID NO: 261272 - DNA, 20 bp, Artificial Sequence
  Description of Artificial Sequence: Synthetic oligonucleotide
  Target: ATXN1; (+) strand; PAM type: YTN; PAM sequence: TTG
gctcagcataaagtataatt

SEQ ID NO: 261273 - DNA, 20 bp, Artificial Sequence
  Description of Artificial Sequence: Synthetic oligonucleotide
  Target: ATXN1; (+) strand; PAM type: YTN; PAM sequence: CTC
agcataaagtataattactt

SEQ ID NO: 261274 - DNA, 20 bp, Artificial Sequence
  Description of Artificial Sequence: Synthetic oligonucleotide
  Target: ATXN1; (+) strand; PAM type: YTN; PAM sequence: TTA
cttgataaccatggaagcta

SEQ ID NO: 261275 - DNA, 20 bp, Artificial Sequence
  Description of Artificial Sequence: Synthetic oligonucleotide
  Target: ATXN1; (+) strand; PAM type: YTN; PAM sequence: CTT
gataaccatggaagctaggt

SEQ ID NO: 261276 - DNA, 20 bp, Artificial Sequence
  Description of Artificial Sequence: Synthetic oligonucleotide
  Target: ATXN1; (+) strand; PAM type: YTN; PAM sequence: TTG
ataaccatggaagctaggta

SEQ ID NO: 261277 - DNA, 20 bp, Artificial Sequence
  Description of Artificial Sequence: Synthetic oligonucleotide
  Target: ATXN1; (+) strand; PAM type: YTN; PAM sequence: CTA
ggtagcagagagtgtaagga

SEQ ID NO: 261278 - DNA, 20 bp, Artificial Sequence
  Description of Artificial Sequence: Synthetic oligonucleotide
  Target: ATXN1; (+) strand; PAM type: YTN; PAM sequence: CTT
cctgtattttgaaatgcact

SEQ ID NO: 261279 - DNA, 20 bp, Artificial Sequence
  Description of Artificial Sequence: Synthetic oligonucleotide
  Target: ATXN1; (+) strand; PAM type: YTN; PAM sequence: TTC
ctgtattttgaaatgcactg

SEQ ID NO: 261280 - DNA, 20 bp, Artificial Sequence
  Description of Artificial Sequence: Synthetic oligonucleotide
  Target: ATXN1; (+) strand; PAM type: YTN; PAM sequence: CTG
tattttgaaatgcactgtcc

SEQ ID NO: 261281 - DNA, 20 bp, Artificial Sequence
  Description of Artificial Sequence: Synthetic oligonucleotide
  Target: ATXN1; (+) strand; PAM type: YTN; PAM sequence: TTT
tgaaatgcactgtccatgga

SEQ ID NO: 261282 - DNA, 20 bp, Artificial Sequence
  Description of Artificial Sequence: Synthetic oligonucleotide
  Target: ATXN1; (+) strand; PAM type: YTN; PAM sequence: TTT
gaaatgcactgtccatggac

SEQ ID NO: 261283 - DNA, 20 bp, Artificial Sequence
  Description of Artificial Sequence: Synthetic oligonucleotide
  Target: ATXN1; (+) strand; PAM type: YTN; PAM sequence: TTG
aaatgcactgtccatggacc

SEQ ID NO: 261284 - DNA, 20 bp, Artificial Sequence
  Description of Artificial Sequence: Synthetic oligonucleotide
  Target: ATXN1; (+) strand; PAM type: YTN; PAM sequence: CTG
tccatggaccttgtctgggg

SEQ ID NO: 261285 - DNA, 20 bp, Artificial Sequence
  Description of Artificial Sequence: Synthetic oligonucleotide
  Target: ATXN1; (+) strand; PAM type: YTN; PAM sequence: CTT
gtctggggaagagggtgcca

SEQ ID NO: 261286 - DNA, 20 bp, Artificial Sequence
  Description of Artificial Sequence: Synthetic oligonucleotide
  Target: ATXN1; (+) strand; PAM type: YTN; PAM sequence: TTG
tctggggaagagggtgccac

SEQ ID NO: 261287 - DNA, 20 bp, Artificial Sequence
  Description of Artificial Sequence: Synthetic oligonucleotide
  Target: ATXN1; (+) strand; PAM type: YTN; PAM sequence: CTG
gggaagagggtgccacacta

SEQ ID NO: 261288 - DNA, 20 bp, Artificial Sequence
  Description of Artificial Sequence: Synthetic oligonucleotide
  Target: ATXN1; (+) strand; PAM type: YTN; PAM sequence: CTA
attctggccttggctactat

SEQ ID NO: 261289 - DNA, 20 bp, Artificial Sequence
  Description of Artificial Sequence: Synthetic oligonucleotide
  Target: ATXN1; (+) strand; PAM type: YTN; PAM sequence: TTC
tggccttggctactatgggt

SEQ ID NO: 261290 - DNA, 20 bp, Artificial Sequence
  Description of Artificial Sequence: Synthetic oligonucleotide
  Target: ATXN1; (+) strand; PAM type: YTN; PAM sequence: CTG
gccttggctactatgggtgt

SEQ ID NO: 261291 - DNA, 20 bp, Artificial Sequence
  Description of Artificial Sequence: Synthetic oligonucleotide
  Target: ATXN1; (+) strand; PAM type: YTN; PAM sequence: CTT
ggctactatgggtgttcaag

SEQ ID NO: 261292 - DNA, 20 bp, Artificial Sequence
  Description of Artificial Sequence: Synthetic oligonucleotide
  Target: ATXN1; (+) strand; PAM type: YTN; PAM sequence: TTG
gctactatgggtgttcaaga

SEQ ID NO: 261293 - DNA, 20 bp, Artificial Sequence
  Description of Artificial Sequence: Synthetic oligonucleotide
  Target: ATXN1; (+) strand; PAM type: YTN; PAM sequence: CTA
ctatgggtgttcaagaagca

SEQ ID NO: 261294 - DNA, 20 bp, Artificial Sequence
  Description of Artificial Sequence: Synthetic oligonucleotide
  Target: ATXN1; (+) strand; PAM type: YTN; PAM sequence: CTA
tgggtgttcaagaagcagca

SEQ ID NO: 261295 - DNA, 20 bp, Artificial Sequence
  Description of Artificial Sequence: Synthetic oligonucleotide
  Target: ATXN1; (+) strand; PAM type: YTN; PAM sequence: TTC
aagaagcagcatcatgcaat

SEQ ID NO: 261296 - DNA, 20 bp, Artificial Sequence
  Description of Artificial Sequence: Synthetic oligonucleotide
  Target: ATXN1; (+) strand; PAM type: YTN; PAM sequence: CTT
ctggtcgggacttcttatgg

SEQ ID NO: 261297 - DNA, 20 bp, Artificial Sequence
  Description of Artificial Sequence: Synthetic oligonucleotide
  Target: ATXN1; (+) strand; PAM type: YTN; PAM sequence: TTC
tggtcgggacttcttatggc

SEQ ID NO: 261298 - DNA, 20 bp, Artificial Sequence
  Description of Artificial Sequence: Synthetic oligonucleotide
  Target: ATXN1; (+) strand; PAM type: YTN; PAM sequence: CTG
gtcgggacttcttatggcag

SEQ ID NO: 261299 - DNA, 20 bp, Artificial Sequence
  Description of Artificial Sequence: Synthetic oligonucleotide
  Target: ATXN1; (+) strand; PAM type: YTN; PAM sequence: CTT
cttatggcagtggtccccaa

SEQ ID NO: 261300 - DNA, 20 bp, Artificial Sequence
  Description of Artificial Sequence: Synthetic oligonucleotide
  Target: ATXN1; (+) strand; PAM type: YTN; PAM sequence: TTC
ttatggcagtggtccccaaa

SEQ ID NO: 261301 - DNA, 20 bp, Artificial Sequence
  Description of Artificial Sequence: Synthetic oligonucleotide
  Target: ATXN1; (+) strand; PAM type: YTN; PAM sequence: CTT
atggcagtggtccccaaact

SEQ ID NO: 261302 - DNA, 20 bp, Artificial Sequence
  Description of Artificial Sequence: Synthetic oligonucleotide
  Target: ATXN1; (+) strand; PAM type: YTN; PAM sequence: TTA
tggcagtggtccccaaactt

SEQ ID NO: 261303 - DNA, 20 bp, Artificial Sequence
  Description of Artificial Sequence: Synthetic oligonucleotide
  Target: ATXN1; (+) strand; PAM type: YTN; PAM sequence: CTT
tttggcactggtccatgagg

SEQ ID NO: 261304 - DNA, 20 bp, Artificial Sequence
  Description of Artificial Sequence: Synthetic oligonucleotide
  Target: ATXN1; (+) strand; PAM type: YTN; PAM sequence: TTT
ttggcactggtccatgaggc

SEQ ID NO: 261305 - DNA, 20 bp, Artificial Sequence
  Description of Artificial Sequence: Synthetic oligonucleotide
  Target: ATXN1; (+) strand; PAM type: YTN; PAM sequence: TTT
tggcactggtccatgaggct

SEQ ID NO: 261306 - DNA, 20 bp, Artificial Sequence
  Description of Artificial Sequence: Synthetic oligonucleotide
  Target: ATXN1; (+) strand; PAM type: YTN; PAM sequence: TTT
ggcactggtccatgaggcta

SEQ ID NO: 261307 - DNA, 20 bp, Artificial Sequence
  Description of Artificial Sequence: Synthetic oligonucleotide
  Target: ATXN1; (+) strand; PAM type: YTN; PAM sequence: TTG
gcactggtccatgaggctag

SEQ ID NO: 261308 - DNA, 20 bp, Artificial Sequence
  Description of Artificial Sequence: Synthetic oligonucleotide
  Target: ATXN1; (+) strand; PAM type: YTN; PAM sequence: CTG
gtccatgaggctaggggtag

SEQ ID NO: 261309 - DNA, 20 bp, Artificial Sequence
  Description of Artificial Sequence: Synthetic oligonucleotide
  Target: ATXN1; (+) strand; PAM type: YTN; PAM sequence: CTA
ggggtagggggatcaggcat

SEQ ID NO: 261310 - DNA, 20 bp, Artificial Sequence
  Description of Artificial Sequence: Synthetic oligonucleotide
  Target: ATXN1; (+) strand; PAM type: YTN; PAM sequence: TTA
gattctcataaggaaggtac

SEQ ID NO: 261311 - DNA, 20 bp, Artificial Sequence
  Description of Artificial Sequence: Synthetic oligonucleotide
  Target: ATXN1; (+) strand; PAM type: YTN; PAM sequence: TTC
tcataaggaaggtacaacct

SEQ ID NO: 261312 - DNA, 20 bp, Artificial Sequence
  Description of Artificial Sequence: Synthetic oligonucleotide
  Target: ATXN1; (+) strand; PAM type: YTN; PAM sequence: CTC
ataaggaaggtacaacctag

SEQ ID NO: 261313 - DNA, 20 bp, Artificial Sequence
  Description of Artificial Sequence: Synthetic oligonucleotide
  Target: ATXN1; (+) strand; PAM type: YTN; PAM sequence: CTA
gatccctcacatgtgcagtt

SEQ ID NO: 261314 - DNA, 20 bp, Artificial Sequence
  Description of Artificial Sequence: Synthetic oligonucleotide
  Target: ATXN1; (+) strand; PAM type: YTN; PAM sequence: CTC
acatgtgcagttcacagtac

SEQ ID NO: 261315 - DNA, 20 bp, Artificial Sequence
  Description of Artificial Sequence: Synthetic oligonucleotide
  Target: ATXN1; (+) strand; PAM type: YTN; PAM sequence: TTC
acagtacggttcactttcct

SEQ ID NO: 261316 - DNA, 20 bp, Artificial Sequence
  Description of Artificial Sequence: Synthetic oligonucleotide
  Target: ATXN1; (+) strand; PAM type: YTN; PAM sequence: TTC
actttcctatgagaaagaat

SEQ ID NO: 261317 - DNA, 20 bp, Artificial Sequence
  Description of Artificial Sequence: Synthetic oligonucleotide
  Target: ATXN1; (+) strand; PAM type: YTN; PAM sequence: CTT
tcctatgagaaagaatctaa

SEQ ID NO: 261318 - DNA, 20 bp, Artificial Sequence
  Description of Artificial Sequence: Synthetic oligonucleotide
  Target: ATXN1; (+) strand; PAM type: YTN; PAM sequence: TTT
cctatgagaaagaatctaat

SEQ ID NO: 261319 - DNA, 20 bp, Artificial Sequence
  Description of Artificial Sequence: Synthetic oligonucleotide
  Target: ATXN1; (+) strand; PAM type: YTN; PAM sequence: TTC
ctatgagaaagaatctaatg

SEQ ID NO: 261320 - DNA, 20 bp, Artificial Sequence
  Description of Artificial Sequence: Synthetic oligonucleotide
  Target: ATXN1; (+) strand; PAM type: YTN; PAM sequence: CTA
tgagaaagaatctaatgctg

SEQ ID NO: 261321 - DNA, 20 bp, Artificial Sequence
  Description of Artificial Sequence: Synthetic oligonucleotide
  Target: ATXN1; (+) strand; PAM type: YTN; PAM sequence: CTA
atgctgccactgatctgaca

SEQ ID NO: 261322 - DNA, 20 bp, Artificial Sequence
  Description of Artificial Sequence: Synthetic oligonucleotide
  Target: ATXN1; (+) strand; PAM type: YTN; PAM sequence: CTG
ccactgatctgacaggaggt

SEQ ID NO: 261323 - DNA, 20 bp, Artificial Sequence
  Description of Artificial Sequence: Synthetic oligonucleotide
  Target: ATXN1; (+) strand; PAM type: YTN; PAM sequence: CTG
atctgacaggaggtggagct

SEQ ID NO: 261324 - DNA, 20 bp, Artificial Sequence
  Description of Artificial Sequence: Synthetic oligonucleotide
  Target: ATXN1; (+) strand; PAM type: YTN; PAM sequence: CTG
acaggaggtggagcttaggc

SEQ ID NO: 261325 - DNA, 20 bp, Artificial Sequence
  Description of Artificial Sequence: Synthetic oligonucleotide
  Target: ATXN1; (+) strand; PAM type: YTN; PAM sequence: CTT
aggctggctgagctggctaa

SEQ ID NO: 261326 - DNA, 20 bp, Artificial Sequence
  Description of Artificial Sequence: Synthetic oligonucleotide
  Target: ATXN1; (+) strand; PAM type: YTN; PAM sequence: TTA
ggctggctgagctggctaat

SEQ ID NO: 261327 - DNA, 20 bp, Artificial Sequence
  Description of Artificial Sequence: Synthetic oligonucleotide
  Target: ATXN1; (+) strand; PAM type: YTN; PAM sequence: CTG
gctgagctggctaatgccgg

SEQ ID NO: 261328 - DNA, 20 bp, Artificial Sequence
  Description of Artificial Sequence: Synthetic oligonucleotide
  Target: ATXN1; (+) strand; PAM type: YTN; PAM sequence: CTG
agctggctaatgccggctcg

SEQ ID NO: 261329 - DNA, 20 bp, Artificial Sequence
  Description of Artificial Sequence: Synthetic oligonucleotide
  Target: ATXN1; (+) strand; PAM type: YTN; PAM sequence: CTG
gctaatgccggctcgcctgc

SEQ ID NO: 261330 - DNA, 20 bp, Artificial Sequence
  Description of Artificial Sequence: Synthetic oligonucleotide
  Target: ATXN1; (+) strand; PAM type: YTN; PAM sequence: CTA
atgccggctcgcctgcctct

SEQ ID NO: 261331 - DNA, 20 bp, Artificial Sequence
  Description of Artificial Sequence: Synthetic oligonucleotide
  Target: ATXN1; (+) strand; PAM type: YTN; PAM sequence: CTC
gcctgcctctcacctactgg

SEQ ID NO: 261332 - DNA, 20 bp, Artificial Sequence
  Description of Artificial Sequence: Synthetic oligonucleotide
  Target: ATXN1; (+) strand; PAM type: YTN; PAM sequence: CTG
cctctcacctactggtgtgc

SEQ ID NO: 261333 - DNA, 20 bp, Artificial Sequence
  Description of Artificial Sequence: Synthetic oligonucleotide
  Target: ATXN1; (+) strand; PAM type: YTN; PAM sequence: CTC
tcacctactggtgtgccacc

SEQ ID NO: 261334 - DNA, 20 bp, Artificial Sequence
  Description of Artificial Sequence: Synthetic oligonucleotide
  Target: ATXN1; (+) strand; PAM type: YTN; PAM sequence: CTC
acctactggtgtgccaccca

SEQ ID NO: 261335 - DNA, 20 bp, Artificial Sequence
  Description of Artificial Sequence: Synthetic oligonucleotide
  Target: ATXN1; (+) strand; PAM type: YTN; PAM sequence: CTA
ctggtgtgccacccagttcc

SEQ ID NO: 261336 - DNA, 20 bp, Artificial Sequence
  Description of Artificial Sequence: Synthetic oligonucleotide
  Target: ATXN1; (+) strand; PAM type: YTN; PAM sequence: CTG
gtgtgccacccagttcctaa

SEQ ID NO: 261337 - DNA, 20 bp, Artificial Sequence
  Description of Artificial Sequence: Synthetic oligonucleotide
  Target: ATXN1; (+) strand; PAM type: YTN; PAM sequence: TTC
ctaacaggccacagacccat

SEQ ID NO: 261338 - DNA, 20 bp, Artificial Sequence
  Description of Artificial Sequence: Synthetic oligonucleotide
  Target: ATXN1; (+) strand; PAM type: YTN; PAM sequence: CTA
acaggccacagacccataat

SEQ ID NO: 261339 - DNA, 20 bp, Artificial Sequence
  Description of Artificial Sequence: Synthetic oligonucleotide
  Target: ATXN1; (+) strand; PAM type: YTN; PAM sequence: TTG
ggaacccctgtgttatagga

SEQ ID NO: 261340 - DNA, 20 bp, Artificial Sequence
  Description of Artificial Sequence: Synthetic oligonucleotide
  Target: ATXN1; (+) strand; PAM type: YTN; PAM sequence: CTG
tgttataggacctgacaccc

SEQ ID NO: 261341 - DNA, 20 bp, Artificial Sequence
  Description of Artificial Sequence: Synthetic oligonucleotide
  Target: ATXN1; (+) strand; PAM type: YTN; PAM sequence: TTA
taggacctgacacccaattt

SEQ ID NO: 261342 - DNA, 20 bp, Artificial Sequence
  Description of Artificial Sequence: Synthetic oligonucleotide
  Target: ATXN1; (+) strand; PAM type: YTN; PAM sequence: CTG
acacccaatttctgccatct

SEQ ID NO: 261343 - DNA, 20 bp, Artificial Sequence
  Description of Artificial Sequence: Synthetic oligonucleotide
  Target: ATXN1; (+) strand; PAM type: YTN; PAM sequence: TTT
ctgccatctgaaaagcaaag

SEQ ID NO: 261344 - DNA, 20 bp, Artificial Sequence
  Description of Artificial Sequence: Synthetic oligonucleotide
  Target: ATXN1; (+) strand; PAM type: YTN; PAM sequence: TTC
tgccatctgaaaagcaaaga

SEQ ID NO: 261345 - DNA, 20 bp, Artificial Sequence
  Description of Artificial Sequence: Synthetic oligonucleotide
  Target: ATXN1; (+) strand; PAM type: YTN; PAM sequence: CTG
ccatctgaaaagcaaagaaa

SEQ ID NO: 261346 - DNA, 20 bp, Artificial Sequence
  Description of Artificial Sequence: Synthetic oligonucleotide
  Target: ATXN1; (+) strand; PAM type: YTN; PAM sequence: CTG
aaaagcaaagaaagataaca

SEQ ID NO: 261347 - DNA, 20 bp, Artificial Sequence
  Description of Artificial Sequence: Synthetic oligonucleotide
  Target: ATXN1; (+) strand; PAM type: YTN; PAM sequence: CTC
tgttgactttttagcagaaa

SEQ ID NO: 261348 - DNA, 20 bp, Artificial Sequence
  Description of Artificial Sequence: Synthetic oligonucleotide
  Target: ATXN1; (+) strand; PAM type: YTN; PAM sequence: CTG
ttgactttttagcagaaata

SEQ ID NO: 261349 - DNA, 20 bp, Artificial Sequence
  Description of Artificial Sequence: Synthetic oligonucleotide
  Target: ATXN1; (+) strand; PAM type: YTN; PAM sequence: TTG
actttttagcagaaataaaa

SEQ ID NO: 261350 - DNA, 20 bp, Artificial Sequence
  Description of Artificial Sequence: Synthetic oligonucleotide
  Target: ATXN1; (+) strand; PAM type: YTN; PAM sequence: CTT
tttagcagaaataaaaattt

SEQ ID NO: 261351 - DNA, 20 bp, Artificial Sequence
  Description of Artificial Sequence: Synthetic oligonucleotide
  Target: ATXN1; (+) strand; PAM type: YTN; PAM sequence: TTT
ttagcagaaataaaaatttc

SEQ ID NO: 261352 - DNA, 20 bp, Artificial Sequence
  Description of Artificial Sequence: Synthetic oligonucleotide
  Target: ATXN1; (+) strand; PAM type: YTN; PAM sequence: TTT
tagcagaaataaaaatttct

SEQ ID NO: 261353 - DNA, 20 bp, Artificial Sequence
  Description of Artificial Sequence: Synthetic oligonucleotide
  Target: ATXN1; (+) strand; PAM type: YTN; PAM sequence: TTT
agcagaaataaaaatttctt

SEQ ID NO: 261354 - DNA, 20 bp, Artificial Sequence
  Description of Artificial Sequence: Synthetic oligonucleotide
  Target: ATXN1; (+) strand; PAM type: YTN; PAM sequence: TTA
gcagaaataaaaatttcttg

SEQ ID NO: 261355 - DNA, 20 bp, Artificial Sequence
  Description of Artificial Sequence: Synthetic oligonucleotide
  Target: ATXN1; (+) strand; PAM type: YTN; PAM sequence: TTT
cttgtttattttttctccat

SEQ ID NO: 261356 - DNA, 20 bp, Artificial Sequence
  Description of Artificial Sequence: Synthetic oligonucleotide
  Target: ATXN1; (+) strand; PAM type: YTN; PAM sequence: TTC
ttgtttattttttctccatt

SEQ ID NO: 261357 - DNA, 20 bp, Artificial Sequence
  Description of Artificial Sequence: Synthetic oligonucleotide
  Target: ATXN1; (+) strand; PAM type: YTN; PAM sequence: CTT
gtttattttttctccatttt

SEQ ID NO: 261358 - DNA, 20 bp, Artificial Sequence
  Description of Artificial Sequence: Synthetic oligonucleotide
  Target: ATXN1; (+) strand; PAM type: YTN; PAM sequence: TTG
tttattttttctccattttt

SEQ ID NO: 261359 - DNA, 20 bp, Artificial Sequence
  Description of Artificial Sequence: Synthetic oligonucleotide
  Target: ATXN1; (+) strand; PAM type: YTN; PAM sequence: TTT
attttttctccattttttaa

SEQ ID NO: 261360 - DNA, 20 bp, Artificial Sequence
  Description of Artificial Sequence: Synthetic oligonucleotide
  Target: ATXN1; (+) strand; PAM type: YTN; PAM sequence: TTA
ttttttctccattttttaat

SEQ ID NO: 261361 - DNA, 20 bp, Artificial Sequence
  Description of Artificial Sequence: Synthetic oligonucleotide
  Target: ATXN1; (+) strand; PAM type: YTN; PAM sequence: TTT
tttctccattttttaatcca

SEQ ID NO: 261362 - DNA, 20 bp, Artificial Sequence
  Description of Artificial Sequence: Synthetic oligonucleotide
  Target: ATXN1; (+) strand; PAM type: YTN; PAM sequence: TTT
ttctccattttttaatccaa

SEQ ID NO: 261363 - DNA, 20 bp, Artificial Sequence
  Description of Artificial Sequence: Synthetic oligonucleotide
  Target: ATXN1; (+) strand; PAM type: YTN; PAM sequence: TTT
tctccattttttaatccaaa

SEQ ID NO: 261364 - DNA, 20 bp, Artificial Sequence
  Description of Artificial Sequence: Synthetic oligonucleotide
  Target: ATXN1; (+) strand; PAM type: YTN; PAM sequence: TTT
ctccattttttaatccaaaa

SEQ ID NO: 261365 - DNA, 20 bp, Artificial Sequence
  Description of Artificial Sequence: Synthetic oligonucleotide
  Target: ATXN1; (+) strand; PAM type: YTN; PAM sequence: TTC
tccattttttaatccaaaat

SEQ ID NO: 261366 - DNA, 20 bp, Artificial Sequence
  Description of Artificial Sequence: Synthetic oligonucleotide
  Target: ATXN1; (+) strand; PAM type: YTN; PAM sequence: CTC
cattttttaatccaaaatat

SEQ ID NO: 261367 - DNA, 20 bp, Artificial Sequence
  Description of Artificial Sequence: Synthetic oligonucleotide
  Target: ATXN1; (+) strand; PAM type: YTN; PAM sequence: TTT
tttaatccaaaatattacaa

SEQ ID NO: 261368 - DNA, 20 bp, Artificial Sequence
  Description of Artificial Sequence: Synthetic oligonucleotide
  Target: ATXN1; (+) strand; PAM type: YTN; PAM sequence: TTT
ttaatccaaaatattacaac

SEQ ID NO: 261369 - DNA, 20 bp, Artificial Sequence
  Description of Artificial Sequence: Synthetic oligonucleotide
  Target: ATXN1; (+) strand; PAM type: YTN; PAM sequence: TTT
taatccaaaatattacaaca

SEQ ID NO: 261370 - DNA, 20 bp, Artificial Sequence
  Description of Artificial Sequence: Synthetic oligonucleotide
  Target: ATXN1; (+) strand; PAM type: YTN; PAM sequence: TTT
aatccaaaatattacaacac

SEQ ID NO: 261371 - DNA, 20 bp, Artificial Sequence
  Description of Artificial Sequence: Synthetic oligonucleotide
  Target: ATXN1; (+) strand; PAM type: YTN; PAM sequence: TTA
atccaaaatattacaacaca

SEQ ID NO: 261372 - DNA, 20 bp, Artificial Sequence
  Description of Artificial Sequence: Synthetic oligonucleotide
  Target: ATXN1; (+) strand; PAM type: YTN; PAM sequence: TTA
caacacataataggacacag

SEQ ID NO: 261373 - DNA, 20 bp, Artificial Sequence
  Description of Artificial Sequence: Synthetic oligonucleotide
  Target: ATXN1; (+) strand; PAM type: YTN; PAM sequence: CTG
aaataatacatttagtgcca

SEQ ID NO: 261374 - DNA, 20 bp, Artificial Sequence
  Description of Artificial Sequence: Synthetic oligonucleotide
  Target: ATXN1; (+) strand; PAM type: YTN; PAM sequence: TTT
agtgccagctttgagtcagg

SEQ ID NO: 261375 - DNA, 20 bp, Artificial Sequence
  Description of Artificial Sequence: Synthetic oligonucleotide
  Target: ATXN1; (+) strand; PAM type: YTN; PAM sequence: TTA
gtgccagctttgagtcaggt

SEQ ID NO: 261376 - DNA, 20 bp, Artificial Sequence
  Description of Artificial Sequence: Synthetic oligonucleotide
  Target: ATXN1; (+) strand; PAM type: YTN; PAM sequence: CTT
tgagtcaggtttcattgctg

SEQ ID NO: 261377 - DNA, 20 bp, Artificial Sequence
  Description of Artificial Sequence: Synthetic oligonucleotide
  Target: ATXN1; (+) strand; PAM type: YTN; PAM sequence: TTT
gagtcaggtttcattgctgt

SEQ ID NO: 261378 - DNA, 20 bp, Artificial Sequence
  Description of Artificial Sequence: Synthetic oligonucleotide
  Target: ATXN1; (+) strand; PAM type: YTN; PAM sequence: TTG
agtcaggtttcattgctgtc

SEQ ID NO: 261379 - DNA, 20 bp, Artificial Sequence
  Description of Artificial Sequence: Synthetic oligonucleotide
  Target: ATXN1; (+) strand; PAM type: YTN; PAM sequence: TTT
cattgctgtcaagagaaagg

SEQ ID NO: 261380 - DNA, 20 bp, Artificial Sequence
  Description of Artificial Sequence: Synthetic oligonucleotide
  Target: ATXN1; (+) strand; PAM type: YTN; PAM sequence: TTC
attgctgtcaagagaaaggt

SEQ ID NO: 261381 - DNA, 20 bp, Artificial Sequence
  Description of Artificial Sequence: Synthetic oligonucleotide
  Target: ATXN1; (+) strand; PAM type: YTN; PAM sequence: TTG
ctgtcaagagaaaggtaaag

SEQ ID NO: 261382 - DNA, 20 bp, Artificial Sequence
  Description of Artificial Sequence: Synthetic oligonucleotide
  Target: ATXN1; (+) strand; PAM type: YTN; PAM sequence: CTG
tcaagagaaaggtaaaggtg

SEQ ID NO: 261383 - DNA, 20 bp, Artificial Sequence
  Description of Artificial Sequence: Synthetic oligonucleotide
  Target: ATXN1; (+) strand; PAM type: YTN; PAM sequence: TTC
aatccatctcccttgtagac

SEQ ID NO: 261384 - DNA, 20 bp, Artificial Sequence
  Description of Artificial Sequence: Synthetic oligonucleotide
  Target: ATXN1; (+) strand; PAM type: YTN; PAM sequence: CTC
ccttgtagacagtaaatttt

SEQ ID NO: 261385 - DNA, 20 bp, Artificial Sequence
  Description of Artificial Sequence: Synthetic oligonucleotide
  Target: ATXN1; (+) strand; PAM type: YTN; PAM sequence: CTT
gtagacagtaaattttaatt

SEQ ID NO: 261386 - DNA, 20 bp, Artificial Sequence
  Description of Artificial Sequence: Synthetic oligonucleotide
  Target: ATXN1; (+) strand; PAM type: YTN; PAM sequence: TTG
tagacagtaaattttaatta

SEQ ID NO: 261387 - DNA, 20 bp, Artificial Sequence
  Description of Artificial Sequence: Synthetic oligonucleotide
  Target: ATXN1; (+) strand; PAM type: YTN; PAM sequence: TTT
taattagttttaattagaaa

SEQ ID NO: 261388 - DNA, 20 bp, Artificial Sequence
  Description of Artificial Sequence: Synthetic oligonucleotide
  Target: ATXN1; (+) strand; PAM type: YTN; PAM sequence: TTT
aattagttttaattagaaat

SEQ ID NO: 261389 - DNA, 20 bp, Artificial Sequence
  Description of Artificial Sequence: Synthetic oligonucleotide
  Target: ATXN1; (+) strand; PAM type: YTN; PAM sequence: TTA
attagttttaattagaaatg

SEQ ID NO: 261390 - DNA, 20 bp, Artificial Sequence
  Description of Artificial Sequence: Synthetic oligonucleotide
  Target: ATXN1; (+) strand; PAM type: YTN; PAM sequence: TTA
gttttaattagaaatgagaa

SEQ ID NO: 261391 - DNA, 20 bp, Artificial Sequence
  Description of Artificial Sequence: Synthetic oligonucleotide
  Target: ATXN1; (+) strand; PAM type: YTN; PAM sequence: TTT
taattagaaatgagaagtcc

SEQ ID NO: 261392 - DNA, 20 bp, Artificial Sequence
  Description of Artificial Sequence: Synthetic oligonucleotide
  Target: ATXN1; (+) strand; PAM type: YTN; PAM sequence: TTT
aattagaaatgagaagtcct

SEQ ID NO: 261393 - DNA, 20 bp, Artificial Sequence
  Description of Artificial Sequence: Synthetic oligonucleotide
  Target: ATXN1; (+) strand; PAM type: YTN; PAM sequence: TTA
attagaaatgagaagtccta

SEQ ID NO: 261394 - DNA, 20 bp, Artificial Sequence
  Description of Artificial Sequence: Synthetic oligonucleotide
  Target: ATXN1; (+) strand; PAM type: YTN; PAM sequence: TTA
gaaatgagaagtcctacacc

SEQ ID NO: 261395 - DNA, 20 bp, Artificial Sequence
  Description of Artificial Sequence: Synthetic oligonucleotide
  Target: ATXN1; (+) strand; PAM type: YTN; PAM sequence: CTA
cacctcatctctacaagtct

SEQ ID NO: 261396 - DNA, 20 bp, Artificial Sequence
  Description of Artificial Sequence: Synthetic oligonucleotide
  Target: ATXN1; (+) strand; PAM type: YTN; PAM sequence: CTC
atctctacaagtctcctgaa

SEQ ID NO: 261397 - DNA, 20 bp, Artificial Sequence
  Description of Artificial Sequence: Synthetic oligonucleotide
  Target: ATXN1; (+) strand; PAM type: YTN; PAM sequence: CTC
tacaagtctcctgaaacata

SEQ ID NO: 261398 - DNA, 20 bp, Artificial Sequence
  Description of Artificial Sequence: Synthetic oligonucleotide
  Target: ATXN1; (+) strand; PAM type: YTN; PAM sequence: CTA
caagtctcctgaaacatacc

SEQ ID NO: 261399 - DNA, 20 bp, Artificial Sequence
  Description of Artificial Sequence: Synthetic oligonucleotide
  Target: ATXN1; (+) strand; PAM type: YTN; PAM sequence: CTC
ctgaaacataccaagatatt

SEQ ID NO: 261400 - DNA, 20 bp, Artificial Sequence
  Description of Artificial Sequence: Synthetic oligonucleotide
  Target: ATXN1; (+) strand; PAM type: YTN; PAM sequence: CTG
aaacataccaagatattgtc

SEQ ID NO: 261401 - DNA, 20 bp, Artificial Sequence
  Description of Artificial Sequence: Synthetic oligonucleotide
  Target: ATXN1; (+) strand; PAM type: YTN; PAM sequence: TTG
tctttctgtagactcagagc

SEQ ID NO: 261402 - DNA, 20 bp, Artificial Sequence
  Description of Artificial Sequence: Synthetic oligonucleotide
  Target: ATXN1; (+) strand; PAM type: YTN; PAM sequence: CTT
tctgtagactcagagcacgt

SEQ ID NO: 261403 - DNA, 20 bp, Artificial Sequence
  Description of Artificial Sequence: Synthetic oligonucleotide
  Target: ATXN1; (+) strand; PAM type: YTN; PAM sequence: TTT
ctgtagactcagagcacgta

SEQ ID NO: 261404 - DNA, 20 bp, Artificial Sequence
  Description of Artificial Sequence: Synthetic oligonucleotide
  Target: ATXN1; (+) strand; PAM type: YTN; PAM sequence: TTC
tgtagactcagagcacgtat

SEQ ID NO: 261405 - DNA, 20 bp, Artificial Sequence
  Description of Artificial Sequence: Synthetic oligonucleotide
  Target: ATXN1; (+) strand; PAM type: YTN; PAM sequence: CTG
tagactcagagcacgtataa

SEQ ID NO: 261406 - DNA, 20 bp, Artificial Sequence
  Description of Artificial Sequence: Synthetic oligonucleotide
  Target: ATXN1; (+) strand; PAM type: YTN; PAM sequence: CTC
agagcacgtataatcagata

SEQ ID NO: 261407 - DNA, 20 bp, Artificial Sequence
  Description of Artificial Sequence: Synthetic oligonucleotide
  Target: ATXN1; (+) strand; PAM type: YTN; PAM sequence: CTG
gtccacttactgtttatatt

SEQ ID NO: 261408 - DNA, 20 bp, Artificial Sequence
  Description of Artificial Sequence: Synthetic oligonucleotide
  Target: ATXN1; (+) strand; PAM type: YTN; PAM sequence: CTT
actgtttatattgtatattt

SEQ ID NO: 261409 - DNA, 20 bp, Artificial Sequence
  Description of Artificial Sequence: Synthetic oligonucleotide
  Target: ATXN1; (+) strand; PAM type: YTN; PAM sequence: TTA
ctgtttatattgtatatttt

SEQ ID NO: 261410 - DNA, 20 bp, Artificial Sequence
  Description of Artificial Sequence: Synthetic oligonucleotide
  Target: ATXN1; (+) strand; PAM type: YTN; PAM sequence: CTG
tttatattgtatattttatc

SEQ ID NO: 261411 - DNA, 20 bp, Artificial Sequence
  Description of Artificial Sequence: Synthetic oligonucleotide
  Target: ATXN1; (+) strand; PAM type: YTN; PAM sequence: TTT
atattgtatattttatccaa

SEQ ID NO: 261412 - DNA, 20 bp, Artificial Sequence
  Description of Artificial Sequence: Synthetic oligonucleotide
  Target: ATXN1; (+) strand; PAM type: YTN; PAM sequence: TTA
tattgtatattttatccaag

SEQ ID NO: 261413 - DNA, 20 bp, Artificial Sequence
  Description of Artificial Sequence: Synthetic oligonucleotide
  Target: ATXN1; (+) strand; PAM type: YTN; PAM sequence: TTG
tatattttatccaagaatga

SEQ ID NO: 261414 - DNA, 20 bp, Artificial Sequence
  Description of Artificial Sequence: Synthetic oligonucleotide
  Target: ATXN1; (+) strand; PAM type: YTN; PAM sequence: TTT
tatccaagaatgatttatac

SEQ ID NO: 261415 - DNA, 20 bp, Artificial Sequence
  Description of Artificial Sequence: Synthetic oligonucleotide
  Target: ATXN1; (+) strand; PAM type: YTN; PAM sequence: TTT
atccaagaatgatttatacc

SEQ ID NO: 261416 - DNA, 20 bp, Artificial Sequence
  Description of Artificial Sequence: Synthetic oligonucleotide
  Target: ATXN1; (+) strand; PAM type: YTN; PAM sequence: TTA
tccaagaatgatttatacct

SEQ ID NO: 261417 - DNA, 20 bp, Artificial Sequence
  Description of Artificial Sequence: Synthetic oligonucleotide
  Target: ATXN1; (+) strand; PAM type: YTN; PAM sequence: TTT
atacctataaatccagccag

SEQ ID NO: 261418 - DNA, 20 bp, Artificial Sequence
  Description of Artificial Sequence: Synthetic oligonucleotide
  Target: ATXN1; (+) strand; PAM type: YTN; PAM sequence: TTA
tacctataaatccagccagg

SEQ ID NO: 261419 - DNA, 20 bp, Artificial Sequence
  Description of Artificial Sequence: Synthetic oligonucleotide
  Target: ATXN1; (+) strand; PAM type: YTN; PAM sequence: CTA
taaatccagccaggaggatc

SEQ ID NO: 261420 - DNA, 20 bp, Artificial Sequence
  Description of Artificial Sequence: Synthetic oligonucleotide
  Target: ATXN1; (+) strand; PAM type: YTN; PAM sequence: CTC
agaataatatttatgagata

SEQ ID NO: 261421 - DNA, 20 bp, Artificial Sequence
  Description of Artificial Sequence: Synthetic oligonucleotide
  Target: ATXN1; (+) strand; PAM type: YTN; PAM sequence: TTT
atgagatagactgaaattta

SEQ ID NO: 261422 - DNA, 20 bp, Artificial Sequence
  Description of Artificial Sequence: Synthetic oligonucleotide
  Target: ATXN1; (+) strand; PAM type: YTN; PAM sequence: TTA
tgagatagactgaaatttaa

SEQ ID NO: 261423 - DNA, 20 bp, Artificial Sequence
  Description of Artificial Sequence: Synthetic oligonucleotide
  Target: ATXN1; (+) strand; PAM type: YTN; PAM sequence: CTG
aaatttaatagcaacacttc

SEQ ID NO: 261424 - DNA, 20 bp, Artificial Sequence
  Description of Artificial Sequence: Synthetic oligonucleotide
  Target: ATXN1; (+) strand; PAM type: YTN; PAM sequence: TTT
aatagcaacacttcttaagt

SEQ ID NO: 261425 - DNA, 20 bp, Artificial Sequence
  Description of Artificial Sequence: Synthetic oligonucleotide
  Target: ATXN1; (+) strand; PAM type: YTN; PAM sequence: TTA
atagcaacacttcttaagta

SEQ ID NO: 261426 - DNA, 20 bp, Artificial Sequence
  Description of Artificial Sequence: Synthetic oligonucleotide
  Target: ATXN1; (+) strand; PAM type: YTN; PAM sequence: CTT
cttaagtagatggactatca

SEQ ID NO: 261427 - DNA, 20 bp, Artificial Sequence
  Description of Artificial Sequence: Synthetic oligonucleotide
  Target: ATXN1; (+) strand; PAM type: YTN; PAM sequence: TTC
ttaagtagatggactatcaa

SEQ ID NO: 261428 - DNA, 20 bp, Artificial Sequence
  Description of Artificial Sequence: Synthetic oligonucleotide
  Target: ATXN1; (+) strand; PAM type: YTN; PAM sequence: CTT
aagtagatggactatcaaga

SEQ ID NO: 261429 - DNA, 20 bp, Artificial Sequence
  Description of Artificial Sequence: Synthetic oligonucleotide
  Target: ATXN1; (+) strand; PAM type: YTN; PAM sequence: TTA
agtagatggactatcaagaa

SEQ ID NO: 261430 - DNA, 20 bp, Artificial Sequence
  Description of Artificial Sequence: Synthetic oligonucleotide
  Target: ATXN1; (+) strand; PAM type: YTN; PAM sequence: CTA
tcaagaaactcttaaaataa

SEQ ID NO: 261431 - DNA, 20 bp, Artificial Sequence
  Description of Artificial Sequence: Synthetic oligonucleotide
  Target: ATXN1; (+) strand; PAM type: YTN; PAM sequence: CTC
ttaaaataacagaatgaaaa

SEQ ID NO: 261432 - DNA, 20 bp, Artificial Sequence
  Description of Artificial Sequence: Synthetic oligonucleotide
  Target: ATXN1; (+) strand; PAM type: YTN; PAM sequence: CTT
aaaataacagaatgaaaaat

SEQ ID NO: 261433 - DNA, 20 bp, Artificial Sequence
  Description of Artificial Sequence: Synthetic oligonucleotide
  Target: ATXN1; (+) strand; PAM type: YTN; PAM sequence: TTA
aaataacagaatgaaaaata

SEQ ID NO: 261434 - DNA, 20 bp, Artificial Sequence
  Description of Artificial Sequence: Synthetic oligonucleotide
  Target: ATXN1; (+) strand; PAM type: YTN; PAM sequence: CTC
tgtatataagccccgtcagc

SEQ ID NO: 261435 - DNA, 20 bp, Artificial Sequence
  Description of Artificial Sequence: Synthetic oligonucleotide
  Target: ATXN1; (+) strand; PAM type: YTN; PAM sequence: CTG
tatataagccccgtcagcca

SEQ ID NO: 261436 - DNA, 20 bp, Artificial Sequence
  Description of Artificial Sequence: Synthetic oligonucleotide
  Target: ATXN1; (+) strand; PAM type: YTN; PAM sequence: CTC
gatcaatgccaaatgaagga

SEQ ID NO: 261437 - DNA, 20 bp, Artificial Sequence
  Description of Artificial Sequence: Synthetic oligonucleotide
  Target: ATXN1; (+) strand; PAM type: YTN; PAM sequence: CTT
cgtaagagggactaagaagc

SEQ ID NO: 261438 - DNA, 20 bp, Artificial Sequence
  Description of Artificial Sequence: Synthetic oligonucleotide
  Target: ATXN1; (+) strand; PAM type: YTN; PAM sequence: TTC
gtaagagggactaagaagca

SEQ ID NO: 261439 - DNA, 20 bp, Artificial Sequence
  Description of Artificial Sequence: Synthetic oligonucleotide
  Target: ATXN1; (+) strand; PAM type: YTN; PAM sequence: CTA
agaagcaattcaagttgcta

SEQ ID NO: 261440 - DNA, 20 bp, Artificial Sequence
  Description of Artificial Sequence: Synthetic oligonucleotide
  Target: ATXN1; (+) strand; PAM type: YTN; PAM sequence: TTC
aagttgctattctggaatct

SEQ ID NO: 261441 - DNA, 20 bp, Artificial Sequence
  Description of Artificial Sequence: Synthetic oligonucleotide
  Target: ATXN1; (+) strand; PAM type: YTN; PAM sequence: TTG
ctattctggaatctcttgtg

SEQ ID NO: 261442 - DNA, 20 bp, Artificial Sequence
  Description of Artificial Sequence: Synthetic oligonucleotide
  Target: ATXN1; (+) strand; PAM type: YTN; PAM sequence: CTA
ttctggaatctcttgtgtaa

SEQ ID NO: 261443 - DNA, 20 bp, Artificial Sequence
  Description of Artificial Sequence: Synthetic oligonucleotide
  Target: ATXN1; (+) strand; PAM type: YTN; PAM sequence: TTC
tggaatctcttgtgtaagat

SEQ ID NO: 261444 - DNA, 20 bp, Artificial Sequence
  Description of Artificial Sequence: Synthetic oligonucleotide
  Target: ATXN1; (+) strand; PAM type: YTN; PAM sequence: CTG
gaatctcttgtgtaagatgg

SEQ ID NO: 261445 - DNA, 20 bp, Artificial Sequence
  Description of Artificial Sequence: Synthetic oligonucleotide
  Target: ATXN1; (+) strand; PAM type: YTN; PAM sequence: CTC
ttgtgtaagatgggaatcaa

SEQ ID NO: 261446 - DNA, 20 bp, Artificial Sequence
  Description of Artificial Sequence: Synthetic oligonucleotide
  Target: ATXN1; (+) strand; PAM type: YTN; PAM sequence: CTT
gtgtaagatgggaatcaagt

SEQ ID NO: 261447 - DNA, 20 bp, Artificial Sequence
  Description of Artificial Sequence: Synthetic oligonucleotide
  Target: ATXN1; (+) strand; PAM type: YTN; PAM sequence: TTG
tgtaagatgggaatcaagtc

SEQ ID NO: 261448 - DNA, 20 bp, Artificial Sequence
  Description of Artificial Sequence: Synthetic oligonucleotide
  Target: ATXN1; (+) strand; PAM type: YTN; PAM sequence: CTA
acagagtcattaatagaatt

SEQ ID NO: 261449 - DNA, 20 bp, Artificial Sequence
  Description of Artificial Sequence: Synthetic oligonucleotide
  Target: ATXN1; (+) strand; PAM type: YTN; PAM sequence: TTA
atagaatttaataaggaaag

SEQ ID NO: 261450 - DNA, 20 bp, Artificial Sequence
  Description of Artificial Sequence: Synthetic oligonucleotide
  Target: ATXN1; (+) strand; PAM type: YTN; PAM sequence: TTT
aataaggaaagcttccaaaa

SEQ ID NO: 261451 - DNA, 20 bp, Artificial Sequence
  Description of Artificial Sequence: Synthetic oligonucleotide
  Target: ATXN1; (+) strand; PAM type: YTN; PAM sequence: TTA
ataaggaaagcttccaaaag

SEQ ID NO: 261452 - DNA, 20 bp, Artificial Sequence
  Description of Artificial Sequence: Synthetic oligonucleotide
  Target: ATXN1; (+) strand; PAM type: YTN; PAM sequence: CTT
ccaaaagaggaaactccaaa

SEQ ID NO: 261453 - DNA, 20 bp, Artificial Sequence
  Description of Artificial Sequence: Synthetic oligonucleotide
  Target: ATXN1; (+) strand; PAM type: YTN; PAM sequence: TTC
caaaagaggaaactccaaag

SEQ ID NO: 261454 - DNA, 20 bp, Artificial Sequence
  Description of Artificial Sequence: Synthetic oligonucleotide
  Target: ATXN1; (+) strand; PAM type: YTN; PAM sequence: CTC
caaagttaccctttcattac

SEQ ID NO: 261455 - DNA, 20 bp, Artificial Sequence
  Description of Artificial Sequence: Synthetic oligonucleotide
  Target: ATXN1; (+) strand; PAM type: YTN; PAM sequence: TTA
ccctttcattactgaatttc

SEQ ID NO: 261456 - DNA, 20 bp, Artificial Sequence
  Description of Artificial Sequence: Synthetic oligonucleotide
  Target: ATXN1; (+) strand; PAM type: YTN; PAM sequence: CTT
tcattactgaatttctcaga

SEQ ID NO: 261457 - DNA, 20 bp, Artificial Sequence
  Description of Artificial Sequence: Synthetic oligonucleotide
  Target: ATXN1; (+) strand; PAM type: YTN; PAM sequence: TTT
cattactgaatttctcagat

SEQ ID NO: 261458 - DNA, 20 bp, Artificial Sequence
  Description of Artificial Sequence: Synthetic oligonucleotide
  Target: ATXN1; (+) strand; PAM type: YTN; PAM sequence: TTC
attactgaatttctcagatt

SEQ ID NO: 261459 - DNA, 20 bp, Artificial Sequence
  Description of Artificial Sequence: Synthetic oligonucleotide
  Target: ATXN1; (+) strand; PAM type: YTN; PAM sequence: TTA
ctgaatttctcagattctca

SEQ ID NO: 261460 - DNA, 20 bp, Artificial Sequence
  Description of Artificial Sequence: Synthetic oligonucleotide
  Target: ATXN1; (+) strand; PAM type: YTN; PAM sequence: CTG
aatttctcagattctcagtg

SEQ ID NO: 261461 - DNA, 20 bp, Artificial Sequence
  Description of Artificial Sequence: Synthetic oligonucleotide
  Target: ATXN1; (+) strand; PAM type: YTN; PAM sequence: TTT
ctcagattctcagtggatct

SEQ ID NO: 261462 - DNA, 20 bp, Artificial Sequence
  Description of Artificial Sequence: Synthetic oligonucleotide
  Target: ATXN1; (+) strand; PAM type: YTN; PAM sequence: TTC
tcagattctcagtggatcta

SEQ ID NO: 261463 - DNA, 20 bp, Artificial Sequence
  Description of Artificial Sequence: Synthetic oligonucleotide
  Target: ATXN1; (+) strand; PAM type: YTN; PAM sequence: CTC
agattctcagtggatctaaa

SEQ ID NO: 261464 - DNA, 20 bp, Artificial Sequence
  Description of Artificial Sequence: Synthetic oligonucleotide
  Target: ATXN1; (+) strand; PAM type: YTN; PAM sequence: TTC
tcagtggatctaaatttaaa

SEQ ID NO: 261465 - DNA, 20 bp, Artificial Sequence
  Description of Artificial Sequence: Synthetic oligonucleotide
  Target: ATXN1; (+) strand; PAM type: YTN; PAM sequence: CTC
agtggatctaaatttaaact

SEQ ID NO: 261466 - DNA, 20 bp, Artificial Sequence
  Description of Artificial Sequence: Synthetic oligonucleotide
  Target: ATXN1; (+) strand; PAM type: YTN; PAM sequence: CTA
aatttaaactgcacaggaaa

SEQ ID NO: 261467 - DNA, 20 bp, Artificial Sequence
  Description of Artificial Sequence: Synthetic oligonucleotide
  Target: ATXN1; (+) strand; PAM type: YTN; PAM sequence: TTT
aaactgcacaggaaacaagg

SEQ ID NO: 261468 - DNA, 20 bp, Artificial Sequence
  Description of Artificial Sequence: Synthetic oligonucleotide
  Target: ATXN1; (+) strand; PAM type: YTN; PAM sequence: TTA
aactgcacaggaaacaaggc

SEQ ID NO: 261469 - DNA, 20 bp, Artificial Sequence
  Description of Artificial Sequence: Synthetic oligonucleotide
  Target: ATXN1; (+) strand; PAM type: YTN; PAM sequence: CTG
cacaggaaacaaggcccttt

SEQ ID NO: 261470 - DNA, 20 bp, Artificial Sequence
  Description of Artificial Sequence: Synthetic oligonucleotide
  Target: ATXN1; (+) strand; PAM type: YTN; PAM sequence: CTT
tgtcaaaaggtgctaaatct

SEQ ID NO: 261471 - DNA, 20 bp, Artificial Sequence
  Description of Artificial Sequence: Synthetic oligonucleotide
  Target: ATXN1; (+) strand; PAM type: YTN; PAM sequence: TTT
gtcaaaaggtgctaaatcta

SEQ ID NO: 261472 - DNA, 20 bp, Artificial Sequence
  Description of Artificial Sequence: Synthetic oligonucleotide
  Target: ATXN1; (+) strand; PAM type: YTN; PAM sequence: TTG
tcaaaaggtgctaaatctaa

SEQ ID NO: 261473 - DNA, 20 bp, Artificial Sequence
  Description of Artificial Sequence: Synthetic oligonucleotide
  Target: ATXN1; (+) strand; PAM type: YTN; PAM sequence: CTA
aatctaacctacactataag

SEQ ID NO: 261474 - DNA, 20 bp, Artificial Sequence
  Description of Artificial Sequence: Synthetic oligonucleotide
  Target: ATXN1; (+) strand; PAM type: YTN; PAM sequence: CTA
acctacactataagaagcac

SEQ ID NO: 261475 - DNA, 20 bp, Artificial Sequence
  Description of Artificial Sequence: Synthetic oligonucleotide
  Target: ATXN1; (+) strand; PAM type: YTN; PAM sequence: CTA
cactataagaagcacgtttg

SEQ ID NO: 261476 - DNA, 20 bp, Artificial Sequence
  Description of Artificial Sequence: Synthetic oligonucleotide
  Target: ATXN1; (+) strand; PAM type: YTN; PAM sequence: CTA
taagaagcacgtttgcccat

SEQ ID NO: 261477 - DNA, 20 bp, Artificial Sequence
  Description of Artificial Sequence: Synthetic oligonucleotide
  Target: ATXN1; (+) strand; PAM type: YTN; PAM sequence: TTT
gcccatcctgtgttccatgt

SEQ ID NO: 261478 - DNA, 20 bp, Artificial Sequence
  Description of Artificial Sequence: Synthetic oligonucleotide
  Target: ATXN1; (+) strand; PAM type: YTN; PAM sequence: TTG
cccatcctgtgttccatgtt

SEQ ID NO: 261479 - DNA, 20 bp, Artificial Sequence
  Description of Artificial Sequence: Synthetic oligonucleotide
  Target: ATXN1; (+) strand; PAM type: YTN; PAM sequence: CTG
tgttccatgttatgaagggc

SEQ ID NO: 261480 - DNA, 20 bp, Artificial Sequence
  Description of Artificial Sequence: Synthetic oligonucleotide
  Target: ATXN1; (+) strand; PAM type: YTN; PAM sequence: TTC
catgttatgaagggcctcca

SEQ ID NO: 261481 - DNA, 20 bp, Artificial Sequence
  Description of Artificial Sequence: Synthetic oligonucleotide
  Target: ATXN1; (+) strand; PAM type: YTN; PAM sequence: TTA
tgaagggcctccaagaattt

SEQ ID NO: 261482 - DNA, 20 bp, Artificial Sequence
  Description of Artificial Sequence: Synthetic oligonucleotide
  Target: ATXN1; (+) strand; PAM type: YTN; PAM sequence: CTC
caagaatttaaaaaggacaa

SEQ ID NO: 261483 - DNA, 20 bp, Artificial Sequence
  Description of Artificial Sequence: Synthetic oligonucleotide
  Target: ATXN1; (+) strand; PAM type: YTN; PAM sequence: TTT
aaaaaggacaaaatagaaaa

SEQ ID NO: 261484 - DNA, 20 bp, Artificial Sequence
  Description of Artificial Sequence: Synthetic oligonucleotide
  Target: ATXN1; (+) strand; PAM type: YTN; PAM sequence: TTA
aaaaggacaaaatagaaaaa

SEQ ID NO: 261485 - DNA, 20 bp, Artificial Sequence
  Description of Artificial Sequence: Synthetic oligonucleotide
  Target: ATXN1; (+) strand; PAM type: YTN; PAM sequence: TTC
ctttatagtattactatcta

SEQ ID NO: 261486 - DNA, 20 bp, Artificial Sequence
  Description of Artificial Sequence: Synthetic oligonucleotide
  Target: ATXN1; (+) strand; PAM type: YTN; PAM sequence: CTT
tatagtattactatctagct

SEQ ID NO: 261487 - DNA, 20 bp, Artificial Sequence
  Description of Artificial Sequence: Synthetic oligonucleotide
  Target: ATXN1; (+) strand; PAM type: YTN; PAM sequence: TTT
atagtattactatctagcta

SEQ ID NO: 261488 - DNA, 20 bp, Artificial Sequence
  Description of Artificial Sequence: Synthetic oligonucleotide
  Target: ATXN1; (+) strand; PAM type: YTN; PAM sequence: TTA
tagtattactatctagctac

SEQ ID NO: 261489 - DNA, 20 bp, Artificial Sequence
  Description of Artificial Sequence: Synthetic oligonucleotide
  Target: ATXN1; (+) strand; PAM type: YTN; PAM sequence: TTA
ctatctagctactaaaagcc

SEQ ID NO: 261490 - DNA, 20 bp, Artificial Sequence
  Description of Artificial Sequence: Synthetic oligonucleotide
  Target: ATXN1; (+) strand; PAM type: YTN; PAM sequence: CTA
tctagctactaaaagccaaa

SEQ ID NO: 261491 - DNA, 20 bp, Artificial Sequence
  Description of Artificial Sequence: Synthetic oligonucleotide
  Target: ATXN1; (+) strand; PAM type: YTN; PAM sequence: CTA
gctactaaaagccaaaaaga

SEQ ID NO: 261492 - DNA, 20 bp, Artificial Sequence
  Description of Artificial Sequence: Synthetic oligonucleotide
  Target: ATXN1; (+) strand; PAM type: YTN; PAM sequence: CTA
ctaaaagccaaaaagaaaaa

SEQ ID NO: 261493 - DNA, 20 bp, Artificial Sequence
  Description of Artificial Sequence: Synthetic oligonucleotide
  Target: ATXN1; (+) strand; PAM type: YTN; PAM sequence: CTA
aaagccaaaaagaaaaatgt

SEQ ID NO: 261494 - DNA, 20 bp, Artificial Sequence
  Description of Artificial Sequence: Synthetic oligonucleotide
  Target: ATXN1; (+) strand; PAM type: YTN; PAM sequence: TTT
ggcaactacatttgtaaagt

SEQ ID NO: 261495 - DNA, 20 bp, Artificial Sequence
  Description of Artificial Sequence: Synthetic oligonucleotide
  Target: ATXN1; (+) strand; PAM type: YTN; PAM sequence: TTG
gcaactacatttgtaaagtt

SEQ ID NO: 261496 - DNA, 20 bp, Artificial Sequence
  Description of Artificial Sequence: Synthetic oligonucleotide
  Target: ATXN1; (+) strand; PAM type: YTN; PAM sequence: CTA
catttgtaaagttataacaa

SEQ ID NO: 261497 - DNA, 20 bp, Artificial Sequence
  Description of Artificial Sequence: Synthetic oligonucleotide
  Target: ATXN1; (+) strand; PAM type: YTN; PAM sequence: TTT
gtaaagttataacaagccaa

SEQ ID NO: 261498 - DNA, 20 bp, Artificial Sequence
  Description of Artificial Sequence: Synthetic oligonucleotide
  Target: ATXN1; (+) strand; PAM type: YTN; PAM sequence: TTG
taaagttataacaagccaat

SEQ ID NO: 261499 - DNA, 20 bp, Artificial Sequence
  Description of Artificial Sequence: Synthetic oligonucleotide
  Target: ATXN1; (+) strand; PAM type: YTN; PAM sequence: TTA
taacaagccaattttcagag

SEQ ID NO: 261500 - DNA, 20 bp, Artificial Sequence
  Description of Artificial Sequence: Synthetic oligonucleotide
  Target: ATXN1; (+) strand; PAM type: YTN; PAM sequence: TTT
tcagagctagagacttcttt

SEQ ID NO: 261501 - DNA, 20 bp, Artificial Sequence
  Description of Artificial Sequence: Synthetic oligonucleotide
  Target: ATXN1; (+) strand; PAM type: YTN; PAM sequence: TTT
cagagctagagacttctttt

SEQ ID NO: 261502 - DNA, 20 bp, Artificial Sequence
  Description of Artificial Sequence: Synthetic oligonucleotide
  Target: ATXN1; (+) strand; PAM type: YTN; PAM sequence: TTC
agagctagagacttcttttc

SEQ ID NO: 261503 - DNA, 20 bp, Artificial Sequence
  Description of Artificial Sequence: Synthetic oligonucleotide
  Target: ATXN1; (+) strand; PAM type: YTN; PAM sequence: CTA
gagacttcttttcgcggggg

SEQ ID NO: 261504 - DNA, 20 bp, Artificial Sequence
  Description of Artificial Sequence: Synthetic oligonucleotide
  Target: ATXN1; (+) strand; PAM type: YTN; PAM sequence: CTT
cttttcgcgggggggggggg

SEQ ID NO: 261505 - DNA, 20 bp, Artificial Sequence
  Description of Artificial Sequence: Synthetic oligonucleotide
  Target: ATXN1; (+) strand; PAM type: YTN; PAM sequence: TTC
ttttcgcggggggggggggg

SEQ ID NO: 261506 - DNA, 20 bp, Artificial Sequence
  Description of Artificial Sequence: Synthetic oligonucleotide
  Target: ATXN1; (+) strand; PAM type: YTN; PAM sequence: CTT
ttcgcggggggggggggggg

SEQ ID NO: 261507 - DNA, 20 bp, Artificial Sequence
  Description of Artificial Sequence: Synthetic oligonucleotide
  Target: ATXN1; (+) strand; PAM type: YTN; PAM sequence: TTT
tcgcgggggggggggggggg

SEQ ID NO: 261508 - DNA, 20 bp, Artificial Sequence
  Description of Artificial Sequence: Synthetic oligonucleotide
  Target: ATXN1; (+) strand; PAM type: YTN; PAM sequence: TTT
cgcggggggggggggggggg

SEQ ID NO: 261509 - DNA, 20 bp, Artificial Sequence
  Description of Artificial Sequence: Synthetic oligonucleotide
  Target: ATXN1; (+) strand; PAM type: YTN; PAM sequence: TTC
gcgggggggggggggggggg

SEQ ID NO: 261510 - DNA, 20 bp, Artificial Sequence
  Description of Artificial Sequence: Synthetic oligonucleotide
  Target: ATXN1; (+) strand; PAM type: YTN; PAM sequence: TTG
gggtggggtggggatgctga

SEQ ID NO: 261511 - DNA, 20 bp, Artificial Sequence
  Description of Artificial Sequence: Synthetic oligonucleotide
  Target: ATXN1; (+) strand; PAM type: YTN; PAM sequence: CTG
acatcagaatgtgtaccaga

SEQ ID NO: 261512 - DNA, 20 bp, Artificial Sequence
  Description of Artificial Sequence: Synthetic oligonucleotide
  Target: ATXN1; (+) strand; PAM type: YTN; PAM sequence: CTC
aggggttttttttcagcctc

SEQ ID NO: 261513 - DNA, 20 bp, Artificial Sequence
  Description of Artificial Sequence: Synthetic oligonucleotide
  Target: ATXN1; (+) strand; PAM type: YTN; PAM sequence: TTT
tttttcagcctcagagctac

SEQ ID NO: 261514 - DNA, 20 bp, Artificial Sequence
  Description of Artificial Sequence: Synthetic oligonucleotide
  Target: ATXN1; (+) strand; PAM type: YTN; PAM sequence: TTT
ttttcagcctcagagctacc

SEQ ID NO: 261515 - DNA, 20 bp, Artificial Sequence
  Description of Artificial Sequence: Synthetic oligonucleotide
  Target: ATXN1; (+) strand; PAM type: YTN; PAM sequence: TTT
tttcagcctcagagctacca

SEQ ID NO: 261516 - DNA, 20 bp, Artificial Sequence
  Description of Artificial Sequence: Synthetic oligonucleotide
  Target: ATXN1; (+) strand; PAM type: YTN; PAM sequence: TTT
ttcagcctcagagctaccat

SEQ ID NO: 261517 - DNA, 20 bp, Artificial Sequence
  Description of Artificial Sequence: Synthetic oligonucleotide
  Target: ATXN1; (+) strand; PAM type: YTN; PAM sequence: TTT
tcagcctcagagctaccatt

SEQ ID NO: 261518 - DNA, 20 bp, Artificial Sequence
  Description of Artificial Sequence: Synthetic oligonucleotide
  Target: ATXN1; (+) strand; PAM type: YTN; PAM sequence: TTT
cagcctcagagctaccattt

SEQ ID NO: 261519 - DNA, 20 bp, Artificial Sequence
  Description of Artificial Sequence: Synthetic oligonucleotide
  Target: ATXN1; (+) strand; PAM type: YTN; PAM sequence: TTC
agcctcagagctaccattta

SEQ ID NO: 261520 - DNA, 20 bp, Artificial Sequence
  Description of Artificial Sequence: Synthetic oligonucleotide
  Target: ATXN1; (+) strand; PAM type: YTN; PAM sequence: CTC
agagctaccatttactcagc

SEQ ID NO: 261521 - DNA, 20 bp, Artificial Sequence
  Description of Artificial Sequence: Synthetic oligonucleotide
  Target: ATXN1; (+) strand; PAM type: YTN; PAM sequence: CTA
ccatttactcagcgtccagc

SEQ ID NO: 261522 - DNA, 20 bp, Artificial Sequence
  Description of Artificial Sequence: Synthetic oligonucleotide
  Target: ATXN1; (+) strand; PAM type: YTN; PAM sequence: TTT
actcagcgtccagcgtccta

SEQ ID NO: 261523 - DNA, 20 bp, Artificial Sequence
  Description of Artificial Sequence: Synthetic oligonucleotide
  Target: ATXN1; (+) strand; PAM type: YTN; PAM sequence: TTA
ctcagcgtccagcgtcctaa

SEQ ID NO: 261524 - DNA, 20 bp, Artificial Sequence
  Description of Artificial Sequence: Synthetic oligonucleotide
  Target: ATXN1; (+) strand; PAM type: YTN; PAM sequence: CTC
agcgtccagcgtcctaacca

SEQ ID NO: 261525 - DNA, 20 bp, Artificial Sequence
  Description of Artificial Sequence: Synthetic oligonucleotide
  Target: ATXN1; (+) strand; PAM type: YTN; PAM sequence: CTA
accaagcctaaacttgatct

SEQ ID NO: 261526 - DNA, 20 bp, Artificial Sequence
  Description of Artificial Sequence: Synthetic oligonucleotide
  Target: ATXN1; (+) strand; PAM type: YTN; PAM sequence: CTA
aacttgatctaaattgtgtc

SEQ ID NO: 261527 - DNA, 20 bp, Artificial Sequence
  Description of Artificial Sequence: Synthetic oligonucleotide
  Target: ATXN1; (+) strand; PAM type: YTN; PAM sequence: CTT
gatctaaattgtgtcttttg

SEQ ID NO: 261528 - DNA, 20 bp, Artificial Sequence
  Description of Artificial Sequence: Synthetic oligonucleotide
  Target: ATXN1; (+) strand; PAM type: YTN; PAM sequence: TTG
atctaaattgtgtcttttga

SEQ ID NO: 261529 - DNA, 20 bp, Artificial Sequence
  Description of Artificial Sequence: Synthetic oligonucleotide
  Target: ATXN1; (+) strand; PAM type: YTN; PAM sequence: CTA
aattgtgtcttttgatgaat

SEQ ID NO: 261530 - DNA, 20 bp, Artificial Sequence
  Description of Artificial Sequence: Synthetic oligonucleotide
  Target: ATXN1; (+) strand; PAM type: YTN; PAM sequence: TTG
tgtcttttgatgaattagta

SEQ ID NO: 261531 - DNA, 20 bp, Artificial Sequence
  Description of Artificial Sequence: Synthetic oligonucleotide
  Target: ATXN1; (+) strand; PAM type: YTN; PAM sequence: CTT
ttgatgaattagtagtggtt

SEQ ID NO: 261532 - DNA, 20 bp, Artificial Sequence
  Description of Artificial Sequence: Synthetic oligonucleotide
  Target: ATXN1; (+) strand; PAM type: YTN; PAM sequence: TTT
tgatgaattagtagtggttg

SEQ ID NO: 261533 - DNA, 20 bp, Artificial Sequence
  Description of Artificial Sequence: Synthetic oligonucleotide
  Target: ATXN1; (+) strand; PAM type: YTN; PAM sequence: TTT
gatgaattagtagtggttgg

SEQ ID NO: 261534 - DNA, 20 bp, Artificial Sequence
  Description of Artificial Sequence: Synthetic oligonucleotide
  Target: ATXN1; (+) strand; PAM type: YTN; PAM sequence: TTG
atgaattagtagtggttggt

SEQ ID NO: 261535 - DNA, 20 bp, Artificial Sequence
  Description of Artificial Sequence: Synthetic oligonucleotide
  Target: ATXN1; (+) strand; PAM type: YTN; PAM sequence: TTA
gtagtggttggtttcatact

SEQ ID NO: 261536 - DNA, 20 bp, Artificial Sequence
  Description of Artificial Sequence: Synthetic oligonucleotide
  Target: ATXN1; (+) strand; PAM type: YTN; PAM sequence: TTG
gtttcatactgtgttaattt

SEQ ID NO: 261537 - DNA, 20 bp, Artificial Sequence
  Description of Artificial Sequence: Synthetic oligonucleotide
  Target: ATXN1; (+) strand; PAM type: YTN; PAM sequence: TTT
catactgtgttaatttggaa

SEQ ID NO: 261538 - DNA, 20 bp, Artificial Sequence
  Description of Artificial Sequence: Synthetic oligonucleotide
  Target: ATXN1; (+) strand; PAM type: YTN; PAM sequence: TTC
atactgtgttaatttggaaa

SEQ ID NO: 261539 - DNA, 20 bp, Artificial Sequence
  Description of Artificial Sequence: Synthetic oligonucleotide
  Target: ATXN1; (+) strand; PAM type: YTN; PAM sequence: CTG
tgttaatttggaaaagatac

SEQ ID NO: 261540 - DNA, 20 bp, Artificial Sequence
  Description of Artificial Sequence: Synthetic oligonucleotide
  Target: ATXN1; (+) strand; PAM type: YTN; PAM sequence: TTA
atttggaaaagatacgtgta

SEQ ID NO: 261541 - DNA, 20 bp, Artificial Sequence
  Description of Artificial Sequence: Synthetic oligonucleotide
  Target: ATXN1; (+) strand; PAM type: YTN; PAM sequence: TTT
ggaaaagatacgtgtattaa

SEQ ID NO: 261542 - DNA, 20 bp, Artificial Sequence
  Description of Artificial Sequence: Synthetic oligonucleotide
  Target: ATXN1; (+) strand; PAM type: YTN; PAM sequence: TTG
gaaaagatacgtgtattaat

SEQ ID NO: 261543 - DNA, 20 bp, Artificial Sequence
  Description of Artificial Sequence: Synthetic oligonucleotide
  Target: ATXN1; (+) strand; PAM type: YTN; PAM sequence: TTA
attttattttctacatatgt

SEQ ID NO: 261544 - DNA, 20 bp, Artificial Sequence
  Description of Artificial Sequence: Synthetic oligonucleotide
  Target: ATXN1; (+) strand; PAM type: YTN; PAM sequence: TTT
tattttctacatatgttaaa

SEQ ID NO: 261545 - DNA, 20 bp, Artificial Sequence
  Description of Artificial Sequence: Synthetic oligonucleotide
  Target: ATXN1; (+) strand; PAM type: YTN; PAM sequence: TTT
attttctacatatgttaaac

SEQ ID NO: 261546 - DNA, 20 bp, Artificial Sequence
  Description of Artificial Sequence: Synthetic oligonucleotide
  Target: ATXN1; (+) strand; PAM type: YTN; PAM sequence: TTA
ttttctacatatgttaaaca

SEQ ID NO: 261547 - DNA, 20 bp, Artificial Sequence
  Description of Artificial Sequence: Synthetic oligonucleotide
  Target: ATXN1; (+) strand; PAM type: YTN; PAM sequence: TTT
tctacatatgttaaacaaat

SEQ ID NO: 261548 - DNA, 20 bp, Artificial Sequence
  Description of Artificial Sequence: Synthetic oligonucleotide
  Target: ATXN1; (+) strand; PAM type: YTN; PAM sequence: TTT
ctacatatgttaaacaaata

SEQ ID NO: 261549 - DNA, 20 bp, Artificial Sequence
  Description of Artificial Sequence: Synthetic oligonucleotide
  Target: ATXN1; (+) strand; PAM type: YTN; PAM sequence: TTC
tacatatgttaaacaaataa

SEQ ID NO: 261550 - DNA, 20 bp, Artificial Sequence
  Description of Artificial Sequence: Synthetic oligonucleotide
  Target: ATXN1; (+) strand; PAM type: YTN; PAM sequence: CTA
catatgttaaacaaataaaa

SEQ ID NO: 261551 - DNA, 20 bp, Artificial Sequence
  Description of Artificial Sequence: Synthetic oligonucleotide
  Target: ATXN1; (+) strand; PAM type: YTN; PAM sequence: TTA
aacaaataaaaaattgagct

SEQ ID NO: 261552 - DNA, 20 bp, Artificial Sequence
  Description of Artificial Sequence: Synthetic oligonucleotide
  Target: ATXN1; (+) strand; PAM type: YTN; PAM sequence: TTG
agcttgttttgtttttcaaa

SEQ ID NO: 261553 - DNA, 20 bp, Artificial Sequence
  Description of Artificial Sequence: Synthetic oligonucleotide
  Target: ATXN1; (+) strand; PAM type: YTN; PAM sequence: CTT
gttttgtttttcaaagcact

SEQ ID NO: 261554 - DNA, 20 bp, Artificial Sequence
  Description of Artificial Sequence: Synthetic oligonucleotide
  Target: ATXN1; (+) strand; PAM type: YTN; PAM sequence: TTG
ttttgtttttcaaagcactt

SEQ ID NO: 261555 - DNA, 20 bp, Artificial Sequence
  Description of Artificial Sequence: Synthetic oligonucleotide
  Target: ATXN1; (+) strand; PAM type: YTN; PAM sequence: TTT
tgtttttcaaagcactttgt

SEQ ID NO: 261556 - DNA, 20 bp, Artificial Sequence
  Description of Artificial Sequence: Synthetic oligonucleotide
  Target: ATXN1; (+) strand; PAM type: YTN; PAM sequence: TTT
gtttttcaaagcactttgta

SEQ ID NO: 261557 - DNA, 20 bp, Artificial Sequence
  Description of Artificial Sequence: Synthetic oligonucleotide
  Target: ATXN1; (+) strand; PAM type: YTN; PAM sequence: TTG
tttttcaaagcactttgtag

SEQ ID NO: 261558 - DNA, 20 bp, Artificial Sequence
  Description of Artificial Sequence: Synthetic oligonucleotide
  Target: ATXN1; (+) strand; PAM type: YTN; PAM sequence: TTT
ttcaaagcactttgtagttt

SEQ ID NO: 261559 - DNA, 20 bp, Artificial Sequence
  Description of Artificial Sequence: Synthetic oligonucleotide
  Target: ATXN1; (+) strand; PAM type: YTN; PAM sequence: TTT
tcaaagcactttgtagtttt

SEQ ID NO: 261560 - DNA, 20 bp, Artificial Sequence
  Description of Artificial Sequence: Synthetic oligonucleotide
  Target: ATXN1; (+) strand; PAM type: YTN; PAM sequence: TTT
caaagcactttgtagttttc

SEQ ID NO: 261561 - DNA, 20 bp, Artificial Sequence
  Description of Artificial Sequence: Synthetic oligonucleotide
  Target: ATXN1; (+) strand; PAM type: YTN; PAM sequence: TTC
aaagcactttgtagttttct

SEQ ID NO: 261562 - DNA, 20 bp, Artificial Sequence
  Description of Artificial Sequence: Synthetic oligonucleotide
  Target: ATXN1; (+) strand; PAM type: YTN; PAM sequence: CTT
tgtagttttcttgtccctaa

SEQ ID NO: 261563 - DNA, 20 bp, Artificial Sequence
  Description of Artificial Sequence: Synthetic oligonucleotide
  Target: ATXN1; (+) strand; PAM type: YTN; PAM sequence: TTT
gtagttttcttgtccctaaa

SEQ ID NO: 261564 - DNA, 20 bp, Artificial Sequence
  Description of Artificial Sequence: Synthetic oligonucleotide
  Target: ATXN1; (+) strand; PAM type: YTN; PAM sequence: TTG
tagttttcttgtccctaaaa

SEQ ID NO: 261565 - DNA, 20 bp, Artificial Sequence
  Description of Artificial Sequence: Synthetic oligonucleotide
  Target: ATXN1; (+) strand; PAM type: YTN; PAM sequence: TTT
tcttgtccctaaaaagtatt

SEQ ID NO: 261566 - DNA, 20 bp, Artificial Sequence
  Description of Artificial Sequence: Synthetic oligonucleotide
  Target: ATXN1; (+) strand; PAM type: YTN; PAM sequence: TTT
cttgtccctaaaaagtattt

SEQ ID NO: 261567 - DNA, 20 bp, Artificial Sequence
  Description of Artificial Sequence: Synthetic oligonucleotide
  Target: ATXN1; (+) strand; PAM type: YTN; PAM sequence: TTC
ttgtccctaaaaagtattta

SEQ ID NO: 261568 - DNA, 20 bp, Artificial Sequence
  Description of Artificial Sequence: Synthetic oligonucleotide
  Target: ATXN1; (+) strand; PAM type: YTN; PAM sequence: CTT
gtccctaaaaagtatttact

SEQ ID NO: 261569 - DNA, 20 bp, Artificial Sequence
  Description of Artificial Sequence: Synthetic oligonucleotide
  Target: ATXN1; (+) strand; PAM type: YTN; PAM sequence: TTG
tccctaaaaagtatttacta

SEQ ID NO: 261570 - DNA, 20 bp, Artificial Sequence
  Description of Artificial Sequence: Synthetic oligonucleotide
  Target: ATXN1; (+) strand; PAM type: YTN; PAM sequence: CTA
aaaagtatttactaaaaatc

SEQ ID NO: 261571 - DNA, 20 bp, Artificial Sequence
  Description of Artificial Sequence: Synthetic oligonucleotide
  Target: ATXN1; (+) strand; PAM type: YTN; PAM sequence: TTT
actaaaaatctgtgaccgaa

SEQ ID NO: 261572 - DNA, 20 bp, Artificial Sequence
  Description of Artificial Sequence: Synthetic oligonucleotide
  Target: ATXN1; (+) strand; PAM type: YTN; PAM sequence: TTA
ctaaaaatctgtgaccgaaa

SEQ ID NO: 261573 - DNA, 20 bp, Artificial Sequence
  Description of Artificial Sequence: Synthetic oligonucleotide
  Target: ATXN1; (+) strand; PAM type: YTN; PAM sequence: CTA
aaaatctgtgaccgaaatca

SEQ ID NO: 261574 - DNA, 20 bp, Artificial Sequence
  Description of Artificial Sequence: Synthetic oligonucleotide
  Target: ATXN1; (+) strand; PAM type: YTN; PAM sequence: CTG
tgaccgaaatcaaacttttc

SEQ ID NO: 261575 - DNA, 20 bp, Artificial Sequence
  Description of Artificial Sequence: Synthetic oligonucleotide
  Target: ATXN1; (+) strand; PAM type: YTN; PAM sequence: CTT
ttcattttgaagtatttgag

SEQ ID NO: 261576 - DNA, 20 bp, Artificial Sequence
  Description of Artificial Sequence: Synthetic oligonucleotide
  Target: ATXN1; (+) strand; PAM type: YTN; PAM sequence: TTT
tcattttgaagtatttgagg

SEQ ID NO: 261577 - DNA, 20 bp, Artificial Sequence
  Description of Artificial Sequence: Synthetic oligonucleotide
  Target: ATXN1; (+) strand; PAM type: YTN; PAM sequence: TTT
cattttgaagtatttgaggt

SEQ ID NO: 261578 - DNA, 20 bp, Artificial Sequence
  Description of Artificial Sequence: Synthetic oligonucleotide
  Target: ATXN1; (+) strand; PAM type: YTN; PAM sequence: TTC
attttgaagtatttgaggtt

SEQ ID NO: 261579 - DNA, 20 bp, Artificial Sequence
  Description of Artificial Sequence: Synthetic oligonucleotide
  Target: ATXN1; (+) strand; PAM type: YTN; PAM sequence: TTT
tgaagtatttgaggtttaat

SEQ ID NO: 261580 - DNA, 20 bp, Artificial Sequence
  Description of Artificial Sequence: Synthetic oligonucleotide
  Target: ATXN1; (+) strand; PAM type: YTN; PAM sequence: TTT
gaagtatttgaggtttaatc

SEQ ID NO: 261581 - DNA, 20 bp, Artificial Sequence
  Description of Artificial Sequence: Synthetic oligonucleotide
  Target: ATXN1; (+) strand; PAM type: YTN; PAM sequence: TTG
aagtatttgaggtttaatcc

SEQ ID NO: 261582 - DNA, 20 bp, Artificial Sequence
  Description of Artificial Sequence: Synthetic oligonucleotide
  Target: ATXN1; (+) strand; PAM type: YTN; PAM sequence: TTT
gaggtttaatccagaggcat

SEQ ID NO: 261583 - DNA, 20 bp, Artificial Sequence
  Description of Artificial Sequence: Synthetic oligonucleotide
  Target: ATXN1; (+) strand; PAM type: YTN; PAM sequence: TTG
aggtttaatccagaggcata

SEQ ID NO: 261584 - DNA, 20 bp, Artificial Sequence
  Description of Artificial Sequence: Synthetic oligonucleotide
  Target: ATXN1; (+) strand; PAM type: YTN; PAM sequence: TTT
aatccagaggcatagtattt

SEQ ID NO: 261585 - DNA, 20 bp, Artificial Sequence
  Description of Artificial Sequence: Synthetic oligonucleotide
  Target: ATXN1; (+) strand; PAM type: YTN; PAM sequence: TTA
atccagaggcatagtattta

SEQ ID NO: 261586 - DNA, 20 bp, Artificial Sequence
  Description of Artificial Sequence: Synthetic oligonucleotide
  Target: ATXN1; (+) strand; PAM type: YTN; PAM sequence: TTT
agcagaaacatcttctcaag

SEQ ID NO: 261587 - DNA, 20 bp, Artificial Sequence
  Description of Artificial Sequence: Synthetic oligonucleotide
  Target: ATXN1; (+) strand; PAM type: YTN; PAM sequence: TTA
gcagaaacatcttctcaagc

SEQ ID NO: 261588 - DNA, 20 bp, Artificial Sequence
  Description of Artificial Sequence: Synthetic oligonucleotide
  Target: ATXN1; (+) strand; PAM type: YTN; PAM sequence: CTT
ctcaagcactattaaaaaat

SEQ ID NO: 261589 - DNA, 20 bp, Artificial Sequence
  Description of Artificial Sequence: Synthetic oligonucleotide
  Target: ATXN1; (+) strand; PAM type: YTN; PAM sequence: TTC
tcaagcactattaaaaaatt

SEQ ID NO: 261590 - DNA, 20 bp, Artificial Sequence
  Description of Artificial Sequence: Synthetic oligonucleotide
  Target: ATXN1; (+) strand; PAM type: YTN; PAM sequence: CTC
aagcactattaaaaaattaa

SEQ ID NO: 261591 - DNA, 20 bp, Artificial Sequence
  Description of Artificial Sequence: Synthetic oligonucleotide
  Target: ATXN1; (+) strand; PAM type: YTN; PAM sequence: CTA
ttaaaaaattaaagtggggc

SEQ ID NO: 261592 - DNA, 20 bp, Artificial Sequence
  Description of Artificial Sequence: Synthetic oligonucleotide
  Target: ATXN1; (+) strand; PAM type: YTN; PAM sequence: TTA
aaaaattaaagtggggccag

SEQ ID NO: 261593 - DNA, 20 bp, Artificial Sequence
  Description of Artificial Sequence: Synthetic oligonucleotide
  Target: ATXN1; (+) strand; PAM type: YTN; PAM sequence: TTA
aagtggggccaggcacagtg

SEQ ID NO: 261594 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 261595 - DNA, 20 bp, Artificial Sequence
  Description of Artificial Sequence: Synthetic oligonucleotide
  Target: ATXN1; (+) strand; PAM type: YTN; PAM sequence: CTG
taatcccagcacttttggga

SEQ ID NO: 261596 - DNA, 20 bp, Artificial Sequence
  Description of Artificial Sequence: Synthetic oligonucleotide
  Target: ATXN1; (+) strand; PAM type: YTN; PAM sequence: CTT
ttgggaggctgaagtgggca

SEQ ID NO: 261597 - DNA, 20 bp, Artificial Sequence
  Description of Artificial Sequence: Synthetic oligonucleotide
  Target: ATXN1; (+) strand; PAM type: YTN; PAM sequence: TTT
tgggaggctgaagtgggcag

SEQ ID NO: 261598 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaagtgggcaga

SEQ ID NO: 261599 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaagtgggcagat

SEQ ID NO: 261600 - DNA, 20 bp, Artificial Sequence
  Description of Artificial Sequence: Synthetic oligonucleotide
  Target: ATXN1; (+) strand; PAM type: YTN; PAM sequence: CTG
aagtgggcagatcatctgag

SEQ ID NO: 261601 - DNA, 20 bp, Artificial Sequence
  Description of Artificial Sequence: Synthetic oligonucleotide
  Target: ATXN1; (+) strand; PAM type: YTN; PAM sequence: CTG
aggtcggaagttcgagacca

SEQ ID NO: 261602 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctgggcaacat

SEQ ID NO: 261603 - DNA, 20 bp, Artificial Sequence
  Description of Artificial Sequence: Synthetic oligonucleotide
  Target: ATXN1; (+) strand; PAM type: YTN; PAM sequence: CTG
ggcaacatggtgaaacccca

SEQ ID NO: 261604 - DNA, 20 bp, Artificial Sequence
  Description of Artificial Sequence: Synthetic oligonucleotide
  Target: ATXN1; (+) strand; PAM type: YTN; PAM sequence: CTT
taccaaaaatacaaaaatta

SEQ ID NO: 261605 - DNA, 20 bp, Artificial Sequence
  Description of Artificial Sequence: Synthetic oligonucleotide
  Target: ATXN1; (+) strand; PAM type: YTN; PAM sequence: TTT
accaaaaatacaaaaattag

SEQ ID NO: 261606 - DNA, 20 bp, Artificial Sequence
  Description of Artificial Sequence: Synthetic oligonucleotide
  Target: ATXN1; (+) strand; PAM type: YTN; PAM sequence: TTA
ccaaaaatacaaaaattagg

SEQ ID NO: 261607 - DNA, 20 bp, Artificial Sequence
  Description of Artificial Sequence: Synthetic oligonucleotide
  Target: ATXN1; (+) strand; PAM type: YTN; PAM sequence: TTA
ggtgggtgtgatggtaggca

SEQ ID NO: 261608 - DNA, 20 bp, Artificial Sequence
  Description of Artificial Sequence: Synthetic oligonucleotide
  Target: ATXN1; (+) strand; PAM type: YTN; PAM sequence: CTG
taatcccagctactcgggag

SEQ ID NO: 261609 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggctgaggcagga

SEQ ID NO: 261610 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcaggagaa

SEQ ID NO: 261611 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcacttgaa

SEQ ID NO: 261612 - DNA, 20 bp, Artificial Sequence
  Description of Artificial Sequence: Synthetic oligonucleotide
  Target: ATXN1; (+) strand; PAM type: YTN; PAM sequence: CTT
gaacccgggaggcggaggtt

SEQ ID NO: 261613 - DNA, 20 bp, Artificial Sequence
  Description of Artificial Sequence: Synthetic oligonucleotide
  Target: ATXN1; (+) strand; PAM type: YTN; PAM sequence: TTG
aacccgggaggcggaggttg

SEQ ID NO: 261614 - DNA, 20 bp, Artificial Sequence
  Description of Artificial Sequence: Synthetic oligonucleotide
  Target: ATXN1; (+) strand; PAM type: YTN; PAM sequence: TTG
cagtgagctgagacggtgcc

SEQ ID NO: 261615 - DNA, 20 bp, Artificial Sequence
  Description of Artificial Sequence: Synthetic oligonucleotide
  Target: ATXN1; (+) strand; PAM type: YTN; PAM sequence: CTG
agacggtgccattgcactcc

SEQ ID NO: 261616 - DNA, 20 bp, Artificial Sequence
  Description of Artificial Sequence: Synthetic oligonucleotide
  Target: ATXN1; (+) strand; PAM type: YTN; PAM sequence: TTG
cactccagcctgggggacaa

SEQ ID NO: 261617 - DNA, 20 bp, Artificial Sequence
  Description of Artificial Sequence: Synthetic oligonucleotide
  Target: ATXN1; (+) strand; PAM type: YTN; PAM sequence: CTC
cagcctgggggacaagagca

SEQ ID NO: 261618 - DNA, 20 bp, Artificial Sequence
  Description of Artificial Sequence: Synthetic oligonucleotide
  Target: ATXN1; (+) strand; PAM type: YTN; PAM sequence: CTG
ggggacaagagcaagacttc

SEQ ID NO: 261619 - DNA, 20 bp, Artificial Sequence
  Description of Artificial Sequence: Synthetic oligonucleotide
  Target: ATXN1; (+) strand; PAM type: YTN; PAM sequence: CTT
cgtctcaaaaaaaaaaaaaa

SEQ ID NO: 261620 - DNA, 20 bp, Artificial Sequence
  Description of Artificial Sequence: Synthetic oligonucleotide
  Target: ATXN1; (+) strand; PAM type: YTN; PAM sequence: TTC
gtctcaaaaaaaaaaaaaaa

SEQ ID NO: 261621 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaattgaa

SEQ ID NO: 261622 - DNA, 20 bp, Artificial Sequence
  Description of Artificial Sequence: Synthetic oligonucleotide
  Target: ATXN1; (+) strand; PAM type: YTN; PAM sequence: TTG
aagtggggccaggtgcggtg

SEQ ID NO: 261623 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcccagcact

SEQ ID NO: 261624 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 261625 - DNA, 20 bp, Artificial Sequence
  Description of Artificial Sequence: Synthetic oligonucleotide
  Target: ATXN1; (+) strand; PAM type: YTN; PAM sequence: CTT
tgggaggtctaaatgggtgg

SEQ ID NO: 261626 - DNA, 20 bp, Artificial Sequence
  Description of Artificial Sequence: Synthetic oligonucleotide
  Target: ATXN1; (+) strand; PAM type: YTN; PAM sequence: TTT
gggaggtctaaatgggtgga

SEQ ID NO: 261627 - DNA, 20 bp, Artificial Sequence
  Description of Artificial Sequence: Synthetic oligonucleotide
  Target: ATXN1; (+) strand; PAM type: YTN; PAM sequence: TTG
ggaggtctaaatgggtggat

SEQ ID NO: 261628 - DNA, 20 bp, Artificial Sequence
  Description of Artificial Sequence: Synthetic oligonucleotide
  Target: ATXN1; (+) strand; PAM type: YTN; PAM sequence: CTA
aatgggtggatcgcttgaac

SEQ ID NO: 261629 - DNA, 20 bp, Artificial Sequence
  Description of Artificial Sequence: Synthetic oligonucleotide
  Target: ATXN1; (+) strand; PAM type: YTN; PAM sequence: CTT
gaacccaggagtctccagcc

SEQ ID NO: 261630 - DNA, 20 bp, Artificial Sequence
  Description of Artificial Sequence: Synthetic oligonucleotide
  Target: ATXN1; (+) strand; PAM type: YTN; PAM sequence: TTG
aacccaggagtctccagcct

SEQ ID NO: 261631 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacatggcaa

SEQ ID NO: 261632 - DNA, 20 bp, Artificial Sequence
  Description of Artificial Sequence: Synthetic oligonucleotide
  Target: ATXN1; (+) strand; PAM type: YTN; PAM sequence: CTG
ggcaacatggcaaaacccca

SEQ ID NO: 261633 - DNA, 20 bp, Artificial Sequence
  Description of Artificial Sequence: Synthetic oligonucleotide
  Target: ATXN1; (+) strand; PAM type: YTN; PAM sequence: CTC
taccaaaaatacaaaaaatt

SEQ ID NO: 261634 - DNA, 20 bp, Artificial Sequence
  Description of Artificial Sequence: Synthetic oligonucleotide
  Target: ATXN1; (+) strand; PAM type: YTN; PAM sequence: CTA
ccaaaaatacaaaaaattag

SEQ ID NO: 261635 - DNA, 20 bp, Artificial Sequence
  Description of Artificial Sequence: Synthetic oligonucleotide
  Target: ATXN1; (+) strand; PAM type: YTN; PAM sequence: TTA
gccaggcgtggtggcacatt

SEQ ID NO: 261636 - DNA, 20 bp, Artificial Sequence
  Description of Artificial Sequence: Synthetic oligonucleotide
  Target: ATXN1; (+) strand; PAM type: YTN; PAM sequence: TTC
ttaccacagagacatgcccc

SEQ ID NO: 261637 - DNA, 20 bp, Artificial Sequence
  Description of Artificial Sequence: Synthetic oligonucleotide
  Target: ATXN1; (+) strand; PAM type: YTN; PAM sequence: CTT
accacagagacatgccccca

SEQ ID NO: 261638 - DNA, 20 bp, Artificial Sequence
  Description of Artificial Sequence: Synthetic oligonucleotide
  Target: ATXN1; (+) strand; PAM type: YTN; PAM sequence: TTA
ccacagagacatgcccccaa

SEQ ID NO: 261639 - DNA, 20 bp, Artificial Sequence
  Description of Artificial Sequence: Synthetic oligonucleotide
  Target: ATXN1; (+) strand; PAM type: YTN; PAM sequence: CTT
tgatatttcaaaagagctaa

SEQ ID NO: 261640 - DNA, 20 bp, Artificial Sequence
  Description of Artificial Sequence: Synthetic oligonucleotide
  Target: ATXN1; (+) strand; PAM type: YTN; PAM sequence: TTT
gatatttcaaaagagctaaa

SEQ ID NO: 261641 - DNA, 20 bp, Artificial Sequence
  Description of Artificial Sequence: Synthetic oligonucleotide
  Target: ATXN1; (+) strand; PAM type: YTN; PAM sequence: TTG
atatttcaaaagagctaaaa

SEQ ID NO: 261642 - DNA, 20 bp, Artificial Sequence
  Description of Artificial Sequence: Synthetic oligonucleotide
  Target: ATXN1; (+) strand; PAM type: YTN; PAM sequence: TTT
caaaagagctaaaagaaaat

SEQ ID NO: 261643 - DNA, 20 bp, Artificial Sequence
  Description of Artificial Sequence: Synthetic oligonucleotide
  Target: ATXN1; (+) strand; PAM type: YTN; PAM sequence: TTC
aaaagagctaaaagaaaatg

SEQ ID NO: 261644 - DNA, 20 bp, Artificial Sequence
  Description of Artificial Sequence: Synthetic oligonucleotide
  Target: ATXN1; (+) strand; PAM type: YTN; PAM sequence: CTA
aaagaaaatgaggaagtaag

SEQ ID NO: 261645 - DNA, 20 bp, Artificial Sequence
  Description of Artificial Sequence: Synthetic oligonucleotide
  Target: ATXN1; (+) strand; PAM type: YTN; PAM sequence: CTA
atcccaataaaaacattcag

SEQ ID NO: 261646 - DNA, 20 bp, Artificial Sequence
  Description of Artificial Sequence: Synthetic oligonucleotide
  Target: ATXN1; (+) strand; PAM type: YTN; PAM sequence: TTC
agaaatgaagtgattggaga

SEQ ID NO: 261647 - DNA, 20 bp, Artificial Sequence
  Description of Artificial Sequence: Synthetic oligonucleotide
  Target: ATXN1; (+) strand; PAM type: YTN; PAM sequence: TTG
gagaaaacaaatagttggat

SEQ ID NO: 261648 - DNA, 20 bp, Artificial Sequence
  Description of Artificial Sequence: Synthetic oligonucleotide
  Target: ATXN1; (+) strand; PAM type: YTN; PAM sequence: TTG
gatagagagaggcaaaagaa

SEQ ID NO: 261649 - DNA, 20 bp, Artificial Sequence
  Description of Artificial Sequence: Synthetic oligonucleotide
  Target: ATXN1; (+) strand; PAM type: YTN; PAM sequence: TTT
gaagtaaaagaaaaaaaaaa

SEQ ID NO: 261650 - DNA, 20 bp, Artificial Sequence
  Description of Artificial Sequence: Synthetic oligonucleotide
  Target: ATXN1; (+) strand; PAM type: YTN; PAM sequence: TTG
aagtaaaagaaaaaaaaaaa

SEQ ID NO: 261651 - DNA, 20 bp, Artificial Sequence
  Description of Artificial Sequence: Synthetic oligonucleotide
  Target: ATXN1; (+) strand; PAM type: YTN; PAM sequence: TTT
tctagatgaagaccaaataa

SEQ ID NO: 261652 - DNA, 20 bp, Artificial Sequence
  Description of Artificial Sequence: Synthetic oligonucleotide
  Target: ATXN1; (+) strand; PAM type: YTN; PAM sequence: TTT
ctagatgaagaccaaataag

SEQ ID NO: 261653 - DNA, 20 bp, Artificial Sequence
  Description of Artificial Sequence: Synthetic oligonucleotide
  Target: ATXN1; (+) strand; PAM type: YTN; PAM sequence: TTC
tagatgaagaccaaataaga

SEQ ID NO: 261654 - DNA, 20 bp, Artificial Sequence
  Description of Artificial Sequence: Synthetic oligonucleotide
  Target: ATXN1; (+) strand; PAM type: YTN; PAM sequence: CTA
gatgaagaccaaataagaag

SEQ ID NO: 261655 - DNA, 20 bp, Artificial Sequence
  Description of Artificial Sequence: Synthetic oligonucleotide
  Target: ATXN1; (+) strand; PAM type: YTN; PAM sequence: CTT
tagtcccagctacttgggag

SEQ ID NO: 261656 - DNA, 20 bp, Artificial Sequence
  Description of Artificial Sequence: Synthetic oligonucleotide
  Target: ATXN1; (+) strand; PAM type: YTN; PAM sequence: TTT
agtcccagctacttgggagg

SEQ ID NO: 261657 - DNA, 20 bp, Artificial Sequence
  Description of Artificial Sequence: Synthetic oligonucleotide
  Target: ATXN1; (+) strand; PAM type: YTN; PAM sequence: TTA
gtcccagctacttgggaggc

SEQ ID NO: 261658 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctaaggtggga

SEQ ID NO: 261659 - DNA, 20 bp, Artificial Sequence
  Description of Artificial Sequence: Synthetic oligonucleotide
  Target: ATXN1; (+) strand; PAM type: YTN; PAM sequence: CTT
gggaggctaaggtgggatga

SEQ ID NO: 261660 - DNA, 20 bp, Artificial Sequence
  Description of Artificial Sequence: Synthetic oligonucleotide
  Target: ATXN1; (+) strand; PAM type: YTN; PAM sequence: TTG
ggaggctaaggtgggatgat

SEQ ID NO: 261661 - DNA, 20 bp, Artificial Sequence
  Description of Artificial Sequence: Synthetic oligonucleotide
  Target: ATXN1; (+) strand; PAM type: YTN; PAM sequence: CTA
aggtgggatgattgcttgaa

SEQ ID NO: 261662 - DNA, 20 bp, Artificial Sequence
  Description of Artificial Sequence: Synthetic oligonucleotide
  Target: ATXN1; (+) strand; PAM type: YTN; PAM sequence: TTG
cttgaacccaggagccagag

SEQ ID NO: 261663 - DNA, 20 bp, Artificial Sequence
  Description of Artificial Sequence: Synthetic oligonucleotide
  Target: ATXN1; (+) strand; PAM type: YTN; PAM sequence: CTT
gaacccaggagccagaggtt

SEQ ID NO: 261664 - DNA, 20 bp, Artificial Sequence
  Description of Artificial Sequence: Synthetic oligonucleotide
  Target: ATXN1; (+) strand; PAM type: YTN; PAM sequence: TTG
aacccaggagccagaggttg

SEQ ID NO: 261665 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaaaatagcacc

SEQ ID NO: 261666 - DNA, 20 bp, Artificial Sequence
  Description of Artificial Sequence: Synthetic oligonucleotide
  Target: ATXN1; (+) strand; PAM type: YTN; PAM sequence: CTG
cactccaacctgggaaacag

SEQ ID NO: 261667 - DNA, 20 bp, Artificial Sequence
  Description of Artificial Sequence: Synthetic oligonucleotide
  Target: ATXN1; (+) strand; PAM type: YTN; PAM sequence: CTC
caacctgggaaacagagtga

SEQ ID NO: 261668 - DNA, 20 bp, Artificial Sequence
  Description of Artificial Sequence: Synthetic oligonucleotide
  Target: ATXN1; (+) strand; PAM type: YTN; PAM sequence: CTG
ggaaacagagtgagaccctg

SEQ ID NO: 261669 - DNA, 20 bp, Artificial Sequence
  Description of Artificial Sequence: Synthetic oligonucleotide
  Target: ATXN1; (+) strand; PAM type: YTN; PAM sequence: CTG
tcttaaaaaaaaaaaagaaa

SEQ ID NO: 261670 - DNA, 20 bp, Artificial Sequence
  Description of Artificial Sequence: Synthetic oligonucleotide
  Target: ATXN1; (+) strand; PAM type: YTN; PAM sequence: CTT
aaaaaaaaaaaagaaaagaa

SEQ ID NO: 261671 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaaaagaaaagaaa

SEQ ID NO: 261672 - DNA, 20 bp, Artificial Sequence
  Description of Artificial Sequence: Synthetic oligonucleotide
  Target: ATXN1; (+) strand; PAM type: YTN; PAM sequence: TTA
aagcgggaattcagggaaga

SEQ ID NO: 261673 - DNA, 20 bp, Artificial Sequence
  Description of Artificial Sequence: Synthetic oligonucleotide
  Target: ATXN1; (+) strand; PAM type: YTN; PAM sequence: TTC
agggaagatgatggcaccag

SEQ ID NO: 261674 - DNA, 20 bp, Artificial Sequence
  Description of Artificial Sequence: Synthetic oligonucleotide
  Target: ATXN1; (+) strand; PAM type: YTN; PAM sequence: TTT
aaaaaaatttttcagaatcc

SEQ ID NO: 261675 - DNA, 20 bp, Artificial Sequence
  Description of Artificial Sequence: Synthetic oligonucleotide
  Target: ATXN1; (+) strand; PAM type: YTN; PAM sequence: TTA
aaaaaatttttcagaatccc

SEQ ID NO: 261676 - DNA, 20 bp, Artificial Sequence
  Description of Artificial Sequence: Synthetic oligonucleotide
  Target: ATXN1; (+) strand; PAM type: YTN; PAM sequence: TTT
ttcagaatccctgccctcct

SEQ ID NO: 261677 - DNA, 20 bp, Artificial Sequence
  Description of Artificial Sequence: Synthetic oligonucleotide
  Target: ATXN1; (+) strand; PAM type: YTN; PAM sequence: TTT
tcagaatccctgccctcctc

SEQ ID NO: 261678 - DNA, 20 bp, Artificial Sequence
  Description of Artificial Sequence: Synthetic oligonucleotide
  Target: ATXN1; (+) strand; PAM type: YTN; PAM sequence: TTT
cagaatccctgccctcctcc

SEQ ID NO: 261679 - DNA, 20 bp, Artificial Sequence
  Description of Artificial Sequence: Synthetic oligonucleotide
  Target: ATXN1; (+) strand; PAM type: YTN; PAM sequence: TTC
agaatccctgccctcctcct

SEQ ID NO: 261680 - DNA, 20 bp, Artificial Sequence
  Description of Artificial Sequence: Synthetic oligonucleotide
  Target: ATXN1; (+) strand; PAM type: YTN; PAM sequence: CTG
ccctcctcctccctgccagt

SEQ ID NO: 261681 - DNA, 20 bp, Artificial Sequence
  Description of Artificial Sequence: Synthetic oligonucleotide
  Target: ATXN1; (+) strand; PAM type: YTN; PAM sequence: CTC
ctcctccctgccagtaacaa

SEQ ID NO: 261682 - DNA, 20 bp, Artificial Sequence
  Description of Artificial Sequence: Synthetic oligonucleotide
  Target: ATXN1; (+) strand; PAM type: YTN; PAM sequence: CTC
ctccctgccagtaacaatag

SEQ ID NO: 261683 - DNA, 20 bp, Artificial Sequence
  Description of Artificial Sequence: Synthetic oligonucleotide
  Target: ATXN1; (+) strand; PAM type: YTN; PAM sequence: CTC
cctgccagtaacaatagcaa

SEQ ID NO: 261684 - DNA, 20 bp, Artificial Sequence
  Description of Artificial Sequence: Synthetic oligonucleotide
  Target: ATXN1; (+) strand; PAM type: YTN; PAM sequence: CTG
ccagtaacaatagcaatgat

SEQ ID NO: 261685 - DNA, 20 bp, Artificial Sequence
  Description of Artificial Sequence: Synthetic oligonucleotide
  Target: ATXN1; (+) strand; PAM type: YTN; PAM sequence: TTG
gaattacacagccaaaaacc

SEQ ID NO: 261686 - DNA, 20 bp, Artificial Sequence
  Description of Artificial Sequence: Synthetic oligonucleotide
  Target: ATXN1; (+) strand; PAM type: YTN; PAM sequence: TTA
cacagccaaaaacccatgga

SEQ ID NO: 261687 - DNA, 20 bp, Artificial Sequence
  Description of Artificial Sequence: Synthetic oligonucleotide
  Target: ATXN1; (+) strand; PAM type: YTN; PAM sequence: TTA
ctgtgtagtccataaacctg

SEQ ID NO: 261688 - DNA, 20 bp, Artificial Sequence
  Description of Artificial Sequence: Synthetic oligonucleotide
  Target: ATXN1; (+) strand; PAM type: YTN; PAM sequence: CTG
tgtagtccataaacctgaag

SEQ ID NO: 261689 - DNA, 20 bp, Artificial Sequence
  Description of Artificial Sequence: Synthetic oligonucleotide
  Target: ATXN1; (+) strand; PAM type: YTN; PAM sequence: CTG
aagacaggaatgggtgtggc

SEQ ID NO: 261690 - DNA, 20 bp, Artificial Sequence
  Description of Artificial Sequence: Synthetic oligonucleotide
  Target: ATXN1; (+) strand; PAM type: YTN; PAM sequence: TTT
atagtgacagagccaggcag

SEQ ID NO: 261691 - DNA, 20 bp, Artificial Sequence
  Description of Artificial Sequence: Synthetic oligonucleotide
  Target: ATXN1; (+) strand; PAM type: YTN; PAM sequence: TTA
tagtgacagagccaggcaga

SEQ ID NO: 261692 - DNA, 20 bp, Artificial Sequence
  Description of Artificial Sequence: Synthetic oligonucleotide
  Target: ATXN1; (+) strand; PAM type: YTN; PAM sequence: CTG
tgcaagagaaagttggagga

SEQ ID NO: 261693 - DNA, 20 bp, Artificial Sequence
  Description of Artificial Sequence: Synthetic oligonucleotide
  Target: ATXN1; (+) strand; PAM type: YTN; PAM sequence: TTG
gaggagaggcagtgggcatc

SEQ ID NO: 261694 - DNA, 20 bp, Artificial Sequence
  Description of Artificial Sequence: Synthetic oligonucleotide
  Target: ATXN1; (+) strand; PAM type: YTN; PAM sequence: CTG
aaggttttggcacaacgggc

SEQ ID NO: 261695 - DNA, 20 bp, Artificial Sequence
  Description of Artificial Sequence: Synthetic oligonucleotide
  Target: ATXN1; (+) strand; PAM type: YTN; PAM sequence: TTT
tggcacaacgggctcccaag

SEQ ID NO: 261696 - DNA, 20 bp, Artificial Sequence
  Description of Artificial Sequence: Synthetic oligonucleotide
  Target: ATXN1; (+) strand; PAM type: YTN; PAM sequence: TTT
ggcacaacgggctcccaagc

SEQ ID NO: 261697 - DNA, 20 bp, Artificial Sequence
  Description of Artificial Sequence: Synthetic oligonucleotide
  Target: ATXN1; (+) strand; PAM type: YTN; PAM sequence: TTG
gcacaacgggctcccaagct

SEQ ID NO: 261698 - DNA, 20 bp, Artificial Sequence
  Description of Artificial Sequence: Synthetic oligonucleotide
  Target: ATXN1; (+) strand; PAM type: YTN; PAM sequence: CTC
ccaagcttccaaaggtcctt

SEQ ID NO: 261699 - DNA, 20 bp, Artificial Sequence
  Description of Artificial Sequence: Synthetic oligonucleotide
  Target: ATXN1; (+) strand; PAM type: YTN; PAM sequence: CTT
ccaaaggtccttacggcacg

SEQ ID NO: 261700 - DNA, 20 bp, Artificial Sequence
  Description of Artificial Sequence: Synthetic oligonucleotide
  Target: ATXN1; (+) strand; PAM type: YTN; PAM sequence: TTC
caaaggtccttacggcacgg

SEQ ID NO: 261701 - DNA, 20 bp, Artificial Sequence
  Description of Artificial Sequence: Synthetic oligonucleotide
  Target: ATXN1; (+) strand; PAM type: YTN; PAM sequence: CTT
acggcacggtcagcagggtg

SEQ ID NO: 261702 - DNA, 20 bp, Artificial Sequence
  Description of Artificial Sequence: Synthetic oligonucleotide
  Target: ATXN1; (+) strand; PAM type: YTN; PAM sequence: TTA
cggcacggtcagcagggtgg

SEQ ID NO: 261703 - DNA, 20 bp, Artificial Sequence
  Description of Artificial Sequence: Synthetic oligonucleotide
  Target: ATXN1; (+) strand; PAM type: YTN; PAM sequence: CTA
ttttgagcacagcagcatca

SEQ ID NO: 261704 - DNA, 20 bp, Artificial Sequence
  Description of Artificial Sequence: Synthetic oligonucleotide
  Target: ATXN1; (+) strand; PAM type: YTN; PAM sequence: TTT
tgagcacagcagcatcattg

SEQ ID NO: 261705 - DNA, 20 bp, Artificial Sequence
  Description of Artificial Sequence: Synthetic oligonucleotide
  Target: ATXN1; (+) strand; PAM type: YTN; PAM sequence: TTT
gagcacagcagcatcattgg

SEQ ID NO: 261706 - DNA, 20 bp, Artificial Sequence
  Description of Artificial Sequence: Synthetic oligonucleotide
  Target: ATXN1; (+) strand; PAM type: YTN; PAM sequence: TTG
agcacagcagcatcattggc

SEQ ID NO: 261707 - DNA, 20 bp, Artificial Sequence
  Description of Artificial Sequence: Synthetic oligonucleotide
  Target: ATXN1; (+) strand; PAM type: YTN; PAM sequence: TTG
gcaaggggtcctgcagaatc

SEQ ID NO: 261708 - DNA, 20 bp, Artificial Sequence
  Description of Artificial Sequence: Synthetic oligonucleotide
  Target: ATXN1; (+) strand; PAM type: YTN; PAM sequence: CTG
cagaatccaattcatggggt

SEQ ID NO: 261709 - DNA, 20 bp, Artificial Sequence
  Description of Artificial Sequence: Synthetic oligonucleotide
  Target: ATXN1; (+) strand; PAM type: YTN; PAM sequence: TTC
atggggtgagggcaaggaac

SEQ ID NO: 261710 - DNA, 20 bp, Artificial Sequence
  Description of Artificial Sequence: Synthetic oligonucleotide
  Target: ATXN1; (+) strand; PAM type: YTN; PAM sequence: CTG
ggaaggtctgaggtgcttag

SEQ ID NO: 261711 - DNA, 20 bp, Artificial Sequence
  Description of Artificial Sequence: Synthetic oligonucleotide
  Target: ATXN1; (+) strand; PAM type: YTN; PAM sequence: CTG
aggtgcttaggtgttacgga

SEQ ID NO: 261712 - DNA, 20 bp, Artificial Sequence
  Description of Artificial Sequence: Synthetic oligonucleotide
  Target: ATXN1; (+) strand; PAM type: YTN; PAM sequence: CTT
aggtgttacggagccagggc

SEQ ID NO: 261713 - DNA, 20 bp, Artificial Sequence
  Description of Artificial Sequence: Synthetic oligonucleotide
  Target: ATXN1; (+) strand; PAM type: YTN; PAM sequence: TTA
ggtgttacggagccagggca

SEQ ID NO: 261714 - DNA, 20 bp, Artificial Sequence
  Description of Artificial Sequence: Synthetic oligonucleotide
  Target: ATXN1; (+) strand; PAM type: YTN; PAM sequence: TTA
cggagccagggcactcttga

SEQ ID NO: 261715 - DNA, 20 bp, Artificial Sequence
  Description of Artificial Sequence: Synthetic oligonucleotide
  Target: ATXN1; (+) strand; PAM type: YTN; PAM sequence: CTC
ttgagaccaacaaatctaag

SEQ ID NO: 261716 - DNA, 20 bp, Artificial Sequence
  Description of Artificial Sequence: Synthetic oligonucleotide
  Target: ATXN1; (+) strand; PAM type: YTN; PAM sequence: CTT
gagaccaacaaatctaagct

SEQ ID NO: 261717 - DNA, 20 bp, Artificial Sequence
  Description of Artificial Sequence: Synthetic oligonucleotide
  Target: ATXN1; (+) strand; PAM type: YTN; PAM sequence: TTG
agaccaacaaatctaagctt

SEQ ID NO: 261718 - DNA, 20 bp, Artificial Sequence
  Description of Artificial Sequence: Synthetic oligonucleotide
  Target: ATXN1; (+) strand; PAM type: YTN; PAM sequence: CTA
agcttccttccacgaccaaa

SEQ ID NO: 261719 - DNA, 20 bp, Artificial Sequence
  Description of Artificial Sequence: Synthetic oligonucleotide
  Target: ATXN1; (+) strand; PAM type: YTN; PAM sequence: CTT
ccttccacgaccaaatcacc

SEQ ID NO: 261720 - DNA, 20 bp, Artificial Sequence
  Description of Artificial Sequence: Synthetic oligonucleotide
  Target: ATXN1; (+) strand; PAM type: YTN; PAM sequence: TTC
cttccacgaccaaatcacct

SEQ ID NO: 261721 - DNA, 20 bp, Artificial Sequence
  Description of Artificial Sequence: Synthetic oligonucleotide
  Target: ATXN1; (+) strand; PAM type: YTN; PAM sequence: CTT
ccacgaccaaatcaccttga

SEQ ID NO: 261722 - DNA, 20 bp, Artificial Sequence
  Description of Artificial Sequence: Synthetic oligonucleotide
  Target: ATXN1; (+) strand; PAM type: YTN; PAM sequence: TTC
cacgaccaaatcaccttgag

SEQ ID NO: 261723 - DNA, 20 bp, Artificial Sequence
  Description of Artificial Sequence: Synthetic oligonucleotide
  Target: ATXN1; (+) strand; PAM type: YTN; PAM sequence: CTT
gagaagaaacttttgagagc

SEQ ID NO: 261724 - DNA, 20 bp, Artificial Sequence
  Description of Artificial Sequence: Synthetic oligonucleotide
  Target: ATXN1; (+) strand; PAM type: YTN; PAM sequence: TTG
agaagaaacttttgagagca

SEQ ID NO: 261725 - DNA, 20 bp, Artificial Sequence
  Description of Artificial Sequence: Synthetic oligonucleotide
  Target: ATXN1; (+) strand; PAM type: YTN; PAM sequence: CTT
ttgagagcagaatctaaatc

SEQ ID NO: 261726 - DNA, 20 bp, Artificial Sequence
  Description of Artificial Sequence: Synthetic oligonucleotide
  Target: ATXN1; (+) strand; PAM type: YTN; PAM sequence: TTT
tgagagcagaatctaaatcg

SEQ ID NO: 261727 - DNA, 20 bp, Artificial Sequence
  Description of Artificial Sequence: Synthetic oligonucleotide
  Target: ATXN1; (+) strand; PAM type: YTN; PAM sequence: TTT
gagagcagaatctaaatcga

SEQ ID NO: 261728 - DNA, 20 bp, Artificial Sequence
  Description of Artificial Sequence: Synthetic oligonucleotide
  Target: ATXN1; (+) strand; PAM type: YTN; PAM sequence: TTG
agagcagaatctaaatcgaa

SEQ ID NO: 261729 - DNA, 20 bp, Artificial Sequence
  Description of Artificial Sequence: Synthetic oligonucleotide
  Target: ATXN1; (+) strand; PAM type: YTN; PAM sequence: CTA
aatcgaacatggcagtaata

SEQ ID NO: 261730 - DNA, 20 bp, Artificial Sequence
  Description of Artificial Sequence: Synthetic oligonucleotide
  Target: ATXN1; (+) strand; PAM type: YTN; PAM sequence: TTT
agccaaagtgaagggagggg

SEQ ID NO: 261731 - DNA, 20 bp, Artificial Sequence
  Description of Artificial Sequence: Synthetic oligonucleotide
  Target: ATXN1; (+) strand; PAM type: YTN; PAM sequence: TTA
gccaaagtgaagggaggggg

SEQ ID NO: 261732 - DNA, 20 bp, Artificial Sequence
  Description of Artificial Sequence: Synthetic oligonucleotide
  Target: ATXN1; (+) strand; PAM type: YTN; PAM sequence: CTA
agaaaatataggccttattt

SEQ ID NO: 261733 - DNA, 20 bp, Artificial Sequence
  Description of Artificial Sequence: Synthetic oligonucleotide
  Target: ATXN1; (+) strand; PAM type: YTN; PAM sequence: CTT
attttattccatggaaacaa

SEQ ID NO: 261734 - DNA, 20 bp, Artificial Sequence
  Description of Artificial Sequence: Synthetic oligonucleotide
  Target: ATXN1; (+) strand; PAM type: YTN; PAM sequence: TTA
ttttattccatggaaacaac

SEQ ID NO: 261735 - DNA, 20 bp, Artificial Sequence
  Description of Artificial Sequence: Synthetic oligonucleotide
  Target: ATXN1; (+) strand; PAM type: YTN; PAM sequence: TTT
tattccatggaaacaacaga

SEQ ID NO: 261736 - DNA, 20 bp, Artificial Sequence
  Description of Artificial Sequence: Synthetic oligonucleotide
  Target: ATXN1; (+) strand; PAM type: YTN; PAM sequence: TTT
attccatggaaacaacagaa

SEQ ID NO: 261737 - DNA, 20 bp, Artificial Sequence
  Description of Artificial Sequence: Synthetic oligonucleotide
  Target: ATXN1; (+) strand; PAM type: YTN; PAM sequence: TTA
ttccatggaaacaacagaag

SEQ ID NO: 261738 - DNA, 20 bp, Artificial Sequence
  Description of Artificial Sequence: Synthetic oligonucleotide
  Target: ATXN1; (+) strand; PAM type: YTN; PAM sequence: TTC
catggaaacaacagaagacg

SEQ ID NO: 261739 - DNA, 20 bp, Artificial Sequence
  Description of Artificial Sequence: Synthetic oligonucleotide
  Target: ATXN1; (+) strand; PAM type: YTN; PAM sequence: TTC
tatggcctagacactagaaa

SEQ ID NO: 261740 - DNA, 20 bp, Artificial Sequence
  Description of Artificial Sequence: Synthetic oligonucleotide
  Target: ATXN1; (+) strand; PAM type: YTN; PAM sequence: CTA
tggcctagacactagaaaat

SEQ ID NO: 261741 - DNA, 20 bp, Artificial Sequence
  Description of Artificial Sequence: Synthetic oligonucleotide
  Target: ATXN1; (+) strand; PAM type: YTN; PAM sequence: CTA
gacactagaaaatattttct

SEQ ID NO: 261742 - DNA, 20 bp, Artificial Sequence
  Description of Artificial Sequence: Synthetic oligonucleotide
  Target: ATXN1; (+) strand; PAM type: YTN; PAM sequence: CTA
gaaaatattttctggcccat

SEQ ID NO: 261743 - DNA, 20 bp, Artificial Sequence
  Description of Artificial Sequence: Synthetic oligonucleotide
  Target: ATXN1; (+) strand; PAM type: YTN; PAM sequence: TTT
tctggcccatcccttatccc

SEQ ID NO: 261744 - DNA, 20 bp, Artificial Sequence
  Description of Artificial Sequence: Synthetic oligonucleotide
  Target: ATXN1; (+) strand; PAM type: YTN; PAM sequence: TTT
ctggcccatcccttatccct

SEQ ID NO: 261745 - DNA, 20 bp, Artificial Sequence
  Description of Artificial Sequence: Synthetic oligonucleotide
  Target: ATXN1; (+) strand; PAM type: YTN; PAM sequence: TTC
tggcccatcccttatcccta

SEQ ID NO: 261746 - DNA, 20 bp, Artificial Sequence
  Description of Artificial Sequence: Synthetic oligonucleotide
  Target: ATXN1; (+) strand; PAM type: YTN; PAM sequence: CTG
gcccatcccttatccctaaa

SEQ ID NO: 261747 - DNA, 20 bp, Artificial Sequence
  Description of Artificial Sequence: Synthetic oligonucleotide
  Target: ATXN1; (+) strand; PAM type: YTN; PAM sequence: CTT
atccctaaaaatacaagaaa

SEQ ID NO: 261748 - DNA, 20 bp, Artificial Sequence
  Description of Artificial Sequence: Synthetic oligonucleotide
  Target: ATXN1; (+) strand; PAM type: YTN; PAM sequence: TTA
tccctaaaaatacaagaaaa

SEQ ID NO: 261749 - DNA, 20 bp, Artificial Sequence
  Description of Artificial Sequence: Synthetic oligonucleotide
  Target: ATXN1; (+) strand; PAM type: YTN; PAM sequence: CTA
aaaatacaagaaaactcatt

SEQ ID NO: 261750 - DNA, 20 bp, Artificial Sequence
  Description of Artificial Sequence: Synthetic oligonucleotide
  Target: ATXN1; (+) strand; PAM type: YTN; PAM sequence: CTC
attccacttaaaaatgagta

SEQ ID NO: 261751 - DNA, 20 bp, Artificial Sequence
  Description of Artificial Sequence: Synthetic oligonucleotide
  Target: ATXN1; (+) strand; PAM type: YTN; PAM sequence: TTC
cacttaaaaatgagtaacaa

SEQ ID NO: 261752 - DNA, 20 bp, Artificial Sequence
  Description of Artificial Sequence: Synthetic oligonucleotide
  Target: ATXN1; (+) strand; PAM type: YTN; PAM sequence: CTT
aaaaatgagtaacaaaatag

SEQ ID NO: 261753 - DNA, 20 bp, Artificial Sequence
  Description of Artificial Sequence: Synthetic oligonucleotide
  Target: ATXN1; (+) strand; PAM type: YTN; PAM sequence: TTA
aaaatgagtaacaaaatagg

SEQ ID NO: 261754 - DNA, 20 bp, Artificial Sequence
  Description of Artificial Sequence: Synthetic oligonucleotide
  Target: ATXN1; (+) strand; PAM type: YTN; PAM sequence: TTG
tggtcaaatacagtgcacag

SEQ ID NO: 261755 - DNA, 20 bp, Artificial Sequence
  Description of Artificial Sequence: Synthetic oligonucleotide
  Target: ATXN1; (+) strand; PAM type: YTN; PAM sequence: TTA
ttataagaagaaaaatcaga

SEQ ID NO: 261756 - DNA, 20 bp, Artificial Sequence
  Description of Artificial Sequence: Synthetic oligonucleotide
  Target: ATXN1; (+) strand; PAM type: YTN; PAM sequence: TTA
taagaagaaaaatcagagta

SEQ ID NO: 261757 - DNA, 20 bp, Artificial Sequence
  Description of Artificial Sequence: Synthetic oligonucleotide
  Target: ATXN1; (+) strand; PAM type: YTN; PAM sequence: TTC
ttaccacagagacatgcccc

SEQ ID NO: 261758 - DNA, 20 bp, Artificial Sequence
  Description of Artificial Sequence: Synthetic oligonucleotide
  Target: ATXN1; (+) strand; PAM type: YTN; PAM sequence: CTT
accacagagacatgccccca

SEQ ID NO: 261759 - DNA, 20 bp, Artificial Sequence
  Description of Artificial Sequence: Synthetic oligonucleotide
  Target: ATXN1; (+) strand; PAM type: YTN; PAM sequence: TTA
ccacagagacatgcccccaa

SEQ ID NO: 261760 - DNA, 20 bp, Artificial Sequence
  Description of Artificial Sequence: Synthetic oligonucleotide
  Target: ATXN1; (+) strand; PAM type: YTN; PAM sequence: CTT
taatatttcaaaagagctaa

SEQ ID NO: 261761 - DNA, 20 bp, Artificial Sequence
  Description of Artificial Sequence: Synthetic oligonucleotide
  Target: ATXN1; (+) strand; PAM type: YTN; PAM sequence: TTT
aatatttcaaaagagctaaa

SEQ ID NO: 261762 - DNA, 20 bp, Artificial Sequence
  Description of Artificial Sequence: Synthetic oligonucleotide
  Target: ATXN1; (+) strand; PAM type: YTN; PAM sequence: TTA
atatttcaaaagagctaaaa

SEQ ID NO: 261763 - DNA, 20 bp, Artificial Sequence
  Description of Artificial Sequence: Synthetic oligonucleotide
  Target: ATXN1; (+) strand; PAM type: YTN; PAM sequence: TTT
caaaagagctaaaagaaaat

SEQ ID NO: 261764 - DNA, 20 bp, Artificial Sequence
  Description of Artificial Sequence: Synthetic oligonucleotide
  Target: ATXN1; (+) strand; PAM type: YTN; PAM sequence: TTC
aaaagagctaaaagaaaatg

SEQ ID NO: 261765 - DNA, 20 bp, Artificial Sequence
  Description of Artificial Sequence: Synthetic oligonucleotide
  Target: ATXN1; (+) strand; PAM type: YTN; PAM sequence: CTA
aaagaaaatgaggcagtaag

SEQ ID NO: 261766 - DNA, 20 bp, Artificial Sequence
  Description of Artificial Sequence: Synthetic oligonucleotide
  Target: ATXN1; (+) strand; PAM type: YTN; PAM sequence: CTA
atcccaataaaaacattcag

SEQ ID NO: 261767 - DNA, 20 bp, Artificial Sequence
  Description of Artificial Sequence: Synthetic oligonucleotide
  Target: ATXN1; (+) strand; PAM type: YTN; PAM sequence: TTC
agaaatgaagtgattggaga

SEQ ID NO: 261768 - DNA, 20 bp, Artificial Sequence
  Description of Artificial Sequence: Synthetic oligonucleotide
  Target: ATXN1; (+) strand; PAM type: YTN; PAM sequence: TTG
gagaaaagaaatagttggat

SEQ ID NO: 261769 - DNA, 20 bp, Artificial Sequence
  Description of Artificial Sequence: Synthetic oligonucleotide
  Target: ATXN1; (+) strand; PAM type: YTN; PAM sequence: TTG
gatagagagaggcaaaagaa

SEQ ID NO: 261770 - DNA, 20 bp, Artificial Sequence
  Description of Artificial Sequence: Synthetic oligonucleotide
  Target: ATXN1; (+) strand; PAM type: YTN; PAM sequence: TTT
gaagaaaacgaaaaaagaaa

SEQ ID NO: 261771 - DNA, 20 bp, Artificial Sequence
  Description of Artificial Sequence: Synthetic oligonucleotide
  Target: ATXN1; (+) strand; PAM type: YTN; PAM sequence: TTG
aagaaaacgaaaaaagaaaa

SEQ ID NO: 261772 - DNA, 20 bp, Artificial Sequence
  Description of Artificial Sequence: Synthetic oligonucleotide
  Target: ATXN1; (+) strand; PAM type: YTN; PAM sequence: TTT
tctagatgaagaccaaataa

SEQ ID NO: 261773 - DNA, 20 bp, Artificial Sequence
  Description of Artificial Sequence: Synthetic oligonucleotide
  Target: ATXN1; (+) strand; PAM type: YTN; PAM sequence: TTT
ctagatgaagaccaaataag

SEQ ID NO: 261774 - DNA, 20 bp, Artificial Sequence
  Description of Artificial Sequence: Synthetic oligonucleotide
  Target: ATXN1; (+) strand; PAM type: YTN; PAM sequence: TTC
tagatgaagaccaaataaga

SEQ ID NO: 261775 - DNA, 20 bp, Artificial Sequence
  Description of Artificial Sequence: Synthetic oligonucleotide
  Target: ATXN1; (+) strand; PAM type: YTN; PAM sequence: CTA
gatgaagaccaaataagaag

SEQ ID NO: 261776 - DNA, 20 bp, Artificial Sequence
  Description of Artificial Sequence: Synthetic oligonucleotide
  Target: ATXN1; (+) strand; PAM type: YTN; PAM sequence: CTT
tgaggagtgctaaaaaatag

SEQ ID NO: 261777 - DNA, 20 bp, Artificial Sequence
  Description of Artificial Sequence: Synthetic oligonucleotide
  Target: ATXN1; (+) strand; PAM type: YTN; PAM sequence: TTT
gaggagtgctaaaaaataga

SEQ ID NO: 261778 - DNA, 20 bp, Artificial Sequence
  Description of Artificial Sequence: Synthetic oligonucleotide
  Target: ATXN1; (+) strand; PAM type: YTN; PAM sequence: TTG
aggagtgctaaaaaatagaa

SEQ ID NO: 261779 - DNA, 20 bp, Artificial Sequence
  Description of Artificial Sequence: Synthetic oligonucleotide
  Target: ATXN1; (+) strand; PAM type: YTN; PAM sequence: CTA
aaaaatagaaaggagaaagt

SEQ ID NO: 261780 - DNA, 20 bp, Artificial Sequence
  Description of Artificial Sequence: Synthetic oligonucleotide
  Target: ATXN1; (+) strand; PAM type: YTN; PAM sequence: TTA
aacatcaaaaagaaatgagg

SEQ ID NO: 261781 - DNA, 20 bp, Artificial Sequence
  Description of Artificial Sequence: Synthetic oligonucleotide
  Target: ATXN1; (+) strand; PAM type: YTN; PAM sequence: TTC
aagagaaagactcagaaaag

SEQ ID NO: 261782 - DNA, 20 bp, Artificial Sequence
  Description of Artificial Sequence: Synthetic oligonucleotide
  Target: ATXN1; (+) strand; PAM type: YTN; PAM sequence: CTC
agaaaaggaacatgagcaaa

SEQ ID NO: 261783 - DNA, 20 bp, Artificial Sequence
  Description of Artificial Sequence: Synthetic oligonucleotide
  Target: ATXN1; (+) strand; PAM type: YTN; PAM sequence: CTG
taataagagcctttgaagaa

SEQ ID NO: 261784 - DNA, 20 bp, Artificial Sequence
  Description of Artificial Sequence: Synthetic oligonucleotide
  Target: ATXN1; (+) strand; PAM type: YTN; PAM sequence: CTT
tgaagaagaaaagcaataaa

SEQ ID NO: 261785 - DNA, 20 bp, Artificial Sequence
  Description of Artificial Sequence: Synthetic oligonucleotide
  Target: ATXN1; (+) strand; PAM type: YTN; PAM sequence: TTT
gaagaagaaaagcaataaaa

SEQ ID NO: 261786 - DNA, 20 bp, Artificial Sequence
  Description of Artificial Sequence: Synthetic oligonucleotide
  Target: ATXN1; (+) strand; PAM type: YTN; PAM sequence: TTG
aagaagaaaagcaataaaaa

SEQ ID NO: 261787 - DNA, 20 bp, Artificial Sequence
  Description of Artificial Sequence: Synthetic oligonucleotide
  Target: ATXN1; (+) strand; PAM type: YTN; PAM sequence: CTT
aaaatcgtgactgaagcaca

SEQ ID NO: 261788 - DNA, 20 bp, Artificial Sequence
  Description of Artificial Sequence: Synthetic oligonucleotide
  Target: ATXN1; (+) strand; PAM type: YTN; PAM sequence: TTA
aaatcgtgactgaagcacaa

SEQ ID NO: 261789 - DNA, 20 bp, Artificial Sequence
  Description of Artificial Sequence: Synthetic oligonucleotide
  Target: ATXN1; (+) strand; PAM type: YTN; PAM sequence: CTG
aagcacaaattctagaagta

SEQ ID NO: 261790 - DNA, 20 bp, Artificial Sequence
  Description of Artificial Sequence: Synthetic oligonucleotide
  Target: ATXN1; (+) strand; PAM type: YTN; PAM sequence: TTC
tagaagtagaaaaagatttg

SEQ ID NO: 261791 - DNA, 20 bp, Artificial Sequence
  Description of Artificial Sequence: Synthetic oligonucleotide
  Target: ATXN1; (+) strand; PAM type: YTN; PAM sequence: CTA
gaagtagaaaaagatttgaa

SEQ ID NO: 261792 - DNA, 20 bp, Artificial Sequence
  Description of Artificial Sequence: Synthetic oligonucleotide
  Target: ATXN1; (+) strand; PAM type: YTN; PAM sequence: TTT
gaaactatatattgacagaa

SEQ ID NO: 261793 - DNA, 20 bp, Artificial Sequence
  Description of Artificial Sequence: Synthetic oligonucleotide
  Target: ATXN1; (+) strand; PAM type: YTN; PAM sequence: TTG
aaactatatattgacagaat

SEQ ID NO: 261794 - DNA, 20 bp, Artificial Sequence
  Description of Artificial Sequence: Synthetic oligonucleotide
  Target: ATXN1; (+) strand; PAM type: YTN; PAM sequence: CTA
tatattgacagaatactcca

SEQ ID NO: 261795 - DNA, 20 bp, Artificial Sequence
  Description of Artificial Sequence: Synthetic oligonucleotide
  Target: ATXN1; (+) strand; PAM type: YTN; PAM sequence: TTG
acagaatactccatgcacct

SEQ ID NO: 261796 - DNA, 20 bp, Artificial Sequence
  Description of Artificial Sequence: Synthetic oligonucleotide
  Target: ATXN1; (+) strand; PAM type: YTN; PAM sequence: CTC
catgcacctggaaaaactga

SEQ ID NO: 261797 - DNA, 20 bp, Artificial Sequence
  Description of Artificial Sequence: Synthetic oligonucleotide
  Target: ATXN1; (+) strand; PAM type: YTN; PAM sequence: CTG
gaaaaactgacctaggaaag

SEQ ID NO: 261798 - DNA, 20 bp, Artificial Sequence
  Description of Artificial Sequence: Synthetic oligonucleotide
  Target: ATXN1; (+) strand; PAM type: YTN; PAM sequence: CTG
acctaggaaagaaaacaaaa

SEQ ID NO: 261799 - DNA, 20 bp, Artificial Sequence
  Description of Artificial Sequence: Synthetic oligonucleotide
  Target: ATXN1; (+) strand; PAM type: YTN; PAM sequence: CTA
ggaaagaaaacaaaaaaaaa

SEQ ID NO: 261800 - DNA, 20 bp, Artificial Sequence
  Description of Artificial Sequence: Synthetic oligonucleotide
  Target: ATXN1; (+) strand; PAM type: YTN; PAM sequence: TTC
tttggacactcaggtaaaat

SEQ ID NO: 261801 - DNA, 20 bp, Artificial Sequence
  Description of Artificial Sequence: Synthetic oligonucleotide
  Target: ATXN1; (+) strand; PAM type: YTN; PAM sequence: CTT
tggacactcaggtaaaatga

SEQ ID NO: 261802 - DNA, 20 bp, Artificial Sequence
  Description of Artificial Sequence: Synthetic oligonucleotide
  Target: ATXN1; (+) strand; PAM type: YTN; PAM sequence: TTT
ggacactcaggtaaaatgac

SEQ ID NO: 261803 - DNA, 20 bp, Artificial Sequence
  Description of Artificial Sequence: Synthetic oligonucleotide
  Target: ATXN1; (+) strand; PAM type: YTN; PAM sequence: TTG
gacactcaggtaaaatgact

SEQ ID NO: 261804 - DNA, 20 bp, Artificial Sequence
  Description of Artificial Sequence: Synthetic oligonucleotide
  Target: ATXN1; (+) strand; PAM type: YTN; PAM sequence: CTC
aggtaaaatgactgagttac

SEQ ID NO: 261805 - DNA, 20 bp, Artificial Sequence
  Description of Artificial Sequence: Synthetic oligonucleotide
  Target: ATXN1; (+) strand; PAM type: YTN; PAM sequence: CTG
agttacctataagggacaga

SEQ ID NO: 261806 - DNA, 20 bp, Artificial Sequence
  Description of Artificial Sequence: Synthetic oligonucleotide
  Target: ATXN1; (+) strand; PAM type: YTN; PAM sequence: TTA
cctataagggacagaaaatt

SEQ ID NO: 261807 - DNA, 20 bp, Artificial Sequence
  Description of Artificial Sequence: Synthetic oligonucleotide
  Target: ATXN1; (+) strand; PAM type: YTN; PAM sequence: CTA
taagggacagaaaattagag

SEQ ID NO: 261808 - DNA, 20 bp, Artificial Sequence
  Description of Artificial Sequence: Synthetic oligonucleotide
  Target: ATXN1; (+) strand; PAM type: YTN; PAM sequence: TTA
gagtgtcacccgatttttca

SEQ ID NO: 261809 - DNA, 20 bp, Artificial Sequence
  Description of Artificial Sequence: Synthetic oligonucleotide
  Target: ATXN1; (+) strand; PAM type: YTN; PAM sequence: TTT
ttcaagagccaggcttcatg

SEQ ID NO: 261810 - DNA, 20 bp, Artificial Sequence
  Description of Artificial Sequence: Synthetic oligonucleotide
  Target: ATXN1; (+) strand; PAM type: YTN; PAM sequence: TTT
tcaagagccaggcttcatgc

SEQ ID NO: 261811 - DNA, 20 bp, Artificial Sequence
  Description of Artificial Sequence: Synthetic oligonucleotide
  Target: ATXN1; (+) strand; PAM type: YTN; PAM sequence: TTT
caagagccaggcttcatgct

SEQ ID NO: 261812 - DNA, 20 bp, Artificial Sequence
  Description of Artificial Sequence: Synthetic oligonucleotide
  Target: ATXN1; (+) strand; PAM type: YTN; PAM sequence: TTC
aagagccaggcttcatgcta

SEQ ID NO: 261813 - DNA, 20 bp, Artificial Sequence
  Description of Artificial Sequence: Synthetic oligonucleotide
  Target: ATXN1; (+) strand; PAM type: YTN; PAM sequence: CTT
catgctaaaagtcagtagcg

SEQ ID NO: 261814 - DNA, 20 bp, Artificial Sequence
  Description of Artificial Sequence: Synthetic oligonucleotide
  Target: ATXN1; (+) strand; PAM type: YTN; PAM sequence: TTC
atgctaaaagtcagtagcgt

SEQ ID NO: 261815 - DNA, 20 bp, Artificial Sequence
  Description of Artificial Sequence: Synthetic oligonucleotide
  Target: ATXN1; (+) strand; PAM type: YTN; PAM sequence: CTA
aaagtcagtagcgtgacact

SEQ ID NO: 261816 - DNA, 20 bp, Artificial Sequence
  Description of Artificial Sequence: Synthetic oligonucleotide
  Target: ATXN1; (+) strand; PAM type: YTN; PAM sequence: CTC
aggaaagacaactaagccaa

SEQ ID NO: 261817 - DNA, 20 bp, Artificial Sequence
  Description of Artificial Sequence: Synthetic oligonucleotide
  Target: ATXN1; (+) strand; PAM type: YTN; PAM sequence: CTA
agccaaggatcttataccca

SEQ ID NO: 261818 - DNA, 20 bp, Artificial Sequence
  Description of Artificial Sequence: Synthetic oligonucleotide
  Target: ATXN1; (+) strand; PAM type: YTN; PAM sequence: CTT
atacccagccaaaatgatct

SEQ ID NO: 261819 - DNA, 20 bp, Artificial Sequence
  Description of Artificial Sequence: Synthetic oligonucleotide
  Target: ATXN1; (+) strand; PAM type: YTN; PAM sequence: TTA
tacccagccaaaatgatctt

SEQ ID NO: 261820 - DNA, 20 bp, Artificial Sequence
  Description of Artificial Sequence: Synthetic oligonucleotide
  Target: ATXN1; (+) strand; PAM type: YTN; PAM sequence: CTT
ccagccaacaacaatctgtt

SEQ ID NO: 261821 - DNA, 20 bp, Artificial Sequence
  Description of Artificial Sequence: Synthetic oligonucleotide
  Target: ATXN1; (+) strand; PAM type: YTN; PAM sequence: TTC
cagccaacaacaatctgtta

SEQ ID NO: 261822 - DNA, 20 bp, Artificial Sequence
  Description of Artificial Sequence: Synthetic oligonucleotide
  Target: ATXN1; (+) strand; PAM type: YTN; PAM sequence: CTG
ttatgaatatgcaaggaccc

SEQ ID NO: 261823 - DNA, 20 bp, Artificial Sequence
  Description of Artificial Sequence: Synthetic oligonucleotide
  Target: ATXN1; (+) strand; PAM type: YTN; PAM sequence: TTA
tgaatatgcaaggacccaag

SEQ ID NO: 261824 - DNA, 20 bp, Artificial Sequence
  Description of Artificial Sequence: Synthetic oligonucleotide
  Target: ATXN1; (+) strand; PAM type: YTN; PAM sequence: TTG
ttcgcagaaacccttagtaa

SEQ ID NO: 261825 - DNA, 20 bp, Artificial Sequence
  Description of Artificial Sequence: Synthetic oligonucleotide
  Target: ATXN1; (+) strand; PAM type: YTN; PAM sequence: TTC
gcagaaacccttagtaatct

SEQ ID NO: 261826 - DNA, 20 bp, Artificial Sequence
  Description of Artificial Sequence: Synthetic oligonucleotide
  Target: ATXN1; (+) strand; PAM type: YTN; PAM sequence: CTT
agtaatctgcaagggagaag

SEQ ID NO: 261827 - DNA, 20 bp, Artificial Sequence
  Description of Artificial Sequence: Synthetic oligonucleotide
  Target: ATXN1; (+) strand; PAM type: YTN; PAM sequence: TTA
gtaatctgcaagggagaaga

SEQ ID NO: 261828 - DNA, 20 bp, Artificial Sequence
  Description of Artificial Sequence: Synthetic oligonucleotide
  Target: ATXN1; (+) strand; PAM type: YTN; PAM sequence: CTG
caagggagaagagtcaggca

SEQ ID NO: 261829 - DNA, 20 bp, Artificial Sequence
  Description of Artificial Sequence: Synthetic oligonucleotide
  Target: ATXN1; (+) strand; PAM type: YTN; PAM sequence: CTG
gctggaaaggcactgataca

SEQ ID NO: 261830 - DNA, 20 bp, Artificial Sequence
  Description of Artificial Sequence: Synthetic oligonucleotide
  Target: ATXN1; (+) strand; PAM type: YTN; PAM sequence: CTG
gaaaggcactgatacaaaga

SEQ ID NO: 261831 - DNA, 20 bp, Artificial Sequence
  Description of Artificial Sequence: Synthetic oligonucleotide
  Target: ATXN1; (+) strand; PAM type: YTN; PAM sequence: CTG
atacaaagactgggtgagca

SEQ ID NO: 261832 - DNA, 20 bp, Artificial Sequence
  Description of Artificial Sequence: Synthetic oligonucleotide
  Target: ATXN1; (+) strand; PAM type: YTN; PAM sequence: CTG
ggtgagcatttaacacataa

SEQ ID NO: 261833 - DNA, 20 bp, Artificial Sequence
  Description of Artificial Sequence: Synthetic oligonucleotide
  Target: ATXN1; (+) strand; PAM type: YTN; PAM sequence: TTT
aacacataatcagctgtagg

SEQ ID NO: 261834 - DNA, 20 bp, Artificial Sequence
  Description of Artificial Sequence: Synthetic oligonucleotide
  Target: ATXN1; (+) strand; PAM type: YTN; PAM sequence: TTA
acacataatcagctgtaggt

SEQ ID NO: 261835 - DNA, 20 bp, Artificial Sequence
  Description of Artificial Sequence: Synthetic oligonucleotide
  Target: ATXN1; (+) strand; PAM type: YTN; PAM sequence: CTG
taggtctgttactgaaagat

SEQ ID NO: 261836 - DNA, 20 bp, Artificial Sequence
  Description of Artificial Sequence: Synthetic oligonucleotide
  Target: ATXN1; (+) strand; PAM type: YTN; PAM sequence: CTG
ttactgaaagatgattacaa

SEQ ID NO: 261837 - DNA, 20 bp, Artificial Sequence
  Description of Artificial Sequence: Synthetic oligonucleotide
  Target: ATXN1; (+) strand; PAM type: YTN; PAM sequence: TTA
ctgaaagatgattacaagga

SEQ ID NO: 261838 - DNA, 20 bp, Artificial Sequence
  Description of Artificial Sequence: Synthetic oligonucleotide
  Target: ATXN1; (+) strand; PAM type: YTN; PAM sequence: CTG
aaagatgattacaaggaaac

SEQ ID NO: 261839 - DNA, 20 bp, Artificial Sequence
  Description of Artificial Sequence: Synthetic oligonucleotide
  Target: ATXN1; (+) strand; PAM type: YTN; PAM sequence: TTA
caaggaaacaatattacata

SEQ ID NO: 261840 - DNA, 20 bp, Artificial Sequence
  Description of Artificial Sequence: Synthetic oligonucleotide
  Target: ATXN1; (+) strand; PAM type: YTN; PAM sequence: TTA
catatagccagaacgatata

SEQ ID NO: 261841 - DNA, 20 bp, Artificial Sequence
  Description of Artificial Sequence: Synthetic oligonucleotide
  Target: ATXN1; (+) strand; PAM type: YTN; PAM sequence: CTA
tgtgccctgacaatatagat

SEQ ID NO: 261842 - DNA, 20 bp, Artificial Sequence
  Description of Artificial Sequence: Synthetic oligonucleotide
  Target: ATXN1; (+) strand; PAM type: YTN; PAM sequence: CTG
acaatatagatagtataatg

SEQ ID NO: 261843 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaacacgcgggaaga

SEQ ID NO: 261844 - DNA, 20 bp, Artificial Sequence
  Description of Artificial Sequence: Synthetic oligonucleotide
  Target: ATXN1; (+) strand; PAM type: YTN; PAM sequence: CTC
actaacatagatgttaagtg

SEQ ID NO: 261845 - DNA, 20 bp, Artificial Sequence
  Description of Artificial Sequence: Synthetic oligonucleotide
  Target: ATXN1; (+) strand; PAM type: YTN; PAM sequence: CTA
acatagatgttaagtgggag

SEQ ID NO: 261846 - DNA, 20 bp, Artificial Sequence
  Description of Artificial Sequence: Synthetic oligonucleotide
  Target: ATXN1; (+) strand; PAM type: YTN; PAM sequence: TTA
agtgggagtaaaaggatatt

SEQ ID NO: 261847 - DNA, 20 bp, Artificial Sequence
  Description of Artificial Sequence: Synthetic oligonucleotide
  Target: ATXN1; (+) strand; PAM type: YTN; PAM sequence: TTA
ccttaaatcaaattatagcc

SEQ ID NO: 261848 - DNA, 20 bp, Artificial Sequence
  Description of Artificial Sequence: Synthetic oligonucleotide
  Target: ATXN1; (+) strand; PAM type: YTN; PAM sequence: CTT
aaatcaaattatagccagag

SEQ ID NO: 261849 - DNA, 20 bp, Artificial Sequence
  Description of Artificial Sequence: Synthetic oligonucleotide
  Target: ATXN1; (+) strand; PAM type: YTN; PAM sequence: TTA
aatcaaattatagccagaga

SEQ ID NO: 261850 - DNA, 20 bp, Artificial Sequence
  Description of Artificial Sequence: Synthetic oligonucleotide
  Target: ATXN1; (+) strand; PAM type: YTN; PAM sequence: TTA
tagccagagaagaaaataag

SEQ ID NO: 261851 - DNA, 20 bp, Artificial Sequence
  Description of Artificial Sequence: Synthetic oligonucleotide
  Target: ATXN1; (+) strand; PAM type: YTN; PAM sequence: CTA
agaatttcaaaatcactcag

SEQ ID NO: 261852 - DNA, 20 bp, Artificial Sequence
  Description of Artificial Sequence: Synthetic oligonucleotide
  Target: ATXN1; (+) strand; PAM type: YTN; PAM sequence: TTT
caaaatcactcagagttgga

SEQ ID NO: 261853 - DNA, 20 bp, Artificial Sequence
  Description of Artificial Sequence: Synthetic oligonucleotide
  Target: ATXN1; (+) strand; PAM type: YTN; PAM sequence: TTC
aaaatcactcagagttggaa

SEQ ID NO: 261854 - DNA, 20 bp, Artificial Sequence
  Description of Artificial Sequence: Synthetic oligonucleotide
  Target: ATXN1; (+) strand; PAM type: YTN; PAM sequence: CTC
agagttggaaaccaataaac

SEQ ID NO: 261855 - DNA, 20 bp, Artificial Sequence
  Description of Artificial Sequence: Synthetic oligonucleotide
  Target: ATXN1; (+) strand; PAM type: YTN; PAM sequence: TTG
gaaaccaataaacaacagct

SEQ ID NO: 261856 - DNA, 20 bp, Artificial Sequence
  Description of Artificial Sequence: Synthetic oligonucleotide
  Target: ATXN1; (+) strand; PAM type: YTN; PAM sequence: CTA
agaaaagtttgggggataag

SEQ ID NO: 261857 - DNA, 20 bp, Artificial Sequence
  Description of Artificial Sequence: Synthetic oligonucleotide
  Target: ATXN1; (+) strand; PAM type: YTN; PAM sequence: TTT
gggggataagaagggtacca

SEQ ID NO: 261858 - DNA, 20 bp, Artificial Sequence
  Description of Artificial Sequence: Synthetic oligonucleotide
  Target: ATXN1; (+) strand; PAM type: YTN; PAM sequence: TTG
ggggataagaagggtaccat

SEQ ID NO: 261859 - DNA, 20 bp, Artificial Sequence
  Description of Artificial Sequence: Synthetic oligonucleotide
  Target: ATXN1; (+) strand; PAM type: YTN; PAM sequence: TTA
aggaattattctaaacattt

SEQ ID NO: 261860 - DNA, 20 bp, Artificial Sequence
  Description of Artificial Sequence: Synthetic oligonucleotide
  Target: ATXN1; (+) strand; PAM type: YTN; PAM sequence: TTA
ttctaaacatttttactgga

SEQ ID NO: 261861 - DNA, 20 bp, Artificial Sequence
  Description of Artificial Sequence: Synthetic oligonucleotide
  Target: ATXN1; (+) strand; PAM type: YTN; PAM sequence: TTC
taaacatttttactggaagg

SEQ ID NO: 261862 - DNA, 20 bp, Artificial Sequence
  Description of Artificial Sequence: Synthetic oligonucleotide
  Target: ATXN1; (+) strand; PAM type: YTN; PAM sequence: CTA
aacatttttactggaaggct

SEQ ID NO: 261863 - DNA, 20 bp, Artificial Sequence
  Description of Artificial Sequence: Synthetic oligonucleotide
  Target: ATXN1; (+) strand; PAM type: YTN; PAM sequence: TTT
ttactggaaggctgggcatg

SEQ ID NO: 261864 - DNA, 20 bp, Artificial Sequence
  Description of Artificial Sequence: Synthetic oligonucleotide
  Target: ATXN1; (+) strand; PAM type: YTN; PAM sequence: TTT
tactggaaggctgggcatgg

SEQ ID NO: 261865 - DNA, 20 bp, Artificial Sequence
  Description of Artificial Sequence: Synthetic oligonucleotide
  Target: ATXN1; (+) strand; PAM type: YTN; PAM sequence: TTT
actggaaggctgggcatggt

SEQ ID NO: 261866 - DNA, 20 bp, Artificial Sequence
  Description of Artificial Sequence: Synthetic oligonucleotide
  Target: ATXN1; (+) strand; PAM type: YTN; PAM sequence: TTA
ctggaaggctgggcatggtg

SEQ ID NO: 261867 - DNA, 20 bp, Artificial Sequence
  Description of Artificial Sequence: Synthetic oligonucleotide
  Target: ATXN1; (+) strand; PAM type: YTN; PAM sequence: CTG
gaaggctgggcatggtggct

SEQ ID NO: 261868 - DNA, 20 bp, Artificial Sequence
  Description of Artificial Sequence: Synthetic oligonucleotide
  Target: ATXN1; (+) strand; PAM type: YTN; PAM sequence: CTG
ggcatggtggctcacacctg

SEQ ID NO: 261869 - DNA, 20 bp, Artificial Sequence
  Description of Artificial Sequence: Synthetic oligonucleotide
  Target: ATXN1; (+) strand; PAM type: YTN; PAM sequence: CTC
acacctgtaatcccaacact

SEQ ID NO: 261870 - DNA, 20 bp, Artificial Sequence
  Description of Artificial Sequence: Synthetic oligonucleotide
  Target: ATXN1; (+) strand; PAM type: YTN; PAM sequence: CTG
taatcccaacactttgggag

SEQ ID NO: 261871 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggcgggtgg

SEQ ID NO: 261872 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggcgggtgga

SEQ ID NO: 261873 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggcgggtggat

SEQ ID NO: 261874 - DNA, 20 bp, Artificial Sequence
  Description of Artificial Sequence: Synthetic oligonucleotide
  Target: ATXN1; (+) strand; PAM type: YTN; PAM sequence: CTT
gaggccaggaacttgagact

SEQ ID NO: 261875 - DNA, 20 bp, Artificial Sequence
  Description of Artificial Sequence: Synthetic oligonucleotide
  Target: ATXN1; (+) strand; PAM type: YTN; PAM sequence: TTG
aggccaggaacttgagacta

SEQ ID NO: 261876 - DNA, 20 bp, Artificial Sequence
  Description of Artificial Sequence: Synthetic oligonucleotide
  Target: ATXN1; (+) strand; PAM type: YTN; PAM sequence: CTT
gagactagcctggccaacat

SEQ ID NO: 261877 - DNA, 20 bp, Artificial Sequence
  Description of Artificial Sequence: Synthetic oligonucleotide
  Target: ATXN1; (+) strand; PAM type: YTN; PAM sequence: TTG
agactagcctggccaacatg

SEQ ID NO: 261878 - DNA, 20 bp, Artificial Sequence
  Description of Artificial Sequence: Synthetic oligonucleotide
  Target: ATXN1; (+) strand; PAM type: YTN; PAM sequence: CTA
gcctggccaacatggcaaaa

SEQ ID NO: 261879 - DNA, 20 bp, Artificial Sequence
  Description of Artificial Sequence: Synthetic oligonucleotide
  Target: ATXN1; (+) strand; PAM type: YTN; PAM sequence: CTG
gccaacatggcaaaaccccg

SEQ ID NO: 261880 - DNA, 20 bp, Artificial Sequence
  Description of Artificial Sequence: Synthetic oligonucleotide
  Target: ATXN1; (+) strand; PAM type: YTN; PAM sequence: CTC
taccaaaaatccaaaaatta

SEQ ID NO: 261881 - DNA, 20 bp, Artificial Sequence
  Description of Artificial Sequence: Synthetic oligonucleotide
  Target: ATXN1; (+) strand; PAM type: YTN; PAM sequence: CTA
ccaaaaatccaaaaattacc

SEQ ID NO: 261882 - DNA, 20 bp, Artificial Sequence
  Description of Artificial Sequence: Synthetic oligonucleotide
  Target: ATXN1; (+) strand; PAM type: YTN; PAM sequence: TTA
cctggtcgtggtggcgcaca

SEQ ID NO: 261883 - DNA, 20 bp, Artificial Sequence
  Description of Artificial Sequence: Synthetic oligonucleotide
  Target: ATXN1; (+) strand; PAM type: YTN; PAM sequence: CTG
gtcgtggtggcgcacacctg

SEQ ID NO: 261884 - DNA, 20 bp, Artificial Sequence
  Description of Artificial Sequence: Synthetic oligonucleotide
  Target: ATXN1; (+) strand; PAM type: YTN; PAM sequence: CTG
taatcccatctactcaggag

SEQ ID NO: 261885 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctgaggcacga

SEQ ID NO: 261886 - DNA, 20 bp, Artificial Sequence
  Description of Artificial Sequence: Synthetic oligonucleotide
  Target: ATXN1; (+) strand; PAM type: YTN; PAM sequence: CTC
aggaggctgaggcacgagaa

SEQ ID NO: 261887 - DNA, 20 bp, Artificial Sequence
  Description of Artificial Sequence: Synthetic oligonucleotide
  Target: ATXN1; (+) strand; PAM type: YTN; PAM sequence: CTG
aggcacgagaattgcttaaa

SEQ ID NO: 261888 - DNA, 20 bp, Artificial Sequence
  Description of Artificial Sequence: Synthetic oligonucleotide
  Target: ATXN1; (+) strand; PAM type: YTN; PAM sequence: TTG
cttaaacccaggagggtgag

SEQ ID NO: 261889 - DNA, 20 bp, Artificial Sequence
  Description of Artificial Sequence: Synthetic oligonucleotide
  Target: ATXN1; (+) strand; PAM type: YTN; PAM sequence: CTT
aaacccaggagggtgaggct

SEQ ID NO: 261890 - DNA, 20 bp, Artificial Sequence
  Description of Artificial Sequence: Synthetic oligonucleotide
  Target: ATXN1; (+) strand; PAM type: YTN; PAM sequence: TTA
aacccaggagggtgaggctg

SEQ ID NO: 261891 - DNA, 20 bp, Artificial Sequence
  Description of Artificial Sequence: Synthetic oligonucleotide
  Target: ATXN1; (+) strand; PAM type: YTN; PAM sequence: CTG
cagtgagccaagatggtgcc

SEQ ID NO: 261892 - DNA, 20 bp, Artificial Sequence
  Description of Artificial Sequence: Synthetic oligonucleotide
  Target: ATXN1; (+) strand; PAM type: YTN; PAM sequence: CTG
ctctccagcccgggtgacag

SEQ ID NO: 261893 - DNA, 20 bp, Artificial Sequence
  Description of Artificial Sequence: Synthetic oligonucleotide
  Target: ATXN1; (+) strand; PAM type: YTN; PAM sequence: CTC
tccagcccgggtgacagagc

SEQ ID NO: 261894 - DNA, 20 bp, Artificial Sequence
  Description of Artificial Sequence: Synthetic oligonucleotide
  Target: ATXN1; (+) strand; PAM type: YTN; PAM sequence: CTC
cagcccgggtgacagagcaa

SEQ ID NO: 261895 - DNA, 20 bp, Artificial Sequence
  Description of Artificial Sequence: Synthetic oligonucleotide
  Target: ATXN1; (+) strand; PAM type: YTN; PAM sequence: CTT
ggtctggaaaaacaaacaaa

SEQ ID NO: 261896 - DNA, 20 bp, Artificial Sequence
  Description of Artificial Sequence: Synthetic oligonucleotide
  Target: ATXN1; (+) strand; PAM type: YTN; PAM sequence: TTG
gtctggaaaaacaaacaaac

SEQ ID NO: 261897 - DNA, 20 bp, Artificial Sequence
  Description of Artificial Sequence: Synthetic oligonucleotide
  Target: ATXN1; (+) strand; PAM type: YTN; PAM sequence: CTG
gaaaaacaaacaaacaaaaa

SEQ ID NO: 261898 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctacttggggg

SEQ ID NO: 261899 - DNA, 20 bp, Artificial Sequence
  Description of Artificial Sequence: Synthetic oligonucleotide
  Target: ATXN1; (+) strand; PAM type: YTN; PAM sequence: CTA
cttggggggctgaggcagaa

SEQ ID NO: 261900 - DNA, 20 bp, Artificial Sequence
  Description of Artificial Sequence: Synthetic oligonucleotide
  Target: ATXN1; (+) strand; PAM type: YTN; PAM sequence: CTT
ggggggctgaggcagaagga

SEQ ID NO: 261901 - DNA, 20 bp, Artificial Sequence
  Description of Artificial Sequence: Synthetic oligonucleotide
  Target: ATXN1; (+) strand; PAM type: YTN; PAM sequence: TTG
gggggctgaggcagaaggat

SEQ ID NO: 261902 - DNA, 20 bp, Artificial Sequence
  Description of Artificial Sequence: Synthetic oligonucleotide
  Target: ATXN1; (+) strand; PAM type: YTN; PAM sequence: CTG
aggcagaaggattgcttaag

SEQ ID NO: 261903 - DNA, 20 bp, Artificial Sequence
  Description of Artificial Sequence: Synthetic oligonucleotide
  Target: ATXN1; (+) strand; PAM type: YTN; PAM sequence: TTG
cttaagcctaagagttcaag

SEQ ID NO: 261904 - DNA, 20 bp, Artificial Sequence
  Description of Artificial Sequence: Synthetic oligonucleotide
  Target: ATXN1; (+) strand; PAM type: YTN; PAM sequence: CTT
aagcctaagagttcaaggct

SEQ ID NO: 261905 - DNA, 20 bp, Artificial Sequence
  Description of Artificial Sequence: Synthetic oligonucleotide
  Target: ATXN1; (+) strand; PAM type: YTN; PAM sequence: TTA
agcctaagagttcaaggctg

SEQ ID NO: 261906 - DNA, 20 bp, Artificial Sequence
  Description of Artificial Sequence: Synthetic oligonucleotide
  Target: ATXN1; (+) strand; PAM type: YTN; PAM sequence: CTA
agagttcaaggctgcagtga

SEQ ID NO: 261907 - DNA, 20 bp, Artificial Sequence
  Description of Artificial Sequence: Synthetic oligonucleotide
  Target: ATXN1; (+) strand; PAM type: YTN; PAM sequence: TTC
aaggctgcagtgagccaaga

SEQ ID NO: 261908 - DNA, 20 bp, Artificial Sequence
  Description of Artificial Sequence: Synthetic oligonucleotide
  Target: ATXN1; (+) strand; PAM type: YTN; PAM sequence: CTG
cagtgagccaagactgtacc

SEQ ID NO: 261909 - DNA, 20 bp, Artificial Sequence
  Description of Artificial Sequence: Synthetic oligonucleotide
  Target: ATXN1; (+) strand; PAM type: YTN; PAM sequence: CTG
taccactgtactccagcctg

SEQ ID NO: 261910 - DNA, 20 bp, Artificial Sequence
  Description of Artificial Sequence: Synthetic oligonucleotide
  Target: ATXN1; (+) strand; PAM type: YTN; PAM sequence: CTG
tactccagcctgggtgacaa

SEQ ID NO: 261911 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacaaagtga

SEQ ID NO: 261912 - DNA, 20 bp, Artificial Sequence
  Description of Artificial Sequence: Synthetic oligonucleotide
  Target: ATXN1; (+) strand; PAM type: YTN; PAM sequence: CTG
ggtgacaaagtgagaccctg

SEQ ID NO: 261913 - DNA, 20 bp, Artificial Sequence
  Description of Artificial Sequence: Synthetic oligonucleotide
  Target: ATXN1; (+) strand; PAM type: YTN; PAM sequence: CTG
tctctaaataaataaataaa

SEQ ID NO: 261914 - DNA, 20 bp, Artificial Sequence
  Description of Artificial Sequence: Synthetic oligonucleotide
  Target: ATXN1; (+) strand; PAM type: YTN; PAM sequence: CTC
taaataaataaataaatcta

SEQ ID NO: 261915 - DNA, 20 bp, Artificial Sequence
  Description of Artificial Sequence: Synthetic oligonucleotide
  Target: ATXN1; (+) strand; PAM type: YTN; PAM sequence: CTA
aataaataaataaatctatt

SEQ ID NO: 261916 - DNA, 20 bp, Artificial Sequence
  Description of Artificial Sequence: Synthetic oligonucleotide
  Target: ATXN1; (+) strand; PAM type: YTN; PAM sequence: CTA
ttggagcaaaaaaaaaaaaa

SEQ ID NO: 261917 - DNA, 20 bp, Artificial Sequence
  Description of Artificial Sequence: Synthetic oligonucleotide
  Target: ATXN1; (+) strand; PAM type: YTN; PAM sequence: TTG
gagcaaaaaaaaaaaaaaaa

SEQ ID NO: 261918 - DNA, 20 bp, Artificial Sequence
  Description of Artificial Sequence: Synthetic oligonucleotide
  Target: ATXN1; (+) strand; PAM type: YTN; PAM sequence: CTA
cctaaatagtatgattgctt

SEQ ID NO: 261919 - DNA, 20 bp, Artificial Sequence
  Description of Artificial Sequence: Synthetic oligonucleotide
  Target: ATXN1; (+) strand; PAM type: YTN; PAM sequence: CTA
aatagtatgattgcttataa

SEQ ID NO: 261920 - DNA, 20 bp, Artificial Sequence
  Description of Artificial Sequence: Synthetic oligonucleotide
  Target: ATXN1; (+) strand; PAM type: YTN; PAM sequence: TTG
cttataataaaaatgaaaga

SEQ ID NO: 261921 - DNA, 20 bp, Artificial Sequence
  Description of Artificial Sequence: Synthetic oligonucleotide
  Target: ATXN1; (+) strand; PAM type: YTN; PAM sequence: CTT
ataataaaaatgaaagatat

SEQ ID NO: 261922 - DNA, 20 bp, Artificial Sequence
  Description of Artificial Sequence: Synthetic oligonucleotide
  Target: ATXN1; (+) strand; PAM type: YTN; PAM sequence: TTA
taataaaaatgaaagatatg

SEQ ID NO: 261923 - DNA, 20 bp, Artificial Sequence
  Description of Artificial Sequence: Synthetic oligonucleotide
  Target: ATXN1; (+) strand; PAM type: YTN; PAM sequence: CTA
aaaatggtaaaaaggagaaa

SEQ ID NO: 261924 - DNA, 20 bp, Artificial Sequence
  Description of Artificial Sequence: Synthetic oligonucleotide
  Target: ATXN1; (+) strand; PAM type: YTN; PAM sequence: CTT
caacgacttcaccttgtttt

SEQ ID NO: 261925 - DNA, 20 bp, Artificial Sequence
  Description of Artificial Sequence: Synthetic oligonucleotide
  Target: ATXN1; (+) strand; PAM type: YTN; PAM sequence: TTC
aacgacttcaccttgttttg

SEQ ID NO: 261926 - DNA, 20 bp, Artificial Sequence
  Description of Artificial Sequence: Synthetic oligonucleotide
  Target: ATXN1; (+) strand; PAM type: YTN; PAM sequence: CTT
caccttgttttgtgggtttt

SEQ ID NO: 261927 - DNA, 20 bp, Artificial Sequence
  Description of Artificial Sequence: Synthetic oligonucleotide
  Target: ATXN1; (+) strand; PAM type: YTN; PAM sequence: TTC
accttgttttgtgggttttg

SEQ ID NO: 261928 - DNA, 20 bp, Artificial Sequence
  Description of Artificial Sequence: Synthetic oligonucleotide
  Target: ATXN1; (+) strand; PAM type: YTN; PAM sequence: CTT
gttttgtgggttttgtttca

SEQ ID NO: 261929 - DNA, 20 bp, Artificial Sequence
  Description of Artificial Sequence: Synthetic oligonucleotide
  Target: ATXN1; (+) strand; PAM type: YTN; PAM sequence: TTG
ttttgtgggttttgtttcag

SEQ ID NO: 261930 - DNA, 20 bp, Artificial Sequence
  Description of Artificial Sequence: Synthetic oligonucleotide
  Target: ATXN1; (+) strand; PAM type: YTN; PAM sequence: TTT
tgtgggttttgtttcaggaa

SEQ ID NO: 261931 - DNA, 20 bp, Artificial Sequence
  Description of Artificial Sequence: Synthetic oligonucleotide
  Target: ATXN1; (+) strand; PAM type: YTN; PAM sequence: TTT
gtgggttttgtttcaggaaa

SEQ ID NO: 261932 - DNA, 20 bp, Artificial Sequence
  Description of Artificial Sequence: Synthetic oligonucleotide
  Target: ATXN1; (+) strand; PAM type: YTN; PAM sequence: TTG
tgggttttgtttcaggaaaa

SEQ ID NO: 261933 - DNA, 20 bp, Artificial Sequence
  Description of Artificial Sequence: Synthetic oligonucleotide
  Target: ATXN1; (+) strand; PAM type: YTN; PAM sequence: TTT
tgtttcaggaaaatttaaat

SEQ ID NO: 261934 - DNA, 20 bp, Artificial Sequence
  Description of Artificial Sequence: Synthetic oligonucleotide
  Target: ATXN1; (+) strand; PAM type: YTN; PAM sequence: TTT
gtttcaggaaaatttaaata

SEQ ID NO: 261935 - DNA, 20 bp, Artificial Sequence
  Description of Artificial Sequence: Synthetic oligonucleotide
  Target: ATXN1; (+) strand; PAM type: YTN; PAM sequence: TTG
tttcaggaaaatttaaatat

SEQ ID NO: 261936 - DNA, 20 bp, Artificial Sequence
  Description of Artificial Sequence: Synthetic oligonucleotide
  Target: ATXN1; (+) strand; PAM type: YTN; PAM sequence: TTT
caggaaaatttaaatatttt

SEQ ID NO: 261937 - DNA, 20 bp, Artificial Sequence
  Description of Artificial Sequence: Synthetic oligonucleotide
  Target: ATXN1; (+) strand; PAM type: YTN; PAM sequence: TTC
aggaaaatttaaatattttt

SEQ ID NO: 261938 - DNA, 20 bp, Artificial Sequence
  Description of Artificial Sequence: Synthetic oligonucleotide
  Target: ATXN1; (+) strand; PAM type: YTN; PAM sequence: TTT
aaatatttttatataattat

SEQ ID NO: 261939 - DNA, 20 bp, Artificial Sequence
  Description of Artificial Sequence: Synthetic oligonucleotide
  Target: ATXN1; (+) strand; PAM type: YTN; PAM sequence: TTA
aatatttttatataattatt

SEQ ID NO: 261940 - DNA, 20 bp, Artificial Sequence
  Description of Artificial Sequence: Synthetic oligonucleotide
  Target: ATXN1; (+) strand; PAM type: YTN; PAM sequence: TTT
ttatataattattgaacaag

SEQ ID NO: 261941 - DNA, 20 bp, Artificial Sequence
  Description of Artificial Sequence: Synthetic oligonucleotide
  Target: ATXN1; (+) strand; PAM type: YTN; PAM sequence: TTT
tatataattattgaacaaga

SEQ ID NO: 261942 - DNA, 20 bp, Artificial Sequence
  Description of Artificial Sequence: Synthetic oligonucleotide
  Target: ATXN1; (+) strand; PAM type: YTN; PAM sequence: TTT
atataattattgaacaagaa

SEQ ID NO: 261943 - DNA, 20 bp, Artificial Sequence
  Description of Artificial Sequence: Synthetic oligonucleotide
  Target: ATXN1; (+) strand; PAM type: YTN; PAM sequence: TTA
tataattattgaacaagaat

SEQ ID NO: 261944 - DNA, 20 bp, Artificial Sequence
  Description of Artificial Sequence: Synthetic oligonucleotide
  Target: ATXN1; (+) strand; PAM type: YTN; PAM sequence: TTA
ttgaacaagaatcacttttc

SEQ ID NO: 261945 - DNA, 20 bp, Artificial Sequence
  Description of Artificial Sequence: Synthetic oligonucleotide
  Target: ATXN1; (+) strand; PAM type: YTN; PAM sequence: TTG
aacaagaatcacttttcaaa

SEQ ID NO: 261946 - DNA, 20 bp, Artificial Sequence
  Description of Artificial Sequence: Synthetic oligonucleotide
  Target: ATXN1; (+) strand; PAM type: YTN; PAM sequence: CTT
ttcaaaagcctcttaggaag

SEQ ID NO: 261947 - DNA, 20 bp, Artificial Sequence
  Description of Artificial Sequence: Synthetic oligonucleotide
  Target: ATXN1; (+) strand; PAM type: YTN; PAM sequence: TTT
tcaaaagcctcttaggaagt

SEQ ID NO: 261948 - DNA, 20 bp, Artificial Sequence
  Description of Artificial Sequence: Synthetic oligonucleotide
  Target: ATXN1; (+) strand; PAM type: YTN; PAM sequence: TTT
caaaagcctcttaggaagtc

SEQ ID NO: 261949 - DNA, 20 bp, Artificial Sequence
  Description of Artificial Sequence: Synthetic oligonucleotide
  Target: ATXN1; (+) strand; PAM type: YTN; PAM sequence: TTC
aaaagcctcttaggaagtct

SEQ ID NO: 261950 - DNA, 20 bp, Artificial Sequence
  Description of Artificial Sequence: Synthetic oligonucleotide
  Target: ATXN1; (+) strand; PAM type: YTN; PAM sequence: CTC
ttaggaagtctcaaattaaa

SEQ ID NO: 261951 - DNA, 20 bp, Artificial Sequence
  Description of Artificial Sequence: Synthetic oligonucleotide
  Target: ATXN1; (+) strand; PAM type: YTN; PAM sequence: CTT
aggaagtctcaaattaaagt

SEQ ID NO: 261952 - DNA, 20 bp, Artificial Sequence
  Description of Artificial Sequence: Synthetic oligonucleotide
  Target: ATXN1; (+) strand; PAM type: YTN; PAM sequence: TTA
ggaagtctcaaattaaagta

SEQ ID NO: 261953 - DNA, 20 bp, Artificial Sequence
  Description of Artificial Sequence: Synthetic oligonucleotide
  Target: ATXN1; (+) strand; PAM type: YTN; PAM sequence: CTC
aaattaaagtaagtgaactc

SEQ ID NO: 261954 - DNA, 20 bp, Artificial Sequence
  Description of Artificial Sequence: Synthetic oligonucleotide
  Target: ATXN1; (+) strand; PAM type: YTN; PAM sequence: TTA
aagtaagtgaactcaaatgt

SEQ ID NO: 261955 - DNA, 20 bp, Artificial Sequence
  Description of Artificial Sequence: Synthetic oligonucleotide
  Target: ATXN1; (+) strand; PAM type: YTN; PAM sequence: CTC
aaatgtatatccagttattg

SEQ ID NO: 261956 - DNA, 20 bp, Artificial Sequence
  Description of Artificial Sequence: Synthetic oligonucleotide
  Target: ATXN1; (+) strand; PAM type: YTN; PAM sequence: TTA
ttggcataaacacacagact

SEQ ID NO: 261957 - DNA, 20 bp, Artificial Sequence
  Description of Artificial Sequence: Synthetic oligonucleotide
  Target: ATXN1; (+) strand; PAM type: YTN; PAM sequence: TTG
gcataaacacacagactgta

SEQ ID NO: 261958 - DNA, 20 bp, Artificial Sequence
  Description of Artificial Sequence: Synthetic oligonucleotide
  Target: ATXN1; (+) strand; PAM type: YTN; PAM sequence: CTG
taactattccaaatgaccct

SEQ ID NO: 261959 - DNA, 20 bp, Artificial Sequence
  Description of Artificial Sequence: Synthetic oligonucleotide
  Target: ATXN1; (+) strand; PAM type: YTN; PAM sequence: CTA
ttccaaatgaccctaacata

SEQ ID NO: 261960 - DNA, 20 bp, Artificial Sequence
  Description of Artificial Sequence: Synthetic oligonucleotide
  Target: ATXN1; (+) strand; PAM type: YTN; PAM sequence: TTC
caaatgaccctaacatattg

SEQ ID NO: 261961 - DNA, 20 bp, Artificial Sequence
  Description of Artificial Sequence: Synthetic oligonucleotide
  Target: ATXN1; (+) strand; PAM type: YTN; PAM sequence: CTA
acatattgtaatgtaattgt

SEQ ID NO: 261962 - DNA, 20 bp, Artificial Sequence
  Description of Artificial Sequence: Synthetic oligonucleotide
  Target: ATXN1; (+) strand; PAM type: YTN; PAM sequence: TTG
taatgtaattgtccatctct

SEQ ID NO: 261963 - DNA, 20 bp, Artificial Sequence
  Description of Artificial Sequence: Synthetic oligonucleotide
  Target: ATXN1; (+) strand; PAM type: YTN; PAM sequence: TTG
tccatctctagcccagtgga

SEQ ID NO: 261964 - DNA, 20 bp, Artificial Sequence
  Description of Artificial Sequence: Synthetic oligonucleotide
  Target: ATXN1; (+) strand; PAM type: YTN; PAM sequence: CTC
tagcccagtggactaaaaac

SEQ ID NO: 261965 - DNA, 20 bp, Artificial Sequence
  Description of Artificial Sequence: Synthetic oligonucleotide
  Target: ATXN1; (+) strand; PAM type: YTN; PAM sequence: CTA
gcccagtggactaaaaacca

SEQ ID NO: 261966 - DNA, 20 bp, Artificial Sequence
  Description of Artificial Sequence: Synthetic oligonucleotide
  Target: ATXN1; (+) strand; PAM type: YTN; PAM sequence: CTA
aaaaccaatacaaaactaaa

SEQ ID NO: 261967 - DNA, 20 bp, Artificial Sequence
  Description of Artificial Sequence: Synthetic oligonucleotide
  Target: ATXN1; (+) strand; PAM type: YTN; PAM sequence: CTA
aacaatcaaaataaaaaaaa

SEQ ID NO: 261968 - DNA, 20 bp, Artificial Sequence
  Description of Artificial Sequence: Synthetic oligonucleotide
  Target: ATXN1; (+) strand; PAM type: YTN; PAM sequence: CTT
aaacattttcagtaagcata

SEQ ID NO: 261969 - DNA, 20 bp, Artificial Sequence
  Description of Artificial Sequence: Synthetic oligonucleotide
  Target: ATXN1; (+) strand; PAM type: YTN; PAM sequence: TTA
aacattttcagtaagcatat

SEQ ID NO: 261970 - DNA, 20 bp, Artificial Sequence
  Description of Artificial Sequence: Synthetic oligonucleotide
  Target: ATXN1; (+) strand; PAM type: YTN; PAM sequence: TTT
tcagtaagcatattgttgca

SEQ ID NO: 261971 - DNA, 20 bp, Artificial Sequence
  Description of Artificial Sequence: Synthetic oligonucleotide
  Target: ATXN1; (+) strand; PAM type: YTN; PAM sequence: TTT
cagtaagcatattgttgcaa

SEQ ID NO: 261972 - DNA, 20 bp, Artificial Sequence
  Description of Artificial Sequence: Synthetic oligonucleotide
  Target: ATXN1; (+) strand; PAM type: YTN; PAM sequence: TTC
agtaagcatattgttgcaat

SEQ ID NO: 261973 - DNA, 20 bp, Artificial Sequence
  Description of Artificial Sequence: Synthetic oligonucleotide
  Target: ATXN1; (+) strand; PAM type: YTN; PAM sequence: TTG
ttgcaatgtcactggcattt

SEQ ID NO: 261974 - DNA, 20 bp, Artificial Sequence
  Description of Artificial Sequence: Synthetic oligonucleotide
  Target: ATXN1; (+) strand; PAM type: YTN; PAM sequence: TTG
caatgtcactggcatttttg

SEQ ID NO: 261975 - DNA, 20 bp, Artificial Sequence
  Description of Artificial Sequence: Synthetic oligonucleotide
  Target: ATXN1; (+) strand; PAM type: YTN; PAM sequence: CTG
gcatttttgttcggaaatta

SEQ ID NO: 261976 - DNA, 20 bp, Artificial Sequence
  Description of Artificial Sequence: Synthetic oligonucleotide
  Target: ATXN1; (+) strand; PAM type: YTN; PAM sequence: TTT
ttgttcggaaattattgcaa

SEQ ID NO: 261977 - DNA, 20 bp, Artificial Sequence
  Description of Artificial Sequence: Synthetic oligonucleotide
  Target: ATXN1; (+) strand; PAM type: YTN; PAM sequence: TTT
tgttcggaaattattgcaag

SEQ ID NO: 261978 - DNA, 20 bp, Artificial Sequence
  Description of Artificial Sequence: Synthetic oligonucleotide
  Target: ATXN1; (+) strand; PAM type: YTN; PAM sequence: TTT
gttcggaaattattgcaagt

SEQ ID NO: 261979 - DNA, 20 bp, Artificial Sequence
  Description of Artificial Sequence: Synthetic oligonucleotide
  Target: ATXN1; (+) strand; PAM type: YTN; PAM sequence: TTG
ttcggaaattattgcaagtg

SEQ ID NO: 261980 - DNA, 20 bp, Artificial Sequence
  Description of Artificial Sequence: Synthetic oligonucleotide
  Target: ATXN1; (+) strand; PAM type: YTN; PAM sequence: TTC
ggaaattattgcaagtgtag

SEQ ID NO: 261981 - DNA, 20 bp, Artificial Sequence
  Description of Artificial Sequence: Synthetic oligonucleotide
  Target: ATXN1; (+) strand; PAM type: YTN; PAM sequence: TTA
ttgcaagtgtagtgtgggag

SEQ ID NO: 261982 - DNA, 20 bp, Artificial Sequence
  Description of Artificial Sequence: Synthetic oligonucleotide
  Target: ATXN1; (+) strand; PAM type: YTN; PAM sequence: TTG
caagtgtagtgtgggagaaa

SEQ ID NO: 261983 - DNA, 20 bp, Artificial Sequence
  Description of Artificial Sequence: Synthetic oligonucleotide
  Target: ATXN1; (+) strand; PAM type: YTN; PAM sequence: TTG
tgttggtgtgagtgagaact

SEQ ID NO: 261984 - DNA, 20 bp, Artificial Sequence
  Description of Artificial Sequence: Synthetic oligonucleotide
  Target: ATXN1; (+) strand; PAM type: YTN; PAM sequence: TTG
gtgtgagtgagaactgctat

SEQ ID NO: 261985 - DNA, 20 bp, Artificial Sequence
  Description of Artificial Sequence: Synthetic oligonucleotide
  Target: ATXN1; (+) strand; PAM type: YTN; PAM sequence: CTG
ctattttcagtttgagagaa

SEQ ID NO: 261986 - DNA, 20 bp, Artificial Sequence
  Description of Artificial Sequence: Synthetic oligonucleotide
  Target: ATXN1; (+) strand; PAM type: YTN; PAM sequence: CTA
ttttcagtttgagagaaaga

SEQ ID NO: 261987 - DNA, 20 bp, Artificial Sequence
  Description of Artificial Sequence: Synthetic oligonucleotide
  Target: ATXN1; (+) strand; PAM type: YTN; PAM sequence: TTT
tcagtttgagagaaagaaaa

SEQ ID NO: 261988 - DNA, 20 bp, Artificial Sequence
  Description of Artificial Sequence: Synthetic oligonucleotide
  Target: ATXN1; (+) strand; PAM type: YTN; PAM sequence: TTT
cagtttgagagaaagaaaat

SEQ ID NO: 261989 - DNA, 20 bp, Artificial Sequence
  Description of Artificial Sequence: Synthetic oligonucleotide
  Target: ATXN1; (+) strand; PAM type: YTN; PAM sequence: TTC
agtttgagagaaagaaaata

SEQ ID NO: 261990 - DNA, 20 bp, Artificial Sequence
  Description of Artificial Sequence: Synthetic oligonucleotide
  Target: ATXN1; (+) strand; PAM type: YTN; PAM sequence: TTT
gagagaaagaaaatactgat

SEQ ID NO: 261991 - DNA, 20 bp, Artificial Sequence
  Description of Artificial Sequence: Synthetic oligonucleotide
  Target: ATXN1; (+) strand; PAM type: YTN; PAM sequence: TTG
agagaaagaaaatactgatg

SEQ ID NO: 261992 - DNA, 20 bp, Artificial Sequence
  Description of Artificial Sequence: Synthetic oligonucleotide
  Target: ATXN1; (+) strand; PAM type: YTN; PAM sequence: CTG
atgtaaaatgaatgaagtta

SEQ ID NO: 261993 - DNA, 20 bp, Artificial Sequence
  Description of Artificial Sequence: Synthetic oligonucleotide
  Target: ATXN1; (+) strand; PAM type: YTN; PAM sequence: TTA
agtaaaagccttgtggcaca

SEQ ID NO: 261994 - DNA, 20 bp, Artificial Sequence
  Description of Artificial Sequence: Synthetic oligonucleotide
  Target: ATXN1; (+) strand; PAM type: YTN; PAM sequence: CTT
gtggcacatcagtataaact

SEQ ID NO: 261995 - DNA, 20 bp, Artificial Sequence
  Description of Artificial Sequence: Synthetic oligonucleotide
  Target: ATXN1; (+) strand; PAM type: YTN; PAM sequence: TTG
tggcacatcagtataaactc

SEQ ID NO: 261996 - DNA, 20 bp, Artificial Sequence
  Description of Artificial Sequence: Synthetic oligonucleotide
  Target: ATXN1; (+) strand; PAM type: YTN; PAM sequence: CTC
atgaggtattttaccttaaa

SEQ ID NO: 261997 - DNA, 20 bp, Artificial Sequence
  Description of Artificial Sequence: Synthetic oligonucleotide
  Target: ATXN1; (+) strand; PAM type: YTN; PAM sequence: TTT
taccttaaaaaatacgtaca

SEQ ID NO: 261998 - DNA, 20 bp, Artificial Sequence
  Description of Artificial Sequence: Synthetic oligonucleotide
  Target: ATXN1; (+) strand; PAM type: YTN; PAM sequence: TTT
accttaaaaaatacgtacac

SEQ ID NO: 261999 - DNA, 20 bp, Artificial Sequence
  Description of Artificial Sequence: Synthetic oligonucleotide
  Target: ATXN1; (+) strand; PAM type: YTN; PAM sequence: TTA
ccttaaaaaatacgtacaca

SEQ ID NO: 262000 - DNA, 20 bp, Artificial Sequence
  Description of Artificial Sequence: Synthetic oligonucleotide
  Target: ATXN1; (+) strand; PAM type: YTN; PAM sequence: CTT
aaaaaatacgtacacacggc

SEQ ID NO: 262001 - DNA, 20 bp, Artificial Sequence
  Description of Artificial Sequence: Synthetic oligonucleotide
  Target: ATXN1; (+) strand; PAM type: YTN; PAM sequence: TTA
aaaaatacgtacacacggcc

SEQ ID NO: 262002 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcccagcact

SEQ ID NO: 262003 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 262004 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggagggccg

SEQ ID NO: 262005 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggagggccga

SEQ ID NO: 262006 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggagggccgat

SEQ ID NO: 262007 - DNA, 20 bp, Artificial Sequence
  Description of Artificial Sequence: Synthetic oligonucleotide
  Target: ATXN1; (+) strand; PAM type: YTN; PAM sequence: CTG
gctaacacagtgaaaccccg

SEQ ID NO: 262008 - DNA, 20 bp, Artificial Sequence
  Description of Artificial Sequence: Synthetic oligonucleotide
  Target: ATXN1; (+) strand; PAM type: YTN; PAM sequence: CTA
acacagtgaaaccccgtctc

SEQ ID NO: 262009 - DNA, 20 bp, Artificial Sequence
  Description of Artificial Sequence: Synthetic oligonucleotide
  Target: ATXN1; (+) strand; PAM type: YTN; PAM sequence: CTC
tactaaaaacagaaaagatt

SEQ ID NO: 262010 - DNA, 20 bp, Artificial Sequence
  Description of Artificial Sequence: Synthetic oligonucleotide
  Target: ATXN1; (+) strand; PAM type: YTN; PAM sequence: CTA
ctaaaaacagaaaagattag

SEQ ID NO: 262011 - DNA, 20 bp, Artificial Sequence
  Description of Artificial Sequence: Synthetic oligonucleotide
  Target: ATXN1; (+) strand; PAM type: YTN; PAM sequence: CTA
aaaacagaaaagattagcca

SEQ ID NO: 262012 - DNA, 20 bp, Artificial Sequence
  Description of Artificial Sequence: Synthetic oligonucleotide
  Target: ATXN1; (+) strand; PAM type: YTN; PAM sequence: TTA
gccaggcgtggtggcgggcg

SEQ ID NO: 262013 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctactcgggag

SEQ ID NO: 262014 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggctgaggcagga

SEQ ID NO: 262015 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcaggagaa

SEQ ID NO: 262016 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatggcgtgaa

SEQ ID NO: 262017 - DNA, 20 bp, Artificial Sequence
  Description of Artificial Sequence: Synthetic oligonucleotide
  Target: ATXN1; (+) strand; PAM type: YTN; PAM sequence: CTG
ggaggtggagcttgcagtga

SEQ ID NO: 262018 - DNA, 20 bp, Artificial Sequence
  Description of Artificial Sequence: Synthetic oligonucleotide
  Target: ATXN1; (+) strand; PAM type: YTN; PAM sequence: CTT
gcagtgagccgagattgcgc

SEQ ID NO: 262019 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagattgcgcc

SEQ ID NO: 262020 - DNA, 20 bp, Artificial Sequence
  Description of Artificial Sequence: Synthetic oligonucleotide
  Target: ATXN1; (+) strand; PAM type: YTN; PAM sequence: TTG
cgccactgcattccagcctg

SEQ ID NO: 262021 - DNA, 20 bp, Artificial Sequence
  Description of Artificial Sequence: Synthetic oligonucleotide
  Target: ATXN1; (+) strand; PAM type: YTN; PAM sequence: CTG
cattccagcctgggcgacag

SEQ ID NO: 262022 - DNA, 20 bp, Artificial Sequence
  Description of Artificial Sequence: Synthetic oligonucleotide
  Target: ATXN1; (+) strand; PAM type: YTN; PAM sequence: TTC
cagcctgggcgacagagcga

SEQ ID NO: 262023 - DNA, 20 bp, Artificial Sequence
  Description of Artificial Sequence: Synthetic oligonucleotide
  Target: ATXN1; (+) strand; PAM type: YTN; PAM sequence: CTG
ggcgacagagcgaggctccg

SEQ ID NO: 262024 - DNA, 20 bp, Artificial Sequence
  Description of Artificial Sequence: Synthetic oligonucleotide
  Target: ATXN1; (+) strand; PAM type: YTN; PAM sequence: CTC
cgtctcaaaaaaaaaaaaaa

SEQ ID NO: 262025 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaagta

SEQ ID NO: 262026 - DNA, 20 bp, Artificial Sequence
  Description of Artificial Sequence: Synthetic oligonucleotide
  Target: ATXN1; (+) strand; PAM type: YTN; PAM sequence: CTA
tatctatatctagagagaca

SEQ ID NO: 262027 - DNA, 20 bp, Artificial Sequence
  Description of Artificial Sequence: Synthetic oligonucleotide
  Target: ATXN1; (+) strand; PAM type: YTN; PAM sequence: CTA
tatctagagagacacagatt

SEQ ID NO: 262028 - DNA, 20 bp, Artificial Sequence
  Description of Artificial Sequence: Synthetic oligonucleotide
  Target: ATXN1; (+) strand; PAM type: YTN; PAM sequence: CTA
gagagacacagatttcctat

SEQ ID NO: 262029 - DNA, 20 bp, Artificial Sequence
  Description of Artificial Sequence: Synthetic oligonucleotide
  Target: ATXN1; (+) strand; PAM type: YTN; PAM sequence: TTT
cctatcactggctgtgtcca

SEQ ID NO: 262030 - DNA, 20 bp, Artificial Sequence
  Description of Artificial Sequence: Synthetic oligonucleotide
  Target: ATXN1; (+) strand; PAM type: YTN; PAM sequence: TTC
ctatcactggctgtgtccac

SEQ ID NO: 262031 - DNA, 20 bp, Artificial Sequence
  Description of Artificial Sequence: Synthetic oligonucleotide
  Target: ATXN1; (+) strand; PAM type: YTN; PAM sequence: CTA
tcactggctgtgtccactgg

SEQ ID NO: 262032 - DNA, 20 bp, Artificial Sequence
  Description of Artificial Sequence: Synthetic oligonucleotide
  Target: ATXN1; (+) strand; PAM type: YTN; PAM sequence: CTG
gctgtgtccactggaaagga

SEQ ID NO: 262033 - DNA, 20 bp, Artificial Sequence
  Description of Artificial Sequence: Synthetic oligonucleotide
  Target: ATXN1; (+) strand; PAM type: YTN; PAM sequence: CTG
tgtccactggaaaggaaaaa

SEQ ID NO: 262034 - DNA, 20 bp, Artificial Sequence
  Description of Artificial Sequence: Synthetic oligonucleotide
  Target: ATXN1; (+) strand; PAM type: YTN; PAM sequence: CTG
gaaaggaaaaacaatattca

SEQ ID NO: 262035 - DNA, 20 bp, Artificial Sequence
  Description of Artificial Sequence: Synthetic oligonucleotide
  Target: ATXN1; (+) strand; PAM type: YTN; PAM sequence: TTC
aacccagtgagaacagttcc

SEQ ID NO: 262036 - DNA, 20 bp, Artificial Sequence
  Description of Artificial Sequence: Synthetic oligonucleotide
  Target: ATXN1; (+) strand; PAM type: YTN; PAM sequence: TTC
ccctggggcccagtctttgg

SEQ ID NO: 262037 - DNA, 20 bp, Artificial Sequence
  Description of Artificial Sequence: Synthetic oligonucleotide
  Target: ATXN1; (+) strand; PAM type: YTN; PAM sequence: CTG
gggcccagtctttggtctcc

SEQ ID NO: 262038 - DNA, 20 bp, Artificial Sequence
  Description of Artificial Sequence: Synthetic oligonucleotide
  Target: ATXN1; (+) strand; PAM type: YTN; PAM sequence: CTT
tggtctccaaatatcatttc

SEQ ID NO: 262039 - DNA, 20 bp, Artificial Sequence
  Description of Artificial Sequence: Synthetic oligonucleotide
  Target: ATXN1; (+) strand; PAM type: YTN; PAM sequence: TTT
ggtctccaaatatcatttct

SEQ ID NO: 262040 - DNA, 20 bp, Artificial Sequence
  Description of Artificial Sequence: Synthetic oligonucleotide
  Target: ATXN1; (+) strand; PAM type: YTN; PAM sequence: TTG
gtctccaaatatcatttctc

SEQ ID NO: 262041 - DNA, 20 bp, Artificial Sequence
  Description of Artificial Sequence: Synthetic oligonucleotide
  Target: ATXN1; (+) strand; PAM type: YTN; PAM sequence: CTC
caaatatcatttctcactga

SEQ ID NO: 262042 - DNA, 20 bp, Artificial Sequence
  Description of Artificial Sequence: Synthetic oligonucleotide
  Target: ATXN1; (+) strand; PAM type: YTN; PAM sequence: TTT
ctcactgaaagaaaccaggt

SEQ ID NO: 262043 - DNA, 20 bp, Artificial Sequence
  Description of Artificial Sequence: Synthetic oligonucleotide
  Target: ATXN1; (+) strand; PAM type: YTN; PAM sequence: TTC
tcactgaaagaaaccaggtc

SEQ ID NO: 262044 - DNA, 20 bp, Artificial Sequence
  Description of Artificial Sequence: Synthetic oligonucleotide
  Target: ATXN1; (+) strand; PAM type: YTN; PAM sequence: CTC
actgaaagaaaccaggtctc

SEQ ID NO: 262045 - DNA, 20 bp, Artificial Sequence
  Description of Artificial Sequence: Synthetic oligonucleotide
  Target: ATXN1; (+) strand; PAM type: YTN; PAM sequence: CTG
aaagaaaccaggtctccttg

SEQ ID NO: 262046 - DNA, 20 bp, Artificial Sequence
  Description of Artificial Sequence: Synthetic oligonucleotide
  Target: ATXN1; (+) strand; PAM type: YTN; PAM sequence: CTC
cttggaaaaaagctgatccc

SEQ ID NO: 262047 - DNA, 20 bp, Artificial Sequence
  Description of Artificial Sequence: Synthetic oligonucleotide
  Target: ATXN1; (+) strand; PAM type: YTN; PAM sequence: CTT
ggaaaaaagctgatcccaga

SEQ ID NO: 262048 - DNA, 20 bp, Artificial Sequence
  Description of Artificial Sequence: Synthetic oligonucleotide
  Target: ATXN1; (+) strand; PAM type: YTN; PAM sequence: TTG
gaaaaaagctgatcccagag

SEQ ID NO: 262049 - DNA, 20 bp, Artificial Sequence
  Description of Artificial Sequence: Synthetic oligonucleotide
  Target: ATXN1; (+) strand; PAM type: YTN; PAM sequence: CTG
atcccagagctaaggcaaga

SEQ ID NO: 262050 - DNA, 20 bp, Artificial Sequence
  Description of Artificial Sequence: Synthetic oligonucleotide
  Target: ATXN1; (+) strand; PAM type: YTN; PAM sequence: CTA
aggcaagaaatgtacaagat

SEQ ID NO: 262051 - DNA, 20 bp, Artificial Sequence
  Description of Artificial Sequence: Synthetic oligonucleotide
  Target: ATXN1; (+) strand; PAM type: YTN; PAM sequence: CTG
gaacatagtgttatactaga

SEQ ID NO: 262052 - DNA, 20 bp, Artificial Sequence
  Description of Artificial Sequence: Synthetic oligonucleotide
  Target: ATXN1; (+) strand; PAM type: YTN; PAM sequence: TTA
tactagaaagcaagaaaact

SEQ ID NO: 262053 - DNA, 20 bp, Artificial Sequence
  Description of Artificial Sequence: Synthetic oligonucleotide
  Target: ATXN1; (+) strand; PAM type: YTN; PAM sequence: CTA
gaaagcaagaaaactatcaa

SEQ ID NO: 262054 - DNA, 20 bp, Artificial Sequence
  Description of Artificial Sequence: Synthetic oligonucleotide
  Target: ATXN1; (+) strand; PAM type: YTN; PAM sequence: CTA
tcaaagacagccagtattgg

SEQ ID NO: 262055 - DNA, 20 bp, Artificial Sequence
  Description of Artificial Sequence: Synthetic oligonucleotide
  Target: ATXN1; (+) strand; PAM type: YTN; PAM sequence: TTG
gattaaaaggactcagtagc

SEQ ID NO: 262056 - DNA, 20 bp, Artificial Sequence
  Description of Artificial Sequence: Synthetic oligonucleotide
  Target: ATXN1; (+) strand; PAM type: YTN; PAM sequence: TTA
aaaggactcagtagccaaac

SEQ ID NO: 262057 - DNA, 20 bp, Artificial Sequence
  Description of Artificial Sequence: Synthetic oligonucleotide
  Target: ATXN1; (+) strand; PAM type: YTN; PAM sequence: CTC
agtagccaaactgaatagga

SEQ ID NO: 262058 - DNA, 20 bp, Artificial Sequence
  Description of Artificial Sequence: Synthetic oligonucleotide
  Target: ATXN1; (+) strand; PAM type: YTN; PAM sequence: CTG
aataggatcccaatgctcag

SEQ ID NO: 262059 - DNA, 20 bp, Artificial Sequence
  Description of Artificial Sequence: Synthetic oligonucleotide
  Target: ATXN1; (+) strand; PAM type: YTN; PAM sequence: CTC
agacaggggaccatctgaac

SEQ ID NO: 262060 - DNA, 20 bp, Artificial Sequence
  Description of Artificial Sequence: Synthetic oligonucleotide
  Target: ATXN1; (+) strand; PAM type: YTN; PAM sequence: CTG
aacatgaaaaagggtaatca

SEQ ID NO: 262061 - DNA, 20 bp, Artificial Sequence
  Description of Artificial Sequence: Synthetic oligonucleotide
  Target: ATXN1; (+) strand; PAM type: YTN; PAM sequence: CTG
tcatggactgaaacacaaca

SEQ ID NO: 262062 - DNA, 20 bp, Artificial Sequence
  Description of Artificial Sequence: Synthetic oligonucleotide
  Target: ATXN1; (+) strand; PAM type: YTN; PAM sequence: CTG
aaacacaacagatatgctgc

SEQ ID NO: 262063 - DNA, 20 bp, Artificial Sequence
  Description of Artificial Sequence: Synthetic oligonucleotide
  Target: ATXN1; (+) strand; PAM type: YTN; PAM sequence: CTG
caatctatgaatttacagtc

SEQ ID NO: 262064 - DNA, 20 bp, Artificial Sequence
  Description of Artificial Sequence: Synthetic oligonucleotide
  Target: ATXN1; (+) strand; PAM type: YTN; PAM sequence: CTA
tgaatttacagtcatgcttt

SEQ ID NO: 262065 - DNA, 20 bp, Artificial Sequence
  Description of Artificial Sequence: Synthetic oligonucleotide
  Target: ATXN1; (+) strand; PAM type: YTN; PAM sequence: TTT
acagtcatgctttcaaaaca

SEQ ID NO: 262066 - DNA, 20 bp, Artificial Sequence
  Description of Artificial Sequence: Synthetic oligonucleotide
  Target: ATXN1; (+) strand; PAM type: YTN; PAM sequence: TTA
cagtcatgctttcaaaacac

SEQ ID NO: 262067 - DNA, 20 bp, Artificial Sequence
  Description of Artificial Sequence: Synthetic oligonucleotide
  Target: ATXN1; (+) strand; PAM type: YTN; PAM sequence: CTT
tcaaaacacagtgacttggt

SEQ ID NO: 262068 - DNA, 20 bp, Artificial Sequence
  Description of Artificial Sequence: Synthetic oligonucleotide
  Target: ATXN1; (+) strand; PAM type: YTN; PAM sequence: TTT
caaaacacagtgacttggtt

SEQ ID NO: 262069 - DNA, 20 bp, Artificial Sequence
  Description of Artificial Sequence: Synthetic oligonucleotide
  Target: ATXN1; (+) strand; PAM type: YTN; PAM sequence: TTC
aaaacacagtgacttggttt

SEQ ID NO: 262070 - DNA, 20 bp, Artificial Sequence
  Description of Artificial Sequence: Synthetic oligonucleotide
  Target: ATXN1; (+) strand; PAM type: YTN; PAM sequence: CTT
ggtttgacactgtgaactag

SEQ ID NO: 262071 - DNA, 20 bp, Artificial Sequence
  Description of Artificial Sequence: Synthetic oligonucleotide
  Target: ATXN1; (+) strand; PAM type: YTN; PAM sequence: TTG
gtttgacactgtgaactagc

SEQ ID NO: 262072 - DNA, 20 bp, Artificial Sequence
  Description of Artificial Sequence: Synthetic oligonucleotide
  Target: ATXN1; (+) strand; PAM type: YTN; PAM sequence: TTT
gacactgtgaactagctgta

SEQ ID NO: 262073 - DNA, 20 bp, Artificial Sequence
  Description of Artificial Sequence: Synthetic oligonucleotide
  Target: ATXN1; (+) strand; PAM type: YTN; PAM sequence: TTG
acactgtgaactagctgtat

SEQ ID NO: 262074 - DNA, 20 bp, Artificial Sequence
  Description of Artificial Sequence: Synthetic oligonucleotide
  Target: ATXN1; (+) strand; PAM type: YTN; PAM sequence: CTG
tgaactagctgtatcgtgca

SEQ ID NO: 262075 - DNA, 20 bp, Artificial Sequence
  Description of Artificial Sequence: Synthetic oligonucleotide
  Target: ATXN1; (+) strand; PAM type: YTN; PAM sequence: CTA
gctgtatcgtgcaaattggt

SEQ ID NO: 262076 - DNA, 20 bp, Artificial Sequence
  Description of Artificial Sequence: Synthetic oligonucleotide
  Target: ATXN1; (+) strand; PAM type: YTN; PAM sequence: CTG
tatcgtgcaaattggtaaat

SEQ ID NO: 262077 - DNA, 20 bp, Artificial Sequence
  Description of Artificial Sequence: Synthetic oligonucleotide
  Target: ATXN1; (+) strand; PAM type: YTN; PAM sequence: TTG
gtaaatagacagaatctagt

SEQ ID NO: 262078 - DNA, 20 bp, Artificial Sequence
  Description of Artificial Sequence: Synthetic oligonucleotide
  Target: ATXN1; (+) strand; PAM type: YTN; PAM sequence: CTA
gtatattatcctgcttttcc

SEQ ID NO: 262079 - DNA, 20 bp, Artificial Sequence
  Description of Artificial Sequence: Synthetic oligonucleotide
  Target: ATXN1; (+) strand; PAM type: YTN; PAM sequence: TTA
tcctgcttttcctacaaaac

SEQ ID NO: 262080 - DNA, 20 bp, Artificial Sequence
  Description of Artificial Sequence: Synthetic oligonucleotide
  Target: ATXN1; (+) strand; PAM type: YTN; PAM sequence: CTG
cttttcctacaaaacctgaa

SEQ ID NO: 262081 - DNA, 20 bp, Artificial Sequence
  Description of Artificial Sequence: Synthetic oligonucleotide
  Target: ATXN1; (+) strand; PAM type: YTN; PAM sequence: CTT
ttcctacaaaacctgaagca

SEQ ID NO: 262082 - DNA, 20 bp, Artificial Sequence
  Description of Artificial Sequence: Synthetic oligonucleotide
  Target: ATXN1; (+) strand; PAM type: YTN; PAM sequence: TTT
tcctacaaaacctgaagcac

SEQ ID NO: 262083 - DNA, 20 bp, Artificial Sequence
  Description of Artificial Sequence: Synthetic oligonucleotide
  Target: ATXN1; (+) strand; PAM type: YTN; PAM sequence: TTT
cctacaaaacctgaagcacc

SEQ ID NO: 262084 - DNA, 20 bp, Artificial Sequence
  Description of Artificial Sequence: Synthetic oligonucleotide
  Target: ATXN1; (+) strand; PAM type: YTN; PAM sequence: TTC
ctacaaaacctgaagcaccg

SEQ ID NO: 262085 - DNA, 20 bp, Artificial Sequence
  Description of Artificial Sequence: Synthetic oligonucleotide
  Target: ATXN1; (+) strand; PAM type: YTN; PAM sequence: CTA
caaaacctgaagcaccgggt

SEQ ID NO: 262086 - DNA, 20 bp, Artificial Sequence
  Description of Artificial Sequence: Synthetic oligonucleotide
  Target: ATXN1; (+) strand; PAM type: YTN; PAM sequence: CTG
aagcaccgggtagataaatt

SEQ ID NO: 262087 - DNA, 20 bp, Artificial Sequence
  Description of Artificial Sequence: Synthetic oligonucleotide
  Target: ATXN1; (+) strand; PAM type: YTN; PAM sequence: TTA
cagatgcaaggagtttctct

SEQ ID NO: 262088 - DNA, 20 bp, Artificial Sequence
  Description of Artificial Sequence: Synthetic oligonucleotide
  Target: ATXN1; (+) strand; PAM type: YTN; PAM sequence: TTT
ctcttcatgaacaataattc

SEQ ID NO: 262089 - DNA, 20 bp, Artificial Sequence
  Description of Artificial Sequence: Synthetic oligonucleotide
  Target: ATXN1; (+) strand; PAM type: YTN; PAM sequence: TTC
tcttcatgaacaataattcc

SEQ ID NO: 262090 - DNA, 20 bp, Artificial Sequence
  Description of Artificial Sequence: Synthetic oligonucleotide
  Target: ATXN1; (+) strand; PAM type: YTN; PAM sequence: CTC
ttcatgaacaataattcctg

SEQ ID NO: 262091 - DNA, 20 bp, Artificial Sequence
  Description of Artificial Sequence: Synthetic oligonucleotide
  Target: ATXN1; (+) strand; PAM type: YTN; PAM sequence: CTT
catgaacaataattcctgct

SEQ ID NO: 262092 - DNA, 20 bp, Artificial Sequence
  Description of Artificial Sequence: Synthetic oligonucleotide
  Target: ATXN1; (+) strand; PAM type: YTN; PAM sequence: TTC
atgaacaataattcctgcta

SEQ ID NO: 262093 - DNA, 20 bp, Artificial Sequence
  Description of Artificial Sequence: Synthetic oligonucleotide
  Target: ATXN1; (+) strand; PAM type: YTN; PAM sequence: TTC
ctgctaacaaatgaacaaat

SEQ ID NO: 262094 - DNA, 20 bp, Artificial Sequence
  Description of Artificial Sequence: Synthetic oligonucleotide
  Target: ATXN1; (+) strand; PAM type: YTN; PAM sequence: CTG
ctaacaaatgaacaaataat

SEQ ID NO: 262095 - DNA, 20 bp, Artificial Sequence
  Description of Artificial Sequence: Synthetic oligonucleotide
  Target: ATXN1; (+) strand; PAM type: YTN; PAM sequence: CTA
acaaatgaacaaataataat

SEQ ID NO: 262096 - DNA, 20 bp, Artificial Sequence
  Description of Artificial Sequence: Synthetic oligonucleotide
  Target: ATXN1; (+) strand; PAM type: YTN; PAM sequence: TTA
gactaccactatttgcaatc

SEQ ID NO: 262097 - DNA, 20 bp, Artificial Sequence
  Description of Artificial Sequence: Synthetic oligonucleotide
  Target: ATXN1; (+) strand; PAM type: YTN; PAM sequence: CTA
ccactatttgcaatccctga

SEQ ID NO: 262098 - DNA, 20 bp, Artificial Sequence
  Description of Artificial Sequence: Synthetic oligonucleotide
  Target: ATXN1; (+) strand; PAM type: YTN; PAM sequence: CTA
tttgcaatccctgataaatt

SEQ ID NO: 262099 - DNA, 20 bp, Artificial Sequence
  Description of Artificial Sequence: Synthetic oligonucleotide
  Target: ATXN1; (+) strand; PAM type: YTN; PAM sequence: TTT
gcaatccctgataaatttat

SEQ ID NO: 262100 - DNA, 20 bp, Artificial Sequence
  Description of Artificial Sequence: Synthetic oligonucleotide
  Target: ATXN1; (+) strand; PAM type: YTN; PAM sequence: TTG
caatccctgataaatttatg

SEQ ID NO: 262101 - DNA, 20 bp, Artificial Sequence
  Description of Artificial Sequence: Synthetic oligonucleotide
  Target: ATXN1; (+) strand; PAM type: YTN; PAM sequence: CTG
ataaatttatgaattcagat

SEQ ID NO: 262102 - DNA, 20 bp, Artificial Sequence
  Description of Artificial Sequence: Synthetic oligonucleotide
  Target: ATXN1; (+) strand; PAM type: YTN; PAM sequence: TTT
atgaattcagatgacagtct

SEQ ID NO: 262103 - DNA, 20 bp, Artificial Sequence
  Description of Artificial Sequence: Synthetic oligonucleotide
  Target: ATXN1; (+) strand; PAM type: YTN; PAM sequence: TTA
tgaattcagatgacagtctc

SEQ ID NO: 262104 - DNA, 20 bp, Artificial Sequence
  Description of Artificial Sequence: Synthetic oligonucleotide
  Target: ATXN1; (+) strand; PAM type: YTN; PAM sequence: TTC
agatgacagtctcactgcaa

SEQ ID NO: 262105 - DNA, 20 bp, Artificial Sequence
  Description of Artificial Sequence: Synthetic oligonucleotide
  Target: ATXN1; (+) strand; PAM type: YTN; PAM sequence: CTC
actgcaaaaagagatgccac

SEQ ID NO: 262106 - DNA, 20 bp, Artificial Sequence
  Description of Artificial Sequence: Synthetic oligonucleotide
  Target: ATXN1; (+) strand; PAM type: YTN; PAM sequence: CTG
caaaaagagatgccaccaac

SEQ ID NO: 262107 - DNA, 20 bp, Artificial Sequence
  Description of Artificial Sequence: Synthetic oligonucleotide
  Target: ATXN1; (+) strand; PAM type: YTN; PAM sequence: TTA
cctcctgaaggaaatacaca

SEQ ID NO: 262108 - DNA, 20 bp, Artificial Sequence
  Description of Artificial Sequence: Synthetic oligonucleotide
  Target: ATXN1; (+) strand; PAM type: YTN; PAM sequence: CTC
ctgaaggaaatacacaacac

SEQ ID NO: 262109 - DNA, 20 bp, Artificial Sequence
  Description of Artificial Sequence: Synthetic oligonucleotide
  Target: ATXN1; (+) strand; PAM type: YTN; PAM sequence: CTG
aaggaaatacacaacacaac

SEQ ID NO: 262110 - DNA, 20 bp, Artificial Sequence
  Description of Artificial Sequence: Synthetic oligonucleotide
  Target: ATXN1; (+) strand; PAM type: YTN; PAM sequence: CTA
tgaagcagtcaggcaaagca

SEQ ID NO: 262111 - DNA, 20 bp, Artificial Sequence
  Description of Artificial Sequence: Synthetic oligonucleotide
  Target: ATXN1; (+) strand; PAM type: YTN; PAM sequence: CTC
tagaacttcctagcaattcc

SEQ ID NO: 262112 - DNA, 20 bp, Artificial Sequence
  Description of Artificial Sequence: Synthetic oligonucleotide
  Target: ATXN1; (+) strand; PAM type: YTN; PAM sequence: CTA
gaacttcctagcaattccca

SEQ ID NO: 262113 - DNA, 20 bp, Artificial Sequence
  Description of Artificial Sequence: Synthetic oligonucleotide
  Target: ATXN1; (+) strand; PAM type: YTN; PAM sequence: CTT
cctagcaattcccaagaaat

SEQ ID NO: 262114 - DNA, 20 bp, Artificial Sequence
  Description of Artificial Sequence: Synthetic oligonucleotide
  Target: ATXN1; (+) strand; PAM type: YTN; PAM sequence: TTC
ctagcaattcccaagaaatt

SEQ ID NO: 262115 - DNA, 20 bp, Artificial Sequence
  Description of Artificial Sequence: Synthetic oligonucleotide
  Target: ATXN1; (+) strand; PAM type: YTN; PAM sequence: CTA
gcaattcccaagaaattcag

SEQ ID NO: 262116 - DNA, 20 bp, Artificial Sequence
  Description of Artificial Sequence: Synthetic oligonucleotide
  Target: ATXN1; (+) strand; PAM type: YTN; PAM sequence: TTC
ccaagaaattcaggagacag

SEQ ID NO: 262117 - DNA, 20 bp, Artificial Sequence
  Description of Artificial Sequence: Synthetic oligonucleotide
  Target: ATXN1; (+) strand; PAM type: YTN; PAM sequence: TTC
aggagacagagggacatgct

SEQ ID NO: 262118 - DNA, 20 bp, Artificial Sequence
  Description of Artificial Sequence: Synthetic oligonucleotide
  Target: ATXN1; (+) strand; PAM type: YTN; PAM sequence: CTT
agcaacaccacatggaggca

SEQ ID NO: 262119 - DNA, 20 bp, Artificial Sequence
  Description of Artificial Sequence: Synthetic oligonucleotide
  Target: ATXN1; (+) strand; PAM type: YTN; PAM sequence: TTA
gcaacaccacatggaggcaa

SEQ ID NO: 262120 - DNA, 20 bp, Artificial Sequence
  Description of Artificial Sequence: Synthetic oligonucleotide
  Target: ATXN1; (+) strand; PAM type: YTN; PAM sequence: TTC
taccagacaaatggtctggt

SEQ ID NO: 262121 - DNA, 20 bp, Artificial Sequence
  Description of Artificial Sequence: Synthetic oligonucleotide
  Target: ATXN1; (+) strand; PAM type: YTN; PAM sequence: CTA
ccagacaaatggtctggttt

SEQ ID NO: 262122 - DNA, 20 bp, Artificial Sequence
  Description of Artificial Sequence: Synthetic oligonucleotide
  Target: ATXN1; (+) strand; PAM type: YTN; PAM sequence: CTG
gtttctcaacagaaaaaact

SEQ ID NO: 262123 - DNA, 20 bp, Artificial Sequence
  Description of Artificial Sequence: Synthetic oligonucleotide
  Target: ATXN1; (+) strand; PAM type: YTN; PAM sequence: TTT
ctcaacagaaaaaactgcaa

SEQ ID NO: 262124 - DNA, 20 bp, Artificial Sequence
  Description of Artificial Sequence: Synthetic oligonucleotide
  Target: ATXN1; (+) strand; PAM type: YTN; PAM sequence: TTC
tcaacagaaaaaactgcaaa

SEQ ID NO: 262125 - DNA, 20 bp, Artificial Sequence
  Description of Artificial Sequence: Synthetic oligonucleotide
  Target: ATXN1; (+) strand; PAM type: YTN; PAM sequence: CTC
aacagaaaaaactgcaaaat

SEQ ID NO: 262126 - DNA, 20 bp, Artificial Sequence
  Description of Artificial Sequence: Synthetic oligonucleotide
  Target: ATXN1; (+) strand; PAM type: YTN; PAM sequence: CTG
caaaataaaaaaaagacata

SEQ ID NO: 262127 - DNA, 20 bp, Artificial Sequence
  Description of Artificial Sequence: Synthetic oligonucleotide
  Target: ATXN1; (+) strand; PAM type: YTN; PAM sequence: TTT
aggagaccgaaatgaccttt

SEQ ID NO: 262128 - DNA, 20 bp, Artificial Sequence
  Description of Artificial Sequence: Synthetic oligonucleotide
  Target: ATXN1; (+) strand; PAM type: YTN; PAM sequence: TTA
ggagaccgaaatgaccttta

SEQ ID NO: 262129 - DNA, 20 bp, Artificial Sequence
  Description of Artificial Sequence: Synthetic oligonucleotide
  Target: ATXN1; (+) strand; PAM type: YTN; PAM sequence: CTT
tatttggatcttggttcaaa

SEQ ID NO: 262130 - DNA, 20 bp, Artificial Sequence
  Description of Artificial Sequence: Synthetic oligonucleotide
  Target: ATXN1; (+) strand; PAM type: YTN; PAM sequence: TTT
atttggatcttggttcaaat

SEQ ID NO: 262131 - DNA, 20 bp, Artificial Sequence
  Description of Artificial Sequence: Synthetic oligonucleotide
  Target: ATXN1; (+) strand; PAM type: YTN; PAM sequence: TTA
tttggatcttggttcaaata

SEQ ID NO: 262132 - DNA, 20 bp, Artificial Sequence
  Description of Artificial Sequence: Synthetic oligonucleotide
  Target: ATXN1; (+) strand; PAM type: YTN; PAM sequence: TTT
ggatcttggttcaaataaac

SEQ ID NO: 262133 - DNA, 20 bp, Artificial Sequence
  Description of Artificial Sequence: Synthetic oligonucleotide
  Target: ATXN1; (+) strand; PAM type: YTN; PAM sequence: TTG
gatcttggttcaaataaact

SEQ ID NO: 262134 - DNA, 20 bp, Artificial Sequence
  Description of Artificial Sequence: Synthetic oligonucleotide
  Target: ATXN1; (+) strand; PAM type: YTN; PAM sequence: CTT
ggttcaaataaactattaaa

SEQ ID NO: 262135 - DNA, 20 bp, Artificial Sequence
  Description of Artificial Sequence: Synthetic oligonucleotide
  Target: ATXN1; (+) strand; PAM type: YTN; PAM sequence: TTG
gttcaaataaactattaaaa

SEQ ID NO: 262136 - DNA, 20 bp, Artificial Sequence
  Description of Artificial Sequence: Synthetic oligonucleotide
  Target: ATXN1; (+) strand; PAM type: YTN; PAM sequence: TTC
aaataaactattaaaaaatc

SEQ ID NO: 262137 - DNA, 20 bp, Artificial Sequence
  Description of Artificial Sequence: Synthetic oligonucleotide
  Target: ATXN1; (+) strand; PAM type: YTN; PAM sequence: CTA
ttaaaaaatcctacaacata

SEQ ID NO: 262138 - DNA, 20 bp, Artificial Sequence
  Description of Artificial Sequence: Synthetic oligonucleotide
  Target: ATXN1; (+) strand; PAM type: YTN; PAM sequence: TTA
aaaaatcctacaacataaaa

SEQ ID NO: 262139 - DNA, 20 bp, Artificial Sequence
  Description of Artificial Sequence: Synthetic oligonucleotide
  Target: ATXN1; (+) strand; PAM type: YTN; PAM sequence: CTA
caacataaaataaaacttat

SEQ ID NO: 262140 - DNA, 20 bp, Artificial Sequence
  Description of Artificial Sequence: Synthetic oligonucleotide
  Target: ATXN1; (+) strand; PAM type: YTN; PAM sequence: CTT
attaataagtcaattaggaa

SEQ ID NO: 262141 - DNA, 20 bp, Artificial Sequence
  Description of Artificial Sequence: Synthetic oligonucleotide
  Target: ATXN1; (+) strand; PAM type: YTN; PAM sequence: TTA
ttaataagtcaattaggaaa

SEQ ID NO: 262142 - DNA, 20 bp, Artificial Sequence
  Description of Artificial Sequence: Synthetic oligonucleotide
  Target: ATXN1; (+) strand; PAM type: YTN; PAM sequence: TTA
ataagtcaattaggaaaata

SEQ ID NO: 262143 - DNA, 20 bp, Artificial Sequence
  Description of Artificial Sequence: Synthetic oligonucleotide
  Target: ATXN1; (+) strand; PAM type: YTN; PAM sequence: TTA
ggaaaatatgaatactgacg

SEQ ID NO: 262144 - DNA, 20 bp, Artificial Sequence
  Description of Artificial Sequence: Synthetic oligonucleotide
  Target: ATXN1; (+) strand; PAM type: YTN; PAM sequence: CTG
acgggatatttgatgatatt

SEQ ID NO: 262145 - DNA, 20 bp, Artificial Sequence
  Description of Artificial Sequence: Synthetic oligonucleotide
  Target: ATXN1; (+) strand; PAM type: YTN; PAM sequence: TTT
gatgatattgagaaatgact

SEQ ID NO: 262146 - DNA, 20 bp, Artificial Sequence
  Description of Artificial Sequence: Synthetic oligonucleotide
  Target: ATXN1; (+) strand; PAM type: YTN; PAM sequence: TTG
atgatattgagaaatgactg

SEQ ID NO: 262147 - DNA, 20 bp, Artificial Sequence
  Description of Artificial Sequence: Synthetic oligonucleotide
  Target: ATXN1; (+) strand; PAM type: YTN; PAM sequence: TTG
agaaatgactgttaatgcat

SEQ ID NO: 262148 - DNA, 20 bp, Artificial Sequence
  Description of Artificial Sequence: Synthetic oligonucleotide
  Target: ATXN1; (+) strand; PAM type: YTN; PAM sequence: CTG
ttaatgcattttttggtgtg

SEQ ID NO: 262149 - DNA, 20 bp, Artificial Sequence
  Description of Artificial Sequence: Synthetic oligonucleotide
  Target: ATXN1; (+) strand; PAM type: YTN; PAM sequence: TTA
atgcattttttggtgtgatg

SEQ ID NO: 262150 - DNA, 20 bp, Artificial Sequence
  Description of Artificial Sequence: Synthetic oligonucleotide
  Target: ATXN1; (+) strand; PAM type: YTN; PAM sequence: TTT
tttggtgtgatgatgatgtt

SEQ ID NO: 262151 - DNA, 20 bp, Artificial Sequence
  Description of Artificial Sequence: Synthetic oligonucleotide
  Target: ATXN1; (+) strand; PAM type: YTN; PAM sequence: TTT
ttggtgtgatgatgatgttg

SEQ ID NO: 262152 - DNA, 20 bp, Artificial Sequence
  Description of Artificial Sequence: Synthetic oligonucleotide
  Target: ATXN1; (+) strand; PAM type: YTN; PAM sequence: TTT
tggtgtgatgatgatgttgt

SEQ ID NO: 262153 - DNA, 20 bp, Artificial Sequence
  Description of Artificial Sequence: Synthetic oligonucleotide
  Target: ATXN1; (+) strand; PAM type: YTN; PAM sequence: TTT
ggtgtgatgatgatgttgta

SEQ ID NO: 262154 - DNA, 20 bp, Artificial Sequence
  Description of Artificial Sequence: Synthetic oligonucleotide
  Target: ATXN1; (+) strand; PAM type: YTN; PAM sequence: TTG
gtgtgatgatgatgttgtag

SEQ ID NO: 262155 - DNA, 20 bp, Artificial Sequence
  Description of Artificial Sequence: Synthetic oligonucleotide
  Target: ATXN1; (+) strand; PAM type: YTN; PAM sequence: TTG
tagttgtgtatgagaagaag

SEQ ID NO: 262156 - DNA, 20 bp, Artificial Sequence
  Description of Artificial Sequence: Synthetic oligonucleotide
  Target: ATXN1; (+) strand; PAM type: YTN; PAM sequence: TTG
tgtatgagaagaagaatcct

SEQ ID NO: 262157 - DNA, 20 bp, Artificial Sequence
  Description of Artificial Sequence: Synthetic oligonucleotide
  Target: ATXN1; (+) strand; PAM type: YTN; PAM sequence: CTA
atcatttatagaaatagtaa

SEQ ID NO: 262158 - DNA, 20 bp, Artificial Sequence
  Description of Artificial Sequence: Synthetic oligonucleotide
  Target: ATXN1; (+) strand; PAM type: YTN; PAM sequence: TTT
atagaaatagtaaaatattt

SEQ ID NO: 262159 - DNA, 20 bp, Artificial Sequence
  Description of Artificial Sequence: Synthetic oligonucleotide
  Target: ATXN1; (+) strand; PAM type: YTN; PAM sequence: TTA
tagaaatagtaaaatatttt

SEQ ID NO: 262160 - DNA, 20 bp, Artificial Sequence
  Description of Artificial Sequence: Synthetic oligonucleotide
  Target: ATXN1; (+) strand; PAM type: YTN; PAM sequence: TTT
tatagatattttgagtcaac

SEQ ID NO: 262161 - DNA, 20 bp, Artificial Sequence
  Description of Artificial Sequence: Synthetic oligonucleotide
  Target: ATXN1; (+) strand; PAM type: YTN; PAM sequence: TTT
atagatattttgagtcaaca

SEQ ID NO: 262162 - DNA, 20 bp, Artificial Sequence
  Description of Artificial Sequence: Synthetic oligonucleotide
  Target: ATXN1; (+) strand; PAM type: YTN; PAM sequence: TTA
tagatattttgagtcaacag

SEQ ID NO: 262163 - DNA, 20 bp, Artificial Sequence
  Description of Artificial Sequence: Synthetic oligonucleotide
  Target: ATXN1; (+) strand; PAM type: YTN; PAM sequence: TTT
tgagtcaacagcaatctgtt

SEQ ID NO: 262164 - DNA, 20 bp, Artificial Sequence
  Description of Artificial Sequence: Synthetic oligonucleotide
  Target: ATXN1; (+) strand; PAM type: YTN; PAM sequence: TTT
gagtcaacagcaatctgtta

SEQ ID NO: 262165 - DNA, 20 bp, Artificial Sequence
  Description of Artificial Sequence: Synthetic oligonucleotide
  Target: ATXN1; (+) strand; PAM type: YTN; PAM sequence: TTG
agtcaacagcaatctgttat

SEQ ID NO: 262166 - DNA, 20 bp, Artificial Sequence
  Description of Artificial Sequence: Synthetic oligonucleotide
  Target: ATXN1; (+) strand; PAM type: YTN; PAM sequence: CTG
ttatgaagatgcaaggtcca

SEQ ID NO: 262167 - DNA, 20 bp, Artificial Sequence
  Description of Artificial Sequence: Synthetic oligonucleotide
  Target: ATXN1; (+) strand; PAM type: YTN; PAM sequence: TTA
tgaagatgcaaggtccaggg

SEQ ID NO: 262168 - DNA, 20 bp, Artificial Sequence
  Description of Artificial Sequence: Synthetic oligonucleotide
  Target: ATXN1; (+) strand; PAM type: YTN; PAM sequence: CTG
ttatttggaatttgcttcaa

SEQ ID NO: 262169 - DNA, 20 bp, Artificial Sequence
  Description of Artificial Sequence: Synthetic oligonucleotide
  Target: ATXN1; (+) strand; PAM type: YTN; PAM sequence: TTA
tttggaatttgcttcaaaat

SEQ ID NO: 262170 - DNA, 20 bp, Artificial Sequence
  Description of Artificial Sequence: Synthetic oligonucleotide
  Target: ATXN1; (+) strand; PAM type: YTN; PAM sequence: TTT
ggaatttgcttcaaaataat

SEQ ID NO: 262171 - DNA, 20 bp, Artificial Sequence
  Description of Artificial Sequence: Synthetic oligonucleotide
  Target: ATXN1; (+) strand; PAM type: YTN; PAM sequence: TTG
gaatttgcttcaaaataatc

SEQ ID NO: 262172 - DNA, 20 bp, Artificial Sequence
  Description of Artificial Sequence: Synthetic oligonucleotide
  Target: ATXN1; (+) strand; PAM type: YTN; PAM sequence: TTT
gcttcaaaataatccaggtg

SEQ ID NO: 262173 - DNA, 20 bp, Artificial Sequence
  Description of Artificial Sequence: Synthetic oligonucleotide
  Target: ATXN1; (+) strand; PAM type: YTN; PAM sequence: TTG
cttcaaaataatccaggtgc

SEQ ID NO: 262174 - DNA, 20 bp, Artificial Sequence
  Description of Artificial Sequence: Synthetic oligonucleotide
  Target: ATXN1; (+) strand; PAM type: YTN; PAM sequence: CTT
caaaataatccaggtgcaga

SEQ ID NO: 262175 - DNA, 20 bp, Artificial Sequence
  Description of Artificial Sequence: Synthetic oligonucleotide
  Target: ATXN1; (+) strand; PAM type: YTN; PAM sequence: TTC
aaaataatccaggtgcagag

SEQ ID NO: 262176 - DNA, 20 bp, Artificial Sequence
  Description of Artificial Sequence: Synthetic oligonucleotide
  Target: ATXN1; (+) strand; PAM type: YTN; PAM sequence: TTG
gctctgctgctgaatggggt

SEQ ID NO: 262177 - DNA, 20 bp, Artificial Sequence
  Description of Artificial Sequence: Synthetic oligonucleotide
  Target: ATXN1; (+) strand; PAM type: YTN; PAM sequence: CTC
tgctgctgaatggggtggtg

SEQ ID NO: 262178 - DNA, 20 bp, Artificial Sequence
  Description of Artificial Sequence: Synthetic oligonucleotide
  Target: ATXN1; (+) strand; PAM type: YTN; PAM sequence: CTG
ctgctgaatggggtggtggg

SEQ ID NO: 262179 - DNA, 20 bp, Artificial Sequence
  Description of Artificial Sequence: Synthetic oligonucleotide
  Target: ATXN1; (+) strand; PAM type: YTN; PAM sequence: CTG
ctgaatggggtggtggggca

SEQ ID NO: 262180 - DNA, 20 bp, Artificial Sequence
  Description of Artificial Sequence: Synthetic oligonucleotide
  Target: ATXN1; (+) strand; PAM type: YTN; PAM sequence: CTG
aatggggtggtggggcaaaa

SEQ ID NO: 262181 - DNA, 20 bp, Artificial Sequence
  Description of Artificial Sequence: Synthetic oligonucleotide
  Target: ATXN1; (+) strand; PAM type: YTN; PAM sequence: TTC
atttaccacctctctgcttt

SEQ ID NO: 262182 - DNA, 20 bp, Artificial Sequence
  Description of Artificial Sequence: Synthetic oligonucleotide
  Target: ATXN1; (+) strand; PAM type: YTN; PAM sequence: TTT
accacctctctgctttcaaa

SEQ ID NO: 262183 - DNA, 20 bp, Artificial Sequence
  Description of Artificial Sequence: Synthetic oligonucleotide
  Target: ATXN1; (+) strand; PAM type: YTN; PAM sequence: TTA
ccacctctctgctttcaaat

SEQ ID NO: 262184 - DNA, 20 bp, Artificial Sequence
  Description of Artificial Sequence: Synthetic oligonucleotide
  Target: ATXN1; (+) strand; PAM type: YTN; PAM sequence: CTC
tctgctttcaaatgtgtttg

SEQ ID NO: 262185 - DNA, 20 bp, Artificial Sequence
  Description of Artificial Sequence: Synthetic oligonucleotide
  Target: ATXN1; (+) strand; PAM type: YTN; PAM sequence: CTC
tgctttcaaatgtgtttgat

SEQ ID NO: 262186 - DNA, 20 bp, Artificial Sequence
  Description of Artificial Sequence: Synthetic oligonucleotide
  Target: ATXN1; (+) strand; PAM type: YTN; PAM sequence: CTG
ctttcaaatgtgtttgatat

SEQ ID NO: 262187 - DNA, 20 bp, Artificial Sequence
  Description of Artificial Sequence: Synthetic oligonucleotide
  Target: ATXN1; (+) strand; PAM type: YTN; PAM sequence: CTT
tcaaatgtgtttgatatttc

SEQ ID NO: 262188 - DNA, 20 bp, Artificial Sequence
  Description of Artificial Sequence: Synthetic oligonucleotide
  Target: ATXN1; (+) strand; PAM type: YTN; PAM sequence: TTT
caaatgtgtttgatatttct

SEQ ID NO: 262189 - DNA, 20 bp, Artificial Sequence
  Description of Artificial Sequence: Synthetic oligonucleotide
  Target: ATXN1; (+) strand; PAM type: YTN; PAM sequence: TTC
aaatgtgtttgatatttctt

SEQ ID NO: 262190 - DNA, 20 bp, Artificial Sequence
  Description of Artificial Sequence: Synthetic oligonucleotide
  Target: ATXN1; (+) strand; PAM type: YTN; PAM sequence: TTT
gatatttcttttttttttaa

SEQ ID NO: 262191 - DNA, 20 bp, Artificial Sequence
  Description of Artificial Sequence: Synthetic oligonucleotide
  Target: ATXN1; (+) strand; PAM type: YTN; PAM sequence: TTG
atatttcttttttttttaag

SEQ ID NO: 262192 - DNA, 20 bp, Artificial Sequence
  Description of Artificial Sequence: Synthetic oligonucleotide
  Target: ATXN1; (+) strand; PAM type: YTN; PAM sequence: TTT
cttttttttttaagttttta

SEQ ID NO: 262193 - DNA, 20 bp, Artificial Sequence
  Description of Artificial Sequence: Synthetic oligonucleotide
  Target: ATXN1; (+) strand; PAM type: YTN; PAM sequence: TTC
ttttttttttaagtttttat

SEQ ID NO: 262194 - DNA, 20 bp, Artificial Sequence
  Description of Artificial Sequence: Synthetic oligonucleotide
  Target: ATXN1; (+) strand; PAM type: YTN; PAM sequence: CTT
ttttttttaagtttttatat

SEQ ID NO: 262195 - DNA, 20 bp, Artificial Sequence
  Description of Artificial Sequence: Synthetic oligonucleotide
  Target: ATXN1; (+) strand; PAM type: YTN; PAM sequence: TTT
tttttttaagtttttatatt

SEQ ID NO: 262196 - DNA, 20 bp, Artificial Sequence
  Description of Artificial Sequence: Synthetic oligonucleotide
  Target: ATXN1; (+) strand; PAM type: YTN; PAM sequence: TTT
ttttttaagtttttatatta

SEQ ID NO: 262197 - DNA, 20 bp, Artificial Sequence
  Description of Artificial Sequence: Synthetic oligonucleotide
  Target: ATXN1; (+) strand; PAM type: YTN; PAM sequence: TTT
tttttaagtttttatattat

SEQ ID NO: 262198 - DNA, 20 bp, Artificial Sequence
  Description of Artificial Sequence: Synthetic oligonucleotide
  Target: ATXN1; (+) strand; PAM type: YTN; PAM sequence: TTT
ttttaagtttttatattatt

SEQ ID NO: 262199 - DNA, 20 bp, Artificial Sequence
  Description of Artificial Sequence: Synthetic oligonucleotide
  Target: ATXN1; (+) strand; PAM type: YTN; PAM sequence: TTT
tttaagtttttatattatta

SEQ ID NO: 262200 - DNA, 20 bp, Artificial Sequence
  Description of Artificial Sequence: Synthetic oligonucleotide
  Target: ATXN1; (+) strand; PAM type: YTN; PAM sequence: TTT
ttaagtttttatattattat

SEQ ID NO: 262201 - DNA, 20 bp, Artificial Sequence
  Description of Artificial Sequence: Synthetic oligonucleotide
  Target: ATXN1; (+) strand; PAM type: YTN; PAM sequence: TTT
taagtttttatattattatt

SEQ ID NO: 262202 - DNA, 20 bp, Artificial Sequence
  Description of Artificial Sequence: Synthetic oligonucleotide
  Target: ATXN1; (+) strand; PAM type: YTN; PAM sequence: TTT
aagtttttatattattatta

SEQ ID NO: 262203 - DNA, 20 bp, Artificial Sequence
  Description of Artificial Sequence: Synthetic oligonucleotide
  Target: ATXN1; (+) strand; PAM type: YTN; PAM sequence: TTA
agtttttatattattattat

SEQ ID NO: 262204 - DNA, 20 bp, Artificial Sequence
  Description of Artificial Sequence: Synthetic oligonucleotide
  Target: ATXN1; (+) strand; PAM type: YTN; PAM sequence: TTT
ttatattattattatacttt

SEQ ID NO: 262205 - DNA, 20 bp, Artificial Sequence
  Description of Artificial Sequence: Synthetic oligonucleotide
  Target: ATXN1; (+) strand; PAM type: YTN; PAM sequence: TTT
tatattattattatacttta

SEQ ID NO: 262206 - DNA, 20 bp, Artificial Sequence
  Description of Artificial Sequence: Synthetic oligonucleotide
  Target: ATXN1; (+) strand; PAM type: YTN; PAM sequence: TTT
atattattattatactttaa

SEQ ID NO: 262207 - DNA, 20 bp, Artificial Sequence
  Description of Artificial Sequence: Synthetic oligonucleotide
  Target: ATXN1; (+) strand; PAM type: YTN; PAM sequence: TTA
tattattattatactttaag

SEQ ID NO: 262208 - DNA, 20 bp, Artificial Sequence
  Description of Artificial Sequence: Synthetic oligonucleotide
  Target: ATXN1; (+) strand; PAM type: YTN; PAM sequence: TTA
ttattatactttaagtttta

SEQ ID NO: 262209 - DNA, 20 bp, Artificial Sequence
  Description of Artificial Sequence: Synthetic oligonucleotide
  Target: ATXN1; (+) strand; PAM type: YTN; PAM sequence: TTA
ttatactttaagttttaggg

SEQ ID NO: 262210 - DNA, 20 bp, Artificial Sequence
  Description of Artificial Sequence: Synthetic oligonucleotide
  Target: ATXN1; (+) strand; PAM type: YTN; PAM sequence: TTA
tactttaagttttagggtac

SEQ ID NO: 262211 - DNA, 20 bp, Artificial Sequence
  Description of Artificial Sequence: Synthetic oligonucleotide
  Target: ATXN1; (+) strand; PAM type: YTN; PAM sequence: CTT
taagttttagggtacatgtg

SEQ ID NO: 262212 - DNA, 20 bp, Artificial Sequence
  Description of Artificial Sequence: Synthetic oligonucleotide
  Target: ATXN1; (+) strand; PAM type: YTN; PAM sequence: TTT
aagttttagggtacatgtgc

SEQ ID NO: 262213 - DNA, 20 bp, Artificial Sequence
  Description of Artificial Sequence: Synthetic oligonucleotide
  Target: ATXN1; (+) strand; PAM type: YTN; PAM sequence: TTA
agttttagggtacatgtgca

SEQ ID NO: 262214 - DNA, 20 bp, Artificial Sequence
  Description of Artificial Sequence: Synthetic oligonucleotide
  Target: ATXN1; (+) strand; PAM type: YTN; PAM sequence: TTT
tagggtacatgtgcacaatg

SEQ ID NO: 262215 - DNA, 20 bp, Artificial Sequence
  Description of Artificial Sequence: Synthetic oligonucleotide
  Target: ATXN1; (+) strand; PAM type: YTN; PAM sequence: TTT
agggtacatgtgcacaatgt

SEQ ID NO: 262216 - DNA, 20 bp, Artificial Sequence
  Description of Artificial Sequence: Synthetic oligonucleotide
  Target: ATXN1; (+) strand; PAM type: YTN; PAM sequence: TTA
gggtacatgtgcacaatgtg

SEQ ID NO: 262217 - DNA, 20 bp, Artificial Sequence
  Description of Artificial Sequence: Synthetic oligonucleotide
  Target: ATXN1; (+) strand; PAM type: YTN; PAM sequence: TTA
gttacatatgtatacatgtg

SEQ ID NO: 262218 - DNA, 20 bp, Artificial Sequence
  Description of Artificial Sequence: Synthetic oligonucleotide
  Target: ATXN1; (+) strand; PAM type: YTN; PAM sequence: TTA
catatgtatacatgtgccat

SEQ ID NO: 262219 - DNA, 20 bp, Artificial Sequence
  Description of Artificial Sequence: Synthetic oligonucleotide
  Target: ATXN1; (+) strand; PAM type: YTN; PAM sequence: CTG
gtgtgctgcacccattacct

SEQ ID NO: 262220 - DNA, 20 bp, Artificial Sequence
  Description of Artificial Sequence: Synthetic oligonucleotide
  Target: ATXN1; (+) strand; PAM type: YTN; PAM sequence: CTG
cacccattacctcgtcatct

SEQ ID NO: 262221 - DNA, 20 bp, Artificial Sequence
  Description of Artificial Sequence: Synthetic oligonucleotide
  Target: ATXN1; (+) strand; PAM type: YTN; PAM sequence: TTA
cctcgtcatctagcattagg

SEQ ID NO: 262222 - DNA, 20 bp, Artificial Sequence
  Description of Artificial Sequence: Synthetic oligonucleotide
  Target: ATXN1; (+) strand; PAM type: YTN; PAM sequence: CTC
gtcatctagcattaggtgta

SEQ ID NO: 262223 - DNA, 20 bp, Artificial Sequence
  Description of Artificial Sequence: Synthetic oligonucleotide
  Target: ATXN1; (+) strand; PAM type: YTN; PAM sequence: CTA
gcattaggtgtatctcctaa

SEQ ID NO: 262224 - DNA, 20 bp, Artificial Sequence
  Description of Artificial Sequence: Synthetic oligonucleotide
  Target: ATXN1; (+) strand; PAM type: YTN; PAM sequence: TTA
ggtgtatctcctaatgctat

SEQ ID NO: 262225 - DNA, 20 bp, Artificial Sequence
  Description of Artificial Sequence: Synthetic oligonucleotide
  Target: ATXN1; (+) strand; PAM type: YTN; PAM sequence: CTC
ctaatgctatccctcccccc

SEQ ID NO: 262226 - DNA, 20 bp, Artificial Sequence
  Description of Artificial Sequence: Synthetic oligonucleotide
  Target: ATXN1; (+) strand; PAM type: YTN; PAM sequence: CTA
atgctatccctcccccctcc

SEQ ID NO: 262227 - DNA, 20 bp, Artificial Sequence
  Description of Artificial Sequence: Synthetic oligonucleotide
  Target: ATXN1; (+) strand; PAM type: YTN; PAM sequence: CTA
tccctcccccctccccccac

SEQ ID NO: 262228 - DNA, 20 bp, Artificial Sequence
  Description of Artificial Sequence: Synthetic oligonucleotide
  Target: ATXN1; (+) strand; PAM type: YTN; PAM sequence: CTC
ccccctccccccaccccaca

SEQ ID NO: 262229 - DNA, 20 bp, Artificial Sequence
  Description of Artificial Sequence: Synthetic oligonucleotide
  Target: ATXN1; (+) strand; PAM type: YTN; PAM sequence: CTC
cccccaccccacaacagtcc

SEQ ID NO: 262230 - DNA, 20 bp, Artificial Sequence
  Description of Artificial Sequence: Synthetic oligonucleotide
  Target: ATXN1; (+) strand; PAM type: YTN; PAM sequence: TTC
cccttcctgtgtccatgtgt

SEQ ID NO: 262231 - DNA, 20 bp, Artificial Sequence
  Description of Artificial Sequence: Synthetic oligonucleotide
  Target: ATXN1; (+) strand; PAM type: YTN; PAM sequence: CTT
cctgtgtccatgtgttctca

SEQ ID NO: 262232 - DNA, 20 bp, Artificial Sequence
  Description of Artificial Sequence: Synthetic oligonucleotide
  Target: ATXN1; (+) strand; PAM type: YTN; PAM sequence: TTC
ctgtgtccatgtgttctcat

SEQ ID NO: 262233 - DNA, 20 bp, Artificial Sequence
  Description of Artificial Sequence: Synthetic oligonucleotide
  Target: ATXN1; (+) strand; PAM type: YTN; PAM sequence: CTG
tgtccatgtgttctcattgt

SEQ ID NO: 262234 - DNA, 20 bp, Artificial Sequence
  Description of Artificial Sequence: Synthetic oligonucleotide
  Target: ATXN1; (+) strand; PAM type: YTN; PAM sequence: TTC
tcattgttcaattcccatct

SEQ ID NO: 262235 - DNA, 20 bp, Artificial Sequence
  Description of Artificial Sequence: Synthetic oligonucleotide
  Target: ATXN1; (+) strand; PAM type: YTN; PAM sequence: CTC
attgttcaattcccatctat

SEQ ID NO: 262236 - DNA, 20 bp, Artificial Sequence
  Description of Artificial Sequence: Synthetic oligonucleotide
  Target: ATXN1; (+) strand; PAM type: YTN; PAM sequence: TTG
ttcaattcccatctatgagt

SEQ ID NO: 262237 - DNA, 20 bp, Artificial Sequence
  Description of Artificial Sequence: Synthetic oligonucleotide
  Target: ATXN1; (+) strand; PAM type: YTN; PAM sequence: TTC
aattcccatctatgagtgag

SEQ ID NO: 262238 - DNA, 20 bp, Artificial Sequence
  Description of Artificial Sequence: Synthetic oligonucleotide
  Target: ATXN1; (+) strand; PAM type: YTN; PAM sequence: TTC
ccatctatgagtgagaacat

SEQ ID NO: 262239 - DNA, 20 bp, Artificial Sequence
  Description of Artificial Sequence: Synthetic oligonucleotide
  Target: ATXN1; (+) strand; PAM type: YTN; PAM sequence: CTA
tgagtgagaacatgcggtgt

SEQ ID NO: 262240 - DNA, 20 bp, Artificial Sequence
  Description of Artificial Sequence: Synthetic oligonucleotide
  Target: ATXN1; (+) strand; PAM type: YTN; PAM sequence: TTT
ggttttttgtccttgtgata

SEQ ID NO: 262241 - DNA, 20 bp, Artificial Sequence
  Description of Artificial Sequence: Synthetic oligonucleotide
  Target: ATXN1; (+) strand; PAM type: YTN; PAM sequence: TTG
gttttttgtccttgtgatag

SEQ ID NO: 262242 - DNA, 20 bp, Artificial Sequence
  Description of Artificial Sequence: Synthetic oligonucleotide
  Target: ATXN1; (+) strand; PAM type: YTN; PAM sequence: TTT
tttgtccttgtgatagttta

SEQ ID NO: 262243 - DNA, 20 bp, Artificial Sequence
  Description of Artificial Sequence: Synthetic oligonucleotide
  Target: ATXN1; (+) strand; PAM type: YTN; PAM sequence: TTT
ttgtccttgtgatagtttac

SEQ ID NO: 262244 - DNA, 20 bp, Artificial Sequence
  Description of Artificial Sequence: Synthetic oligonucleotide
  Target: ATXN1; (+) strand; PAM type: YTN; PAM sequence: TTT
tgtccttgtgatagtttact

SEQ ID NO: 262245 - DNA, 20 bp, Artificial Sequence
  Description of Artificial Sequence: Synthetic oligonucleotide
  Target: ATXN1; (+) strand; PAM type: YTN; PAM sequence: TTT
gtccttgtgatagtttactg

SEQ ID NO: 262246 - DNA, 20 bp, Artificial Sequence
  Description of Artificial Sequence: Synthetic oligonucleotide
  Target: ATXN1; (+) strand; PAM type: YTN; PAM sequence: TTG
tccttgtgatagtttactga

SEQ ID NO: 262247 - DNA, 20 bp, Artificial Sequence
  Description of Artificial Sequence: Synthetic oligonucleotide
  Target: ATXN1; (+) strand; PAM type: YTN; PAM sequence: CTT
gtgatagtttactgagaatg

SEQ ID NO: 262248 - DNA, 20 bp, Artificial Sequence
  Description of Artificial Sequence: Synthetic oligonucleotide
  Target: ATXN1; (+) strand; PAM type: YTN; PAM sequence: TTG
tgatagtttactgagaatga

SEQ ID NO: 262249 - DNA, 20 bp, Artificial Sequence
  Description of Artificial Sequence: Synthetic oligonucleotide
  Target: ATXN1; (+) strand; PAM type: YTN; PAM sequence: TTT
actgagaatgatgatttcca

SEQ ID NO: 262250 - DNA, 20 bp, Artificial Sequence
  Description of Artificial Sequence: Synthetic oligonucleotide
  Target: ATXN1; (+) strand; PAM type: YTN; PAM sequence: TTA
ctgagaatgatgatttccaa

SEQ ID NO: 262251 - DNA, 20 bp, Artificial Sequence
  Description of Artificial Sequence: Synthetic oligonucleotide
  Target: ATXN1; (+) strand; PAM type: YTN; PAM sequence: CTG
agaatgatgatttccaattt

SEQ ID NO: 262252 - DNA, 20 bp, Artificial Sequence
  Description of Artificial Sequence: Synthetic oligonucleotide
  Target: ATXN1; (+) strand; PAM type: YTN; PAM sequence: TTT
ccaatttcatccatgtccct

SEQ ID NO: 262253 - DNA, 20 bp, Artificial Sequence
  Description of Artificial Sequence: Synthetic oligonucleotide
  Target: ATXN1; (+) strand; PAM type: YTN; PAM sequence: TTC
caatttcatccatgtcccta

SEQ ID NO: 262254 - DNA, 20 bp, Artificial Sequence
  Description of Artificial Sequence: Synthetic oligonucleotide
  Target: ATXN1; (+) strand; PAM type: YTN; PAM sequence: TTT
catccatgtccctacaaagg

SEQ ID NO: 262255 - DNA, 20 bp, Artificial Sequence
  Description of Artificial Sequence: Synthetic oligonucleotide
  Target: ATXN1; (+) strand; PAM type: YTN; PAM sequence: TTC
atccatgtccctacaaagga

SEQ ID NO: 262256 - DNA, 20 bp, Artificial Sequence
  Description of Artificial Sequence: Synthetic oligonucleotide
  Target: ATXN1; (+) strand; PAM type: YTN; PAM sequence: CTA
caaaggacgtgaactcatca

SEQ ID NO: 262257 - DNA, 20 bp, Artificial Sequence
  Description of Artificial Sequence: Synthetic oligonucleotide
  Target: ATXN1; (+) strand; PAM type: YTN; PAM sequence: CTC
atcattttttatggctgcat

SEQ ID NO: 262258 - DNA, 20 bp, Artificial Sequence
  Description of Artificial Sequence: Synthetic oligonucleotide
  Target: ATXN1; (+) strand; PAM type: YTN; PAM sequence: TTT
tttatggctgcatagtattc

SEQ ID NO: 262259 - DNA, 20 bp, Artificial Sequence
  Description of Artificial Sequence: Synthetic oligonucleotide
  Target: ATXN1; (+) strand; PAM type: YTN; PAM sequence: TTT
ttatggctgcatagtattcc

SEQ ID NO: 262260 - DNA, 20 bp, Artificial Sequence
  Description of Artificial Sequence: Synthetic oligonucleotide
  Target: ATXN1; (+) strand; PAM type: YTN; PAM sequence: TTT
tatggctgcatagtattcca

SEQ ID NO: 262261 - DNA, 20 bp, Artificial Sequence
  Description of Artificial Sequence: Synthetic oligonucleotide
  Target: ATXN1; (+) strand; PAM type: YTN; PAM sequence: TTT
atggctgcatagtattccat

SEQ ID NO: 262262 - DNA, 20 bp, Artificial Sequence
  Description of Artificial Sequence: Synthetic oligonucleotide
  Target: ATXN1; (+) strand; PAM type: YTN; PAM sequence: TTA
tggctgcatagtattccatg

SEQ ID NO: 262263 - DNA, 20 bp, Artificial Sequence
  Description of Artificial Sequence: Synthetic oligonucleotide
  Target: ATXN1; (+) strand; PAM type: YTN; PAM sequence: CTG
catagtattccatggtgtat

SEQ ID NO: 262264 - DNA, 20 bp, Artificial Sequence
  Description of Artificial Sequence: Synthetic oligonucleotide
  Target: ATXN1; (+) strand; PAM type: YTN; PAM sequence: TTC
catggtgtatatgtgccaca

SEQ ID NO: 262265 - DNA, 20 bp, Artificial Sequence
  Description of Artificial Sequence: Synthetic oligonucleotide
  Target: ATXN1; (+) strand; PAM type: YTN; PAM sequence: TTT
tcttaatccagtctatcatt

SEQ ID NO: 262266 - DNA, 20 bp, Artificial Sequence
  Description of Artificial Sequence: Synthetic oligonucleotide
  Target: ATXN1; (+) strand; PAM type: YTN; PAM sequence: TTT
cttaatccagtctatcattg

SEQ ID NO: 262267 - DNA, 20 bp, Artificial Sequence
  Description of Artificial Sequence: Synthetic oligonucleotide
  Target: ATXN1; (+) strand; PAM type: YTN; PAM sequence: TTC
ttaatccagtctatcattgt

SEQ ID NO: 262268 - DNA, 20 bp, Artificial Sequence
  Description of Artificial Sequence: Synthetic oligonucleotide
  Target: ATXN1; (+) strand; PAM type: YTN; PAM sequence: CTT
aatccagtctatcattgttg

SEQ ID NO: 262269 - DNA, 20 bp, Artificial Sequence
  Description of Artificial Sequence: Synthetic oligonucleotide
  Target: ATXN1; (+) strand; PAM type: YTN; PAM sequence: TTA
atccagtctatcattgttgg

SEQ ID NO: 262270 - DNA, 20 bp, Artificial Sequence
  Description of Artificial Sequence: Synthetic oligonucleotide
  Target: ATXN1; (+) strand; PAM type: YTN; PAM sequence: CTA
tcattgttggacatttgggt

SEQ ID NO: 262271 - DNA, 20 bp, Artificial Sequence
  Description of Artificial Sequence: Synthetic oligonucleotide
  Target: ATXN1; (+) strand; PAM type: YTN; PAM sequence: TTG
ttggacatttgggttggttc

SEQ ID NO: 262272 - DNA, 20 bp, Artificial Sequence
  Description of Artificial Sequence: Synthetic oligonucleotide
  Target: ATXN1; (+) strand; PAM type: YTN; PAM sequence: TTG
gacatttgggttggttccaa

SEQ ID NO: 262273 - DNA, 20 bp, Artificial Sequence
  Description of Artificial Sequence: Synthetic oligonucleotide
  Target: ATXN1; (+) strand; PAM type: YTN; PAM sequence: TTT
gggttggttccaagtctttg

SEQ ID NO: 262274 - DNA, 20 bp, Artificial Sequence
  Description of Artificial Sequence: Synthetic oligonucleotide
  Target: ATXN1; (+) strand; PAM type: YTN; PAM sequence: TTG
ggttggttccaagtctttgc

SEQ ID NO: 262275 - DNA, 20 bp, Artificial Sequence
  Description of Artificial Sequence: Synthetic oligonucleotide
  Target: ATXN1; (+) strand; PAM type: YTN; PAM sequence: TTG
gttccaagtctttgctattg

SEQ ID NO: 262276 - DNA, 20 bp, Artificial Sequence
  Description of Artificial Sequence: Synthetic oligonucleotide
  Target: ATXN1; (+) strand; PAM type: YTN; PAM sequence: TTC
caagtctttgctattgtgaa

SEQ ID NO: 262277 - DNA, 20 bp, Artificial Sequence
  Description of Artificial Sequence: Synthetic oligonucleotide
  Target: ATXN1; (+) strand; PAM type: YTN; PAM sequence: CTT
tgctattgtgaatagtgccg

SEQ ID NO: 262278 - DNA, 20 bp, Artificial Sequence
  Description of Artificial Sequence: Synthetic oligonucleotide
  Target: ATXN1; (+) strand; PAM type: YTN; PAM sequence: TTT
gctattgtgaatagtgccgc

SEQ ID NO: 262279 - DNA, 20 bp, Artificial Sequence
  Description of Artificial Sequence: Synthetic oligonucleotide
  Target: ATXN1; (+) strand; PAM type: YTN; PAM sequence: TTG
ctattgtgaatagtgccgcc

SEQ ID NO: 262280 - DNA, 20 bp, Artificial Sequence
  Description of Artificial Sequence: Synthetic oligonucleotide
  Target: ATXN1; (+) strand; PAM type: YTN; PAM sequence: CTA
ttgtgaatagtgccgccata

SEQ ID NO: 262281 - DNA, 20 bp, Artificial Sequence
  Description of Artificial Sequence: Synthetic oligonucleotide
  Target: ATXN1; (+) strand; PAM type: YTN; PAM sequence: TTG
tgaatagtgccgccataaac

SEQ ID NO: 262282 - DNA, 20 bp, Artificial Sequence
  Description of Artificial Sequence: Synthetic oligonucleotide
  Target: ATXN1; (+) strand; PAM type: YTN; PAM sequence: CTT
tattgcagcatgatttatag

SEQ ID NO: 262283 - DNA, 20 bp, Artificial Sequence
  Description of Artificial Sequence: Synthetic oligonucleotide
  Target: ATXN1; (+) strand; PAM type: YTN; PAM sequence: TTT
attgcagcatgatttatagt

SEQ ID NO: 262284 - DNA, 20 bp, Artificial Sequence
  Description of Artificial Sequence: Synthetic oligonucleotide
  Target: ATXN1; (+) strand; PAM type: YTN; PAM sequence: TTA
ttgcagcatgatttatagtc

SEQ ID NO: 262285 - DNA, 20 bp, Artificial Sequence
  Description of Artificial Sequence: Synthetic oligonucleotide
  Target: ATXN1; (+) strand; PAM type: YTN; PAM sequence: TTG
cagcatgatttatagtcctt

SEQ ID NO: 262286 - DNA, 20 bp, Artificial Sequence
  Description of Artificial Sequence: Synthetic oligonucleotide
  Target: ATXN1; (+) strand; PAM type: YTN; PAM sequence: TTT
atagtcctttgggtatatac

SEQ ID NO: 262287 - DNA, 20 bp, Artificial Sequence
  Description of Artificial Sequence: Synthetic oligonucleotide
  Target: ATXN1; (+) strand; PAM type: YTN; PAM sequence: TTA
tagtcctttgggtatatacc

SEQ ID NO: 262288 - DNA, 20 bp, Artificial Sequence
  Description of Artificial Sequence: Synthetic oligonucleotide
  Target: ATXN1; (+) strand; PAM type: YTN; PAM sequence: CTT
tgggtatatacccagtaatg

SEQ ID NO: 262289 - DNA, 20 bp, Artificial Sequence
  Description of Artificial Sequence: Synthetic oligonucleotide
  Target: ATXN1; (+) strand; PAM type: YTN; PAM sequence: TTT
gggtatatacccagtaatgg

SEQ ID NO: 262290 - DNA, 20 bp, Artificial Sequence
  Description of Artificial Sequence: Synthetic oligonucleotide
  Target: ATXN1; (+) strand; PAM type: YTN; PAM sequence: TTG
ggtatatacccagtaatggg

SEQ ID NO: 262291 - DNA, 20 bp, Artificial Sequence
  Description of Artificial Sequence: Synthetic oligonucleotide
  Target: ATXN1; (+) strand; PAM type: YTN; PAM sequence: CTG
ggtcaaatggtatttctagt

SEQ ID NO: 262292 - DNA, 20 bp, Artificial Sequence
  Description of Artificial Sequence: Synthetic oligonucleotide
  Target: ATXN1; (+) strand; PAM type: YTN; PAM sequence: TTT
ctagttctagatccctgagg

SEQ ID NO: 262293 - DNA, 20 bp, Artificial Sequence
  Description of Artificial Sequence: Synthetic oligonucleotide
  Target: ATXN1; (+) strand; PAM type: YTN; PAM sequence: TTC
tagttctagatccctgagga

SEQ ID NO: 262294 - DNA, 20 bp, Artificial Sequence
  Description of Artificial Sequence: Synthetic oligonucleotide
  Target: ATXN1; (+) strand; PAM type: YTN; PAM sequence: CTA
gttctagatccctgaggaat

SEQ ID NO: 262295 - DNA, 20 bp, Artificial Sequence
  Description of Artificial Sequence: Synthetic oligonucleotide
  Target: ATXN1; (+) strand; PAM type: YTN; PAM sequence: TTC
tagatccctgaggaatcgcc

SEQ ID NO: 262296 - DNA, 20 bp, Artificial Sequence
  Description of Artificial Sequence: Synthetic oligonucleotide
  Target: ATXN1; (+) strand; PAM type: YTN; PAM sequence: CTA
gatccctgaggaatcgccac

SEQ ID NO: 262297 - DNA, 20 bp, Artificial Sequence
  Description of Artificial Sequence: Synthetic oligonucleotide
  Target: ATXN1; (+) strand; PAM type: YTN; PAM sequence: CTG
aggaatcgccacactgactt

SEQ ID NO: 262298 - DNA, 20 bp, Artificial Sequence
  Description of Artificial Sequence: Synthetic oligonucleotide
  Target: ATXN1; (+) strand; PAM type: YTN; PAM sequence: CTG
acttccacaatggttgaact

SEQ ID NO: 262299 - DNA, 20 bp, Artificial Sequence
  Description of Artificial Sequence: Synthetic oligonucleotide
  Target: ATXN1; (+) strand; PAM type: YTN; PAM sequence: CTT
ccacaatggttgaactagtt

SEQ ID NO: 262300 - DNA, 20 bp, Artificial Sequence
  Description of Artificial Sequence: Synthetic oligonucleotide
  Target: ATXN1; (+) strand; PAM type: YTN; PAM sequence: TTC
cacaatggttgaactagttt

SEQ ID NO: 262301 - DNA, 20 bp, Artificial Sequence
  Description of Artificial Sequence: Synthetic oligonucleotide
  Target: ATXN1; (+) strand; PAM type: YTN; PAM sequence: TTG
aactagtttacagtcccacc

SEQ ID NO: 262302 - DNA, 20 bp, Artificial Sequence
  Description of Artificial Sequence: Synthetic oligonucleotide
  Target: ATXN1; (+) strand; PAM type: YTN; PAM sequence: CTA
gtttacagtcccaccaacag

SEQ ID NO: 262303 - DNA, 20 bp, Artificial Sequence
  Description of Artificial Sequence: Synthetic oligonucleotide
  Target: ATXN1; (+) strand; PAM type: YTN; PAM sequence: TTT
acagtcccaccaacagtgta

SEQ ID NO: 262304 - DNA, 20 bp, Artificial Sequence
  Description of Artificial Sequence: Synthetic oligonucleotide
  Target: ATXN1; (+) strand; PAM type: YTN; PAM sequence: TTA
cagtcccaccaacagtgtaa

SEQ ID NO: 262305 - DNA, 20 bp, Artificial Sequence
  Description of Artificial Sequence: Synthetic oligonucleotide
  Target: ATXN1; (+) strand; PAM type: YTN; PAM sequence: TTC
ctatttctccacatcctctc

SEQ ID NO: 262306 - DNA, 20 bp, Artificial Sequence
  Description of Artificial Sequence: Synthetic oligonucleotide
  Target: ATXN1; (+) strand; PAM type: YTN; PAM sequence: CTA
tttctccacatcctctccag

SEQ ID NO: 262307 - DNA, 20 bp, Artificial Sequence
  Description of Artificial Sequence: Synthetic oligonucleotide
  Target: ATXN1; (+) strand; PAM type: YTN; PAM sequence: TTT
ctccacatcctctccagcac

SEQ ID NO: 262308 - DNA, 20 bp, Artificial Sequence
  Description of Artificial Sequence: Synthetic oligonucleotide
  Target: ATXN1; (+) strand; PAM type: YTN; PAM sequence: TTC
tccacatcctctccagcacc

SEQ ID NO: 262309 - DNA, 20 bp, Artificial Sequence
  Description of Artificial Sequence: Synthetic oligonucleotide
  Target: ATXN1; (+) strand; PAM type: YTN; PAM sequence: CTC
cacatcctctccagcacctg

SEQ ID NO: 262310 - DNA, 20 bp, Artificial Sequence
  Description of Artificial Sequence: Synthetic oligonucleotide
  Target: ATXN1; (+) strand; PAM type: YTN; PAM sequence: CTC
tccagcacctgttgtttcct

SEQ ID NO: 262311 - DNA, 20 bp, Artificial Sequence
  Description of Artificial Sequence: Synthetic oligonucleotide
  Target: ATXN1; (+) strand; PAM type: YTN; PAM sequence: CTC
cagcacctgttgtttcctga

SEQ ID NO: 262312 - DNA, 20 bp, Artificial Sequence
  Description of Artificial Sequence: Synthetic oligonucleotide
  Target: ATXN1; (+) strand; PAM type: YTN; PAM sequence: CTG
ttgtttcctgactttttaat

SEQ ID NO: 262313 - DNA, 20 bp, Artificial Sequence
  Description of Artificial Sequence: Synthetic oligonucleotide
  Target: ATXN1; (+) strand; PAM type: YTN; PAM sequence: TTG
tttcctgactttttaatgat

SEQ ID NO: 262314 - DNA, 20 bp, Artificial Sequence
  Description of Artificial Sequence: Synthetic oligonucleotide
  Target: ATXN1; (+) strand; PAM type: YTN; PAM sequence: TTT
cctgactttttaatgattgc

SEQ ID NO: 262315 - DNA, 20 bp, Artificial Sequence
  Description of Artificial Sequence: Synthetic oligonucleotide
  Target: ATXN1; (+) strand; PAM type: YTN; PAM sequence: TTC
ctgactttttaatgattgcc

SEQ ID NO: 262316 - DNA, 20 bp, Artificial Sequence
  Description of Artificial Sequence: Synthetic oligonucleotide
  Target: ATXN1; (+) strand; PAM type: YTN; PAM sequence: CTG
actttttaatgattgccatt

SEQ ID NO: 262317 - DNA, 20 bp, Artificial Sequence
  Description of Artificial Sequence: Synthetic oligonucleotide
  Target: ATXN1; (+) strand; PAM type: YTN; PAM sequence: CTT
tttaatgattgccattctaa

SEQ ID NO: 262318 - DNA, 20 bp, Artificial Sequence
  Description of Artificial Sequence: Synthetic oligonucleotide
  Target: ATXN1; (+) strand; PAM type: YTN; PAM sequence: TTT
ttaatgattgccattctaac

SEQ ID NO: 262319 - DNA, 20 bp, Artificial Sequence
  Description of Artificial Sequence: Synthetic oligonucleotide
  Target: ATXN1; (+) strand; PAM type: YTN; PAM sequence: TTT
taatgattgccattctaact

SEQ ID NO: 262320 - DNA, 20 bp, Artificial Sequence
  Description of Artificial Sequence: Synthetic oligonucleotide
  Target: ATXN1; (+) strand; PAM type: YTN; PAM sequence: TTT
aatgattgccattctaactg

SEQ ID NO: 262321 - DNA, 20 bp, Artificial Sequence
  Description of Artificial Sequence: Synthetic oligonucleotide
  Target: ATXN1; (+) strand; PAM type: YTN; PAM sequence: TTA
atgattgccattctaactgg

SEQ ID NO: 262322 - DNA, 20 bp, Artificial Sequence
  Description of Artificial Sequence: Synthetic oligonucleotide
  Target: ATXN1; (+) strand; PAM type: YTN; PAM sequence: TTG
ccattctaactggtgtgaga

SEQ ID NO: 262323 - DNA, 20 bp, Artificial Sequence
  Description of Artificial Sequence: Synthetic oligonucleotide
  Target: ATXN1; (+) strand; PAM type: YTN; PAM sequence: TTC
taactggtgtgagatggtat

SEQ ID NO: 262324 - DNA, 20 bp, Artificial Sequence
  Description of Artificial Sequence: Synthetic oligonucleotide
  Target: ATXN1; (+) strand; PAM type: YTN; PAM sequence: CTA
actggtgtgagatggtatct

SEQ ID NO: 262325 - DNA, 20 bp, Artificial Sequence
  Description of Artificial Sequence: Synthetic oligonucleotide
  Target: ATXN1; (+) strand; PAM type: YTN; PAM sequence: CTG
gtgtgagatggtatctcatt

SEQ ID NO: 262326 - DNA, 20 bp, Artificial Sequence
  Description of Artificial Sequence: Synthetic oligonucleotide
  Target: ATXN1; (+) strand; PAM type: YTN; PAM sequence: CTC
attgtggttttgatttgcat

SEQ ID NO: 262327 - DNA, 20 bp, Artificial Sequence
  Description of Artificial Sequence: Synthetic oligonucleotide
  Target: ATXN1; (+) strand; PAM type: YTN; PAM sequence: TTG
tggttttgatttgcatttct

SEQ ID NO: 262328 - DNA, 20 bp, Artificial Sequence
  Description of Artificial Sequence: Synthetic oligonucleotide
  Target: ATXN1; (+) strand; PAM type: YTN; PAM sequence: TTT
tgatttgcatttctctgatg

SEQ ID NO: 262329 - DNA, 20 bp, Artificial Sequence
  Description of Artificial Sequence: Synthetic oligonucleotide
  Target: ATXN1; (+) strand; PAM type: YTN; PAM sequence: TTT
gatttgcatttctctgatgg

SEQ ID NO: 262330 - DNA, 20 bp, Artificial Sequence
  Description of Artificial Sequence: Synthetic oligonucleotide
  Target: ATXN1; (+) strand; PAM type: YTN; PAM sequence: TTG
atttgcatttctctgatggc

SEQ ID NO: 262331 - DNA, 20 bp, Artificial Sequence
  Description of Artificial Sequence: Synthetic oligonucleotide
  Target: ATXN1; (+) strand; PAM type: YTN; PAM sequence: TTT
gcatttctctgatggccagt

SEQ ID NO: 262332 - DNA, 20 bp, Artificial Sequence
  Description of Artificial Sequence: Synthetic oligonucleotide
  Target: ATXN1; (+) strand; PAM type: YTN; PAM sequence: TTG
catttctctgatggccagtg

SEQ ID NO: 262333 - DNA, 20 bp, Artificial Sequence
  Description of Artificial Sequence: Synthetic oligonucleotide
  Target: ATXN1; (+) strand; PAM type: YTN; PAM sequence: TTT
ctctgatggccagtgatgat

SEQ ID NO: 262334 - DNA, 20 bp, Artificial Sequence
  Description of Artificial Sequence: Synthetic oligonucleotide
  Target: ATXN1; (+) strand; PAM type: YTN; PAM sequence: TTC
tctgatggccagtgatgatg

SEQ ID NO: 262335 - DNA, 20 bp, Artificial Sequence
  Description of Artificial Sequence: Synthetic oligonucleotide
  Target: ATXN1; (+) strand; PAM type: YTN; PAM sequence: CTC
tgatggccagtgatgatgag

SEQ ID NO: 262336 - DNA, 20 bp, Artificial Sequence
  Description of Artificial Sequence: Synthetic oligonucleotide
  Target: ATXN1; (+) strand; PAM type: YTN; PAM sequence: CTG
atggccagtgatgatgagca

SEQ ID NO: 262337 - DNA, 20 bp, Artificial Sequence
  Description of Artificial Sequence: Synthetic oligonucleotide
  Target: ATXN1; (+) strand; PAM type: YTN; PAM sequence: TTT
tttcacgtgtcttttggctg

SEQ ID NO: 262338 - DNA, 20 bp, Artificial Sequence
  Description of Artificial Sequence: Synthetic oligonucleotide
  Target: ATXN1; (+) strand; PAM type: YTN; PAM sequence: TTT
ttcacgtgtcttttggctgc

SEQ ID NO: 262339 - DNA, 20 bp, Artificial Sequence
  Description of Artificial Sequence: Synthetic oligonucleotide
  Target: ATXN1; (+) strand; PAM type: YTN; PAM sequence: TTT
tcacgtgtcttttggctgca

SEQ ID NO: 262340 - DNA, 20 bp, Artificial Sequence
  Description of Artificial Sequence: Synthetic oligonucleotide
  Target: ATXN1; (+) strand; PAM type: YTN; PAM sequence: TTT
cacgtgtcttttggctgcat

SEQ ID NO: 262341 - DNA, 20 bp, Artificial Sequence
  Description of Artificial Sequence: Synthetic oligonucleotide
  Target: ATXN1; (+) strand; PAM type: YTN; PAM sequence: TTC
acgtgtcttttggctgcata

SEQ ID NO: 262342 - DNA, 20 bp, Artificial Sequence
  Description of Artificial Sequence: Synthetic oligonucleotide
  Target: ATXN1; (+) strand; PAM type: YTN; PAM sequence: CTT
ttggctgcataaatgtcttc

SEQ ID NO: 262343 - DNA, 20 bp, Artificial Sequence
  Description of Artificial Sequence: Synthetic oligonucleotide
  Target: ATXN1; (+) strand; PAM type: YTN; PAM sequence: TTT
tggctgcataaatgtcttct

SEQ ID NO: 262344 - DNA, 20 bp, Artificial Sequence
  Description of Artificial Sequence: Synthetic oligonucleotide
  Target: ATXN1; (+) strand; PAM type: YTN; PAM sequence: TTT
ggctgcataaatgtcttctt

SEQ ID NO: 262345 - DNA, 20 bp, Artificial Sequence
  Description of Artificial Sequence: Synthetic oligonucleotide
  Target: ATXN1; (+) strand; PAM type: YTN; PAM sequence: TTG
gctgcataaatgtcttcttt

SEQ ID NO: 262346 - DNA, 20 bp, Artificial Sequence
  Description of Artificial Sequence: Synthetic oligonucleotide
  Target: ATXN1; (+) strand; PAM type: YTN; PAM sequence: CTG
cataaatgtcttcttttgag

SEQ ID NO: 262347 - DNA, 20 bp, Artificial Sequence
  Description of Artificial Sequence: Synthetic oligonucleotide
  Target: ATXN1; (+) strand; PAM type: YTN; PAM sequence: CTT
cttttgagaagtgtctgtta

SEQ ID NO: 262348 - DNA, 20 bp, Artificial Sequence
  Description of Artificial Sequence: Synthetic oligonucleotide
  Target: ATXN1; (+) strand; PAM type: YTN; PAM sequence: TTC
ttttgagaagtgtctgttaa

SEQ ID NO: 262349 - DNA, 20 bp, Artificial Sequence
  Description of Artificial Sequence: Synthetic oligonucleotide
  Target: ATXN1; (+) strand; PAM type: YTN; PAM sequence: CTT
ttgagaagtgtctgttaaat

SEQ ID NO: 262350 - DNA, 20 bp, Artificial Sequence
  Description of Artificial Sequence: Synthetic oligonucleotide
  Target: ATXN1; (+) strand; PAM type: YTN; PAM sequence: TTT
tgagaagtgtctgttaaatg

SEQ ID NO: 262351 - DNA, 20 bp, Artificial Sequence
  Description of Artificial Sequence: Synthetic oligonucleotide
  Target: ATXN1; (+) strand; PAM type: YTN; PAM sequence: TTT
gagaagtgtctgttaaatgt

SEQ ID NO: 262352 - DNA, 20 bp, Artificial Sequence
  Description of Artificial Sequence: Synthetic oligonucleotide
  Target: ATXN1; (+) strand; PAM type: YTN; PAM sequence: TTG
agaagtgtctgttaaatgtg

SEQ ID NO: 262353 - DNA, 20 bp, Artificial Sequence
  Description of Artificial Sequence: Synthetic oligonucleotide
  Target: ATXN1; (+) strand; PAM type: YTN; PAM sequence: CTG
ttaaatgtgtttgatatttc

SEQ ID NO: 262354 - DNA, 20 bp, Artificial Sequence
  Description of Artificial Sequence: Synthetic oligonucleotide
  Target: ATXN1; (+) strand; PAM type: YTN; PAM sequence: TTA
aatgtgtttgatatttctat

SEQ ID NO: 262355 - DNA, 20 bp, Artificial Sequence
  Description of Artificial Sequence: Synthetic oligonucleotide
  Target: ATXN1; (+) strand; PAM type: YTN; PAM sequence: TTT
gatatttctataacacaaag

SEQ ID NO: 262356 - DNA, 20 bp, Artificial Sequence
  Description of Artificial Sequence: Synthetic oligonucleotide
  Target: ATXN1; (+) strand; PAM type: YTN; PAM sequence: TTG
atatttctataacacaaagt

SEQ ID NO: 262357 - DNA, 20 bp, Artificial Sequence
  Description of Artificial Sequence: Synthetic oligonucleotide
  Target: ATXN1; (+) strand; PAM type: YTN; PAM sequence: TTT
ctataacacaaagttaaagt

SEQ ID NO: 262358 - DNA, 20 bp, Artificial Sequence
  Description of Artificial Sequence: Synthetic oligonucleotide
  Target: ATXN1; (+) strand; PAM type: YTN; PAM sequence: TTC
tataacacaaagttaaagtt

SEQ ID NO: 262359 - DNA, 20 bp, Artificial Sequence
  Description of Artificial Sequence: Synthetic oligonucleotide
  Target: ATXN1; (+) strand; PAM type: YTN; PAM sequence: CTA
taacacaaagttaaagttcc

SEQ ID NO: 262360 - DNA, 20 bp, Artificial Sequence
  Description of Artificial Sequence: Synthetic oligonucleotide
  Target: ATXN1; (+) strand; PAM type: YTN; PAM sequence: TTA
aagttcctttggtaatttgg

SEQ ID NO: 262361 - DNA, 20 bp, Artificial Sequence
  Description of Artificial Sequence: Synthetic oligonucleotide
  Target: ATXN1; (+) strand; PAM type: YTN; PAM sequence: TTC
ctttggtaatttggcagtgt

SEQ ID NO: 262362 - DNA, 20 bp, Artificial Sequence
  Description of Artificial Sequence: Synthetic oligonucleotide
  Target: ATXN1; (+) strand; PAM type: YTN; PAM sequence: CTT
tggtaatttggcagtgtttc

SEQ ID NO: 262363 - DNA, 20 bp, Artificial Sequence
  Description of Artificial Sequence: Synthetic oligonucleotide
  Target: ATXN1; (+) strand; PAM type: YTN; PAM sequence: TTT
ggtaatttggcagtgtttct

SEQ ID NO: 262364 - DNA, 20 bp, Artificial Sequence
  Description of Artificial Sequence: Synthetic oligonucleotide
  Target: ATXN1; (+) strand; PAM type: YTN; PAM sequence: TTG
gtaatttggcagtgtttctc

SEQ ID NO: 262365 - DNA, 20 bp, Artificial Sequence
  Description of Artificial Sequence: Synthetic oligonucleotide
  Target: ATXN1; (+) strand; PAM type: YTN; PAM sequence: TTT
ggcagtgtttctcaaatgtg

SEQ ID NO: 262366 - DNA, 20 bp, Artificial Sequence
  Description of Artificial Sequence: Synthetic oligonucleotide
  Target: ATXN1; (+) strand; PAM type: YTN; PAM sequence: TTG
gcagtgtttctcaaatgtgg

SEQ ID NO: 262367 - DNA, 20 bp, Artificial Sequence
  Description of Artificial Sequence: Synthetic oligonucleotide
  Target: ATXN1; (+) strand; PAM type: YTN; PAM sequence: TTT
ctcaaatgtggtttcccaca

SEQ ID NO: 262368 - DNA, 20 bp, Artificial Sequence
  Description of Artificial Sequence: Synthetic oligonucleotide
  Target: ATXN1; (+) strand; PAM type: YTN; PAM sequence: TTC
tcaaatgtggtttcccacag

SEQ ID NO: 262369 - DNA, 20 bp, Artificial Sequence
  Description of Artificial Sequence: Synthetic oligonucleotide
  Target: ATXN1; (+) strand; PAM type: YTN; PAM sequence: CTC
aaatgtggtttcccacagcc

SEQ ID NO: 262370 - DNA, 20 bp, Artificial Sequence
  Description of Artificial Sequence: Synthetic oligonucleotide
  Target: ATXN1; (+) strand; PAM type: YTN; PAM sequence: TTT
cccacagccttcctttgggg

SEQ ID NO: 262371 - DNA, 20 bp, Artificial Sequence
  Description of Artificial Sequence: Synthetic oligonucleotide
  Target: ATXN1; (+) strand; PAM type: YTN; PAM sequence: TTC
ccacagccttcctttggggt

SEQ ID NO: 262372 - DNA, 20 bp, Artificial Sequence
  Description of Artificial Sequence: Synthetic oligonucleotide
  Target: ATXN1; (+) strand; PAM type: YTN; PAM sequence: CTT
cctttggggtgcctgttaaa

SEQ ID NO: 262373 - DNA, 20 bp, Artificial Sequence
  Description of Artificial Sequence: Synthetic oligonucleotide
  Target: ATXN1; (+) strand; PAM type: YTN; PAM sequence: TTC
ctttggggtgcctgttaaaa

SEQ ID NO: 262374 - DNA, 20 bp, Artificial Sequence
  Description of Artificial Sequence: Synthetic oligonucleotide
  Target: ATXN1; (+) strand; PAM type: YTN; PAM sequence: CTT
tggggtgcctgttaaaattc

SEQ ID NO: 262375 - DNA, 20 bp, Artificial Sequence
  Description of Artificial Sequence: Synthetic oligonucleotide
  Target: ATXN1; (+) strand; PAM type: YTN; PAM sequence: TTT
ggggtgcctgttaaaattca

SEQ ID NO: 262376 - DNA, 20 bp, Artificial Sequence
  Description of Artificial Sequence: Synthetic oligonucleotide
  Target: ATXN1; (+) strand; PAM type: YTN; PAM sequence: TTG
gggtgcctgttaaaattcac

SEQ ID NO: 262377 - DNA, 20 bp, Artificial Sequence
  Description of Artificial Sequence: Synthetic oligonucleotide
  Target: ATXN1; (+) strand; PAM type: YTN; PAM sequence: CTG
ttaaaattcacattcctgac

SEQ ID NO: 262378 - DNA, 20 bp, Artificial Sequence
  Description of Artificial Sequence: Synthetic oligonucleotide
  Target: ATXN1; (+) strand; PAM type: YTN; PAM sequence: TTA
aaattcacattcctgacatc

SEQ ID NO: 262379 - DNA, 20 bp, Artificial Sequence
  Description of Artificial Sequence: Synthetic oligonucleotide
  Target: ATXN1; (+) strand; PAM type: YTN; PAM sequence: TTC
acattcctgacatcagctta

SEQ ID NO: 262380 - DNA, 20 bp, Artificial Sequence
  Description of Artificial Sequence: Synthetic oligonucleotide
  Target: ATXN1; (+) strand; PAM type: YTN; PAM sequence: TTC
ctgacatcagcttactcggg

SEQ ID NO: 262381 - DNA, 20 bp, Artificial Sequence
  Description of Artificial Sequence: Synthetic oligonucleotide
  Target: ATXN1; (+) strand; PAM type: YTN; PAM sequence: CTG
acatcagcttactcggggca

SEQ ID NO: 262382 - DNA, 20 bp, Artificial Sequence
  Description of Artificial Sequence: Synthetic oligonucleotide
  Target: ATXN1; (+) strand; PAM type: YTN; PAM sequence: CTT
actcggggcacttctcaaaa

SEQ ID NO: 262383 - DNA, 20 bp, Artificial Sequence
  Description of Artificial Sequence: Synthetic oligonucleotide
  Target: ATXN1; (+) strand; PAM type: YTN; PAM sequence: TTA
ctcggggcacttctcaaaat

SEQ ID NO: 262384 - DNA, 20 bp, Artificial Sequence
  Description of Artificial Sequence: Synthetic oligonucleotide
  Target: ATXN1; (+) strand; PAM type: YTN; PAM sequence: CTC
ggggcacttctcaaaattga

SEQ ID NO: 262385 - DNA, 20 bp, Artificial Sequence
  Description of Artificial Sequence: Synthetic oligonucleotide
  Target: ATXN1; (+) strand; PAM type: YTN; PAM sequence: CTT
ctcaaaattgaaagctgccc

SEQ ID NO: 262386 - DNA, 20 bp, Artificial Sequence
  Description of Artificial Sequence: Synthetic oligonucleotide
  Target: ATXN1; (+) strand; PAM type: YTN; PAM sequence: TTC
tcaaaattgaaagctgccca

SEQ ID NO: 262387 - DNA, 20 bp, Artificial Sequence
  Description of Artificial Sequence: Synthetic oligonucleotide
  Target: ATXN1; (+) strand; PAM type: YTN; PAM sequence: CTC
aaaattgaaagctgcccaac

SEQ ID NO: 262388 - DNA, 20 bp, Artificial Sequence
  Description of Artificial Sequence: Synthetic oligonucleotide
  Target: ATXN1; (+) strand; PAM type: YTN; PAM sequence: TTG
aaagctgcccaaccccagat

SEQ ID NO: 262389 - DNA, 20 bp, Artificial Sequence
  Description of Artificial Sequence: Synthetic oligonucleotide
  Target: ATXN1; (+) strand; PAM type: YTN; PAM sequence: CTG
cccaaccccagatttgtgaa

SEQ ID NO: 262390 - DNA, 20 bp, Artificial Sequence
  Description of Artificial Sequence: Synthetic oligonucleotide
  Target: ATXN1; (+) strand; PAM type: YTN; PAM sequence: TTT
gtgaatcagaattcctggga

SEQ ID NO: 262391 - DNA, 20 bp, Artificial Sequence
  Description of Artificial Sequence: Synthetic oligonucleotide
  Target: ATXN1; (+) strand; PAM type: YTN; PAM sequence: TTG
tgaatcagaattcctgggag

SEQ ID NO: 262392 - DNA, 20 bp, Artificial Sequence
  Description of Artificial Sequence: Synthetic oligonucleotide
  Target: ATXN1; (+) strand; PAM type: YTN; PAM sequence: TTC
ctgggagtgaagcccagaaa

SEQ ID NO: 262393 - DNA, 20 bp, Artificial Sequence
  Description of Artificial Sequence: Synthetic oligonucleotide
  Target: ATXN1; (+) strand; PAM type: YTN; PAM sequence: CTG
ggagtgaagcccagaaaact

SEQ ID NO: 262394 - DNA, 20 bp, Artificial Sequence
  Description of Artificial Sequence: Synthetic oligonucleotide
  Target: ATXN1; (+) strand; PAM type: YTN; PAM sequence: CTG
tattttacatacagtatgca

SEQ ID NO: 262395 - DNA, 20 bp, Artificial Sequence
  Description of Artificial Sequence: Synthetic oligonucleotide
  Target: ATXN1; (+) strand; PAM type: YTN; PAM sequence: TTT
tacatacagtatgcaggtag

SEQ ID NO: 262396 - DNA, 20 bp, Artificial Sequence
  Description of Artificial Sequence: Synthetic oligonucleotide
  Target: ATXN1; (+) strand; PAM type: YTN; PAM sequence: TTT
acatacagtatgcaggtagg

SEQ ID NO: 262397 - DNA, 20 bp, Artificial Sequence
  Description of Artificial Sequence: Synthetic oligonucleotide
  Target: ATXN1; (+) strand; PAM type: YTN; PAM sequence: TTA
catacagtatgcaggtaggt

SEQ ID NO: 262398 - DNA, 20 bp, Artificial Sequence
  Description of Artificial Sequence: Synthetic oligonucleotide
  Target: ATXN1; (+) strand; PAM type: YTN; PAM sequence: CTT
ctgcacactccattttgctt

SEQ ID NO: 262399 - DNA, 20 bp, Artificial Sequence
  Description of Artificial Sequence: Synthetic oligonucleotide
  Target: ATXN1; (+) strand; PAM type: YTN; PAM sequence: TTC
tgcacactccattttgcttt

SEQ ID NO: 262400 - DNA, 20 bp, Artificial Sequence
  Description of Artificial Sequence: Synthetic oligonucleotide
  Target: ATXN1; (+) strand; PAM type: YTN; PAM sequence: CTG
cacactccattttgctttag

SEQ ID NO: 262401 - DNA, 20 bp, Artificial Sequence
  Description of Artificial Sequence: Synthetic oligonucleotide
  Target: ATXN1; (+) strand; PAM type: YTN; PAM sequence: CTC
cattttgctttagtcatttg

SEQ ID NO: 262402 - DNA, 20 bp, Artificial Sequence
  Description of Artificial Sequence: Synthetic oligonucleotide
  Target: ATXN1; (+) strand; PAM type: YTN; PAM sequence: TTT
tgctttagtcatttgcatga

SEQ ID NO: 262403 - DNA, 20 bp, Artificial Sequence
  Description of Artificial Sequence: Synthetic oligonucleotide
  Target: ATXN1; (+) strand; PAM type: YTN; PAM sequence: TTT
gctttagtcatttgcatgaa

SEQ ID NO: 262404 - DNA, 20 bp, Artificial Sequence
  Description of Artificial Sequence: Synthetic oligonucleotide
  Target: ATXN1; (+) strand; PAM type: YTN; PAM sequence: TTG
ctttagtcatttgcatgaaa

SEQ ID NO: 262405 - DNA, 20 bp, Artificial Sequence
  Description of Artificial Sequence: Synthetic oligonucleotide
  Target: ATXN1; (+) strand; PAM type: YTN; PAM sequence: CTT
tagtcatttgcatgaaataa

SEQ ID NO: 262406 - DNA, 20 bp, Artificial Sequence
  Description of Artificial Sequence: Synthetic oligonucleotide
  Target: ATXN1; (+) strand; PAM type: YTN; PAM sequence: TTT
agtcatttgcatgaaataaa

SEQ ID NO: 262407 - DNA, 20 bp, Artificial Sequence
  Description of Artificial Sequence: Synthetic oligonucleotide
  Target: ATXN1; (+) strand; PAM type: YTN; PAM sequence: TTA
gtcatttgcatgaaataaat

SEQ ID NO: 262408 - DNA, 20 bp, Artificial Sequence
  Description of Artificial Sequence: Synthetic oligonucleotide
  Target: ATXN1; (+) strand; PAM type: YTN; PAM sequence: TTT
gcatgaaataaattatttct

SEQ ID NO: 262409 - DNA, 20 bp, Artificial Sequence
  Description of Artificial Sequence: Synthetic oligonucleotide
  Target: ATXN1; (+) strand; PAM type: YTN; PAM sequence: TTG
catgaaataaattatttctt

SEQ ID NO: 262410 - DNA, 20 bp, Artificial Sequence
  Description of Artificial Sequence: Synthetic oligonucleotide
  Target: ATXN1; (+) strand; PAM type: YTN; PAM sequence: TTA
tttctttttcaaagggttta

SEQ ID NO: 262411 - DNA, 20 bp, Artificial Sequence
  Description of Artificial Sequence: Synthetic oligonucleotide
  Target: ATXN1; (+) strand; PAM type: YTN; PAM sequence: TTT
ctttttcaaagggtttaaca

SEQ ID NO: 262412 - DNA, 20 bp, Artificial Sequence
  Description of Artificial Sequence: Synthetic oligonucleotide
  Target: ATXN1; (+) strand; PAM type: YTN; PAM sequence: TTC
tttttcaaagggtttaacag

SEQ ID NO: 262413 - DNA, 20 bp, Artificial Sequence
  Description of Artificial Sequence: Synthetic oligonucleotide
  Target: ATXN1; (+) strand; PAM type: YTN; PAM sequence: CTT
tttcaaagggtttaacagtt

SEQ ID NO: 262414 - DNA, 20 bp, Artificial Sequence
  Description of Artificial Sequence: Synthetic oligonucleotide
  Target: ATXN1; (+) strand; PAM type: YTN; PAM sequence: TTT
ttcaaagggtttaacagtta

SEQ ID NO: 262415 - DNA, 20 bp, Artificial Sequence
  Description of Artificial Sequence: Synthetic oligonucleotide
  Target: ATXN1; (+) strand; PAM type: YTN; PAM sequence: TTT
tcaaagggtttaacagttaa

SEQ ID NO: 262416 - DNA, 20 bp, Artificial Sequence
  Description of Artificial Sequence: Synthetic oligonucleotide
  Target: ATXN1; (+) strand; PAM type: YTN; PAM sequence: TTT
caaagggtttaacagttaaa

SEQ ID NO: 262417 - DNA, 20 bp, Artificial Sequence
  Description of Artificial Sequence: Synthetic oligonucleotide
  Target: ATXN1; (+) strand; PAM type: YTN; PAM sequence: TTC
aaagggtttaacagttaaat

SEQ ID NO: 262418 - DNA, 20 bp, Artificial Sequence
  Description of Artificial Sequence: Synthetic oligonucleotide
  Target: ATXN1; (+) strand; PAM type: YTN; PAM sequence: TTT
aacagttaaatctaaagttt

SEQ ID NO: 262419 - DNA, 20 bp, Artificial Sequence
  Description of Artificial Sequence: Synthetic oligonucleotide
  Target: ATXN1; (+) strand; PAM type: YTN; PAM sequence: TTA
acagttaaatctaaagtttt

SEQ ID NO: 262420 - DNA, 20 bp, Artificial Sequence
  Description of Artificial Sequence: Synthetic oligonucleotide
  Target: ATXN1; (+) strand; PAM type: YTN; PAM sequence: TTA
aatctaaagttttttttcta

SEQ ID NO: 262421 - DNA, 20 bp, Artificial Sequence
  Description of Artificial Sequence: Synthetic oligonucleotide
  Target: ATXN1; (+) strand; PAM type: YTN; PAM sequence: CTA
aagttttttttctattaaag

SEQ ID NO: 262422 - DNA, 20 bp, Artificial Sequence
  Description of Artificial Sequence: Synthetic oligonucleotide
  Target: ATXN1; (+) strand; PAM type: YTN; PAM sequence: TTT
tttttctattaaaggaactt

SEQ ID NO: 262423 - DNA, 20 bp, Artificial Sequence
  Description of Artificial Sequence: Synthetic oligonucleotide
  Target: ATXN1; (+) strand; PAM type: YTN; PAM sequence: TTT
ttttctattaaaggaacttt

SEQ ID NO: 262424 - DNA, 20 bp, Artificial Sequence
  Description of Artificial Sequence: Synthetic oligonucleotide
  Target: ATXN1; (+) strand; PAM type: YTN; PAM sequence: TTT
tttctattaaaggaacttta

SEQ ID NO: 262425 - DNA, 20 bp, Artificial Sequence
  Description of Artificial Sequence: Synthetic oligonucleotide
  Target: ATXN1; (+) strand; PAM type: YTN; PAM sequence: TTT
ttctattaaaggaactttac

SEQ ID NO: 262426 - DNA, 20 bp, Artificial Sequence
  Description of Artificial Sequence: Synthetic oligonucleotide
  Target: ATXN1; (+) strand; PAM type: YTN; PAM sequence: TTT
tctattaaaggaactttaca

SEQ ID NO: 262427 - DNA, 20 bp, Artificial Sequence
  Description of Artificial Sequence: Synthetic oligonucleotide
  Target: ATXN1; (+) strand; PAM type: YTN; PAM sequence: TTT
ctattaaaggaactttacag

SEQ ID NO: 262428 - DNA, 20 bp, Artificial Sequence
  Description of Artificial Sequence: Synthetic oligonucleotide
  Target: ATXN1; (+) strand; PAM type: YTN; PAM sequence: TTC
tattaaaggaactttacagt

SEQ ID NO: 262429 - DNA, 20 bp, Artificial Sequence
  Description of Artificial Sequence: Synthetic oligonucleotide
  Target: ATXN1; (+) strand; PAM type: YTN; PAM sequence: CTA
ttaaaggaactttacagtga

SEQ ID NO: 262430 - DNA, 20 bp, Artificial Sequence
  Description of Artificial Sequence: Synthetic oligonucleotide
  Target: ATXN1; (+) strand; PAM type: YTN; PAM sequence: TTA
aaggaactttacagtgacct

SEQ ID NO: 262431 - DNA, 20 bp, Artificial Sequence
  Description of Artificial Sequence: Synthetic oligonucleotide
  Target: ATXN1; (+) strand; PAM type: YTN; PAM sequence: CTT
tacagtgacctaaaatattc

SEQ ID NO: 262432 - DNA, 20 bp, Artificial Sequence
  Description of Artificial Sequence: Synthetic oligonucleotide
  Target: ATXN1; (+) strand; PAM type: YTN; PAM sequence: TTT
acagtgacctaaaatattct

SEQ ID NO: 262433 - DNA, 20 bp, Artificial Sequence
  Description of Artificial Sequence: Synthetic oligonucleotide
  Target: ATXN1; (+) strand; PAM type: YTN; PAM sequence: TTA
cagtgacctaaaatattctt

SEQ ID NO: 262434 - DNA, 20 bp, Artificial Sequence
  Description of Artificial Sequence: Synthetic oligonucleotide
  Target: ATXN1; (+) strand; PAM type: YTN; PAM sequence: CTA
aaatattcttcacatgttgt

SEQ ID NO: 262435 - DNA, 20 bp, Artificial Sequence
  Description of Artificial Sequence: Synthetic oligonucleotide
  Target: ATXN1; (+) strand; PAM type: YTN; PAM sequence: TTC
ttcacatgttgttgtttcat

SEQ ID NO: 262436 - DNA, 20 bp, Artificial Sequence
  Description of Artificial Sequence: Synthetic oligonucleotide
  Target: ATXN1; (+) strand; PAM type: YTN; PAM sequence: CTT
cacatgttgttgtttcattt

SEQ ID NO: 262437 - DNA, 20 bp, Artificial Sequence
  Description of Artificial Sequence: Synthetic oligonucleotide
  Target: ATXN1; (+) strand; PAM type: YTN; PAM sequence: TTC
acatgttgttgtttcatttc

SEQ ID NO: 262438 - DNA, 20 bp, Artificial Sequence
  Description of Artificial Sequence: Synthetic oligonucleotide
  Target: ATXN1; (+) strand; PAM type: YTN; PAM sequence: TTG
ttgtttcatttctgtaaaat

SEQ ID NO: 262439 - DNA, 20 bp, Artificial Sequence
  Description of Artificial Sequence: Synthetic oligonucleotide
  Target: ATXN1; (+) strand; PAM type: YTN; PAM sequence: TTG
tttcatttctgtaaaatata

SEQ ID NO: 262440 - DNA, 20 bp, Artificial Sequence
  Description of Artificial Sequence: Synthetic oligonucleotide
  Target: ATXN1; (+) strand; PAM type: YTN; PAM sequence: TTT
catttctgtaaaatatatcc

SEQ ID NO: 262441 - DNA, 20 bp, Artificial Sequence
  Description of Artificial Sequence: Synthetic oligonucleotide
  Target: ATXN1; (+) strand; PAM type: YTN; PAM sequence: TTC
atttctgtaaaatatatcct

SEQ ID NO: 262442 - DNA, 20 bp, Artificial Sequence
  Description of Artificial Sequence: Synthetic oligonucleotide
  Target: ATXN1; (+) strand; PAM type: YTN; PAM sequence: TTT
ctgtaaaatatatcctgttg

SEQ ID NO: 262443 - DNA, 20 bp, Artificial Sequence
  Description of Artificial Sequence: Synthetic oligonucleotide
  Target: ATXN1; (+) strand; PAM type: YTN; PAM sequence: TTC
tgtaaaatatatcctgttgg

SEQ ID NO: 262444 - DNA, 20 bp, Artificial Sequence
  Description of Artificial Sequence: Synthetic oligonucleotide
  Target: ATXN1; (+) strand; PAM type: YTN; PAM sequence: CTG
taaaatatatcctgttggtg

SEQ ID NO: 262445 - DNA, 20 bp, Artificial Sequence
  Description of Artificial Sequence: Synthetic oligonucleotide
  Target: ATXN1; (+) strand; PAM type: YTN; PAM sequence: CTG
ttggtgtcatctatcaacaa

SEQ ID NO: 262446 - DNA, 20 bp, Artificial Sequence
  Description of Artificial Sequence: Synthetic oligonucleotide
  Target: ATXN1; (+) strand; PAM type: YTN; PAM sequence: TTG
gtgtcatctatcaacaagta

SEQ ID NO: 262447 - DNA, 20 bp, Artificial Sequence
  Description of Artificial Sequence: Synthetic oligonucleotide
  Target: ATXN1; (+) strand; PAM type: YTN; PAM sequence: CTA
tcaacaagtacatagtctta

SEQ ID NO: 262448 - DNA, 20 bp, Artificial Sequence
  Description of Artificial Sequence: Synthetic oligonucleotide
  Target: ATXN1; (+) strand; PAM type: YTN; PAM sequence: CTT
aaaatttttattatgggaga

SEQ ID NO: 262449 - DNA, 20 bp, Artificial Sequence
  Description of Artificial Sequence: Synthetic oligonucleotide
  Target: ATXN1; (+) strand; PAM type: YTN; PAM sequence: TTA
aaatttttattatgggagaa

SEQ ID NO: 262450 - DNA, 20 bp, Artificial Sequence
  Description of Artificial Sequence: Synthetic oligonucleotide
  Target: ATXN1; (+) strand; PAM type: YTN; PAM sequence: TTT
ttattatgggagaaagggat

SEQ ID NO: 262451 - DNA, 20 bp, Artificial Sequence
  Description of Artificial Sequence: Synthetic oligonucleotide
  Target: ATXN1; (+) strand; PAM type: YTN; PAM sequence: TTT
tattatgggagaaagggatc

SEQ ID NO: 262452 - DNA, 20 bp, Artificial Sequence
  Description of Artificial Sequence: Synthetic oligonucleotide
  Target: ATXN1; (+) strand; PAM type: YTN; PAM sequence: TTT
attatgggagaaagggatca

SEQ ID NO: 262453 - DNA, 20 bp, Artificial Sequence
  Description of Artificial Sequence: Synthetic oligonucleotide
  Target: ATXN1; (+) strand; PAM type: YTN; PAM sequence: TTA
ttatgggagaaagggatcag

SEQ ID NO: 262454 - DNA, 20 bp, Artificial Sequence
  Description of Artificial Sequence: Synthetic oligonucleotide
  Target: ATXN1; (+) strand; PAM type: YTN; PAM sequence: TTA
tgggagaaagggatcagacc

SEQ ID NO: 262455 - DNA, 20 bp, Artificial Sequence
  Description of Artificial Sequence: Synthetic oligonucleotide
  Target: ATXN1; (+) strand; PAM type: YTN; PAM sequence: CTC
tctacagtttgctgagcgtg

SEQ ID NO: 262456 - DNA, 20 bp, Artificial Sequence
  Description of Artificial Sequence: Synthetic oligonucleotide
  Target: ATXN1; (+) strand; PAM type: YTN; PAM sequence: CTC
tacagtttgctgagcgtgtg

SEQ ID NO: 262457 - DNA, 20 bp, Artificial Sequence
  Description of Artificial Sequence: Synthetic oligonucleotide
  Target: ATXN1; (+) strand; PAM type: YTN; PAM sequence: CTA
cagtttgctgagcgtgtggt

SEQ ID NO: 262458 - DNA, 20 bp, Artificial Sequence
  Description of Artificial Sequence: Synthetic oligonucleotide
  Target: ATXN1; (+) strand; PAM type: YTN; PAM sequence: TTT
gctgagcgtgtggttaataa

SEQ ID NO: 262459 - DNA, 20 bp, Artificial Sequence
  Description of Artificial Sequence: Synthetic oligonucleotide
  Target: ATXN1; (+) strand; PAM type: YTN; PAM sequence: TTG
ctgagcgtgtggttaataaa

SEQ ID NO: 262460 - DNA, 20 bp, Artificial Sequence
  Description of Artificial Sequence: Synthetic oligonucleotide
  Target: ATXN1; (+) strand; PAM type: YTN; PAM sequence: CTG
agcgtgtggttaataaacta

SEQ ID NO: 262461 - DNA, 20 bp, Artificial Sequence
  Description of Artificial Sequence: Synthetic oligonucleotide
  Target: ATXN1; (+) strand; PAM type: YTN; PAM sequence: TTA
ataaactagaggaaatagcc

SEQ ID NO: 262462 - DNA, 20 bp, Artificial Sequence
  Description of Artificial Sequence: Synthetic oligonucleotide
  Target: ATXN1; (+) strand; PAM type: YTN; PAM sequence: CTA
gaggaaatagcctagagtaa

SEQ ID NO: 262463 - DNA, 20 bp, Artificial Sequence
  Description of Artificial Sequence: Synthetic oligonucleotide
  Target: ATXN1; (+) strand; PAM type: YTN; PAM sequence: CTA
gagtaacatggatgaagcta

SEQ ID NO: 262464 - DNA, 20 bp, Artificial Sequence
  Description of Artificial Sequence: Synthetic oligonucleotide
  Target: ATXN1; (+) strand; PAM type: YTN; PAM sequence: CTA
cagaaatgtgccttttgtat

SEQ ID NO: 262465 - DNA, 20 bp, Artificial Sequence
  Description of Artificial Sequence: Synthetic oligonucleotide
  Target: ATXN1; (+) strand; PAM type: YTN; PAM sequence: CTT
ttgtatggaagacatgcttg

SEQ ID NO: 262466 - DNA, 20 bp, Artificial Sequence
  Description of Artificial Sequence: Synthetic oligonucleotide
  Target: ATXN1; (+) strand; PAM type: YTN; PAM sequence: TTT
tgtatggaagacatgcttgg

SEQ ID NO: 262467 - DNA, 20 bp, Artificial Sequence
  Description of Artificial Sequence: Synthetic oligonucleotide
  Target: ATXN1; (+) strand; PAM type: YTN; PAM sequence: TTT
gtatggaagacatgcttggt

SEQ ID NO: 262468 - DNA, 20 bp, Artificial Sequence
  Description of Artificial Sequence: Synthetic oligonucleotide
  Target: ATXN1; (+) strand; PAM type: YTN; PAM sequence: TTG
tatggaagacatgcttggtg

SEQ ID NO: 262469 - DNA, 20 bp, Artificial Sequence
  Description of Artificial Sequence: Synthetic oligonucleotide
  Target: ATXN1; (+) strand; PAM type: YTN; PAM sequence: CTT
ggtgacagagaagataagtt

SEQ ID NO: 262470 - DNA, 20 bp, Artificial Sequence
  Description of Artificial Sequence: Synthetic oligonucleotide
  Target: ATXN1; (+) strand; PAM type: YTN; PAM sequence: TTG
gtgacagagaagataagttt

SEQ ID NO: 262471 - DNA, 20 bp, Artificial Sequence
  Description of Artificial Sequence: Synthetic oligonucleotide
  Target: ATXN1; (+) strand; PAM type: YTN; PAM sequence: TTT
gcatttttaaaaaagtgatt

SEQ ID NO: 262472 - DNA, 20 bp, Artificial Sequence
  Description of Artificial Sequence: Synthetic oligonucleotide
  Target: ATXN1; (+) strand; PAM type: YTN; PAM sequence: TTG
catttttaaaaaagtgattt

SEQ ID NO: 262473 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaagtgatttgaact

SEQ ID NO: 262474 - DNA, 20 bp, Artificial Sequence
  Description of Artificial Sequence: Synthetic oligonucleotide
  Target: ATXN1; (+) strand; PAM type: YTN; PAM sequence: TTT
taaaaaagtgatttgaactc

SEQ ID NO: 262475 - DNA, 20 bp, Artificial Sequence
  Description of Artificial Sequence: Synthetic oligonucleotide
  Target: ATXN1; (+) strand; PAM type: YTN; PAM sequence: TTT
aaaaaagtgatttgaactca

SEQ ID NO: 262476 - DNA, 20 bp, Artificial Sequence
  Description of Artificial Sequence: Synthetic oligonucleotide
  Target: ATXN1; (+) strand; PAM type: YTN; PAM sequence: TTA
aaaaagtgatttgaactcag

SEQ ID NO: 262477 - DNA, 20 bp, Artificial Sequence
  Description of Artificial Sequence: Synthetic oligonucleotide
  Target: ATXN1; (+) strand; PAM type: YTN; PAM sequence: TTT
gaactcagctatagcattag

SEQ ID NO: 262478 - DNA, 20 bp, Artificial Sequence
  Description of Artificial Sequence: Synthetic oligonucleotide
  Target: ATXN1; (+) strand; PAM type: YTN; PAM sequence: TTG
aactcagctatagcattagc

SEQ ID NO: 262479 - DNA, 20 bp, Artificial Sequence
  Description of Artificial Sequence: Synthetic oligonucleotide
  Target: ATXN1; (+) strand; PAM type: YTN; PAM sequence: CTC
agctatagcattagcatata

SEQ ID NO: 262480 - DNA, 20 bp, Artificial Sequence
  Description of Artificial Sequence: Synthetic oligonucleotide
  Target: ATXN1; (+) strand; PAM type: YTN; PAM sequence: CTA
tagcattagcatatattccc

SEQ ID NO: 262481 - DNA, 20 bp, Artificial Sequence
  Description of Artificial Sequence: Synthetic oligonucleotide
  Target: ATXN1; (+) strand; PAM type: YTN; PAM sequence: TTA
gcatatattcccagattata

SEQ ID NO: 262482 - DNA, 20 bp, Artificial Sequence
  Description of Artificial Sequence: Synthetic oligonucleotide
  Target: ATXN1; (+) strand; PAM type: YTN; PAM sequence: TTC
ccagattatacaactattcc

SEQ ID NO: 262483 - DNA, 20 bp, Artificial Sequence
  Description of Artificial Sequence: Synthetic oligonucleotide
  Target: ATXN1; (+) strand; PAM type: YTN; PAM sequence: TTA
tacaactattcctagactca

SEQ ID NO: 262484 - DNA, 20 bp, Artificial Sequence
  Description of Artificial Sequence: Synthetic oligonucleotide
  Target: ATXN1; (+) strand; PAM type: YTN; PAM sequence: CTA
ttcctagactcacaagcact

SEQ ID NO: 262485 - DNA, 20 bp, Artificial Sequence
  Description of Artificial Sequence: Synthetic oligonucleotide
  Target: ATXN1; (+) strand; PAM type: YTN; PAM sequence: TTC
ctagactcacaagcactatt

SEQ ID NO: 262486 - DNA, 20 bp, Artificial Sequence
  Description of Artificial Sequence: Synthetic oligonucleotide
  Target: ATXN1; (+) strand; PAM type: YTN; PAM sequence: CTA
gactcacaagcactattttc

SEQ ID NO: 262487 - DNA, 20 bp, Artificial Sequence
  Description of Artificial Sequence: Synthetic oligonucleotide
  Target: ATXN1; (+) strand; PAM type: YTN; PAM sequence: CTC
acaagcactattttccaaaa

SEQ ID NO: 262488 - DNA, 20 bp, Artificial Sequence
  Description of Artificial Sequence: Synthetic oligonucleotide
  Target: ATXN1; (+) strand; PAM type: YTN; PAM sequence: CTA
ttttccaaaaagaatgtgtc

SEQ ID NO: 262489 - DNA, 20 bp, Artificial Sequence
  Description of Artificial Sequence: Synthetic oligonucleotide
  Target: ATXN1; (+) strand; PAM type: YTN; PAM sequence: TTT
tccaaaaagaatgtgtccct

SEQ ID NO: 262490 - DNA, 20 bp, Artificial Sequence
  Description of Artificial Sequence: Synthetic oligonucleotide
  Target: ATXN1; (+) strand; PAM type: YTN; PAM sequence: TTT
ccaaaaagaatgtgtccctt

SEQ ID NO: 262491 - DNA, 20 bp, Artificial Sequence
  Description of Artificial Sequence: Synthetic oligonucleotide
  Target: ATXN1; (+) strand; PAM type: YTN; PAM sequence: TTC
caaaaagaatgtgtccctta

SEQ ID NO: 262492 - DNA, 20 bp, Artificial Sequence
  Description of Artificial Sequence: Synthetic oligonucleotide
  Target: ATXN1; (+) strand; PAM type: YTN; PAM sequence: CTT
atccttaacacacagaacat

SEQ ID NO: 262493 - DNA, 20 bp, Artificial Sequence
  Description of Artificial Sequence: Synthetic oligonucleotide
  Target: ATXN1; (+) strand; PAM type: YTN; PAM sequence: TTA
tccttaacacacagaacata

SEQ ID NO: 262494 - DNA, 20 bp, Artificial Sequence
  Description of Artificial Sequence: Synthetic oligonucleotide
  Target: ATXN1; (+) strand; PAM type: YTN; PAM sequence: CTT
aacacacagaacataattct

SEQ ID NO: 262495 - DNA, 20 bp, Artificial Sequence
  Description of Artificial Sequence: Synthetic oligonucleotide
  Target: ATXN1; (+) strand; PAM type: YTN; PAM sequence: TTA
acacacagaacataattctt

SEQ ID NO: 262496 - DNA, 20 bp, Artificial Sequence
  Description of Artificial Sequence: Synthetic oligonucleotide
  Target: ATXN1; (+) strand; PAM type: YTN; PAM sequence: TTC
tttctaatgatagtgcttat

SEQ ID NO: 262497 - DNA, 20 bp, Artificial Sequence
  Description of Artificial Sequence: Synthetic oligonucleotide
  Target: ATXN1; (+) strand; PAM type: YTN; PAM sequence: CTT
tctaatgatagtgcttatca

SEQ ID NO: 262498 - DNA, 20 bp, Artificial Sequence
  Description of Artificial Sequence: Synthetic oligonucleotide
  Target: ATXN1; (+) strand; PAM type: YTN; PAM sequence: TTT
ctaatgatagtgcttatcac

SEQ ID NO: 262499 - DNA, 20 bp, Artificial Sequence
  Description of Artificial Sequence: Synthetic oligonucleotide
  Target: ATXN1; (+) strand; PAM type: YTN; PAM sequence: TTC
taatgatagtgcttatcact

SEQ ID NO: 262500 - DNA, 20 bp, Artificial Sequence
  Description of Artificial Sequence: Synthetic oligonucleotide
  Target: ATXN1; (+) strand; PAM type: YTN; PAM sequence: CTA
atgatagtgcttatcactag

SEQ ID NO: 262501 - DNA, 20 bp, Artificial Sequence
  Description of Artificial Sequence: Synthetic oligonucleotide
  Target: ATXN1; (+) strand; PAM type: YTN; PAM sequence: CTT
atcactagaagccagaggct

SEQ ID NO: 262502 - DNA, 20 bp, Artificial Sequence
  Description of Artificial Sequence: Synthetic oligonucleotide
  Target: ATXN1; (+) strand; PAM type: YTN; PAM sequence: TTA
tcactagaagccagaggctt

SEQ ID NO: 262503 - DNA, 20 bp, Artificial Sequence
  Description of Artificial Sequence: Synthetic oligonucleotide
  Target: ATXN1; (+) strand; PAM type: YTN; PAM sequence: CTA
gaagccagaggcttgttgaa

SEQ ID NO: 262504 - DNA, 20 bp, Artificial Sequence
  Description of Artificial Sequence: Synthetic oligonucleotide
  Target: ATXN1; (+) strand; PAM type: YTN; PAM sequence: CTT
gttgaatgactcagtttccc

SEQ ID NO: 262505 - DNA, 20 bp, Artificial Sequence
  Description of Artificial Sequence: Synthetic oligonucleotide
  Target: ATXN1; (+) strand; PAM type: YTN; PAM sequence: TTG
ttgaatgactcagtttccct

SEQ ID NO: 262506 - DNA, 20 bp, Artificial Sequence
  Description of Artificial Sequence: Synthetic oligonucleotide
  Target: ATXN1; (+) strand; PAM type: YTN; PAM sequence: TTG
aatgactcagtttccctgga

SEQ ID NO: 262507 - DNA, 20 bp, Artificial Sequence
  Description of Artificial Sequence: Synthetic oligonucleotide
  Target: ATXN1; (+) strand; PAM type: YTN; PAM sequence: CTC
agtttccctggaaagtaaat

SEQ ID NO: 262508 - DNA, 20 bp, Artificial Sequence
  Description of Artificial Sequence: Synthetic oligonucleotide
  Target: ATXN1; (+) strand; PAM type: YTN; PAM sequence: TTT
ccctggaaagtaaatatagt

SEQ ID NO: 262509 - DNA, 20 bp, Artificial Sequence
  Description of Artificial Sequence: Synthetic oligonucleotide
  Target: ATXN1; (+) strand; PAM type: YTN; PAM sequence: TTC
cctggaaagtaaatatagtg

SEQ ID NO: 262510 - DNA, 20 bp, Artificial Sequence
  Description of Artificial Sequence: Synthetic oligonucleotide
  Target: ATXN1; (+) strand; PAM type: YTN; PAM sequence: CTG
gaaagtaaatatagtgtacc

SEQ ID NO: 262511 - DNA, 20 bp, Artificial Sequence
  Description of Artificial Sequence: Synthetic oligonucleotide
  Target: ATXN1; (+) strand; PAM type: YTN; PAM sequence: TTT
tttaattgtattttttaaaa

SEQ ID NO: 262512 - DNA, 20 bp, Artificial Sequence
  Description of Artificial Sequence: Synthetic oligonucleotide
  Target: ATXN1; (+) strand; PAM type: YTN; PAM sequence: TTT
ttaattgtattttttaaaaa

SEQ ID NO: 262513 - DNA, 20 bp, Artificial Sequence
  Description of Artificial Sequence: Synthetic oligonucleotide
  Target: ATXN1; (+) strand; PAM type: YTN; PAM sequence: TTT
taattgtattttttaaaaat

SEQ ID NO: 262514 - DNA, 20 bp, Artificial Sequence
  Description of Artificial Sequence: Synthetic oligonucleotide
  Target: ATXN1; (+) strand; PAM type: YTN; PAM sequence: TTT
aattgtattttttaaaaatt

SEQ ID NO: 262515 - DNA, 20 bp, Artificial Sequence
  Description of Artificial Sequence: Synthetic oligonucleotide
  Target: ATXN1; (+) strand; PAM type: YTN; PAM sequence: TTA
attgtattttttaaaaattt

SEQ ID NO: 262516 - DNA, 20 bp, Artificial Sequence
  Description of Artificial Sequence: Synthetic oligonucleotide
  Target: ATXN1; (+) strand; PAM type: YTN; PAM sequence: TTG
tattttttaaaaatttttaa

SEQ ID NO: 262517 - DNA, 20 bp, Artificial Sequence
  Description of Artificial Sequence: Synthetic oligonucleotide
  Target: ATXN1; (+) strand; PAM type: YTN; PAM sequence: TTT
tttaaaaatttttaattaat

SEQ ID NO: 262518 - DNA, 20 bp, Artificial Sequence
  Description of Artificial Sequence: Synthetic oligonucleotide
  Target: ATXN1; (+) strand; PAM type: YTN; PAM sequence: TTT
ttaaaaatttttaattaatt

SEQ ID NO: 262519 - DNA, 20 bp, Artificial Sequence
  Description of Artificial Sequence: Synthetic oligonucleotide
  Target: ATXN1; (+) strand; PAM type: YTN; PAM sequence: TTT
taaaaatttttaattaatta

SEQ ID NO: 262520 - DNA, 20 bp, Artificial Sequence
  Description of Artificial Sequence: Synthetic oligonucleotide
  Target: ATXN1; (+) strand; PAM type: YTN; PAM sequence: TTT
aaaaatttttaattaattaa

SEQ ID NO: 262521 - DNA, 20 bp, Artificial Sequence
  Description of Artificial Sequence: Synthetic oligonucleotide
  Target: ATXN1; (+) strand; PAM type: YTN; PAM sequence: TTA
aaaatttttaattaattaat

SEQ ID NO: 262522 - DNA, 20 bp, Artificial Sequence
  Description of Artificial Sequence: Synthetic oligonucleotide
  Target: ATXN1; (+) strand; PAM type: YTN; PAM sequence: TTT
ttaattaattaatttttttg

SEQ ID NO: 262523 - DNA, 20 bp, Artificial Sequence
  Description of Artificial Sequence: Synthetic oligonucleotide
  Target: ATXN1; (+) strand; PAM type: YTN; PAM sequence: TTT
taattaattaatttttttga

SEQ ID NO: 262524 - DNA, 20 bp, Artificial Sequence
  Description of Artificial Sequence: Synthetic oligonucleotide
  Target: ATXN1; (+) strand; PAM type: YTN; PAM sequence: TTT
aattaattaatttttttgag

SEQ ID NO: 262525 - DNA, 20 bp, Artificial Sequence
  Description of Artificial Sequence: Synthetic oligonucleotide
  Target: ATXN1; (+) strand; PAM type: YTN; PAM sequence: TTA
attaattaatttttttgaga

SEQ ID NO: 262526 - DNA, 20 bp, Artificial Sequence
  Description of Artificial Sequence: Synthetic oligonucleotide
  Target: ATXN1; (+) strand; PAM type: YTN; PAM sequence: TTA
attaatttttttgagacagg

SEQ ID NO: 262527 - DNA, 20 bp, Artificial Sequence
  Description of Artificial Sequence: Synthetic oligonucleotide
  Target: ATXN1; (+) strand; PAM type: YTN; PAM sequence: TTA
atttttttgagacagggtct

SEQ ID NO: 262528 - DNA, 20 bp, Artificial Sequence
  Description of Artificial Sequence: Synthetic oligonucleotide
  Target: ATXN1; (+) strand; PAM type: YTN; PAM sequence: TTT
ttttgagacagggtctcgtt

SEQ ID NO: 262529 - DNA, 20 bp, Artificial Sequence
  Description of Artificial Sequence: Synthetic oligonucleotide
  Target: ATXN1; (+) strand; PAM type: YTN; PAM sequence: TTT
tttgagacagggtctcgttc

SEQ ID NO: 262530 - DNA, 20 bp, Artificial Sequence
  Description of Artificial Sequence: Synthetic oligonucleotide
  Target: ATXN1; (+) strand; PAM type: YTN; PAM sequence: TTT
ttgagacagggtctcgttct

SEQ ID NO: 262531 - DNA, 20 bp, Artificial Sequence
  Description of Artificial Sequence: Synthetic oligonucleotide
  Target: ATXN1; (+) strand; PAM type: YTN; PAM sequence: TTT
tgagacagggtctcgttctg

SEQ ID NO: 262532 - DNA, 20 bp, Artificial Sequence
  Description of Artificial Sequence: Synthetic oligonucleotide
  Target: ATXN1; (+) strand; PAM type: YTN; PAM sequence: TTT
gagacagggtctcgttctgt

SEQ ID NO: 262533 - DNA, 20 bp, Artificial Sequence
  Description of Artificial Sequence: Synthetic oligonucleotide
  Target: ATXN1; (+) strand; PAM type: YTN; PAM sequence: TTG
agacagggtctcgttctgtc

SEQ ID NO: 262534 - DNA, 20 bp, Artificial Sequence
  Description of Artificial Sequence: Synthetic oligonucleotide
  Target: ATXN1; (+) strand; PAM type: YTN; PAM sequence: CTC
gttctgtcacccacgttaga

SEQ ID NO: 262535 - DNA, 20 bp, Artificial Sequence
  Description of Artificial Sequence: Synthetic oligonucleotide
  Target: ATXN1; (+) strand; PAM type: YTN; PAM sequence: TTC
tgtcacccacgttagagtgc

SEQ ID NO: 262536 - DNA, 20 bp, Artificial Sequence
  Description of Artificial Sequence: Synthetic oligonucleotide
  Target: ATXN1; (+) strand; PAM type: YTN; PAM sequence: CTG
tcacccacgttagagtgcag

SEQ ID NO: 262537 - DNA, 20 bp, Artificial Sequence
  Description of Artificial Sequence: Synthetic oligonucleotide
  Target: ATXN1; (+) strand; PAM type: YTN; PAM sequence: TTA
gagtgcagtggcatgatctc

SEQ ID NO: 262538 - DNA, 20 bp, Artificial Sequence
  Description of Artificial Sequence: Synthetic oligonucleotide
  Target: ATXN1; (+) strand; PAM type: YTN; PAM sequence: CTC
agcatactgcaaccttggcc

SEQ ID NO: 262539 - DNA, 20 bp, Artificial Sequence
  Description of Artificial Sequence: Synthetic oligonucleotide
  Target: ATXN1; (+) strand; PAM type: YTN; PAM sequence: CTG
caaccttggcctcttgggtt

SEQ ID NO: 262540 - DNA, 20 bp, Artificial Sequence
  Description of Artificial Sequence: Synthetic oligonucleotide
  Target: ATXN1; (+) strand; PAM type: YTN; PAM sequence: CTT
ggcctcttgggttcaaacta

SEQ ID NO: 262541 - DNA, 20 bp, Artificial Sequence
  Description of Artificial Sequence: Synthetic oligonucleotide
  Target: ATXN1; (+) strand; PAM type: YTN; PAM sequence: TTG
gcctcttgggttcaaactat

SEQ ID NO: 262542 - DNA, 20 bp, Artificial Sequence
  Description of Artificial Sequence: Synthetic oligonucleotide
  Target: ATXN1; (+) strand; PAM type: YTN; PAM sequence: CTC
ttgggttcaaactattctcc

SEQ ID NO: 262543 - DNA, 20 bp, Artificial Sequence
  Description of Artificial Sequence: Synthetic oligonucleotide
  Target: ATXN1; (+) strand; PAM type: YTN; PAM sequence: CTT
gggttcaaactattctcctg

SEQ ID NO: 262544 - DNA, 20 bp, Artificial Sequence
  Description of Artificial Sequence: Synthetic oligonucleotide
  Target: ATXN1; (+) strand; PAM type: YTN; PAM sequence: TTG
ggttcaaactattctcctgc

SEQ ID NO: 262545 - DNA, 20 bp, Artificial Sequence
  Description of Artificial Sequence: Synthetic oligonucleotide
  Target: ATXN1; (+) strand; PAM type: YTN; PAM sequence: TTC
aaactattctcctgcctcag

SEQ ID NO: 262546 - DNA, 20 bp, Artificial Sequence
  Description of Artificial Sequence: Synthetic oligonucleotide
  Target: ATXN1; (+) strand; PAM type: YTN; PAM sequence: CTA
ttctcctgcctcagcctcct

SEQ ID NO: 262547 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcctgag

SEQ ID NO: 262548 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcctgagta

SEQ ID NO: 262549 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcctgagtagct

SEQ ID NO: 262550 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagtagctggta

SEQ ID NO: 262551 - DNA, 20 bp, Artificial Sequence
  Description of Artificial Sequence: Synthetic oligonucleotide
  Target: ATXN1; (+) strand; PAM type: YTN; PAM sequence: CTC
ctgagtagctggtattacag

SEQ ID NO: 262552 - DNA, 20 bp, Artificial Sequence
  Description of Artificial Sequence: Synthetic oligonucleotide
  Target: ATXN1; (+) strand; PAM type: YTN; PAM sequence: CTG
agtagctggtattacaggtg

SEQ ID NO: 262553 - DNA, 20 bp, Artificial Sequence
  Description of Artificial Sequence: Synthetic oligonucleotide
  Target: ATXN1; (+) strand; PAM type: YTN; PAM sequence: CTG
gtattacaggtgcccaccac

SEQ ID NO: 262554 - DNA, 20 bp, Artificial Sequence
  Description of Artificial Sequence: Synthetic oligonucleotide
  Target: ATXN1; (+) strand; PAM type: YTN; PAM sequence: TTA
caggtgcccaccacccaccc

SEQ ID NO: 262555 - DNA, 20 bp, Artificial Sequence
  Description of Artificial Sequence: Synthetic oligonucleotide
  Target: ATXN1; (+) strand; PAM type: YTN; PAM sequence: CTA
atttttgtatttttagtagg

SEQ ID NO: 262556 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagggatg

SEQ ID NO: 262557 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagggatgg

SEQ ID NO: 262558 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagggatggg

SEQ ID NO: 262559 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagggatgggg

SEQ ID NO: 262560 - DNA, 20 bp, Artificial Sequence
  Description of Artificial Sequence: Synthetic oligonucleotide
  Target: ATXN1; (+) strand; PAM type: YTN; PAM sequence: TTT
ttagtagggatggggtttca

SEQ ID NO: 262561 - DNA, 20 bp, Artificial Sequence
  Description of Artificial Sequence: Synthetic oligonucleotide
  Target: ATXN1; (+) strand; PAM type: YTN; PAM sequence: TTT
tagtagggatggggtttcac

SEQ ID NO: 262562 - DNA, 20 bp, Artificial Sequence
  Description of Artificial Sequence: Synthetic oligonucleotide
  Target: ATXN1; (+) strand; PAM type: YTN; PAM sequence: TTT
agtagggatggggtttcacc

SEQ ID NO: 262563 - DNA, 20 bp, Artificial Sequence
  Description of Artificial Sequence: Synthetic oligonucleotide
  Target: ATXN1; (+) strand; PAM type: YTN; PAM sequence: TTA
gtagggatggggtttcacca

SEQ ID NO: 262564 - DNA, 20 bp, Artificial Sequence
  Description of Artificial Sequence: Synthetic oligonucleotide
  Target: ATXN1; (+) strand; PAM type: YTN; PAM sequence: TTT
caccatgttggccaggtttg

SEQ ID NO: 262565 - DNA, 20 bp, Artificial Sequence
  Description of Artificial Sequence: Synthetic oligonucleotide
  Target: ATXN1; (+) strand; PAM type: YTN; PAM sequence: TTC
accatgttggccaggtttgt

SEQ ID NO: 262566 - DNA, 20 bp, Artificial Sequence
  Description of Artificial Sequence: Synthetic oligonucleotide
  Target: ATXN1; (+) strand; PAM type: YTN; PAM sequence: TTG
gccaggtttgtctcaaactc

SEQ ID NO: 262567 - DNA, 20 bp, Artificial Sequence
  Description of Artificial Sequence: Synthetic oligonucleotide
  Target: ATXN1; (+) strand; PAM type: YTN; PAM sequence: TTT
gtctcaaactcctggcctca

SEQ ID NO: 262568 - DNA, 20 bp, Artificial Sequence
  Description of Artificial Sequence: Synthetic oligonucleotide
  Target: ATXN1; (+) strand; PAM type: YTN; PAM sequence: TTG
tctcaaactcctggcctcaa

SEQ ID NO: 262569 - DNA, 20 bp, Artificial Sequence
  Description of Artificial Sequence: Synthetic oligonucleotide
  Target: ATXN1; (+) strand; PAM type: YTN; PAM sequence: CTC
aaactcctggcctcaagtga

SEQ ID NO: 262570 - DNA, 20 bp, Artificial Sequence
  Description of Artificial Sequence: Synthetic oligonucleotide
  Target: ATXN1; (+) strand; PAM type: YTN; PAM sequence: CTC
ctggcctcaagtgatccacc

SEQ ID NO: 262571 - DNA, 20 bp, Artificial Sequence
  Description of Artificial Sequence: Synthetic oligonucleotide
  Target: ATXN1; (+) strand; PAM type: YTN; PAM sequence: CTG
gcctcaagtgatccacctgc

SEQ ID NO: 262572 - DNA, 20 bp, Artificial Sequence
  Description of Artificial Sequence: Synthetic oligonucleotide
  Target: ATXN1; (+) strand; PAM type: YTN; PAM sequence: CTC
aagtgatccacctgcctcag

SEQ ID NO: 262573 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaaagtgct

SEQ ID NO: 262574 - DNA, 20 bp, Artificial Sequence
  Description of Artificial Sequence: Synthetic oligonucleotide
  Target: ATXN1; (+) strand; PAM type: YTN; PAM sequence: CTC
agcctcccaaagtgctagga

SEQ ID NO: 262575 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctaggattagaa

SEQ ID NO: 262576 - DNA, 20 bp, Artificial Sequence
  Description of Artificial Sequence: Synthetic oligonucleotide
  Target: ATXN1; (+) strand; PAM type: YTN; PAM sequence: CTA
ggattagaagtgttagccac

SEQ ID NO: 262577 - DNA, 20 bp, Artificial Sequence
  Description of Artificial Sequence: Synthetic oligonucleotide
  Target: ATXN1; (+) strand; PAM type: YTN; PAM sequence: TTA
gaagtgttagccaccacacc

SEQ ID NO: 262578 - DNA, 20 bp, Artificial Sequence
  Description of Artificial Sequence: Synthetic oligonucleotide
  Target: ATXN1; (+) strand; PAM type: YTN; PAM sequence: TTA
gccaccacaccctgcctatt

SEQ ID NO: 262579 - DNA, 20 bp, Artificial Sequence
  Description of Artificial Sequence: Synthetic oligonucleotide
  Target: ATXN1; (+) strand; PAM type: YTN; PAM sequence: CTG
cctatttttattttttatca

SEQ ID NO: 262580 - DNA, 20 bp, Artificial Sequence
  Description of Artificial Sequence: Synthetic oligonucleotide
  Target: ATXN1; (+) strand; PAM type: YTN; PAM sequence: CTA
tttttattttttatcaaggc

SEQ ID NO: 262581 - DNA, 20 bp, Artificial Sequence
  Description of Artificial Sequence: Synthetic oligonucleotide
  Target: ATXN1; (+) strand; PAM type: YTN; PAM sequence: TTT
ttattttttatcaaggcaga

SEQ ID NO: 262582 - DNA, 20 bp, Artificial Sequence
  Description of Artificial Sequence: Synthetic oligonucleotide
  Target: ATXN1; (+) strand; PAM type: YTN; PAM sequence: TTT
tattttttatcaaggcagaa

SEQ ID NO: 262583 - DNA, 20 bp, Artificial Sequence
  Description of Artificial Sequence: Synthetic oligonucleotide
  Target: ATXN1; (+) strand; PAM type: YTN; PAM sequence: TTT
attttttatcaaggcagaat

SEQ ID NO: 262584 - DNA, 20 bp, Artificial Sequence
  Description of Artificial Sequence: Synthetic oligonucleotide
  Target: ATXN1; (+) strand; PAM type: YTN; PAM sequence: TTA
ttttttatcaaggcagaatc

SEQ ID NO: 262585 - DNA, 20 bp, Artificial Sequence
  Description of Artificial Sequence: Synthetic oligonucleotide
  Target: ATXN1; (+) strand; PAM type: YTN; PAM sequence: TTT
tttatcaaggcagaatcgca

SEQ ID NO: 262586 - DNA, 20 bp, Artificial Sequence
  Description of Artificial Sequence: Synthetic oligonucleotide
  Target: ATXN1; (+) strand; PAM type: YTN; PAM sequence: TTT
ttatcaaggcagaatcgcac

SEQ ID NO: 262587 - DNA, 20 bp, Artificial Sequence
  Description of Artificial Sequence: Synthetic oligonucleotide
  Target: ATXN1; (+) strand; PAM type: YTN; PAM sequence: TTT
tatcaaggcagaatcgcact

SEQ ID NO: 262588 - DNA, 20 bp, Artificial Sequence
  Description of Artificial Sequence: Synthetic oligonucleotide
  Target: ATXN1; (+) strand; PAM type: YTN; PAM sequence: TTT
atcaaggcagaatcgcacta

SEQ ID NO: 262589 - DNA, 20 bp, Artificial Sequence
  Description of Artificial Sequence: Synthetic oligonucleotide
  Target: ATXN1; (+) strand; PAM type: YTN; PAM sequence: TTA
tcaaggcagaatcgcactat

SEQ ID NO: 262590 - DNA, 20 bp, Artificial Sequence
  Description of Artificial Sequence: Synthetic oligonucleotide
  Target: ATXN1; (+) strand; PAM type: YTN; PAM sequence: CTA
tgttgcccaggctggttttg

SEQ ID NO: 262591 - DNA, 20 bp, Artificial Sequence
  Description of Artificial Sequence: Synthetic oligonucleotide
  Target: ATXN1; (+) strand; PAM type: YTN; PAM sequence: TTG
cccaggctggttttgaactt

SEQ ID NO: 262592 - DNA, 20 bp, Artificial Sequence
  Description of Artificial Sequence: Synthetic oligonucleotide
  Target: ATXN1; (+) strand; PAM type: YTN; PAM sequence: CTG
gttttgaacttctggcgtca

SEQ ID NO: 262593 - DNA, 20 bp, Artificial Sequence
  Description of Artificial Sequence: Synthetic oligonucleotide
  Target: ATXN1; (+) strand; PAM type: YTN; PAM sequence: TTT
tgaacttctggcgtcaagtg

SEQ ID NO: 262594 - DNA, 20 bp, Artificial Sequence
  Description of Artificial Sequence: Synthetic oligonucleotide
  Target: ATXN1; (+) strand; PAM type: YTN; PAM sequence: TTT
gaacttctggcgtcaagtga

SEQ ID NO: 262595 - DNA, 20 bp, Artificial Sequence
  Description of Artificial Sequence: Synthetic oligonucleotide
  Target: ATXN1; (+) strand; PAM type: YTN; PAM sequence: TTG
aacttctggcgtcaagtgat

SEQ ID NO: 262596 - DNA, 20 bp, Artificial Sequence
  Description of Artificial Sequence: Synthetic oligonucleotide
  Target: ATXN1; (+) strand; PAM type: YTN; PAM sequence: CTT
ctggcgtcaagtgatcctcc

SEQ ID NO: 262597 - DNA, 20 bp, Artificial Sequence
  Description of Artificial Sequence: Synthetic oligonucleotide
  Target: ATXN1; (+) strand; PAM type: YTN; PAM sequence: TTC
tggcgtcaagtgatcctccc

SEQ ID NO: 262598 - DNA, 20 bp, Artificial Sequence
  Description of Artificial Sequence: Synthetic oligonucleotide
  Target: ATXN1; (+) strand; PAM type: YTN; PAM sequence: CTG
gcgtcaagtgatcctcccac

SEQ ID NO: 262599 - DNA, 20 bp, Artificial Sequence
  Description of Artificial Sequence: Synthetic oligonucleotide
  Target: ATXN1; (+) strand; PAM type: YTN; PAM sequence: CTC
ccacctcggcctcccaaagt

SEQ ID NO: 262600 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaagtgctggga

SEQ ID NO: 262601 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 262602 - DNA, 20 bp, Artificial Sequence
  Description of Artificial Sequence: Synthetic oligonucleotide
  Target: ATXN1; (+) strand; PAM type: YTN; PAM sequence: CTG
ggattacaggtgtgagctac

SEQ ID NO: 262603 - DNA, 20 bp, Artificial Sequence
  Description of Artificial Sequence: Synthetic oligonucleotide
  Target: ATXN1; (+) strand; PAM type: YTN; PAM sequence: TTA
caggtgtgagctactgcgcc

SEQ ID NO: 262604 - DNA, 20 bp, Artificial Sequence
  Description of Artificial Sequence: Synthetic oligonucleotide
  Target: ATXN1; (+) strand; PAM type: YTN; PAM sequence: CTA
ctgcgcctggcctaatagca

SEQ ID NO: 262605 - DNA, 20 bp, Artificial Sequence
  Description of Artificial Sequence: Synthetic oligonucleotide
  Target: ATXN1; (+) strand; PAM type: YTN; PAM sequence: CTG
cgcctggcctaatagcaaag

SEQ ID NO: 262606 - DNA, 20 bp, Artificial Sequence
  Description of Artificial Sequence: Synthetic oligonucleotide
  Target: ATXN1; (+) strand; PAM type: YTN; PAM sequence: CTG
gcctaatagcaaaggcgctg

SEQ ID NO: 262607 - DNA, 20 bp, Artificial Sequence
  Description of Artificial Sequence: Synthetic oligonucleotide
  Target: ATXN1; (+) strand; PAM type: YTN; PAM sequence: CTA
atagcaaaggcgctgataaa

SEQ ID NO: 262608 - DNA, 20 bp, Artificial Sequence
  Description of Artificial Sequence: Synthetic oligonucleotide
  Target: ATXN1; (+) strand; PAM type: YTN; PAM sequence: CTG
ataaaaaaaataggagagca

SEQ ID NO: 262609 - DNA, 20 bp, Artificial Sequence
  Description of Artificial Sequence: Synthetic oligonucleotide
  Target: ATXN1; (+) strand; PAM type: YTN; PAM sequence: CTT
agtaagcattactaaaatgc

SEQ ID NO: 262610 - DNA, 20 bp, Artificial Sequence
  Description of Artificial Sequence: Synthetic oligonucleotide
  Target: ATXN1; (+) strand; PAM type: YTN; PAM sequence: TTA
gtaagcattactaaaatgct

SEQ ID NO: 262611 - DNA, 20 bp, Artificial Sequence
  Description of Artificial Sequence: Synthetic oligonucleotide
  Target: ATXN1; (+) strand; PAM type: YTN; PAM sequence: TTA
ctaaaatgctagttacactc

SEQ ID NO: 262612 - DNA, 20 bp, Artificial Sequence
  Description of Artificial Sequence: Synthetic oligonucleotide
  Target: ATXN1; (+) strand; PAM type: YTN; PAM sequence: CTA
aaatgctagttacactctta

SEQ ID NO: 262613 - DNA, 20 bp, Artificial Sequence
  Description of Artificial Sequence: Synthetic oligonucleotide
  Target: ATXN1; (+) strand; PAM type: YTN; PAM sequence: CTA
gttacactcttagaagcttt

SEQ ID NO: 262614 - DNA, 20 bp, Artificial Sequence
  Description of Artificial Sequence: Synthetic oligonucleotide
  Target: ATXN1; (+) strand; PAM type: YTN; PAM sequence: TTA
cactcttagaagctttatat

SEQ ID NO: 262615 - DNA, 20 bp, Artificial Sequence
  Description of Artificial Sequence: Synthetic oligonucleotide
  Target: ATXN1; (+) strand; PAM type: YTN; PAM sequence: CTC
ttagaagctttatataggat

SEQ ID NO: 262616 - DNA, 20 bp, Artificial Sequence
  Description of Artificial Sequence: Synthetic oligonucleotide
  Target: ATXN1; (+) strand; PAM type: YTN; PAM sequence: CTT
agaagctttatataggattt

SEQ ID NO: 262617 - DNA, 20 bp, Artificial Sequence
  Description of Artificial Sequence: Synthetic oligonucleotide
  Target: ATXN1; (+) strand; PAM type: YTN; PAM sequence: TTA
gaagctttatataggatttc

SEQ ID NO: 262618 - DNA, 20 bp, Artificial Sequence
  Description of Artificial Sequence: Synthetic oligonucleotide
  Target: ATXN1; (+) strand; PAM type: YTN; PAM sequence: CTT
tatataggatttctaattta

SEQ ID NO: 262619 - DNA, 20 bp, Artificial Sequence
  Description of Artificial Sequence: Synthetic oligonucleotide
  Target: ATXN1; (+) strand; PAM type: YTN; PAM sequence: TTT
atataggatttctaatttaa

SEQ ID NO: 262620 - DNA, 20 bp, Artificial Sequence
  Description of Artificial Sequence: Synthetic oligonucleotide
  Target: ATXN1; (+) strand; PAM type: YTN; PAM sequence: TTA
tataggatttctaatttaat

SEQ ID NO: 262621 - DNA, 20 bp, Artificial Sequence
  Description of Artificial Sequence: Synthetic oligonucleotide
  Target: ATXN1; (+) strand; PAM type: YTN; PAM sequence: TTT
ctaatttaatctttattgaa

SEQ ID NO: 262622 - DNA, 20 bp, Artificial Sequence
  Description of Artificial Sequence: Synthetic oligonucleotide
  Target: ATXN1; (+) strand; PAM type: YTN; PAM sequence: TTC
taatttaatctttattgaag

SEQ ID NO: 262623 - DNA, 20 bp, Artificial Sequence
  Description of Artificial Sequence: Synthetic oligonucleotide
  Target: ATXN1; (+) strand; PAM type: YTN; PAM sequence: CTA
atttaatctttattgaagct

SEQ ID NO: 262624 - DNA, 20 bp, Artificial Sequence
  Description of Artificial Sequence: Synthetic oligonucleotide
  Target: ATXN1; (+) strand; PAM type: YTN; PAM sequence: TTT
aatctttattgaagcttgta

SEQ ID NO: 262625 - DNA, 20 bp, Artificial Sequence
  Description of Artificial Sequence: Synthetic oligonucleotide
  Target: ATXN1; (+) strand; PAM type: YTN; PAM sequence: TTA
atctttattgaagcttgtag

SEQ ID NO: 262626 - DNA, 20 bp, Artificial Sequence
  Description of Artificial Sequence: Synthetic oligonucleotide
  Target: ATXN1; (+) strand; PAM type: YTN; PAM sequence: CTT
tattgaagcttgtagctttt

SEQ ID NO: 262627 - DNA, 20 bp, Artificial Sequence
  Description of Artificial Sequence: Synthetic oligonucleotide
  Target: ATXN1; (+) strand; PAM type: YTN; PAM sequence: TTT
attgaagcttgtagctttta

SEQ ID NO: 262628 - DNA, 20 bp, Artificial Sequence
  Description of Artificial Sequence: Synthetic oligonucleotide
  Target: ATXN1; (+) strand; PAM type: YTN; PAM sequence: TTA
ttgaagcttgtagcttttaa

SEQ ID NO: 262629 - DNA, 20 bp, Artificial Sequence
  Description of Artificial Sequence: Synthetic oligonucleotide
  Target: ATXN1; (+) strand; PAM type: YTN; PAM sequence: TTG
aagcttgtagcttttaaact

SEQ ID NO: 262630 - DNA, 20 bp, Artificial Sequence
  Description of Artificial Sequence: Synthetic oligonucleotide
  Target: ATXN1; (+) strand; PAM type: YTN; PAM sequence: CTT
gtagcttttaaacttattta

SEQ ID NO: 262631 - DNA, 20 bp, Artificial Sequence
  Description of Artificial Sequence: Synthetic oligonucleotide
  Target: ATXN1; (+) strand; PAM type: YTN; PAM sequence: TTG
tagcttttaaacttatttaa

SEQ ID NO: 262632 - DNA, 20 bp, Artificial Sequence
  Description of Artificial Sequence: Synthetic oligonucleotide
  Target: ATXN1; (+) strand; PAM type: YTN; PAM sequence: CTT
ttaaacttatttaaaagccc

SEQ ID NO: 262633 - DNA, 20 bp, Artificial Sequence
  Description of Artificial Sequence: Synthetic oligonucleotide
  Target: ATXN1; (+) strand; PAM type: YTN; PAM sequence: TTT
taaacttatttaaaagcccc

SEQ ID NO: 262634 - DNA, 20 bp, Artificial Sequence
  Description of Artificial Sequence: Synthetic oligonucleotide
  Target: ATXN1; (+) strand; PAM type: YTN; PAM sequence: TTT
aaacttatttaaaagcccca

SEQ ID NO: 262635 - DNA, 20 bp, Artificial Sequence
  Description of Artificial Sequence: Synthetic oligonucleotide
  Target: ATXN1; (+) strand; PAM type: YTN; PAM sequence: TTA
aacttatttaaaagccccaa

SEQ ID NO: 262636 - DNA, 20 bp, Artificial Sequence
  Description of Artificial Sequence: Synthetic oligonucleotide
  Target: ATXN1; (+) strand; PAM type: YTN; PAM sequence: CTT
atttaaaagccccaaagatt

SEQ ID NO: 262637 - DNA, 20 bp, Artificial Sequence
  Description of Artificial Sequence: Synthetic oligonucleotide
  Target: ATXN1; (+) strand; PAM type: YTN; PAM sequence: TTA
tttaaaagccccaaagattc

SEQ ID NO: 262638 - DNA, 20 bp, Artificial Sequence
  Description of Artificial Sequence: Synthetic oligonucleotide
  Target: ATXN1; (+) strand; PAM type: YTN; PAM sequence: TTT
aaaagccccaaagattctac

SEQ ID NO: 262639 - DNA, 20 bp, Artificial Sequence
  Description of Artificial Sequence: Synthetic oligonucleotide
  Target: ATXN1; (+) strand; PAM type: YTN; PAM sequence: TTA
aaagccccaaagattctacc

SEQ ID NO: 262640 - DNA, 20 bp, Artificial Sequence
  Description of Artificial Sequence: Synthetic oligonucleotide
  Target: ATXN1; (+) strand; PAM type: YTN; PAM sequence: TTC
taccaacgggcttcagagca

SEQ ID NO: 262641 - DNA, 20 bp, Artificial Sequence
  Description of Artificial Sequence: Synthetic oligonucleotide
  Target: ATXN1; (+) strand; PAM type: YTN; PAM sequence: CTA
ccaacgggcttcagagcatc

SEQ ID NO: 262642 - DNA, 20 bp, Artificial Sequence
  Description of Artificial Sequence: Synthetic oligonucleotide
  Target: ATXN1; (+) strand; PAM type: YTN; PAM sequence: CTT
cagagcatctgcgttttatt

SEQ ID NO: 262643 - DNA, 20 bp, Artificial Sequence
  Description of Artificial Sequence: Synthetic oligonucleotide
  Target: ATXN1; (+) strand; PAM type: YTN; PAM sequence: TTC
agagcatctgcgttttattt

SEQ ID NO: 262644 - DNA, 20 bp, Artificial Sequence
  Description of Artificial Sequence: Synthetic oligonucleotide
  Target: ATXN1; (+) strand; PAM type: YTN; PAM sequence: CTG
cgttttatttttaaattgaa

SEQ ID NO: 262645 - DNA, 20 bp, Artificial Sequence
  Description of Artificial Sequence: Synthetic oligonucleotide
  Target: ATXN1; (+) strand; PAM type: YTN; PAM sequence: TTT
tatttttaaattgaatttct

SEQ ID NO: 262646 - DNA, 20 bp, Artificial Sequence
  Description of Artificial Sequence: Synthetic oligonucleotide
  Target: ATXN1; (+) strand; PAM type: YTN; PAM sequence: TTT
atttttaaattgaatttctc

SEQ ID NO: 262647 - DNA, 20 bp, Artificial Sequence
  Description of Artificial Sequence: Synthetic oligonucleotide
  Target: ATXN1; (+) strand; PAM type: YTN; PAM sequence: TTA
tttttaaattgaatttctca

SEQ ID NO: 262648 - DNA, 20 bp, Artificial Sequence
  Description of Artificial Sequence: Synthetic oligonucleotide
  Target: ATXN1; (+) strand; PAM type: YTN; PAM sequence: TTT
ttaaattgaatttctcatta

SEQ ID NO: 262649 - DNA, 20 bp, Artificial Sequence
  Description of Artificial Sequence: Synthetic oligonucleotide
  Target: ATXN1; (+) strand; PAM type: YTN; PAM sequence: TTT
taaattgaatttctcattat

SEQ ID NO: 262650 - DNA, 20 bp, Artificial Sequence
  Description of Artificial Sequence: Synthetic oligonucleotide
  Target: ATXN1; (+) strand; PAM type: YTN; PAM sequence: TTT
aaattgaatttctcattatt

SEQ ID NO: 262651 - DNA, 20 bp, Artificial Sequence
  Description of Artificial Sequence: Synthetic oligonucleotide
  Target: ATXN1; (+) strand; PAM type: YTN; PAM sequence: TTA
aattgaatttctcattatta

SEQ ID NO: 262652 - DNA, 20 bp, Artificial Sequence
  Description of Artificial Sequence: Synthetic oligonucleotide
  Target: ATXN1; (+) strand; PAM type: YTN; PAM sequence: TTG
aatttctcattattaagtaa

SEQ ID NO: 262653 - DNA, 20 bp, Artificial Sequence
  Description of Artificial Sequence: Synthetic oligonucleotide
  Target: ATXN1; (+) strand; PAM type: YTN; PAM sequence: TTT
ctcattattaagtaactgta

SEQ ID NO: 262654 - DNA, 20 bp, Artificial Sequence
  Description of Artificial Sequence: Synthetic oligonucleotide
  Target: ATXN1; (+) strand; PAM type: YTN; PAM sequence: TTC
tcattattaagtaactgtag

SEQ ID NO: 262655 - DNA, 20 bp, Artificial Sequence
  Description of Artificial Sequence: Synthetic oligonucleotide
  Target: ATXN1; (+) strand; PAM type: YTN; PAM sequence: CTC
attattaagtaactgtagtt

SEQ ID NO: 262656 - DNA, 20 bp, Artificial Sequence
  Description of Artificial Sequence: Synthetic oligonucleotide
  Target: ATXN1; (+) strand; PAM type: YTN; PAM sequence: TTA
ttaagtaactgtagtttcag

SEQ ID NO: 262657 - DNA, 20 bp, Artificial Sequence
  Description of Artificial Sequence: Synthetic oligonucleotide
  Target: ATXN1; (+) strand; PAM type: YTN; PAM sequence: TTA
agtaactgtagtttcagaaa

SEQ ID NO: 262658 - DNA, 20 bp, Artificial Sequence
  Description of Artificial Sequence: Synthetic oligonucleotide
  Target: ATXN1; (+) strand; PAM type: YTN; PAM sequence: CTG
tagtttcagaaaagctctcc

SEQ ID NO: 262659 - DNA, 20 bp, Artificial Sequence
  Description of Artificial Sequence: Synthetic oligonucleotide
  Target: ATXN1; (+) strand; PAM type: YTN; PAM sequence: TTT
cagaaaagctctccatgtgc

SEQ ID NO: 262660 - DNA, 20 bp, Artificial Sequence
  Description of Artificial Sequence: Synthetic oligonucleotide
  Target: ATXN1; (+) strand; PAM type: YTN; PAM sequence: TTC
agaaaagctctccatgtgcc

SEQ ID NO: 262661 - DNA, 20 bp, Artificial Sequence
  Description of Artificial Sequence: Synthetic oligonucleotide
  Target: ATXN1; (+) strand; PAM type: YTN; PAM sequence: CTC
tccatgtgccatatagtaga

SEQ ID NO: 262662 - DNA, 20 bp, Artificial Sequence
  Description of Artificial Sequence: Synthetic oligonucleotide
  Target: ATXN1; (+) strand; PAM type: YTN; PAM sequence: CTC
catgtgccatatagtagaat

SEQ ID NO: 262663 - DNA, 20 bp, Artificial Sequence
  Description of Artificial Sequence: Synthetic oligonucleotide
  Target: ATXN1; (+) strand; PAM type: YTN; PAM sequence: CTT
aattcaggggctagggtcta

SEQ ID NO: 262664 - DNA, 20 bp, Artificial Sequence
  Description of Artificial Sequence: Synthetic oligonucleotide
  Target: ATXN1; (+) strand; PAM type: YTN; PAM sequence: TTA
attcaggggctagggtctaa

SEQ ID NO: 262665 - DNA, 20 bp, Artificial Sequence
  Description of Artificial Sequence: Synthetic oligonucleotide
  Target: ATXN1; (+) strand; PAM type: YTN; PAM sequence: TTC
aggggctagggtctaaagtt

SEQ ID NO: 262666 - DNA, 20 bp, Artificial Sequence
  Description of Artificial Sequence: Synthetic oligonucleotide
  Target: ATXN1; (+) strand; PAM type: YTN; PAM sequence: CTA
gggtctaaagttcccaccca

SEQ ID NO: 262667 - DNA, 20 bp, Artificial Sequence
  Description of Artificial Sequence: Synthetic oligonucleotide
  Target: ATXN1; (+) strand; PAM type: YTN; PAM sequence: CTA
aagttcccacccaatgcaga

SEQ ID NO: 262668 - DNA, 20 bp, Artificial Sequence
  Description of Artificial Sequence: Synthetic oligonucleotide
  Target: ATXN1; (+) strand; PAM type: YTN; PAM sequence: TTC
ccacccaatgcagagtgtgt

SEQ ID NO: 262669 - DNA, 20 bp, Artificial Sequence
  Description of Artificial Sequence: Synthetic oligonucleotide
  Target: ATXN1; (+) strand; PAM type: YTN; PAM sequence: TTC
aaaagtatccttgaaattgt

SEQ ID NO: 262670 - DNA, 20 bp, Artificial Sequence
  Description of Artificial Sequence: Synthetic oligonucleotide
  Target: ATXN1; (+) strand; PAM type: YTN; PAM sequence: CTT
gaaattgtaaggtgcaaatc

SEQ ID NO: 262671 - DNA, 20 bp, Artificial Sequence
  Description of Artificial Sequence: Synthetic oligonucleotide
  Target: ATXN1; (+) strand; PAM type: YTN; PAM sequence: TTG
aaattgtaaggtgcaaatca

SEQ ID NO: 262672 - DNA, 20 bp, Artificial Sequence
  Description of Artificial Sequence: Synthetic oligonucleotide
  Target: ATXN1; (+) strand; PAM type: YTN; PAM sequence: TTG
taaggtgcaaatcagatcct

SEQ ID NO: 262673 - DNA, 20 bp, Artificial Sequence
  Description of Artificial Sequence: Synthetic oligonucleotide
  Target: ATXN1; (+) strand; PAM type: YTN; PAM sequence: CTA
ataccattccactcaaacct

SEQ ID NO: 262674 - DNA, 20 bp, Artificial Sequence
  Description of Artificial Sequence: Synthetic oligonucleotide
  Target: ATXN1; (+) strand; PAM type: YTN; PAM sequence: TTC
cactcaaacctttcaatgct

SEQ ID NO: 262675 - DNA, 20 bp, Artificial Sequence
  Description of Artificial Sequence: Synthetic oligonucleotide
  Target: ATXN1; (+) strand; PAM type: YTN; PAM sequence: CTC
aaacctttcaatgcttccta

SEQ ID NO: 262676 - DNA, 20 bp, Artificial Sequence
  Description of Artificial Sequence: Synthetic oligonucleotide
  Target: ATXN1; (+) strand; PAM type: YTN; PAM sequence: CTT
tcaatgcttcctattacatt

SEQ ID NO: 262677 - DNA, 20 bp, Artificial Sequence
  Description of Artificial Sequence: Synthetic oligonucleotide
  Target: ATXN1; (+) strand; PAM type: YTN; PAM sequence: TTT
caatgcttcctattacattt

SEQ ID NO: 262678 - DNA, 20 bp, Artificial Sequence
  Description of Artificial Sequence: Synthetic oligonucleotide
  Target: ATXN1; (+) strand; PAM type: YTN; PAM sequence: TTC
aatgcttcctattacattta

SEQ ID NO: 262679 - DNA, 20 bp, Artificial Sequence
  Description of Artificial Sequence: Synthetic oligonucleotide
  Target: ATXN1; (+) strand; PAM type: YTN; PAM sequence: CTT
cctattacatttatggtaaa

SEQ ID NO: 262680 - DNA, 20 bp, Artificial Sequence
  Description of Artificial Sequence: Synthetic oligonucleotide
  Target: ATXN1; (+) strand; PAM type: YTN; PAM sequence: TTC
ctattacatttatggtaaaa

SEQ ID NO: 262681 - DNA, 20 bp, Artificial Sequence
  Description of Artificial Sequence: Synthetic oligonucleotide
  Target: ATXN1; (+) strand; PAM type: YTN; PAM sequence: CTA
ttacatttatggtaaaaacc

SEQ ID NO: 262682 - DNA, 20 bp, Artificial Sequence
  Description of Artificial Sequence: Synthetic oligonucleotide
  Target: ATXN1; (+) strand; PAM type: YTN; PAM sequence: TTA
catttatggtaaaaaccaca

SEQ ID NO: 262683 - DNA, 20 bp, Artificial Sequence
  Description of Artificial Sequence: Synthetic oligonucleotide
  Target: ATXN1; (+) strand; PAM type: YTN; PAM sequence: TTT
atggtaaaaaccacagtcct

SEQ ID NO: 262684 - DNA, 20 bp, Artificial Sequence
  Description of Artificial Sequence: Synthetic oligonucleotide
  Target: ATXN1; (+) strand; PAM type: YTN; PAM sequence: TTA
tggtaaaaaccacagtcctg

SEQ ID NO: 262685 - DNA, 20 bp, Artificial Sequence
  Description of Artificial Sequence: Synthetic oligonucleotide
  Target: ATXN1; (+) strand; PAM type: YTN; PAM sequence: CTG
gtccatgtcaagacttagaa

SEQ ID NO: 262686 - DNA, 20 bp, Artificial Sequence
  Description of Artificial Sequence: Synthetic oligonucleotide
  Target: ATXN1; (+) strand; PAM type: YTN; PAM sequence: CTT
agaaggccctacatgatctg

SEQ ID NO: 262687 - DNA, 20 bp, Artificial Sequence
  Description of Artificial Sequence: Synthetic oligonucleotide
  Target: ATXN1; (+) strand; PAM type: YTN; PAM sequence: TTA
gaaggccctacatgatctga

SEQ ID NO: 262688 - DNA, 20 bp, Artificial Sequence
  Description of Artificial Sequence: Synthetic oligonucleotide
  Target: ATXN1; (+) strand; PAM type: YTN; PAM sequence: CTA
catgatctgaccccaactat

SEQ ID NO: 262689 - DNA, 20 bp, Artificial Sequence
  Description of Artificial Sequence: Synthetic oligonucleotide
  Target: ATXN1; (+) strand; PAM type: YTN; PAM sequence: CTG
accccaactatgtgaaaccc

SEQ ID NO: 262690 - DNA, 20 bp, Artificial Sequence
  Description of Artificial Sequence: Synthetic oligonucleotide
  Target: ATXN1; (+) strand; PAM type: YTN; PAM sequence: CTA
tgtgaaaccctcctcctctt

SEQ ID NO: 262691 - DNA, 20 bp, Artificial Sequence
  Description of Artificial Sequence: Synthetic oligonucleotide
  Target: ATXN1; (+) strand; PAM type: YTN; PAM sequence: CTC
ctcctcttttttcctgccca

SEQ ID NO: 262692 - DNA, 20 bp, Artificial Sequence
  Description of Artificial Sequence: Synthetic oligonucleotide
  Target: ATXN1; (+) strand; PAM type: YTN; PAM sequence: CTC
ctcttttttcctgcccatct

SEQ ID NO: 262693 - DNA, 20 bp, Artificial Sequence
  Description of Artificial Sequence: Synthetic oligonucleotide
  Target: ATXN1; (+) strand; PAM type: YTN; PAM sequence: CTC
ttttttcctgcccatctcct

SEQ ID NO: 262694 - DNA, 20 bp, Artificial Sequence
  Description of Artificial Sequence: Synthetic oligonucleotide
  Target: ATXN1; (+) strand; PAM type: YTN; PAM sequence: CTT
ttttcctgcccatctcctcc

SEQ ID NO: 262695 - DNA, 20 bp, Artificial Sequence
  Description of Artificial Sequence: Synthetic oligonucleotide
  Target: ATXN1; (+) strand; PAM type: YTN; PAM sequence: TTT
tttcctgcccatctcctccc

SEQ ID NO: 262696 - DNA, 20 bp, Artificial Sequence
  Description of Artificial Sequence: Synthetic oligonucleotide
  Target: ATXN1; (+) strand; PAM type: YTN; PAM sequence: TTT
ttcctgcccatctcctccct

SEQ ID NO: 262697 - DNA, 20 bp, Artificial Sequence
  Description of Artificial Sequence: Synthetic oligonucleotide
  Target: ATXN1; (+) strand; PAM type: YTN; PAM sequence: TTT
tcctgcccatctcctcccta

SEQ ID NO: 262698 - DNA, 20 bp, Artificial Sequence
  Description of Artificial Sequence: Synthetic oligonucleotide
  Target: ATXN1; (+) strand; PAM type: YTN; PAM sequence: TTT
cctgcccatctcctccctat

SEQ ID NO: 262699 - DNA, 20 bp, Artificial Sequence
  Description of Artificial Sequence: Synthetic oligonucleotide
  Target: ATXN1; (+) strand; PAM type: YTN; PAM sequence: TTC
ctgcccatctcctccctatg

SEQ ID NO: 262700 - DNA, 20 bp, Artificial Sequence
  Description of Artificial Sequence: Synthetic oligonucleotide
  Target: ATXN1; (+) strand; PAM type: YTN; PAM sequence: CTG
cccatctcctccctatgttc

SEQ ID NO: 262701 - DNA, 20 bp, Artificial Sequence
  Description of Artificial Sequence: Synthetic oligonucleotide
  Target: ATXN1; (+) strand; PAM type: YTN; PAM sequence: CTC
ctccctatgttctgctccag

SEQ ID NO: 262702 - DNA, 20 bp, Artificial Sequence
  Description of Artificial Sequence: Synthetic oligonucleotide
  Target: ATXN1; (+) strand; PAM type: YTN; PAM sequence: CTC
cctatgttctgctccagcat

SEQ ID NO: 262703 - DNA, 20 bp, Artificial Sequence
  Description of Artificial Sequence: Synthetic oligonucleotide
  Target: ATXN1; (+) strand; PAM type: YTN; PAM sequence: CTA
tgttctgctccagcatagtg

SEQ ID NO: 262704 - DNA, 20 bp, Artificial Sequence
  Description of Artificial Sequence: Synthetic oligonucleotide
  Target: ATXN1; (+) strand; PAM type: YTN; PAM sequence: TTC
tgctccagcatagtggcctc

SEQ ID NO: 262705 - DNA, 20 bp, Artificial Sequence
  Description of Artificial Sequence: Synthetic oligonucleotide
  Target: ATXN1; (+) strand; PAM type: YTN; PAM sequence: CTG
ctccagcatagtggcctcca

SEQ ID NO: 262706 - DNA, 20 bp, Artificial Sequence
  Description of Artificial Sequence: Synthetic oligonucleotide
  Target: ATXN1; (+) strand; PAM type: YTN; PAM sequence: CTC
cagcatagtggcctccacac

SEQ ID NO: 262707 - DNA, 20 bp, Artificial Sequence
  Description of Artificial Sequence: Synthetic oligonucleotide
  Target: ATXN1; (+) strand; PAM type: YTN; PAM sequence: CTC
cacactcccttccacatcca

SEQ ID NO: 262708 - DNA, 20 bp, Artificial Sequence
  Description of Artificial Sequence: Synthetic oligonucleotide
  Target: ATXN1; (+) strand; PAM type: YTN; PAM sequence: CTC
ccttccacatccaggcacaa

SEQ ID NO: 262709 - DNA, 20 bp, Artificial Sequence
  Description of Artificial Sequence: Synthetic oligonucleotide
  Target: ATXN1; (+) strand; PAM type: YTN; PAM sequence: CTT
ccacatccaggcacaatcct

SEQ ID NO: 262710 - DNA, 20 bp, Artificial Sequence
  Description of Artificial Sequence: Synthetic oligonucleotide
  Target: ATXN1; (+) strand; PAM type: YTN; PAM sequence: TTC
cacatccaggcacaatcctg

SEQ ID NO: 262711 - DNA, 20 bp, Artificial Sequence
  Description of Artificial Sequence: Synthetic oligonucleotide
  Target: ATXN1; (+) strand; PAM type: YTN; PAM sequence: CTG
gtcctacctagaatgctcct

SEQ ID NO: 262712 - DNA, 20 bp, Artificial Sequence
  Description of Artificial Sequence: Synthetic oligonucleotide
  Target: ATXN1; (+) strand; PAM type: YTN; PAM sequence: CTA
cctagaatgctcctctggca

SEQ ID NO: 262713 - DNA, 20 bp, Artificial Sequence
  Description of Artificial Sequence: Synthetic oligonucleotide
  Target: ATXN1; (+) strand; PAM type: YTN; PAM sequence: CTA
gaatgctcctctggcaaatg

SEQ ID NO: 262714 - DNA, 20 bp, Artificial Sequence
  Description of Artificial Sequence: Synthetic oligonucleotide
  Target: ATXN1; (+) strand; PAM type: YTN; PAM sequence: CTC
ctctggcaaatgagttctct

SEQ ID NO: 262715 - DNA, 20 bp, Artificial Sequence
  Description of Artificial Sequence: Synthetic oligonucleotide
  Target: ATXN1; (+) strand; PAM type: YTN; PAM sequence: CTC
tggcaaatgagttctcttca

SEQ ID NO: 262716 - DNA, 20 bp, Artificial Sequence
  Description of Artificial Sequence: Synthetic oligonucleotide
  Target: ATXN1; (+) strand; PAM type: YTN; PAM sequence: CTG
gcaaatgagttctcttcatt

SEQ ID NO: 262717 - DNA, 20 bp, Artificial Sequence
  Description of Artificial Sequence: Synthetic oligonucleotide
  Target: ATXN1; (+) strand; PAM type: YTN; PAM sequence: TTC
tcttcattcaggtctctgct

SEQ ID NO: 262718 - DNA, 20 bp, Artificial Sequence
  Description of Artificial Sequence: Synthetic oligonucleotide
  Target: ATXN1; (+) strand; PAM type: YTN; PAM sequence: CTC
ttcattcaggtctctgctgt

SEQ ID NO: 262719 - DNA, 20 bp, Artificial Sequence
  Description of Artificial Sequence: Synthetic oligonucleotide
  Target: ATXN1; (+) strand; PAM type: YTN; PAM sequence: CTT
cattcaggtctctgctgtga

SEQ ID NO: 262720 - DNA, 20 bp, Artificial Sequence
  Description of Artificial Sequence: Synthetic oligonucleotide
  Target: ATXN1; (+) strand; PAM type: YTN; PAM sequence: TTC
attcaggtctctgctgtgat

SEQ ID NO: 262721 - DNA, 20 bp, Artificial Sequence
  Description of Artificial Sequence: Synthetic oligonucleotide
  Target: ATXN1; (+) strand; PAM type: YTN; PAM sequence: TTC
aggtctctgctgtgatgtgt

SEQ ID NO: 262722 - DNA, 20 bp, Artificial Sequence
  Description of Artificial Sequence: Synthetic oligonucleotide
  Target: ATXN1; (+) strand; PAM type: YTN; PAM sequence: CTC
tgctgtgatgtgtccctccc

SEQ ID NO: 262723 - DNA, 20 bp, Artificial Sequence
  Description of Artificial Sequence: Synthetic oligonucleotide
  Target: ATXN1; (+) strand; PAM type: YTN; PAM sequence: CTG
ctgtgatgtgtccctccctg

SEQ ID NO: 262724 - DNA, 20 bp, Artificial Sequence
  Description of Artificial Sequence: Synthetic oligonucleotide
  Target: ATXN1; (+) strand; PAM type: YTN; PAM sequence: CTG
tgatgtgtccctccctggtc

SEQ ID NO: 262725 - DNA, 20 bp, Artificial Sequence
  Description of Artificial Sequence: Synthetic oligonucleotide
  Target: ATXN1; (+) strand; PAM type: YTN; PAM sequence: CTC
cctggtcgccttgtctaaaa

SEQ ID NO: 262726 - DNA, 20 bp, Artificial Sequence
  Description of Artificial Sequence: Synthetic oligonucleotide
  Target: ATXN1; (+) strand; PAM type: YTN; PAM sequence: CTG
gtcgccttgtctaaaagagc

SEQ ID NO: 262727 - DNA, 20 bp, Artificial Sequence
  Description of Artificial Sequence: Synthetic oligonucleotide
  Target: ATXN1; (+) strand; PAM type: YTN; PAM sequence: CTT
gtctaaaagagcaggccccc

SEQ ID NO: 262728 - DNA, 20 bp, Artificial Sequence
  Description of Artificial Sequence: Synthetic oligonucleotide
  Target: ATXN1; (+) strand; PAM type: YTN; PAM sequence: TTG
tctaaaagagcaggccccct

SEQ ID NO: 262729 - DNA, 20 bp, Artificial Sequence
  Description of Artificial Sequence: Synthetic oligonucleotide
  Target: ATXN1; (+) strand; PAM type: YTN; PAM sequence: CTA
aaagagcaggccccctcttc

SEQ ID NO: 262730 - DNA, 20 bp, Artificial Sequence
  Description of Artificial Sequence: Synthetic oligonucleotide
  Target: ATXN1; (+) strand; PAM type: YTN; PAM sequence: CTC
ttccctcgcccctctgattc

SEQ ID NO: 262731 - DNA, 20 bp, Artificial Sequence
  Description of Artificial Sequence: Synthetic oligonucleotide
  Target: ATXN1; (+) strand; PAM type: YTN; PAM sequence: CTT
ccctcgcccctctgattctt

SEQ ID NO: 262732 - DNA, 20 bp, Artificial Sequence
  Description of Artificial Sequence: Synthetic oligonucleotide
  Target: ATXN1; (+) strand; PAM type: YTN; PAM sequence: TTC
cctcgcccctctgattcttc

SEQ ID NO: 262733 - DNA, 20 bp, Artificial Sequence
  Description of Artificial Sequence: Synthetic oligonucleotide
  Target: ATXN1; (+) strand; PAM type: YTN; PAM sequence: CTC
gcccctctgattcttctctt

SEQ ID NO: 262734 - DNA, 20 bp, Artificial Sequence
  Description of Artificial Sequence: Synthetic oligonucleotide
  Target: ATXN1; (+) strand; PAM type: YTN; PAM sequence: CTC
tgattcttctcttcattcat

SEQ ID NO: 262735 - DNA, 20 bp, Artificial Sequence
  Description of Artificial Sequence: Synthetic oligonucleotide
  Target: ATXN1; (+) strand; PAM type: YTN; PAM sequence: CTG
attcttctcttcattcatca

SEQ ID NO: 262736 - DNA, 20 bp, Artificial Sequence
  Description of Artificial Sequence: Synthetic oligonucleotide
  Target: ATXN1; (+) strand; PAM type: YTN; PAM sequence: TTC
ttctcttcattcatcacagc

SEQ ID NO: 262737 - DNA, 20 bp, Artificial Sequence
  Description of Artificial Sequence: Synthetic oligonucleotide
  Target: ATXN1; (+) strand; PAM type: YTN; PAM sequence: CTT
ctcttcattcatcacagctg

SEQ ID NO: 262738 - DNA, 20 bp, Artificial Sequence
  Description of Artificial Sequence: Synthetic oligonucleotide
  Target: ATXN1; (+) strand; PAM type: YTN; PAM sequence: TTC
tcttcattcatcacagctga

SEQ ID NO: 262739 - DNA, 20 bp, Artificial Sequence
  Description of Artificial Sequence: Synthetic oligonucleotide
  Target: ATXN1; (+) strand; PAM type: YTN; PAM sequence: CTC
ttcattcatcacagctgatg

SEQ ID NO: 262740 - DNA, 20 bp, Artificial Sequence
  Description of Artificial Sequence: Synthetic oligonucleotide
  Target: ATXN1; (+) strand; PAM type: YTN; PAM sequence: CTT
cattcatcacagctgatgtt

SEQ ID NO: 262741 - DNA, 20 bp, Artificial Sequence
  Description of Artificial Sequence: Synthetic oligonucleotide
  Target: ATXN1; (+) strand; PAM type: YTN; PAM sequence: TTC
attcatcacagctgatgtta

SEQ ID NO: 262742 - DNA, 20 bp, Artificial Sequence
  Description of Artificial Sequence: Synthetic oligonucleotide
  Target: ATXN1; (+) strand; PAM type: YTN; PAM sequence: TTC
atcacagctgatgttacacc

SEQ ID NO: 262743 - DNA, 20 bp, Artificial Sequence
  Description of Artificial Sequence: Synthetic oligonucleotide
  Target: ATXN1; (+) strand; PAM type: YTN; PAM sequence: CTG
atgttacaccacaaagtcct

SEQ ID NO: 262744 - DNA, 20 bp, Artificial Sequence
  Description of Artificial Sequence: Synthetic oligonucleotide
  Target: ATXN1; (+) strand; PAM type: YTN; PAM sequence: TTA
caccacaaagtccttgttgg

SEQ ID NO: 262745 - DNA, 20 bp, Artificial Sequence
  Description of Artificial Sequence: Synthetic oligonucleotide
  Target: ATXN1; (+) strand; PAM type: YTN; PAM sequence: CTT
gttggtttgtttcctgcgct

SEQ ID NO: 262746 - DNA, 20 bp, Artificial Sequence
  Description of Artificial Sequence: Synthetic oligonucleotide
  Target: ATXN1; (+) strand; PAM type: YTN; PAM sequence: TTG
ttggtttgtttcctgcgcta

SEQ ID NO: 262747 - DNA, 20 bp, Artificial Sequence
  Description of Artificial Sequence: Synthetic oligonucleotide
  Target: ATXN1; (+) strand; PAM type: YTN; PAM sequence: TTG
gtttgtttcctgcgctagaa

SEQ ID NO: 262748 - DNA, 20 bp, Artificial Sequence
  Description of Artificial Sequence: Synthetic oligonucleotide
  Target: ATXN1; (+) strand; PAM type: YTN; PAM sequence: TTT
gtttcctgcgctagaatgat

SEQ ID NO: 262749 - DNA, 20 bp, Artificial Sequence
  Description of Artificial Sequence: Synthetic oligonucleotide
  Target: ATXN1; (+) strand; PAM type: YTN; PAM sequence: TTG
tttcctgcgctagaatgatg

SEQ ID NO: 262750 - DNA, 20 bp, Artificial Sequence
  Description of Artificial Sequence: Synthetic oligonucleotide
  Target: ATXN1; (+) strand; PAM type: YTN; PAM sequence: TTT
cctgcgctagaatgatgctc

SEQ ID NO: 262751 - DNA, 20 bp, Artificial Sequence
  Description of Artificial Sequence: Synthetic oligonucleotide
  Target: ATXN1; (+) strand; PAM type: YTN; PAM sequence: TTC
ctgcgctagaatgatgctcc

SEQ ID NO: 262752 - DNA, 20 bp, Artificial Sequence
  Description of Artificial Sequence: Synthetic oligonucleotide
  Target: ATXN1; (+) strand; PAM type: YTN; PAM sequence: CTG
cgctagaatgatgctcctta

SEQ ID NO: 262753 - DNA, 20 bp, Artificial Sequence
  Description of Artificial Sequence: Synthetic oligonucleotide
  Target: ATXN1; (+) strand; PAM type: YTN; PAM sequence: CTA
gaatgatgctccttatttat

SEQ ID NO: 262754 - DNA, 20 bp, Artificial Sequence
  Description of Artificial Sequence: Synthetic oligonucleotide
  Target: ATXN1; (+) strand; PAM type: YTN; PAM sequence: CTC
cttatttattcattactgat

SEQ ID NO: 262755 - DNA, 20 bp, Artificial Sequence
  Description of Artificial Sequence: Synthetic oligonucleotide
  Target: ATXN1; (+) strand; PAM type: YTN; PAM sequence: CTT
atttattcattactgatata

SEQ ID NO: 262756 - DNA, 20 bp, Artificial Sequence
  Description of Artificial Sequence: Synthetic oligonucleotide
  Target: ATXN1; (+) strand; PAM type: YTN; PAM sequence: TTA
tttattcattactgatatat

SEQ ID NO: 262757 - DNA, 20 bp, Artificial Sequence
  Description of Artificial Sequence: Synthetic oligonucleotide
  Target: ATXN1; (+) strand; PAM type: YTN; PAM sequence: TTT
attcattactgatatatcac

SEQ ID NO: 262758 - DNA, 20 bp, Artificial Sequence
  Description of Artificial Sequence: Synthetic oligonucleotide
  Target: ATXN1; (+) strand; PAM type: YTN; PAM sequence: TTA
ttcattactgatatatcaca

SEQ ID NO: 262759 - DNA, 20 bp, Artificial Sequence
  Description of Artificial Sequence: Synthetic oligonucleotide
  Target: ATXN1; (+) strand; PAM type: YTN; PAM sequence: TTC
attactgatatatcacaggt

SEQ ID NO: 262760 - DNA, 20 bp, Artificial Sequence
  Description of Artificial Sequence: Synthetic oligonucleotide
  Target: ATXN1; (+) strand; PAM type: YTN; PAM sequence: TTA
ctgatatatcacaggtgtac

SEQ ID NO: 262761 - DNA, 20 bp, Artificial Sequence
  Description of Artificial Sequence: Synthetic oligonucleotide
  Target: ATXN1; (+) strand; PAM type: YTN; PAM sequence: CTG
atatatcacaggtgtacata

SEQ ID NO: 262762 - DNA, 20 bp, Artificial Sequence
  Description of Artificial Sequence: Synthetic oligonucleotide
  Target: ATXN1; (+) strand; PAM type: YTN; PAM sequence: TTT
tgggggtacaagtgatatgt

SEQ ID NO: 262763 - DNA, 20 bp, Artificial Sequence
  Description of Artificial Sequence: Synthetic oligonucleotide
  Target: ATXN1; (+) strand; PAM type: YTN; PAM sequence: TTT
gggggtacaagtgatatgta

SEQ ID NO: 262764 - DNA, 20 bp, Artificial Sequence
  Description of Artificial Sequence: Synthetic oligonucleotide
  Target: ATXN1; (+) strand; PAM type: YTN; PAM sequence: TTG
ggggtacaagtgatatgtac

SEQ ID NO: 262765 - DNA, 20 bp, Artificial Sequence
  Description of Artificial Sequence: Synthetic oligonucleotide
  Target: ATXN1; (+) strand; PAM type: YTN; PAM sequence: CTA
ttgaatcctaaaacttactc

SEQ ID NO: 262766 - DNA, 20 bp, Artificial Sequence
  Description of Artificial Sequence: Synthetic oligonucleotide
  Target: ATXN1; (+) strand; PAM type: YTN; PAM sequence: TTG
aatcctaaaacttactcctt

SEQ ID NO: 262767 - DNA, 20 bp, Artificial Sequence
  Description of Artificial Sequence: Synthetic oligonucleotide
  Target: ATXN1; (+) strand; PAM type: YTN; PAM sequence: CTA
aaacttactccttctattta

SEQ ID NO: 262768 - DNA, 20 bp, Artificial Sequence
  Description of Artificial Sequence: Synthetic oligonucleotide
  Target: ATXN1; (+) strand; PAM type: YTN; PAM sequence: CTT
actccttctatttaactgta

SEQ ID NO: 262769 - DNA, 20 bp, Artificial Sequence
  Description of Artificial Sequence: Synthetic oligonucleotide
  Target: ATXN1; (+) strand; PAM type: YTN; PAM sequence: TTA
ctccttctatttaactgtat

SEQ ID NO: 262770 - DNA, 20 bp, Artificial Sequence
  Description of Artificial Sequence: Synthetic oligonucleotide
  Target: ATXN1; (+) strand; PAM type: YTN; PAM sequence: CTC
cttctatttaactgtatttt

SEQ ID NO: 262771 - DNA, 20 bp, Artificial Sequence
  Description of Artificial Sequence: Synthetic oligonucleotide
  Target: ATXN1; (+) strand; PAM type: YTN; PAM sequence: CTT
ctatttaactgtatttttgt

SEQ ID NO: 262772 - DNA, 20 bp, Artificial Sequence
  Description of Artificial Sequence: Synthetic oligonucleotide
  Target: ATXN1; (+) strand; PAM type: YTN; PAM sequence: TTC
tatttaactgtatttttgta

SEQ ID NO: 262773 - DNA, 20 bp, Artificial Sequence
  Description of Artificial Sequence: Synthetic oligonucleotide
  Target: ATXN1; (+) strand; PAM type: YTN; PAM sequence: CTA
tttaactgtatttttgtatc

SEQ ID NO: 262774 - DNA, 20 bp, Artificial Sequence
  Description of Artificial Sequence: Synthetic oligonucleotide
  Target: ATXN1; (+) strand; PAM type: YTN; PAM sequence: TTT
aactgtatttttgtatcacc

SEQ ID NO: 262775 - DNA, 20 bp, Artificial Sequence
  Description of Artificial Sequence: Synthetic oligonucleotide
  Target: ATXN1; (+) strand; PAM type: YTN; PAM sequence: TTA
actgtatttttgtatcaccc

SEQ ID NO: 262776 - DNA, 20 bp, Artificial Sequence
  Description of Artificial Sequence: Synthetic oligonucleotide
  Target: ATXN1; (+) strand; PAM type: YTN; PAM sequence: CTG
tatttttgtatcacccatta

SEQ ID NO: 262777 - DNA, 20 bp, Artificial Sequence
  Description of Artificial Sequence: Synthetic oligonucleotide
  Target: ATXN1; (+) strand; PAM type: YTN; PAM sequence: TTT
ttgtatcacccattaactga

SEQ ID NO: 262778 - DNA, 20 bp, Artificial Sequence
  Description of Artificial Sequence: Synthetic oligonucleotide
  Target: ATXN1; (+) strand; PAM type: YTN; PAM sequence: TTT
tgtatcacccattaactgac

SEQ ID NO: 262779 - DNA, 20 bp, Artificial Sequence
  Description of Artificial Sequence: Synthetic oligonucleotide
  Target: ATXN1; (+) strand; PAM type: YTN; PAM sequence: TTT
gtatcacccattaactgact

SEQ ID NO: 262780 - DNA, 20 bp, Artificial Sequence
  Description of Artificial Sequence: Synthetic oligonucleotide
  Target: ATXN1; (+) strand; PAM type: YTN; PAM sequence: TTG
tatcacccattaactgactt

SEQ ID NO: 262781 - DNA, 20 bp, Artificial Sequence
  Description of Artificial Sequence: Synthetic oligonucleotide
  Target: ATXN1; (+) strand; PAM type: YTN; PAM sequence: TTA
actgacttctcttcatcctt

SEQ ID NO: 262782 - DNA, 20 bp, Artificial Sequence
  Description of Artificial Sequence: Synthetic oligonucleotide
  Target: ATXN1; (+) strand; PAM type: YTN; PAM sequence: CTG
acttctcttcatccttgctc

SEQ ID NO: 262783 - DNA, 20 bp, Artificial Sequence
  Description of Artificial Sequence: Synthetic oligonucleotide
  Target: ATXN1; (+) strand; PAM type: YTN; PAM sequence: CTT
ctcttcatccttgctcaaac

SEQ ID NO: 262784 - DNA, 20 bp, Artificial Sequence
  Description of Artificial Sequence: Synthetic oligonucleotide
  Target: ATXN1; (+) strand; PAM type: YTN; PAM sequence: TTC
tcttcatccttgctcaaact

SEQ ID NO: 262785 - DNA, 20 bp, Artificial Sequence
  Description of Artificial Sequence: Synthetic oligonucleotide
  Target: ATXN1; (+) strand; PAM type: YTN; PAM sequence: CTC
ttcatccttgctcaaactgc

SEQ ID NO: 262786 - DNA, 20 bp, Artificial Sequence
  Description of Artificial Sequence: Synthetic oligonucleotide
  Target: ATXN1; (+) strand; PAM type: YTN; PAM sequence: CTT
catccttgctcaaactgcag

SEQ ID NO: 262787 - DNA, 20 bp, Artificial Sequence
  Description of Artificial Sequence: Synthetic oligonucleotide
  Target: ATXN1; (+) strand; PAM type: YTN; PAM sequence: TTC
atccttgctcaaactgcagc

SEQ ID NO: 262788 - DNA, 20 bp, Artificial Sequence
  Description of Artificial Sequence: Synthetic oligonucleotide
  Target: ATXN1; (+) strand; PAM type: YTN; PAM sequence: CTT
gctcaaactgcagcacctat

SEQ ID NO: 262789 - DNA, 20 bp, Artificial Sequence
  Description of Artificial Sequence: Synthetic oligonucleotide
  Target: ATXN1; (+) strand; PAM type: YTN; PAM sequence: TTG
ctcaaactgcagcacctatg

SEQ ID NO: 262790 - DNA, 20 bp, Artificial Sequence
  Description of Artificial Sequence: Synthetic oligonucleotide
  Target: ATXN1; (+) strand; PAM type: YTN; PAM sequence: CTC
aaactgcagcacctatgagt

SEQ ID NO: 262791 - DNA, 20 bp, Artificial Sequence
  Description of Artificial Sequence: Synthetic oligonucleotide
  Target: ATXN1; (+) strand; PAM type: YTN; PAM sequence: CTG
cagcacctatgagtcttagc

SEQ ID NO: 262792 - DNA, 20 bp, Artificial Sequence
  Description of Artificial Sequence: Synthetic oligonucleotide
  Target: ATXN1; (+) strand; PAM type: YTN; PAM sequence: CTA
tgagtcttagcacagagaag

SEQ ID NO: 262793 - DNA, 20 bp, Artificial Sequence
  Description of Artificial Sequence: Synthetic oligonucleotide
  Target: ATXN1; (+) strand; PAM type: YTN; PAM sequence: CTT
agcacagagaaggcactctg

SEQ ID NO: 262794 - DNA, 20 bp, Artificial Sequence
  Description of Artificial Sequence: Synthetic oligonucleotide
  Target: ATXN1; (+) strand; PAM type: YTN; PAM sequence: TTA
gcacagagaaggcactctgt

SEQ ID NO: 262795 - DNA, 20 bp, Artificial Sequence
  Description of Artificial Sequence: Synthetic oligonucleotide
  Target: ATXN1; (+) strand; PAM type: YTN; PAM sequence: CTC
tgtaagtattggctcaataa

SEQ ID NO: 262796 - DNA, 20 bp, Artificial Sequence
  Description of Artificial Sequence: Synthetic oligonucleotide
  Target: ATXN1; (+) strand; PAM type: YTN; PAM sequence: CTG
taagtattggctcaataaat

SEQ ID NO: 262797 - DNA, 20 bp, Artificial Sequence
  Description of Artificial Sequence: Synthetic oligonucleotide
  Target: ATXN1; (+) strand; PAM type: YTN; PAM sequence: TTG
gctcaataaataaaagtgtc

SEQ ID NO: 262798 - DNA, 20 bp, Artificial Sequence
  Description of Artificial Sequence: Synthetic oligonucleotide
  Target: ATXN1; (+) strand; PAM type: YTN; PAM sequence: CTC
aataaataaaagtgtcttac

SEQ ID NO: 262799 - DNA, 20 bp, Artificial Sequence
  Description of Artificial Sequence: Synthetic oligonucleotide
  Target: ATXN1; (+) strand; PAM type: YTN; PAM sequence: CTT
acattgcccaacaaggacac

SEQ ID NO: 262800 - DNA, 20 bp, Artificial Sequence
  Description of Artificial Sequence: Synthetic oligonucleotide
  Target: ATXN1; (+) strand; PAM type: YTN; PAM sequence: TTA
cattgcccaacaaggacact

SEQ ID NO: 262801 - DNA, 20 bp, Artificial Sequence
  Description of Artificial Sequence: Synthetic oligonucleotide
  Target: ATXN1; (+) strand; PAM type: YTN; PAM sequence: TTG
cccaacaaggacactatata

SEQ ID NO: 262802 - DNA, 20 bp, Artificial Sequence
  Description of Artificial Sequence: Synthetic oligonucleotide
  Target: ATXN1; (+) strand; PAM type: YTN; PAM sequence: CTA
tatacagtttttgtttatac

SEQ ID NO: 262803 - DNA, 20 bp, Artificial Sequence
  Description of Artificial Sequence: Synthetic oligonucleotide
  Target: ATXN1; (+) strand; PAM type: YTN; PAM sequence: TTT
ttgtttataccaccctgtgc

SEQ ID NO: 262804 - DNA, 20 bp, Artificial Sequence
  Description of Artificial Sequence: Synthetic oligonucleotide
  Target: ATXN1; (+) strand; PAM type: YTN; PAM sequence: TTT
tgtttataccaccctgtgca

SEQ ID NO: 262805 - DNA, 20 bp, Artificial Sequence
  Description of Artificial Sequence: Synthetic oligonucleotide
  Target: ATXN1; (+) strand; PAM type: YTN; PAM sequence: TTT
gtttataccaccctgtgcaa

SEQ ID NO: 262806 - DNA, 20 bp, Artificial Sequence
  Description of Artificial Sequence: Synthetic oligonucleotide
  Target: ATXN1; (+) strand; PAM type: YTN; PAM sequence: TTG
tttataccaccctgtgcaac

SEQ ID NO: 262807 - DNA, 20 bp, Artificial Sequence
  Description of Artificial Sequence: Synthetic oligonucleotide
  Target: ATXN1; (+) strand; PAM type: YTN; PAM sequence: TTT
ataccaccctgtgcaacaat

SEQ ID NO: 262808 - DNA, 20 bp, Artificial Sequence
  Description of Artificial Sequence: Synthetic oligonucleotide
  Target: ATXN1; (+) strand; PAM type: YTN; PAM sequence: TTA
taccaccctgtgcaacaatg

SEQ ID NO: 262809 - DNA, 20 bp, Artificial Sequence
  Description of Artificial Sequence: Synthetic oligonucleotide
  Target: ATXN1; (+) strand; PAM type: YTN; PAM sequence: CTG
tgcaacaatgctcacataca

SEQ ID NO: 262810 - DNA, 20 bp, Artificial Sequence
  Description of Artificial Sequence: Synthetic oligonucleotide
  Target: ATXN1; (+) strand; PAM type: YTN; PAM sequence: CTC
acatacagtggaatttgaaa

SEQ ID NO: 262811 - DNA, 20 bp, Artificial Sequence
  Description of Artificial Sequence: Synthetic oligonucleotide
  Target: ATXN1; (+) strand; PAM type: YTN; PAM sequence: TTT
gaaaaccactgagctaggct

SEQ ID NO: 262812 - DNA, 20 bp, Artificial Sequence
  Description of Artificial Sequence: Synthetic oligonucleotide
  Target: ATXN1; (+) strand; PAM type: YTN; PAM sequence: TTG
aaaaccactgagctaggcta

SEQ ID NO: 262813 - DNA, 20 bp, Artificial Sequence
  Description of Artificial Sequence: Synthetic oligonucleotide
  Target: ATXN1; (+) strand; PAM type: YTN; PAM sequence: CTG
agctaggctaaggcccaaga

SEQ ID NO: 262814 - DNA, 20 bp, Artificial Sequence
  Description of Artificial Sequence: Synthetic oligonucleotide
  Target: ATXN1; (+) strand; PAM type: YTN; PAM sequence: CTA
ggctaaggcccaagaggaaa

SEQ ID NO: 262815 - DNA, 20 bp, Artificial Sequence
  Description of Artificial Sequence: Synthetic oligonucleotide
  Target: ATXN1; (+) strand; PAM type: YTN; PAM sequence: CTA
aggcccaagaggaaagccta

SEQ ID NO: 262816 - DNA, 20 bp, Artificial Sequence
  Description of Artificial Sequence: Synthetic oligonucleotide
  Target: ATXN1; (+) strand; PAM type: YTN; PAM sequence: CTA
catcagatctgtgtctggac

SEQ ID NO: 262817 - DNA, 20 bp, Artificial Sequence
  Description of Artificial Sequence: Synthetic oligonucleotide
  Target: ATXN1; (+) strand; PAM type: YTN; PAM sequence: CTG
tgtctggacgtccacaccac

SEQ ID NO: 262818 - DNA, 20 bp, Artificial Sequence
  Description of Artificial Sequence: Synthetic oligonucleotide
  Target: ATXN1; (+) strand; PAM type: YTN; PAM sequence: CTG
gacgtccacaccactgcacc

SEQ ID NO: 262819 - DNA, 20 bp, Artificial Sequence
  Description of Artificial Sequence: Synthetic oligonucleotide
  Target: ATXN1; (+) strand; PAM type: YTN; PAM sequence: CTG
cacctttgatgtccctagca

SEQ ID NO: 262820 - DNA, 20 bp, Artificial Sequence
  Description of Artificial Sequence: Synthetic oligonucleotide
  Target: ATXN1; (+) strand; PAM type: YTN; PAM sequence: CTT
tgatgtccctagcagagatc

SEQ ID NO: 262821 - DNA, 20 bp, Artificial Sequence
  Description of Artificial Sequence: Synthetic oligonucleotide
  Target: ATXN1; (+) strand; PAM type: YTN; PAM sequence: TTT
gatgtccctagcagagatca

SEQ ID NO: 262822 - DNA, 20 bp, Artificial Sequence
  Description of Artificial Sequence: Synthetic oligonucleotide
  Target: ATXN1; (+) strand; PAM type: YTN; PAM sequence: TTG
atgtccctagcagagatcaa

SEQ ID NO: 262823 - DNA, 20 bp, Artificial Sequence
  Description of Artificial Sequence: Synthetic oligonucleotide
  Target: ATXN1; (+) strand; PAM type: YTN; PAM sequence: CTA
gcagagatcaagcttttttg

SEQ ID NO: 262824 - DNA, 20 bp, Artificial Sequence
  Description of Artificial Sequence: Synthetic oligonucleotide
  Target: ATXN1; (+) strand; PAM type: YTN; PAM sequence: CTT
ttttgcttgcatgaagggtt

SEQ ID NO: 262825 - DNA, 20 bp, Artificial Sequence
  Description of Artificial Sequence: Synthetic oligonucleotide
  Target: ATXN1; (+) strand; PAM type: YTN; PAM sequence: TTT
tttgcttgcatgaagggttt

SEQ ID NO: 262826 - DNA, 20 bp, Artificial Sequence
  Description of Artificial Sequence: Synthetic oligonucleotide
  Target: ATXN1; (+) strand; PAM type: YTN; PAM sequence: TTT
ttgcttgcatgaagggtttt

SEQ ID NO: 262827 - DNA, 20 bp, Artificial Sequence
  Description of Artificial Sequence: Synthetic oligonucleotide
  Target: ATXN1; (+) strand; PAM type: YTN; PAM sequence: TTT
tgcttgcatgaagggttttc

SEQ ID NO: 262828 - DNA, 20 bp, Artificial Sequence
  Description of Artificial Sequence: Synthetic oligonucleotide
  Target: ATXN1; (+) strand; PAM type: YTN; PAM sequence: TTT
gcttgcatgaagggttttct

SEQ ID NO: 262829 - DNA, 20 bp, Artificial Sequence
  Description of Artificial Sequence: Synthetic oligonucleotide
  Target: ATXN1; (+) strand; PAM type: YTN; PAM sequence: TTG
cttgcatgaagggttttctt

SEQ ID NO: 262830 - DNA, 20 bp, Artificial Sequence
  Description of Artificial Sequence: Synthetic oligonucleotide
  Target: ATXN1; (+) strand; PAM type: YTN; PAM sequence: CTT
gcatgaagggttttcttaac

SEQ ID NO: 262831 - DNA, 20 bp, Artificial Sequence
  Description of Artificial Sequence: Synthetic oligonucleotide
  Target: ATXN1; (+) strand; PAM type: YTN; PAM sequence: TTG
catgaagggttttcttaact

SEQ ID NO: 262832 - DNA, 20 bp, Artificial Sequence
  Description of Artificial Sequence: Synthetic oligonucleotide
  Target: ATXN1; (+) strand; PAM type: YTN; PAM sequence: TTT
tcttaactccattttgttag

SEQ ID NO: 262833 - DNA, 20 bp, Artificial Sequence
  Description of Artificial Sequence: Synthetic oligonucleotide
  Target: ATXN1; (+) strand; PAM type: YTN; PAM sequence: TTT
cttaactccattttgttagt

SEQ ID NO: 262834 - DNA, 20 bp, Artificial Sequence
  Description of Artificial Sequence: Synthetic oligonucleotide
  Target: ATXN1; (+) strand; PAM type: YTN; PAM sequence: TTC
ttaactccattttgttagta

SEQ ID NO: 262835 - DNA, 20 bp, Artificial Sequence
  Description of Artificial Sequence: Synthetic oligonucleotide
  Target: ATXN1; (+) strand; PAM type: YTN; PAM sequence: CTT
aactccattttgttagtaag

SEQ ID NO: 262836 - DNA, 20 bp, Artificial Sequence
  Description of Artificial Sequence: Synthetic oligonucleotide
  Target: ATXN1; (+) strand; PAM type: YTN; PAM sequence: TTA
actccattttgttagtaagg

SEQ ID NO: 262837 - DNA, 20 bp, Artificial Sequence
  Description of Artificial Sequence: Synthetic oligonucleotide
  Target: ATXN1; (+) strand; PAM type: YTN; PAM sequence: CTC
cattttgttagtaaggctct

SEQ ID NO: 262838 - DNA, 20 bp, Artificial Sequence
  Description of Artificial Sequence: Synthetic oligonucleotide
  Target: ATXN1; (+) strand; PAM type: YTN; PAM sequence: TTT
tgttagtaaggctctacatc

SEQ ID NO: 262839 - DNA, 20 bp, Artificial Sequence
  Description of Artificial Sequence: Synthetic oligonucleotide
  Target: ATXN1; (+) strand; PAM type: YTN; PAM sequence: TTT
gttagtaaggctctacatct

SEQ ID NO: 262840 - DNA, 20 bp, Artificial Sequence
  Description of Artificial Sequence: Synthetic oligonucleotide
  Target: ATXN1; (+) strand; PAM type: YTN; PAM sequence: TTG
ttagtaaggctctacatctt

SEQ ID NO: 262841 - DNA, 20 bp, Artificial Sequence
  Description of Artificial Sequence: Synthetic oligonucleotide
  Target: ATXN1; (+) strand; PAM type: YTN; PAM sequence: TTA
gtaaggctctacatcttcaa

SEQ ID NO: 262842 - DNA, 20 bp, Artificial Sequence
  Description of Artificial Sequence: Synthetic oligonucleotide
  Target: ATXN1; (+) strand; PAM type: YTN; PAM sequence: CTC
tacatcttcaagatttgcca

SEQ ID NO: 262843 - DNA, 20 bp, Artificial Sequence
  Description of Artificial Sequence: Synthetic oligonucleotide
  Target: ATXN1; (+) strand; PAM type: YTN; PAM sequence: CTA
catcttcaagatttgccaac

SEQ ID NO: 262844 - DNA, 20 bp, Artificial Sequence
  Description of Artificial Sequence: Synthetic oligonucleotide
  Target: ATXN1; (+) strand; PAM type: YTN; PAM sequence: CTT
caagatttgccaactgattt

SEQ ID NO: 262845 - DNA, 20 bp, Artificial Sequence
  Description of Artificial Sequence: Synthetic oligonucleotide
  Target: ATXN1; (+) strand; PAM type: YTN; PAM sequence: TTC
aagatttgccaactgattta

SEQ ID NO: 262846 - DNA, 20 bp, Artificial Sequence
  Description of Artificial Sequence: Synthetic oligonucleotide
  Target: ATXN1; (+) strand; PAM type: YTN; PAM sequence: TTT
gccaactgatttatttgttg

SEQ ID NO: 262847 - DNA, 20 bp, Artificial Sequence
  Description of Artificial Sequence: Synthetic oligonucleotide
  Target: ATXN1; (+) strand; PAM type: YTN; PAM sequence: TTG
ccaactgatttatttgttgc

SEQ ID NO: 262848 - DNA, 20 bp, Artificial Sequence
  Description of Artificial Sequence: Synthetic oligonucleotide
  Target: ATXN1; (+) strand; PAM type: YTN; PAM sequence: CTG
atttatttgttgctgttgtt

SEQ ID NO: 262849 - DNA, 20 bp, Artificial Sequence
  Description of Artificial Sequence: Synthetic oligonucleotide
  Target: ATXN1; (+) strand; PAM type: YTN; PAM sequence: TTT
atttgttgctgttgttgtga

SEQ ID NO: 262850 - DNA, 20 bp, Artificial Sequence
  Description of Artificial Sequence: Synthetic oligonucleotide
  Target: ATXN1; (+) strand; PAM type: YTN; PAM sequence: TTA
tttgttgctgttgttgtgag

SEQ ID NO: 262851 - DNA, 20 bp, Artificial Sequence
  Description of Artificial Sequence: Synthetic oligonucleotide
  Target: ATXN1; (+) strand; PAM type: YTN; PAM sequence: TTT
gttgctgttgttgtgagggt

SEQ ID NO: 262852 - DNA, 20 bp, Artificial Sequence
  Description of Artificial Sequence: Synthetic oligonucleotide
  Target: ATXN1; (+) strand; PAM type: YTN; PAM sequence: TTG
ttgctgttgttgtgagggtt

SEQ ID NO: 262853 - DNA, 20 bp, Artificial Sequence
  Description of Artificial Sequence: Synthetic oligonucleotide
  Target: ATXN1; (+) strand; PAM type: YTN; PAM sequence: TTG
ctgttgttgtgagggttaaa

SEQ ID NO: 262854 - DNA, 20 bp, Artificial Sequence
  Description of Artificial Sequence: Synthetic oligonucleotide
  Target: ATXN1; (+) strand; PAM type: YTN; PAM sequence: CTG
ttgttgtgagggttaaaggg

SEQ ID NO: 262855 - DNA, 20 bp, Artificial Sequence
  Description of Artificial Sequence: Synthetic oligonucleotide
  Target: ATXN1; (+) strand; PAM type: YTN; PAM sequence: TTG
ttgtgagggttaaaggggat

SEQ ID NO: 262856 - DNA, 20 bp, Artificial Sequence
  Description of Artificial Sequence: Synthetic oligonucleotide
  Target: ATXN1; (+) strand; PAM type: YTN; PAM sequence: TTG
tgagggttaaaggggatagc

SEQ ID NO: 262857 - DNA, 20 bp, Artificial Sequence
  Description of Artificial Sequence: Synthetic oligonucleotide
  Target: ATXN1; (+) strand; PAM type: YTN; PAM sequence: TTA
aaggggatagcaagagttct

SEQ ID NO: 262858 - DNA, 20 bp, Artificial Sequence
  Description of Artificial Sequence: Synthetic oligonucleotide
  Target: ATXN1; (+) strand; PAM type: YTN; PAM sequence: TTC
ttctgaagttagattcttag

SEQ ID NO: 262859 - DNA, 20 bp, Artificial Sequence
  Description of Artificial Sequence: Synthetic oligonucleotide
  Target: ATXN1; (+) strand; PAM type: YTN; PAM sequence: CTT
ctgaagttagattcttagtt

SEQ ID NO: 262860 - DNA, 20 bp, Artificial Sequence
  Description of Artificial Sequence: Synthetic oligonucleotide
  Target: ATXN1; (+) strand; PAM type: YTN; PAM sequence: TTC
tgaagttagattcttagtta

SEQ ID NO: 262861 - DNA, 20 bp, Artificial Sequence
  Description of Artificial Sequence: Synthetic oligonucleotide
  Target: ATXN1; (+) strand; PAM type: YTN; PAM sequence: CTG
aagttagattcttagttacc

SEQ ID NO: 262862 - DNA, 20 bp, Artificial Sequence
  Description of Artificial Sequence: Synthetic oligonucleotide
  Target: ATXN1; (+) strand; PAM type: YTN; PAM sequence: TTA
gattcttagttaccccgtta

SEQ ID NO: 262863 - DNA, 20 bp, Artificial Sequence
  Description of Artificial Sequence: Synthetic oligonucleotide
  Target: ATXN1; (+) strand; PAM type: YTN; PAM sequence: TTC
ttagttaccccgttaatcaa

SEQ ID NO: 262864 - DNA, 20 bp, Artificial Sequence
  Description of Artificial Sequence: Synthetic oligonucleotide
  Target: ATXN1; (+) strand; PAM type: YTN; PAM sequence: CTT
agttaccccgttaatcaaat

SEQ ID NO: 262865 - DNA, 20 bp, Artificial Sequence
  Description of Artificial Sequence: Synthetic oligonucleotide
  Target: ATXN1; (+) strand; PAM type: YTN; PAM sequence: TTA
gttaccccgttaatcaaatg

SEQ ID NO: 262866 - DNA, 20 bp, Artificial Sequence
  Description of Artificial Sequence: Synthetic oligonucleotide
  Target: ATXN1; (+) strand; PAM type: YTN; PAM sequence: TTA
ccccgttaatcaaatgtaac

SEQ ID NO: 262867 - DNA, 20 bp, Artificial Sequence
  Description of Artificial Sequence: Synthetic oligonucleotide
  Target: ATXN1; (+) strand; PAM type: YTN; PAM sequence: TTA
atcaaatgtaacttccatcc

SEQ ID NO: 262868 - DNA, 20 bp, Artificial Sequence
  Description of Artificial Sequence: Synthetic oligonucleotide
  Target: ATXN1; (+) strand; PAM type: YTN; PAM sequence: CTT
ccatcctggcattgccacaa

SEQ ID NO: 262869 - DNA, 20 bp, Artificial Sequence
  Description of Artificial Sequence: Synthetic oligonucleotide
  Target: ATXN1; (+) strand; PAM type: YTN; PAM sequence: TTC
catcctggcattgccacaac

SEQ ID NO: 262870 - DNA, 20 bp, Artificial Sequence
  Description of Artificial Sequence: Synthetic oligonucleotide
  Target: ATXN1; (+) strand; PAM type: YTN; PAM sequence: CTG
gcattgccacaactactaat

SEQ ID NO: 262871 - DNA, 20 bp, Artificial Sequence
  Description of Artificial Sequence: Synthetic oligonucleotide
  Target: ATXN1; (+) strand; PAM type: YTN; PAM sequence: TTG
ccacaactactaatgggcca

SEQ ID NO: 262872 - DNA, 20 bp, Artificial Sequence
  Description of Artificial Sequence: Synthetic oligonucleotide
  Target: ATXN1; (+) strand; PAM type: YTN; PAM sequence: CTA
ctaatgggccagaccatact

SEQ ID NO: 262873 - DNA, 20 bp, Artificial Sequence
  Description of Artificial Sequence: Synthetic oligonucleotide
  Target: ATXN1; (+) strand; PAM type: YTN; PAM sequence: CTA
atgggccagaccatactgcc

SEQ ID NO: 262874 - DNA, 20 bp, Artificial Sequence
  Description of Artificial Sequence: Synthetic oligonucleotide
  Target: ATXN1; (+) strand; PAM type: YTN; PAM sequence: CTG
ccaggcttgtgtagatctca

SEQ ID NO: 262875 - DNA, 20 bp, Artificial Sequence
  Description of Artificial Sequence: Synthetic oligonucleotide
  Target: ATXN1; (+) strand; PAM type: YTN; PAM sequence: CTT
gtgtagatctcaaaataaag

SEQ ID NO: 262876 - DNA, 20 bp, Artificial Sequence
  Description of Artificial Sequence: Synthetic oligonucleotide
  Target: ATXN1; (+) strand; PAM type: YTN; PAM sequence: TTG
tgtagatctcaaaataaagg

SEQ ID NO: 262877 - DNA, 20 bp, Artificial Sequence
  Description of Artificial Sequence: Synthetic oligonucleotide
  Target: ATXN1; (+) strand; PAM type: YTN; PAM sequence: CTC
aaaataaaggtatcccgtca

SEQ ID NO: 262878 - DNA, 20 bp, Artificial Sequence
  Description of Artificial Sequence: Synthetic oligonucleotide
  Target: ATXN1; (+) strand; PAM type: YTN; PAM sequence: CTC
agtgacatcctgtttctcag

SEQ ID NO: 262879 - DNA, 20 bp, Artificial Sequence
  Description of Artificial Sequence: Synthetic oligonucleotide
  Target: ATXN1; (+) strand; PAM type: YTN; PAM sequence: CTG
tttctcaggtagaaaggttg

SEQ ID NO: 262880 - DNA, 20 bp, Artificial Sequence
  Description of Artificial Sequence: Synthetic oligonucleotide
  Target: ATXN1; (+) strand; PAM type: YTN; PAM sequence: TTT
ctcaggtagaaaggttgtag

SEQ ID NO: 262881 - DNA, 20 bp, Artificial Sequence
  Description of Artificial Sequence: Synthetic oligonucleotide
  Target: ATXN1; (+) strand; PAM type: YTN; PAM sequence: TTC
tcaggtagaaaggttgtagc

SEQ ID NO: 262882 - DNA, 20 bp, Artificial Sequence
  Description of Artificial Sequence: Synthetic oligonucleotide
  Target: ATXN1; (+) strand; PAM type: YTN; PAM sequence: CTC
aggtagaaaggttgtagcgc

SEQ ID NO: 262883 - DNA, 20 bp, Artificial Sequence
  Description of Artificial Sequence: Synthetic oligonucleotide
  Target: ATXN1; (+) strand; PAM type: YTN; PAM sequence: TTG
tagcgctaccattgcttttt

SEQ ID NO: 262884 - DNA, 20 bp, Artificial Sequence
  Description of Artificial Sequence: Synthetic oligonucleotide
  Target: ATXN1; (+) strand; PAM type: YTN; PAM sequence: CTA
ccattgctttttttaaacat

SEQ ID NO: 262885 - DNA, 20 bp, Artificial Sequence
  Description of Artificial Sequence: Synthetic oligonucleotide
  Target: ATXN1; (+) strand; PAM type: YTN; PAM sequence: TTG
ctttttttaaacatataaac

SEQ ID NO: 262886 - DNA, 20 bp, Artificial Sequence
  Description of Artificial Sequence: Synthetic oligonucleotide
  Target: ATXN1; (+) strand; PAM type: YTN; PAM sequence: CTT
tttttaaacatataaactta

SEQ ID NO: 262887 - DNA, 20 bp, Artificial Sequence
  Description of Artificial Sequence: Synthetic oligonucleotide
  Target: ATXN1; (+) strand; PAM type: YTN; PAM sequence: TTT
ttttaaacatataaacttaa

SEQ ID NO: 262888 - DNA, 20 bp, Artificial Sequence
  Description of Artificial Sequence: Synthetic oligonucleotide
  Target: ATXN1; (+) strand; PAM type: YTN; PAM sequence: TTT
tttaaacatataaacttaag

SEQ ID NO: 262889 - DNA, 20 bp, Artificial Sequence
  Description of Artificial Sequence: Synthetic oligonucleotide
  Target: ATXN1; (+) strand; PAM type: YTN; PAM sequence: TTT
ttaaacatataaacttaagt

SEQ ID NO: 262890 - DNA, 20 bp, Artificial Sequence
  Description of Artificial Sequence: Synthetic oligonucleotide
  Target: ATXN1; (+) strand; PAM type: YTN; PAM sequence: TTT
taaacatataaacttaagtt

SEQ ID NO: 262891 - DNA, 20 bp, Artificial Sequence
  Description of Artificial Sequence: Synthetic oligonucleotide
  Target: ATXN1; (+) strand; PAM type: YTN; PAM sequence: TTT
aaacatataaacttaagttc

SEQ ID NO: 262892 - DNA, 20 bp, Artificial Sequence
  Description of Artificial Sequence: Synthetic oligonucleotide
  Target: ATXN1; (+) strand; PAM type: YTN; PAM sequence: TTA
aacatataaacttaagttct

SEQ ID NO: 262893 - DNA, 20 bp, Artificial Sequence
  Description of Artificial Sequence: Synthetic oligonucleotide
  Target: ATXN1; (+) strand; PAM type: YTN; PAM sequence: CTT
aagttctccctacgtccact

SEQ ID NO: 262894 - DNA, 20 bp, Artificial Sequence
  Description of Artificial Sequence: Synthetic oligonucleotide
  Target: ATXN1; (+) strand; PAM type: YTN; PAM sequence: TTA
agttctccctacgtccactt

SEQ ID NO: 262895 - DNA, 20 bp, Artificial Sequence
  Description of Artificial Sequence: Synthetic oligonucleotide
  Target: ATXN1; (+) strand; PAM type: YTN; PAM sequence: TTC
tccctacgtccacttgcatg

SEQ ID NO: 262896 - DNA, 20 bp, Artificial Sequence
  Description of Artificial Sequence: Synthetic oligonucleotide
  Target: ATXN1; (+) strand; PAM type: YTN; PAM sequence: CTC
cctacgtccacttgcatgaa

SEQ ID NO: 262897 - DNA, 20 bp, Artificial Sequence
  Description of Artificial Sequence: Synthetic oligonucleotide
  Target: ATXN1; (+) strand; PAM type: YTN; PAM sequence: CTA
cgtccacttgcatgaaattt

SEQ ID NO: 262898 - DNA, 20 bp, Artificial Sequence
  Description of Artificial Sequence: Synthetic oligonucleotide
  Target: ATXN1; (+) strand; PAM type: YTN; PAM sequence: CTT
gcatgaaatttcacaagtga

SEQ ID NO: 262899 - DNA, 20 bp, Artificial Sequence
  Description of Artificial Sequence: Synthetic oligonucleotide
  Target: ATXN1; (+) strand; PAM type: YTN; PAM sequence: TTG
catgaaatttcacaagtgag

SEQ ID NO: 262900 - DNA, 20 bp, Artificial Sequence
  Description of Artificial Sequence: Synthetic oligonucleotide
  Target: ATXN1; (+) strand; PAM type: YTN; PAM sequence: TTT
cacaagtgagcaccctagta

SEQ ID NO: 262901 - DNA, 20 bp, Artificial Sequence
  Description of Artificial Sequence: Synthetic oligonucleotide
  Target: ATXN1; (+) strand; PAM type: YTN; PAM sequence: TTC
acaagtgagcaccctagtac

SEQ ID NO: 262902 - DNA, 20 bp, Artificial Sequence
  Description of Artificial Sequence: Synthetic oligonucleotide
  Target: ATXN1; (+) strand; PAM type: YTN; PAM sequence: CTA
gtacagcatgagtgtatcat

SEQ ID NO: 262903 - DNA, 20 bp, Artificial Sequence
  Description of Artificial Sequence: Synthetic oligonucleotide
  Target: ATXN1; (+) strand; PAM type: YTN; PAM sequence: TTA
acggccaagaccagacaaaa

SEQ ID NO: 262904 - DNA, 20 bp, Artificial Sequence
  Description of Artificial Sequence: Synthetic oligonucleotide
  Target: ATXN1; (+) strand; PAM type: YTN; PAM sequence: CTG
agttcttgtcctcagtgaat

SEQ ID NO: 262905 - DNA, 20 bp, Artificial Sequence
  Description of Artificial Sequence: Synthetic oligonucleotide
  Target: ATXN1; (+) strand; PAM type: YTN; PAM sequence: TTC
ttgtcctcagtgaattttgg

SEQ ID NO: 262906 - DNA, 20 bp, Artificial Sequence
  Description of Artificial Sequence: Synthetic oligonucleotide
  Target: ATXN1; (+) strand; PAM type: YTN; PAM sequence: CTT
gtcctcagtgaattttggta

SEQ ID NO: 262907 - DNA, 20 bp, Artificial Sequence
  Description of Artificial Sequence: Synthetic oligonucleotide
  Target: ATXN1; (+) strand; PAM type: YTN; PAM sequence: TTG
tcctcagtgaattttggtat

SEQ ID NO: 262908 - DNA, 20 bp, Artificial Sequence
  Description of Artificial Sequence: Synthetic oligonucleotide
  Target: ATXN1; (+) strand; PAM type: YTN; PAM sequence: CTC
agtgaattttggtatgtaat

SEQ ID NO: 262909 - DNA, 20 bp, Artificial Sequence
  Description of Artificial Sequence: Synthetic oligonucleotide
  Target: ATXN1; (+) strand; PAM type: YTN; PAM sequence: TTT
tggtatgtaataaataaaca

SEQ ID NO: 262910 - DNA, 20 bp, Artificial Sequence
  Description of Artificial Sequence: Synthetic oligonucleotide
  Target: ATXN1; (+) strand; PAM type: YTN; PAM sequence: TTT
ggtatgtaataaataaacat

SEQ ID NO: 262911 - DNA, 20 bp, Artificial Sequence
  Description of Artificial Sequence: Synthetic oligonucleotide
  Target: ATXN1; (+) strand; PAM type: YTN; PAM sequence: TTG
gtatgtaataaataaacatg

SEQ ID NO: 262912 - DNA, 20 bp, Artificial Sequence
  Description of Artificial Sequence: Synthetic oligonucleotide
  Target: ATXN1; (+) strand; PAM type: YTN; PAM sequence: TTA
aattattggcattaaactgt

SEQ ID NO: 262913 - DNA, 20 bp, Artificial Sequence
  Description of Artificial Sequence: Synthetic oligonucleotide
  Target: ATXN1; (+) strand; PAM type: YTN; PAM sequence: TTA
ttggcattaaactgtcagac

SEQ ID NO: 262914 - DNA, 20 bp, Artificial Sequence
  Description of Artificial Sequence: Synthetic oligonucleotide
  Target: ATXN1; (+) strand; PAM type: YTN; PAM sequence: TTG
gcattaaactgtcagacata

SEQ ID NO: 262915 - DNA, 20 bp, Artificial Sequence
  Description of Artificial Sequence: Synthetic oligonucleotide
  Target: ATXN1; (+) strand; PAM type: YTN; PAM sequence: TTA
aactgtcagacataccatgc

SEQ ID NO: 262916 - DNA, 20 bp, Artificial Sequence
  Description of Artificial Sequence: Synthetic oligonucleotide
  Target: ATXN1; (+) strand; PAM type: YTN; PAM sequence: CTG
tcagacataccatgcttatg

SEQ ID NO: 262917 - DNA, 20 bp, Artificial Sequence
  Description of Artificial Sequence: Synthetic oligonucleotide
  Target: ATXN1; (+) strand; PAM type: YTN; PAM sequence: CTT
atggtagccaatgtcagaga

SEQ ID NO: 262918 - DNA, 20 bp, Artificial Sequence
  Description of Artificial Sequence: Synthetic oligonucleotide
  Target: ATXN1; (+) strand; PAM type: YTN; PAM sequence: TTA
tggtagccaatgtcagagat

SEQ ID NO: 262919 - DNA, 20 bp, Artificial Sequence
  Description of Artificial Sequence: Synthetic oligonucleotide
  Target: ATXN1; (+) strand; PAM type: YTN; PAM sequence: TTA
aatctaaagttcaagattgg

SEQ ID NO: 262920 - DNA, 20 bp, Artificial Sequence
  Description of Artificial Sequence: Synthetic oligonucleotide
  Target: ATXN1; (+) strand; PAM type: YTN; PAM sequence: CTA
aagttcaagattggacccac

SEQ ID NO: 262921 - DNA, 20 bp, Artificial Sequence
  Description of Artificial Sequence: Synthetic oligonucleotide
  Target: ATXN1; (+) strand; PAM type: YTN; PAM sequence: TTC
aagattggacccaccatgca

SEQ ID NO: 262922 - DNA, 20 bp, Artificial Sequence
  Description of Artificial Sequence: Synthetic oligonucleotide
  Target: ATXN1; (+) strand; PAM type: YTN; PAM sequence: TTG
gacccaccatgcaaagcaaa

SEQ ID NO: 262923 - DNA, 20 bp, Artificial Sequence
  Description of Artificial Sequence: Synthetic oligonucleotide
  Target: ATXN1; (+) strand; PAM type: YTN; PAM sequence: TTT
cttccttctaaaattgaaag

SEQ ID NO: 262924 - DNA, 20 bp, Artificial Sequence
  Description of Artificial Sequence: Synthetic oligonucleotide
  Target: ATXN1; (+) strand; PAM type: YTN; PAM sequence: TTC
ttccttctaaaattgaaaga

SEQ ID NO: 262925 - DNA, 20 bp, Artificial Sequence
  Description of Artificial Sequence: Synthetic oligonucleotide
  Target: ATXN1; (+) strand; PAM type: YTN; PAM sequence: CTT
ccttctaaaattgaaagaga

SEQ ID NO: 262926 - DNA, 20 bp, Artificial Sequence
  Description of Artificial Sequence: Synthetic oligonucleotide
  Target: ATXN1; (+) strand; PAM type: YTN; PAM sequence: TTC
cttctaaaattgaaagagat

SEQ ID NO: 262927 - DNA, 20 bp, Artificial Sequence
  Description of Artificial Sequence: Synthetic oligonucleotide
  Target: ATXN1; (+) strand; PAM type: YTN; PAM sequence: CTT
ctaaaattgaaagagatgag

SEQ ID NO: 262928 - DNA, 20 bp, Artificial Sequence
  Description of Artificial Sequence: Synthetic oligonucleotide
  Target: ATXN1; (+) strand; PAM type: YTN; PAM sequence: TTC
taaaattgaaagagatgagc

SEQ ID NO: 262929 - DNA, 20 bp, Artificial Sequence
  Description of Artificial Sequence: Synthetic oligonucleotide
  Target: ATXN1; (+) strand; PAM type: YTN; PAM sequence: CTA
aaattgaaagagatgagccc

SEQ ID NO: 262930 - DNA, 20 bp, Artificial Sequence
  Description of Artificial Sequence: Synthetic oligonucleotide
  Target: ATXN1; (+) strand; PAM type: YTN; PAM sequence: TTG
aaagagatgagccctccctc

SEQ ID NO: 262931 - DNA, 20 bp, Artificial Sequence
  Description of Artificial Sequence: Synthetic oligonucleotide
  Target: ATXN1; (+) strand; PAM type: YTN; PAM sequence: CTC
cctcaggcttatgagtttct

SEQ ID NO: 262932 - DNA, 20 bp, Artificial Sequence
  Description of Artificial Sequence: Synthetic oligonucleotide
  Target: ATXN1; (+) strand; PAM type: YTN; PAM sequence: CTC
aggcttatgagtttcttctt

SEQ ID NO: 262933 - DNA, 20 bp, Artificial Sequence
  Description of Artificial Sequence: Synthetic oligonucleotide
  Target: ATXN1; (+) strand; PAM type: YTN; PAM sequence: CTT
atgagtttcttcttcttctt

SEQ ID NO: 262934 - DNA, 20 bp, Artificial Sequence
  Description of Artificial Sequence: Synthetic oligonucleotide
  Target: ATXN1; (+) strand; PAM type: YTN; PAM sequence: TTA
tgagtttcttcttcttcttg

SEQ ID NO: 262935 - DNA, 20 bp, Artificial Sequence
  Description of Artificial Sequence: Synthetic oligonucleotide
  Target: ATXN1; (+) strand; PAM type: YTN; PAM sequence: TTT
cttcttcttcttgtttttta

SEQ ID NO: 262936 - DNA, 20 bp, Artificial Sequence
  Description of Artificial Sequence: Synthetic oligonucleotide
  Target: ATXN1; (+) strand; PAM type: YTN; PAM sequence: TTC
ttcttcttcttgttttttaa

SEQ ID NO: 262937 - DNA, 20 bp, Artificial Sequence
  Description of Artificial Sequence: Synthetic oligonucleotide
  Target: ATXN1; (+) strand; PAM type: YTN; PAM sequence: CTT
cttcttcttgttttttaagt

SEQ ID NO: 262938 - DNA, 20 bp, Artificial Sequence
  Description of Artificial Sequence: Synthetic oligonucleotide
  Target: ATXN1; (+) strand; PAM type: YTN; PAM sequence: TTC
ttcttcttgttttttaagta

SEQ ID NO: 262939 - DNA, 20 bp, Artificial Sequence
  Description of Artificial Sequence: Synthetic oligonucleotide
  Target: ATXN1; (+) strand; PAM type: YTN; PAM sequence: CTT
cttcttgttttttaagtaca

SEQ ID NO: 262940 - DNA, 20 bp, Artificial Sequence
  Description of Artificial Sequence: Synthetic oligonucleotide
  Target: ATXN1; (+) strand; PAM type: YTN; PAM sequence: TTC
ttcttgttttttaagtacat

SEQ ID NO: 262941 - DNA, 20 bp, Artificial Sequence
  Description of Artificial Sequence: Synthetic oligonucleotide
  Target: ATXN1; (+) strand; PAM type: YTN; PAM sequence: CTT
cttgttttttaagtacatca

SEQ ID NO: 262942 - DNA, 20 bp, Artificial Sequence
  Description of Artificial Sequence: Synthetic oligonucleotide
  Target: ATXN1; (+) strand; PAM type: YTN; PAM sequence: TTC
ttgttttttaagtacatcaa

SEQ ID NO: 262943 - DNA, 20 bp, Artificial Sequence
  Description of Artificial Sequence: Synthetic oligonucleotide
  Target: ATXN1; (+) strand; PAM type: YTN; PAM sequence: CTT
gttttttaagtacatcaatg

SEQ ID NO: 262944 - DNA, 20 bp, Artificial Sequence
  Description of Artificial Sequence: Synthetic oligonucleotide
  Target: ATXN1; (+) strand; PAM type: YTN; PAM sequence: TTG
ttttttaagtacatcaatga

SEQ ID NO: 262945 - DNA, 20 bp, Artificial Sequence
  Description of Artificial Sequence: Synthetic oligonucleotide
  Target: ATXN1; (+) strand; PAM type: YTN; PAM sequence: TTT
tttaagtacatcaatgagca

SEQ ID NO: 262946 - DNA, 20 bp, Artificial Sequence
  Description of Artificial Sequence: Synthetic oligonucleotide
  Target: ATXN1; (+) strand; PAM type: YTN; PAM sequence: TTT
ttaagtacatcaatgagcat

SEQ ID NO: 262947 - DNA, 20 bp, Artificial Sequence
  Description of Artificial Sequence: Synthetic oligonucleotide
  Target: ATXN1; (+) strand; PAM type: YTN; PAM sequence: TTT
taagtacatcaatgagcatc

SEQ ID NO: 262948 - DNA, 20 bp, Artificial Sequence
  Description of Artificial Sequence: Synthetic oligonucleotide
  Target: ATXN1; (+) strand; PAM type: YTN; PAM sequence: TTT
aagtacatcaatgagcatct

SEQ ID NO: 262949 - DNA, 20 bp, Artificial Sequence
  Description of Artificial Sequence: Synthetic oligonucleotide
  Target: ATXN1; (+) strand; PAM type: YTN; PAM sequence: TTA
agtacatcaatgagcatctc

SEQ ID NO: 262950 - DNA, 20 bp, Artificial Sequence
  Description of Artificial Sequence: Synthetic oligonucleotide
  Target: ATXN1; (+) strand; PAM type: YTN; PAM sequence: CTC
attaatgttataatttaaaa

SEQ ID NO: 262951 - DNA, 20 bp, Artificial Sequence
  Description of Artificial Sequence: Synthetic oligonucleotide
  Target: ATXN1; (+) strand; PAM type: YTN; PAM sequence: TTA
atgttataatttaaaaagtg

SEQ ID NO: 262952 - DNA, 20 bp, Artificial Sequence
  Description of Artificial Sequence: Synthetic oligonucleotide
  Target: ATXN1; (+) strand; PAM type: YTN; PAM sequence: TTA
taatttaaaaagtgttttct

SEQ ID NO: 262953 - DNA, 20 bp, Artificial Sequence
  Description of Artificial Sequence: Synthetic oligonucleotide
  Target: ATXN1; (+) strand; PAM type: YTN; PAM sequence: TTT
aaaaagtgttttctccctct

SEQ ID NO: 262954 - DNA, 20 bp, Artificial Sequence
  Description of Artificial Sequence: Synthetic oligonucleotide
  Target: ATXN1; (+) strand; PAM type: YTN; PAM sequence: TTA
aaaagtgttttctccctcta

SEQ ID NO: 262955 - DNA, 20 bp, Artificial Sequence
  Description of Artificial Sequence: Synthetic oligonucleotide
  Target: ATXN1; (+) strand; PAM type: YTN; PAM sequence: TTT
tctccctctaatggaagatt

SEQ ID NO: 262956 - DNA, 20 bp, Artificial Sequence
  Description of Artificial Sequence: Synthetic oligonucleotide
  Target: ATXN1; (+) strand; PAM type: YTN; PAM sequence: TTT
ctccctctaatggaagattt

SEQ ID NO: 262957 - DNA, 20 bp, Artificial Sequence
  Description of Artificial Sequence: Synthetic oligonucleotide
  Target: ATXN1; (+) strand; PAM type: YTN; PAM sequence: TTC
tccctctaatggaagattta

SEQ ID NO: 262958 - DNA, 20 bp, Artificial Sequence
  Description of Artificial Sequence: Synthetic oligonucleotide
  Target: ATXN1; (+) strand; PAM type: YTN; PAM sequence: CTC
cctctaatggaagatttagg

SEQ ID NO: 262959 - DNA, 20 bp, Artificial Sequence
  Description of Artificial Sequence: Synthetic oligonucleotide
  Target: ATXN1; (+) strand; PAM type: YTN; PAM sequence: CTC
taatggaagatttaggctag

SEQ ID NO: 262960 - DNA, 20 bp, Artificial Sequence
  Description of Artificial Sequence: Synthetic oligonucleotide
  Target: ATXN1; (+) strand; PAM type: YTN; PAM sequence: CTA
atggaagatttaggctagag

SEQ ID NO: 262961 - DNA, 20 bp, Artificial Sequence
  Description of Artificial Sequence: Synthetic oligonucleotide
  Target: ATXN1; (+) strand; PAM type: YTN; PAM sequence: TTT
aggctagaggaagctatcat

SEQ ID NO: 262962 - DNA, 20 bp, Artificial Sequence
  Description of Artificial Sequence: Synthetic oligonucleotide
  Target: ATXN1; (+) strand; PAM type: YTN; PAM sequence: TTA
ggctagaggaagctatcatt

SEQ ID NO: 262963 - DNA, 20 bp, Artificial Sequence
  Description of Artificial Sequence: Synthetic oligonucleotide
  Target: ATXN1; (+) strand; PAM type: YTN; PAM sequence: CTA
gaggaagctatcattggtcc

SEQ ID NO: 262964 - DNA, 20 bp, Artificial Sequence
  Description of Artificial Sequence: Synthetic oligonucleotide
  Target: ATXN1; (+) strand; PAM type: YTN; PAM sequence: CTA
tcattggtcctccaaatcgc

SEQ ID NO: 262965 - DNA, 20 bp, Artificial Sequence
  Description of Artificial Sequence: Synthetic oligonucleotide
  Target: ATXN1; (+) strand; PAM type: YTN; PAM sequence: TTG
gtcctccaaatcgcaggctt

SEQ ID NO: 262966 - DNA, 20 bp, Artificial Sequence
  Description of Artificial Sequence: Synthetic oligonucleotide
  Target: ATXN1; (+) strand; PAM type: YTN; PAM sequence: CTC
caaatcgcaggcttaccaat

SEQ ID NO: 262967 - DNA, 20 bp, Artificial Sequence
  Description of Artificial Sequence: Synthetic oligonucleotide
  Target: ATXN1; (+) strand; PAM type: YTN; PAM sequence: CTT
accaattaaaaaatgtaaat

SEQ ID NO: 262968 - DNA, 20 bp, Artificial Sequence
  Description of Artificial Sequence: Synthetic oligonucleotide
  Target: ATXN1; (+) strand; PAM type: YTN; PAM sequence: TTA
ccaattaaaaaatgtaaatg

SEQ ID NO: 262969 - DNA, 20 bp, Artificial Sequence
  Description of Artificial Sequence: Synthetic oligonucleotide
  Target: ATXN1; (+) strand; PAM type: YTN; PAM sequence: TTA
aaaaatgtaaatggtttcac

SEQ ID NO: 262970 - DNA, 20 bp, Artificial Sequence
  Description of Artificial Sequence: Synthetic oligonucleotide
  Target: ATXN1; (+) strand; PAM type: YTN; PAM sequence: TTT
cacattgttagcgatatcag

SEQ ID NO: 262971 - DNA, 20 bp, Artificial Sequence
  Description of Artificial Sequence: Synthetic oligonucleotide
  Target: ATXN1; (+) strand; PAM type: YTN; PAM sequence: TTC
acattgttagcgatatcagc

SEQ ID NO: 262972 - DNA, 20 bp, Artificial Sequence
  Description of Artificial Sequence: Synthetic oligonucleotide
  Target: ATXN1; (+) strand; PAM type: YTN; PAM sequence: TTG
ttagcgatatcagctttgaa

SEQ ID NO: 262973 - DNA, 20 bp, Artificial Sequence
  Description of Artificial Sequence: Synthetic oligonucleotide
  Target: ATXN1; (+) strand; PAM type: YTN; PAM sequence: TTA
gcgatatcagctttgaaaga

SEQ ID NO: 262974 - DNA, 20 bp, Artificial Sequence
  Description of Artificial Sequence: Synthetic oligonucleotide
  Target: ATXN1; (+) strand; PAM type: YTN; PAM sequence: CTT
tgaaagaagccatttctttt

SEQ ID NO: 262975 - DNA, 20 bp, Artificial Sequence
  Description of Artificial Sequence: Synthetic oligonucleotide
  Target: ATXN1; (+) strand; PAM type: YTN; PAM sequence: TTT
gaaagaagccatttcttttc

SEQ ID NO: 262976 - DNA, 20 bp, Artificial Sequence
  Description of Artificial Sequence: Synthetic oligonucleotide
  Target: ATXN1; (+) strand; PAM type: YTN; PAM sequence: TTG
aaagaagccatttcttttct

SEQ ID NO: 262977 - DNA, 20 bp, Artificial Sequence
  Description of Artificial Sequence: Synthetic oligonucleotide
  Target: ATXN1; (+) strand; PAM type: YTN; PAM sequence: TTT
cttttcttccttttgtttta

SEQ ID NO: 262978 - DNA, 20 bp, Artificial Sequence
  Description of Artificial Sequence: Synthetic oligonucleotide
  Target: ATXN1; (+) strand; PAM type: YTN; PAM sequence: TTC
ttttcttccttttgttttaa

SEQ ID NO: 262979 - DNA, 20 bp, Artificial Sequence
  Description of Artificial Sequence: Synthetic oligonucleotide
  Target: ATXN1; (+) strand; PAM type: YTN; PAM sequence: CTT
ttcttccttttgttttaagt

SEQ ID NO: 262980 - DNA, 20 bp, Artificial Sequence
  Description of Artificial Sequence: Synthetic oligonucleotide
  Target: ATXN1; (+) strand; PAM type: YTN; PAM sequence: TTT
tcttccttttgttttaagtg

SEQ ID NO: 262981 - DNA, 20 bp, Artificial Sequence
  Description of Artificial Sequence: Synthetic oligonucleotide
  Target: ATXN1; (+) strand; PAM type: YTN; PAM sequence: TTT
cttccttttgttttaagtga

SEQ ID NO: 262982 - DNA, 20 bp, Artificial Sequence
  Description of Artificial Sequence: Synthetic oligonucleotide
  Target: ATXN1; (+) strand; PAM type: YTN; PAM sequence: TTC
ttccttttgttttaagtgaa

SEQ ID NO: 262983 - DNA, 20 bp, Artificial Sequence
  Description of Artificial Sequence: Synthetic oligonucleotide
  Target: ATXN1; (+) strand; PAM type: YTN; PAM sequence: CTT
ccttttgttttaagtgaaca

SEQ ID NO: 262984 - DNA, 20 bp, Artificial Sequence
  Description of Artificial Sequence: Synthetic oligonucleotide
  Target: ATXN1; (+) strand; PAM type: YTN; PAM sequence: TTC
cttttgttttaagtgaacac

SEQ ID NO: 262985 - DNA, 20 bp, Artificial Sequence
  Description of Artificial Sequence: Synthetic oligonucleotide
  Target: ATXN1; (+) strand; PAM type: YTN; PAM sequence: CTT
ttgttttaagtgaacacgtt

SEQ ID NO: 262986 - DNA, 20 bp, Artificial Sequence
  Description of Artificial Sequence: Synthetic oligonucleotide
  Target: ATXN1; (+) strand; PAM type: YTN; PAM sequence: TTT
tgttttaagtgaacacgttt

SEQ ID NO: 262987 - DNA, 20 bp, Artificial Sequence
  Description of Artificial Sequence: Synthetic oligonucleotide
  Target: ATXN1; (+) strand; PAM type: YTN; PAM sequence: TTT
gttttaagtgaacacgtttt

SEQ ID NO: 262988 - DNA, 20 bp, Artificial Sequence
  Description of Artificial Sequence: Synthetic oligonucleotide
  Target: ATXN1; (+) strand; PAM type: YTN; PAM sequence: TTG
ttttaagtgaacacgtttta

SEQ ID NO: 262989 - DNA, 20 bp, Artificial Sequence
  Description of Artificial Sequence: Synthetic oligonucleotide
  Target: ATXN1; (+) strand; PAM type: YTN; PAM sequence: TTT
taagtgaacacgttttaagt

SEQ ID NO: 262990 - DNA, 20 bp, Artificial Sequence
  Description of Artificial Sequence: Synthetic oligonucleotide
  Target: ATXN1; (+) strand; PAM type: YTN; PAM sequence: TTT
aagtgaacacgttttaagtg

SEQ ID NO: 262991 - DNA, 20 bp, Artificial Sequence
  Description of Artificial Sequence: Synthetic oligonucleotide
  Target: ATXN1; (+) strand; PAM type: YTN; PAM sequence: TTA
agtgaacacgttttaagtgg

SEQ ID NO: 262992 - DNA, 20 bp, Artificial Sequence
  Description of Artificial Sequence: Synthetic oligonucleotide
  Target: ATXN1; (+) strand; PAM type: YTN; PAM sequence: TTT
taagtggataagtttaaagg

SEQ ID NO: 262993 - DNA, 20 bp, Artificial Sequence
  Description of Artificial Sequence: Synthetic oligonucleotide
  Target: ATXN1; (+) strand; PAM type: YTN; PAM sequence: TTT
aagtggataagtttaaagga

SEQ ID NO: 262994 - DNA, 20 bp, Artificial Sequence
  Description of Artificial Sequence: Synthetic oligonucleotide
  Target: ATXN1; (+) strand; PAM type: YTN; PAM sequence: TTA
agtggataagtttaaaggaa

SEQ ID NO: 262995 - DNA, 20 bp, Artificial Sequence
  Description of Artificial Sequence: Synthetic oligonucleotide
  Target: ATXN1; (+) strand; PAM type: YTN; PAM sequence: TTT
aaaggaaaacatatcctgag

SEQ ID NO: 262996 - DNA, 20 bp, Artificial Sequence
  Description of Artificial Sequence: Synthetic oligonucleotide
  Target: ATXN1; (+) strand; PAM type: YTN; PAM sequence: TTA
aaggaaaacatatcctgagc

SEQ ID NO: 262997 - DNA, 20 bp, Artificial Sequence
  Description of Artificial Sequence: Synthetic oligonucleotide
  Target: ATXN1; (+) strand; PAM type: YTN; PAM sequence: CTG
agcttgcaaggtaactgttt

SEQ ID NO: 262998 - DNA, 20 bp, Artificial Sequence
  Description of Artificial Sequence: Synthetic oligonucleotide
  Target: ATXN1; (+) strand; PAM type: YTN; PAM sequence: CTT
gcaaggtaactgtttaaaaa

SEQ ID NO: 262999 - DNA, 20 bp, Artificial Sequence
  Description of Artificial Sequence: Synthetic oligonucleotide
  Target: ATXN1; (+) strand; PAM type: YTN; PAM sequence: TTG
caaggtaactgtttaaaaaa

SEQ ID NO: 263000 - DNA, 20 bp, Artificial Sequence
  Description of Artificial Sequence: Synthetic oligonucleotide
  Target: ATXN1; (+) strand; PAM type: YTN; PAM sequence: CTG
tttaaaaaaataaaacaact

SEQ ID NO: 263001 - DNA, 20 bp, Artificial Sequence
  Description of Artificial Sequence: Synthetic oligonucleotide
  Target: ATXN1; (+) strand; PAM type: YTN; PAM sequence: TTT
aaaaaaataaaacaactcat

SEQ ID NO: 263002 - DNA, 20 bp, Artificial Sequence
  Description of Artificial Sequence: Synthetic oligonucleotide
  Target: ATXN1; (+) strand; PAM type: YTN; PAM sequence: TTA
aaaaaataaaacaactcatt

SEQ ID NO: 263003 - DNA, 20 bp, Artificial Sequence
  Description of Artificial Sequence: Synthetic oligonucleotide
  Target: ATXN1; (+) strand; PAM type: YTN; PAM sequence: CTC
attattatttgcaactcctt

SEQ ID NO: 263004 - DNA, 20 bp, Artificial Sequence
  Description of Artificial Sequence: Synthetic oligonucleotide
  Target: ATXN1; (+) strand; PAM type: YTN; PAM sequence: TTA
ttatttgcaactccttattt

SEQ ID NO: 263005 - DNA, 20 bp, Artificial Sequence
  Description of Artificial Sequence: Synthetic oligonucleotide
  Target: ATXN1; (+) strand; PAM type: YTN; PAM sequence: TTA
tttgcaactccttattttag

SEQ ID NO: 263006 - DNA, 20 bp, Artificial Sequence
  Description of Artificial Sequence: Synthetic oligonucleotide
  Target: ATXN1; (+) strand; PAM type: YTN; PAM sequence: TTT
gcaactccttattttaggga

SEQ ID NO: 263007 - DNA, 20 bp, Artificial Sequence
  Description of Artificial Sequence: Synthetic oligonucleotide
  Target: ATXN1; (+) strand; PAM type: YTN; PAM sequence: TTG
caactccttattttagggaa

SEQ ID NO: 263008 - DNA, 20 bp, Artificial Sequence
  Description of Artificial Sequence: Synthetic oligonucleotide
  Target: ATXN1; (+) strand; PAM type: YTN; PAM sequence: CTC
cttattttagggaatcaggg

SEQ ID NO: 263009 - DNA, 20 bp, Artificial Sequence
  Description of Artificial Sequence: Synthetic oligonucleotide
  Target: ATXN1; (+) strand; PAM type: YTN; PAM sequence: CTT
attttagggaatcagggttt

SEQ ID NO: 263010 - DNA, 20 bp, Artificial Sequence
  Description of Artificial Sequence: Synthetic oligonucleotide
  Target: ATXN1; (+) strand; PAM type: YTN; PAM sequence: TTA
ttttagggaatcagggtttt

SEQ ID NO: 263011 - DNA, 20 bp, Artificial Sequence
  Description of Artificial Sequence: Synthetic oligonucleotide
  Target: ATXN1; (+) strand; PAM type: YTN; PAM sequence: TTT
tagggaatcagggttttctc

SEQ ID NO: 263012 - DNA, 20 bp, Artificial Sequence
  Description of Artificial Sequence: Synthetic oligonucleotide
  Target: ATXN1; (+) strand; PAM type: YTN; PAM sequence: TTT
agggaatcagggttttctca

SEQ ID NO: 263013 - DNA, 20 bp, Artificial Sequence
  Description of Artificial Sequence: Synthetic oligonucleotide
  Target: ATXN1; (+) strand; PAM type: YTN; PAM sequence: TTA
gggaatcagggttttctcaa

SEQ ID NO: 263014 - DNA, 20 bp, Artificial Sequence
  Description of Artificial Sequence: Synthetic oligonucleotide
  Target: ATXN1; (+) strand; PAM type: YTN; PAM sequence: TTT
tctcaatactgcacaacaac

SEQ ID NO: 263015 - DNA, 20 bp, Artificial Sequence
  Description of Artificial Sequence: Synthetic oligonucleotide
  Target: ATXN1; (+) strand; PAM type: YTN; PAM sequence: TTT
ctcaatactgcacaacaaca

SEQ ID NO: 263016 - DNA, 20 bp, Artificial Sequence
  Description of Artificial Sequence: Synthetic oligonucleotide
  Target: ATXN1; (+) strand; PAM type: YTN; PAM sequence: TTC
tcaatactgcacaacaacat

SEQ ID NO: 263017 - DNA, 20 bp, Artificial Sequence
  Description of Artificial Sequence: Synthetic oligonucleotide
  Target: ATXN1; (+) strand; PAM type: YTN; PAM sequence: CTC
aatactgcacaacaacataa

SEQ ID NO: 263018 - DNA, 20 bp, Artificial Sequence
  Description of Artificial Sequence: Synthetic oligonucleotide
  Target: ATXN1; (+) strand; PAM type: YTN; PAM sequence: CTG
cacaacaacataaaaaatat

SEQ ID NO: 263019 - DNA, 20 bp, Artificial Sequence
  Description of Artificial Sequence: Synthetic oligonucleotide
  Target: ATXN1; (+) strand; PAM type: YTN; PAM sequence: CTA
acaacaaaaggcaataaatt

SEQ ID NO: 263020 - DNA, 20 bp, Artificial Sequence
  Description of Artificial Sequence: Synthetic oligonucleotide
  Target: ATXN1; (+) strand; PAM type: YTN; PAM sequence: TTG
gaaactgaagttaaagaaga

SEQ ID NO: 263021 - DNA, 20 bp, Artificial Sequence
  Description of Artificial Sequence: Synthetic oligonucleotide
  Target: ATXN1; (+) strand; PAM type: YTN; PAM sequence: CTG
aagttaaagaagattgcagc

SEQ ID NO: 263022 - DNA, 20 bp, Artificial Sequence
  Description of Artificial Sequence: Synthetic oligonucleotide
  Target: ATXN1; (+) strand; PAM type: YTN; PAM sequence: TTA
aagaagattgcagctgtcat

SEQ ID NO: 263023 - DNA, 20 bp, Artificial Sequence
  Description of Artificial Sequence: Synthetic oligonucleotide
  Target: ATXN1; (+) strand; PAM type: YTN; PAM sequence: TTG
cagctgtcatctctaacact

SEQ ID NO: 263024 - DNA, 20 bp, Artificial Sequence
  Description of Artificial Sequence: Synthetic oligonucleotide
  Target: ATXN1; (+) strand; PAM type: YTN; PAM sequence: CTG
tcatctctaacactgctttc

SEQ ID NO: 263025 - DNA, 20 bp, Artificial Sequence
  Description of Artificial Sequence: Synthetic oligonucleotide
  Target: ATXN1; (+) strand; PAM type: YTN; PAM sequence: CTC
taacactgctttcaaatttc

SEQ ID NO: 263026 - DNA, 20 bp, Artificial Sequence
  Description of Artificial Sequence: Synthetic oligonucleotide
  Target: ATXN1; (+) strand; PAM type: YTN; PAM sequence: CTA
acactgctttcaaatttctg

SEQ ID NO: 263027 - DNA, 20 bp, Artificial Sequence
  Description of Artificial Sequence: Synthetic oligonucleotide
  Target: ATXN1; (+) strand; PAM type: YTN; PAM sequence: CTG
ctttcaaatttctgtgttca

SEQ ID NO: 263028 - DNA, 20 bp, Artificial Sequence
  Description of Artificial Sequence: Synthetic oligonucleotide
  Target: ATXN1; (+) strand; PAM type: YTN; PAM sequence: CTT
tcaaatttctgtgttcatca

SEQ ID NO: 263029 - DNA, 20 bp, Artificial Sequence
  Description of Artificial Sequence: Synthetic oligonucleotide
  Target: ATXN1; (+) strand; PAM type: YTN; PAM sequence: TTT
caaatttctgtgttcatcac

SEQ ID NO: 263030 - DNA, 20 bp, Artificial Sequence
  Description of Artificial Sequence: Synthetic oligonucleotide
  Target: ATXN1; (+) strand; PAM type: YTN; PAM sequence: TTC
aaatttctgtgttcatcaca

SEQ ID NO: 263031 - DNA, 20 bp, Artificial Sequence
  Description of Artificial Sequence: Synthetic oligonucleotide
  Target: ATXN1; (+) strand; PAM type: YTN; PAM sequence: TTT
ctgtgttcatcacaaagctt

SEQ ID NO: 263032 - DNA, 20 bp, Artificial Sequence
  Description of Artificial Sequence: Synthetic oligonucleotide
  Target: ATXN1; (+) strand; PAM type: YTN; PAM sequence: TTC
tgtgttcatcacaaagcttc

SEQ ID NO: 263033 - DNA, 20 bp, Artificial Sequence
  Description of Artificial Sequence: Synthetic oligonucleotide
  Target: ATXN1; (+) strand; PAM type: YTN; PAM sequence: CTG
tgttcatcacaaagcttcat

SEQ ID NO: 263034 - DNA, 20 bp, Artificial Sequence
  Description of Artificial Sequence: Synthetic oligonucleotide
  Target: ATXN1; (+) strand; PAM type: YTN; PAM sequence: TTC
atcacaaagcttcattgttc

SEQ ID NO: 263035 - DNA, 20 bp, Artificial Sequence
  Description of Artificial Sequence: Synthetic oligonucleotide
  Target: ATXN1; (+) strand; PAM type: YTN; PAM sequence: CTT
cattgttctttcttcttgat

SEQ ID NO: 263036 - DNA, 20 bp, Artificial Sequence
  Description of Artificial Sequence: Synthetic oligonucleotide
  Target: ATXN1; (+) strand; PAM type: YTN; PAM sequence: TTC
attgttctttcttcttgatt

SEQ ID NO: 263037 - DNA, 20 bp, Artificial Sequence
  Description of Artificial Sequence: Synthetic oligonucleotide
  Target: ATXN1; (+) strand; PAM type: YTN; PAM sequence: TTG
ttctttcttcttgattttat

SEQ ID NO: 263038 - DNA, 20 bp, Artificial Sequence
  Description of Artificial Sequence: Synthetic oligonucleotide
  Target: ATXN1; (+) strand; PAM type: YTN; PAM sequence: TTC
tttcttcttgattttataag

SEQ ID NO: 263039 - DNA, 20 bp, Artificial Sequence
  Description of Artificial Sequence: Synthetic oligonucleotide
  Target: ATXN1; (+) strand; PAM type: YTN; PAM sequence: CTT
tcttcttgattttataagtc

SEQ ID NO: 263040 - DNA, 20 bp, Artificial Sequence
  Description of Artificial Sequence: Synthetic oligonucleotide
  Target: ATXN1; (+) strand; PAM type: YTN; PAM sequence: TTT
cttcttgattttataagtca

SEQ ID NO: 263041 - DNA, 20 bp, Artificial Sequence
  Description of Artificial Sequence: Synthetic oligonucleotide
  Target: ATXN1; (+) strand; PAM type: YTN; PAM sequence: TTC
ttcttgattttataagtcag

SEQ ID NO: 263042 - DNA, 20 bp, Artificial Sequence
  Description of Artificial Sequence: Synthetic oligonucleotide
  Target: ATXN1; (+) strand; PAM type: YTN; PAM sequence: CTT
cttgattttataagtcagca

SEQ ID NO: 263043 - DNA, 20 bp, Artificial Sequence
  Description of Artificial Sequence: Synthetic oligonucleotide
  Target: ATXN1; (+) strand; PAM type: YTN; PAM sequence: TTC
ttgattttataagtcagcat

SEQ ID NO: 263044 - DNA, 20 bp, Artificial Sequence
  Description of Artificial Sequence: Synthetic oligonucleotide
  Target: ATXN1; (+) strand; PAM type: YTN; PAM sequence: CTT
gattttataagtcagcatta

SEQ ID NO: 263045 - DNA, 20 bp, Artificial Sequence
  Description of Artificial Sequence: Synthetic oligonucleotide
  Target: ATXN1; (+) strand; PAM type: YTN; PAM sequence: TTG
attttataagtcagcattac

SEQ ID NO: 263046 - DNA, 20 bp, Artificial Sequence
  Description of Artificial Sequence: Synthetic oligonucleotide
  Target: ATXN1; (+) strand; PAM type: YTN; PAM sequence: TTT
tataagtcagcattacacgc

SEQ ID NO: 263047 - DNA, 20 bp, Artificial Sequence
  Description of Artificial Sequence: Synthetic oligonucleotide
  Target: ATXN1; (+) strand; PAM type: YTN; PAM sequence: TTT
ataagtcagcattacacgct

SEQ ID NO: 263048 - DNA, 20 bp, Artificial Sequence
  Description of Artificial Sequence: Synthetic oligonucleotide
  Target: ATXN1; (+) strand; PAM type: YTN; PAM sequence: TTA
taagtcagcattacacgctg

SEQ ID NO: 263049 - DNA, 20 bp, Artificial Sequence
  Description of Artificial Sequence: Synthetic oligonucleotide
  Target: ATXN1; (+) strand; PAM type: YTN; PAM sequence: TTA
cacgctgaaatctaacatac

SEQ ID NO: 263050 - DNA, 20 bp, Artificial Sequence
  Description of Artificial Sequence: Synthetic oligonucleotide
  Target: ATXN1; (+) strand; PAM type: YTN; PAM sequence: CTG
aaatctaacatacattatgc

SEQ ID NO: 263051 - DNA, 20 bp, Artificial Sequence
  Description of Artificial Sequence: Synthetic oligonucleotide
  Target: ATXN1; (+) strand; PAM type: YTN; PAM sequence: CTA
acatacattatgctaacaaa

SEQ ID NO: 263052 - DNA, 20 bp, Artificial Sequence
  Description of Artificial Sequence: Synthetic oligonucleotide
  Target: ATXN1; (+) strand; PAM type: YTN; PAM sequence: TTA
tgctaacaaaattttccttt

SEQ ID NO: 263053 - DNA, 20 bp, Artificial Sequence
  Description of Artificial Sequence: Synthetic oligonucleotide
  Target: ATXN1; (+) strand; PAM type: YTN; PAM sequence: CTA
acaaaattttcctttattcg

SEQ ID NO: 263054 - DNA, 20 bp, Artificial Sequence
  Description of Artificial Sequence: Synthetic oligonucleotide
  Target: ATXN1; (+) strand; PAM type: YTN; PAM sequence: TTT
tcctttattcgtttcatatg

SEQ ID NO: 263055 - DNA, 20 bp, Artificial Sequence
  Description of Artificial Sequence: Synthetic oligonucleotide
  Target: ATXN1; (+) strand; PAM type: YTN; PAM sequence: TTT
cctttattcgtttcatatgt

SEQ ID NO: 263056 - DNA, 20 bp, Artificial Sequence
  Description of Artificial Sequence: Synthetic oligonucleotide
  Target: ATXN1; (+) strand; PAM type: YTN; PAM sequence: TTC
ctttattcgtttcatatgtt

SEQ ID NO: 263057 - DNA, 20 bp, Artificial Sequence
  Description of Artificial Sequence: Synthetic oligonucleotide
  Target: ATXN1; (+) strand; PAM type: YTN; PAM sequence: CTT
tattcgtttcatatgttgag

SEQ ID NO: 263058 - DNA, 20 bp, Artificial Sequence
  Description of Artificial Sequence: Synthetic oligonucleotide
  Target: ATXN1; (+) strand; PAM type: YTN; PAM sequence: TTT
attcgtttcatatgttgagg

SEQ ID NO: 263059 - DNA, 20 bp, Artificial Sequence
  Description of Artificial Sequence: Synthetic oligonucleotide
  Target: ATXN1; (+) strand; PAM type: YTN; PAM sequence: TTA
ttcgtttcatatgttgaggt

SEQ ID NO: 263060 - DNA, 20 bp, Artificial Sequence
  Description of Artificial Sequence: Synthetic oligonucleotide
  Target: ATXN1; (+) strand; PAM type: YTN; PAM sequence: TTC
gtttcatatgttgaggtttc

SEQ ID NO: 263061 - DNA, 20 bp, Artificial Sequence
  Description of Artificial Sequence: Synthetic oligonucleotide
  Target: ATXN1; (+) strand; PAM type: YTN; PAM sequence: TTT
catatgttgaggtttcaaga

SEQ ID NO: 263062 - DNA, 20 bp, Artificial Sequence
  Description of Artificial Sequence: Synthetic oligonucleotide
  Target: ATXN1; (+) strand; PAM type: YTN; PAM sequence: TTC
atatgttgaggtttcaagat

SEQ ID NO: 263063 - DNA, 20 bp, Artificial Sequence
  Description of Artificial Sequence: Synthetic oligonucleotide
  Target: ATXN1; (+) strand; PAM type: YTN; PAM sequence: TTG
aggtttcaagattgtgtttg

SEQ ID NO: 263064 - DNA, 20 bp, Artificial Sequence
  Description of Artificial Sequence: Synthetic oligonucleotide
  Target: ATXN1; (+) strand; PAM type: YTN; PAM sequence: TTT
caagattgtgtttgaaaaag

SEQ ID NO: 263065 - DNA, 20 bp, Artificial Sequence
  Description of Artificial Sequence: Synthetic oligonucleotide
  Target: ATXN1; (+) strand; PAM type: YTN; PAM sequence: TTC
aagattgtgtttgaaaaaga

SEQ ID NO: 263066 - DNA, 20 bp, Artificial Sequence
  Description of Artificial Sequence: Synthetic oligonucleotide
  Target: ATXN1; (+) strand; PAM type: YTN; PAM sequence: TTG
tgtttgaaaaagaagtagag

SEQ ID NO: 263067 - DNA, 20 bp, Artificial Sequence
  Description of Artificial Sequence: Synthetic oligonucleotide
  Target: ATXN1; (+) strand; PAM type: YTN; PAM sequence: TTT
gaaaaagaagtagagactaa

SEQ ID NO: 263068 - DNA, 20 bp, Artificial Sequence
  Description of Artificial Sequence: Synthetic oligonucleotide
  Target: ATXN1; (+) strand; PAM type: YTN; PAM sequence: TTG
aaaaagaagtagagactaaa

SEQ ID NO: 263069 - DNA, 20 bp, Artificial Sequence
  Description of Artificial Sequence: Synthetic oligonucleotide
  Target: ATXN1; (+) strand; PAM type: YTN; PAM sequence: CTA
aaaatatttgtaaacctcca

SEQ ID NO: 263070 - DNA, 20 bp, Artificial Sequence
  Description of Artificial Sequence: Synthetic oligonucleotide
  Target: ATXN1; (+) strand; PAM type: YTN; PAM sequence: TTT
gtaaacctccaagtaaaggc

SEQ ID NO: 263071 - DNA, 20 bp, Artificial Sequence
  Description of Artificial Sequence: Synthetic oligonucleotide
  Target: ATXN1; (+) strand; PAM type: YTN; PAM sequence: TTG
taaacctccaagtaaaggca

SEQ ID NO: 263072 - DNA, 20 bp, Artificial Sequence
  Description of Artificial Sequence: Synthetic oligonucleotide
  Target: ATXN1; (+) strand; PAM type: YTN; PAM sequence: CTC
caagtaaaggcaatgaatga

SEQ ID NO: 263073 - DNA, 20 bp, Artificial Sequence
  Description of Artificial Sequence: Synthetic oligonucleotide
  Target: ATXN1; (+) strand; PAM type: YTN; PAM sequence: TTT
gtacctgtgggtgatcactg

SEQ ID NO: 263074 - DNA, 20 bp, Artificial Sequence
  Description of Artificial Sequence: Synthetic oligonucleotide
  Target: ATXN1; (+) strand; PAM type: YTN; PAM sequence: TTG
tacctgtgggtgatcactgc

SEQ ID NO: 263075 - DNA, 20 bp, Artificial Sequence
  Description of Artificial Sequence: Synthetic oligonucleotide
  Target: ATXN1; (+) strand; PAM type: YTN; PAM sequence: CTG
tgggtgatcactgccatagc

SEQ ID NO: 263076 - DNA, 20 bp, Artificial Sequence
  Description of Artificial Sequence: Synthetic oligonucleotide
  Target: ATXN1; (+) strand; PAM type: YTN; PAM sequence: CTG
ccatagctatataatgccta

SEQ ID NO: 263077 - DNA, 20 bp, Artificial Sequence
  Description of Artificial Sequence: Synthetic oligonucleotide
  Target: ATXN1; (+) strand; PAM type: YTN; PAM sequence: CTA
tataatgcctaaatacagga

SEQ ID NO: 263078 - DNA, 20 bp, Artificial Sequence
  Description of Artificial Sequence: Synthetic oligonucleotide
  Target: ATXN1; (+) strand; PAM type: YTN; PAM sequence: CTA
aatacaggaaagagaagcaa

SEQ ID NO: 263079 - DNA, 20 bp, Artificial Sequence
  Description of Artificial Sequence: Synthetic oligonucleotide
  Target: ATXN1; (+) strand; PAM type: YTN; PAM sequence: TTT
acaaaaaccggtccttgtgg

SEQ ID NO: 263080 - DNA, 20 bp, Artificial Sequence
  Description of Artificial Sequence: Synthetic oligonucleotide
  Target: ATXN1; (+) strand; PAM type: YTN; PAM sequence: TTA
caaaaaccggtccttgtggg

SEQ ID NO: 263081 - DNA, 20 bp, Artificial Sequence
  Description of Artificial Sequence: Synthetic oligonucleotide
  Target: ATXN1; (+) strand; PAM type: YTN; PAM sequence: CTT
gtgggaactatgctccccta

SEQ ID NO: 263082 - DNA, 20 bp, Artificial Sequence
  Description of Artificial Sequence: Synthetic oligonucleotide
  Target: ATXN1; (+) strand; PAM type: YTN; PAM sequence: TTG
tgggaactatgctcccctat

SEQ ID NO: 263083 - DNA, 20 bp, Artificial Sequence
  Description of Artificial Sequence: Synthetic oligonucleotide
  Target: ATXN1; (+) strand; PAM type: YTN; PAM sequence: CTA
tgctcccctatatgattgca

SEQ ID NO: 263084 - DNA, 20 bp, Artificial Sequence
  Description of Artificial Sequence: Synthetic oligonucleotide
  Target: ATXN1; (+) strand; PAM type: YTN; PAM sequence: CTC
ccctatatgattgcaaacac

SEQ ID NO: 263085 - DNA, 20 bp, Artificial Sequence
  Description of Artificial Sequence: Synthetic oligonucleotide
  Target: ATXN1; (+) strand; PAM type: YTN; PAM sequence: CTA
tatgattgcaaacactcaga

SEQ ID NO: 263086 - DNA, 20 bp, Artificial Sequence
  Description of Artificial Sequence: Synthetic oligonucleotide
  Target: ATXN1; (+) strand; PAM type: YTN; PAM sequence: TTG
caaacactcagatataagta

SEQ ID NO: 263087 - DNA, 20 bp, Artificial Sequence
  Description of Artificial Sequence: Synthetic oligonucleotide
  Target: ATXN1; (+) strand; PAM type: YTN; PAM sequence: CTC
agatataagtaatatatgaa

SEQ ID NO: 263088 - DNA, 20 bp, Artificial Sequence
  Description of Artificial Sequence: Synthetic oligonucleotide
  Target: ATXN1; (+) strand; PAM type: YTN; PAM sequence: CTT
acttaatcttcctcttcttt

SEQ ID NO: 263089 - DNA, 20 bp, Artificial Sequence
  Description of Artificial Sequence: Synthetic oligonucleotide
  Target: ATXN1; (+) strand; PAM type: YTN; PAM sequence: TTA
cttaatcttcctcttctttt

SEQ ID NO: 263090 - DNA, 20 bp, Artificial Sequence
  Description of Artificial Sequence: Synthetic oligonucleotide
  Target: ATXN1; (+) strand; PAM type: YTN; PAM sequence: CTT
aatcttcctcttctttttca

SEQ ID NO: 263091 - DNA, 20 bp, Artificial Sequence
  Description of Artificial Sequence: Synthetic oligonucleotide
  Target: ATXN1; (+) strand; PAM type: YTN; PAM sequence: TTA
atcttcctcttctttttcac

SEQ ID NO: 263092 - DNA, 20 bp, Artificial Sequence
  Description of Artificial Sequence: Synthetic oligonucleotide
  Target: ATXN1; (+) strand; PAM type: YTN; PAM sequence: CTT
cctcttctttttcacatgtt

SEQ ID NO: 263093 - DNA, 20 bp, Artificial Sequence
  Description of Artificial Sequence: Synthetic oligonucleotide
  Target: ATXN1; (+) strand; PAM type: YTN; PAM sequence: TTC
ctcttctttttcacatgttt

SEQ ID NO: 263094 - DNA, 20 bp, Artificial Sequence
  Description of Artificial Sequence: Synthetic oligonucleotide
  Target: ATXN1; (+) strand; PAM type: YTN; PAM sequence: CTC
ttctttttcacatgtttggg

SEQ ID NO: 263095 - DNA, 20 bp, Artificial Sequence
  Description of Artificial Sequence: Synthetic oligonucleotide
  Target: ATXN1; (+) strand; PAM type: YTN; PAM sequence: CTT
ctttttcacatgtttgggag

SEQ ID NO: 263096 - DNA, 20 bp, Artificial Sequence
  Description of Artificial Sequence: Synthetic oligonucleotide
  Target: ATXN1; (+) strand; PAM type: YTN; PAM sequence: TTC
tttttcacatgtttgggagc

SEQ ID NO: 263097 - DNA, 20 bp, Artificial Sequence
  Description of Artificial Sequence: Synthetic oligonucleotide
  Target: ATXN1; (+) strand; PAM type: YTN; PAM sequence: CTT
tttcacatgtttgggagcaa

SEQ ID NO: 263098 - DNA, 20 bp, Artificial Sequence
  Description of Artificial Sequence: Synthetic oligonucleotide
  Target: ATXN1; (+) strand; PAM type: YTN; PAM sequence: TTT
ttcacatgtttgggagcaag

SEQ ID NO: 263099 - DNA, 20 bp, Artificial Sequence
  Description of Artificial Sequence: Synthetic oligonucleotide
  Target: ATXN1; (+) strand; PAM type: YTN; PAM sequence: TTT
tcacatgtttgggagcaagt

SEQ ID NO: 263100 - DNA, 20 bp, Artificial Sequence
  Description of Artificial Sequence: Synthetic oligonucleotide
  Target: ATXN1; (+) strand; PAM type: YTN; PAM sequence: TTT
cacatgtttgggagcaagta

SEQ ID NO: 263101 - DNA, 20 bp, Artificial Sequence
  Description of Artificial Sequence: Synthetic oligonucleotide
  Target: ATXN1; (+) strand; PAM type: YTN; PAM sequence: TTC
acatgtttgggagcaagtag

SEQ ID NO: 263102 - DNA, 20 bp, Artificial Sequence
  Description of Artificial Sequence: Synthetic oligonucleotide
  Target: ATXN1; (+) strand; PAM type: YTN; PAM sequence: TTT
gggagcaagtaggcaaagcc

SEQ ID NO: 263103 - DNA, 20 bp, Artificial Sequence
  Description of Artificial Sequence: Synthetic oligonucleotide
  Target: ATXN1; (+) strand; PAM type: YTN; PAM sequence: TTG
ggagcaagtaggcaaagcct

SEQ ID NO: 263104 - DNA, 20 bp, Artificial Sequence
  Description of Artificial Sequence: Synthetic oligonucleotide
  Target: ATXN1; (+) strand; PAM type: YTN; PAM sequence: CTG
gaacaatcactgatgcaaca

SEQ ID NO: 263105 - DNA, 20 bp, Artificial Sequence
  Description of Artificial Sequence: Synthetic oligonucleotide
  Target: ATXN1; (+) strand; PAM type: YTN; PAM sequence: CTG
atgcaacatgtgtttacaca

SEQ ID NO: 263106 - DNA, 20 bp, Artificial Sequence
  Description of Artificial Sequence: Synthetic oligonucleotide
  Target: ATXN1; (+) strand; PAM type: YTN; PAM sequence: TTT
acacacatgcatggttctta

SEQ ID NO: 263107 - DNA, 20 bp, Artificial Sequence
  Description of Artificial Sequence: Synthetic oligonucleotide
  Target: ATXN1; (+) strand; PAM type: YTN; PAM sequence: TTA
cacacatgcatggttcttag

SEQ ID NO: 263108 - DNA, 20 bp, Artificial Sequence
  Description of Artificial Sequence: Synthetic oligonucleotide
  Target: ATXN1; (+) strand; PAM type: YTN; PAM sequence: TTC
ttagagaatggaaggacagg

SEQ ID NO: 263109 - DNA, 20 bp, Artificial Sequence
  Description of Artificial Sequence: Synthetic oligonucleotide
  Target: ATXN1; (+) strand; PAM type: YTN; PAM sequence: CTT
agagaatggaaggacaggag

SEQ ID NO: 263110 - DNA, 20 bp, Artificial Sequence
  Description of Artificial Sequence: Synthetic oligonucleotide
  Target: ATXN1; (+) strand; PAM type: YTN; PAM sequence: TTA
gagaatggaaggacaggagc

SEQ ID NO: 263111 - DNA, 20 bp, Artificial Sequence
  Description of Artificial Sequence: Synthetic oligonucleotide
  Target: ATXN1; (+) strand; PAM type: YTN; PAM sequence: CTG
aatagttccatctgccagtg

SEQ ID NO: 263112 - DNA, 20 bp, Artificial Sequence
  Description of Artificial Sequence: Synthetic oligonucleotide
  Target: ATXN1; (+) strand; PAM type: YTN; PAM sequence: TTC
catctgccagtgataatgta

SEQ ID NO: 263113 - DNA, 20 bp, Artificial Sequence
  Description of Artificial Sequence: Synthetic oligonucleotide
  Target: ATXN1; (+) strand; PAM type: YTN; PAM sequence: CTG
ccagtgataatgtagctccc

SEQ ID NO: 263114 - DNA, 20 bp, Artificial Sequence
  Description of Artificial Sequence: Synthetic oligonucleotide
  Target: ATXN1; (+) strand; PAM type: YTN; PAM sequence: CTC
ccatcacccttcccatctag

SEQ ID NO: 263115 - DNA, 20 bp, Artificial Sequence
  Description of Artificial Sequence: Synthetic oligonucleotide
  Target: ATXN1; (+) strand; PAM type: YTN; PAM sequence: CTT
cccatctagtgctctctgat

SEQ ID NO: 263116 - DNA, 20 bp, Artificial Sequence
  Description of Artificial Sequence: Synthetic oligonucleotide
  Target: ATXN1; (+) strand; PAM type: YTN; PAM sequence: TTC
ccatctagtgctctctgatt

SEQ ID NO: 263117 - DNA, 20 bp, Artificial Sequence
  Description of Artificial Sequence: Synthetic oligonucleotide
  Target: ATXN1; (+) strand; PAM type: YTN; PAM sequence: CTA
gtgctctctgattcaaggga

SEQ ID NO: 263118 - DNA, 20 bp, Artificial Sequence
  Description of Artificial Sequence: Synthetic oligonucleotide
  Target: ATXN1; (+) strand; PAM type: YTN; PAM sequence: CTC
tctgattcaagggaaggaat

SEQ ID NO: 263119 - DNA, 20 bp, Artificial Sequence
  Description of Artificial Sequence: Synthetic oligonucleotide
  Target: ATXN1; (+) strand; PAM type: YTN; PAM sequence: CTC
tgattcaagggaaggaatgt

SEQ ID NO: 263120 - DNA, 20 bp, Artificial Sequence
  Description of Artificial Sequence: Synthetic oligonucleotide
  Target: ATXN1; (+) strand; PAM type: YTN; PAM sequence: CTG
attcaagggaaggaatgtgc

SEQ ID NO: 263121 - DNA, 20 bp, Artificial Sequence
  Description of Artificial Sequence: Synthetic oligonucleotide
  Target: ATXN1; (+) strand; PAM type: YTN; PAM sequence: TTC
aagggaaggaatgtgctttg

SEQ ID NO: 263122 - DNA, 20 bp, Artificial Sequence
  Description of Artificial Sequence: Synthetic oligonucleotide
  Target: ATXN1; (+) strand; PAM type: YTN; PAM sequence: CTT
tggaagagagggcaggggct

SEQ ID NO: 263123 - DNA, 20 bp, Artificial Sequence
  Description of Artificial Sequence: Synthetic oligonucleotide
  Target: ATXN1; (+) strand; PAM type: YTN; PAM sequence: TTT
ggaagagagggcaggggctt

SEQ ID NO: 263124 - DNA, 20 bp, Artificial Sequence
  Description of Artificial Sequence: Synthetic oligonucleotide
  Target: ATXN1; (+) strand; PAM type: YTN; PAM sequence: TTG
gaagagagggcaggggctta

SEQ ID NO: 263125 - DNA, 20 bp, Artificial Sequence
  Description of Artificial Sequence: Synthetic oligonucleotide
  Target: ATXN1; (+) strand; PAM type: YTN; PAM sequence: CTT
attactcagagagacgtagg

SEQ ID NO: 263126 - DNA, 20 bp, Artificial Sequence
  Description of Artificial Sequence: Synthetic oligonucleotide
  Target: ATXN1; (+) strand; PAM type: YTN; PAM sequence: TTA
ttactcagagagacgtaggt

SEQ ID NO: 263127 - DNA, 20 bp, Artificial Sequence
  Description of Artificial Sequence: Synthetic oligonucleotide
  Target: ATXN1; (+) strand; PAM type: YTN; PAM sequence: TTA
ctcagagagacgtaggttca

SEQ ID NO: 263128 - DNA, 20 bp, Artificial Sequence
  Description of Artificial Sequence: Synthetic oligonucleotide
  Target: ATXN1; (+) strand; PAM type: YTN; PAM sequence: CTC
agagagacgtaggttcaaag

SEQ ID NO: 263129 - DNA, 20 bp, Artificial Sequence
  Description of Artificial Sequence: Synthetic oligonucleotide
  Target: ATXN1; (+) strand; PAM type: YTN; PAM sequence: TTC
aaagccagcacgtttattat

SEQ ID NO: 263130 - DNA, 20 bp, Artificial Sequence
  Description of Artificial Sequence: Synthetic oligonucleotide
  Target: ATXN1; (+) strand; PAM type: YTN; PAM sequence: TTT
attattagcagagtaactct

SEQ ID NO: 263131 - DNA, 20 bp, Artificial Sequence
  Description of Artificial Sequence: Synthetic oligonucleotide
  Target: ATXN1; (+) strand; PAM type: YTN; PAM sequence: TTA
ttattagcagagtaactctg

SEQ ID NO: 263132 - DNA, 20 bp, Artificial Sequence
  Description of Artificial Sequence: Synthetic oligonucleotide
  Target: ATXN1; (+) strand; PAM type: YTN; PAM sequence: TTA
ttagcagagtaactctgaac

SEQ ID NO: 263133 - DNA, 20 bp, Artificial Sequence
  Description of Artificial Sequence: Synthetic oligonucleotide
  Target: ATXN1; (+) strand; PAM type: YTN; PAM sequence: TTA
gcagagtaactctgaactga

SEQ ID NO: 263134 - DNA, 20 bp, Artificial Sequence
  Description of Artificial Sequence: Synthetic oligonucleotide
  Target: ATXN1; (+) strand; PAM type: YTN; PAM sequence: CTC
tgaactgactcactcccatt

SEQ ID NO: 263135 - DNA, 20 bp, Artificial Sequence
  Description of Artificial Sequence: Synthetic oligonucleotide
  Target: ATXN1; (+) strand; PAM type: YTN; PAM sequence: CTG
aactgactcactcccattcc

SEQ ID NO: 263136 - DNA, 20 bp, Artificial Sequence
  Description of Artificial Sequence: Synthetic oligonucleotide
  Target: ATXN1; (+) strand; PAM type: YTN; PAM sequence: CTG
actcactcccattccatcga

SEQ ID NO: 263137 - DNA, 20 bp, Artificial Sequence
  Description of Artificial Sequence: Synthetic oligonucleotide
  Target: ATXN1; (+) strand; PAM type: YTN; PAM sequence: CTC
actcccattccatcgagcct

SEQ ID NO: 263138 - DNA, 20 bp, Artificial Sequence
  Description of Artificial Sequence: Synthetic oligonucleotide
  Target: ATXN1; (+) strand; PAM type: YTN; PAM sequence: CTC
ccattccatcgagcctcttt

SEQ ID NO: 263139 - DNA, 20 bp, Artificial Sequence
  Description of Artificial Sequence: Synthetic oligonucleotide
  Target: ATXN1; (+) strand; PAM type: YTN; PAM sequence: TTC
catcgagcctcttttatctg

SEQ ID NO: 263140 - DNA, 20 bp, Artificial Sequence
  Description of Artificial Sequence: Synthetic oligonucleotide
  Target: ATXN1; (+) strand; PAM type: YTN; PAM sequence: CTC
ttttatctgcaacatggaga

SEQ ID NO: 263141 - DNA, 20 bp, Artificial Sequence
  Description of Artificial Sequence: Synthetic oligonucleotide
  Target: ATXN1; (+) strand; PAM type: YTN; PAM sequence: CTT
ttatctgcaacatggagatg

SEQ ID NO: 263142 - DNA, 20 bp, Artificial Sequence
  Description of Artificial Sequence: Synthetic oligonucleotide
  Target: ATXN1; (+) strand; PAM type: YTN; PAM sequence: TTT
tatctgcaacatggagatgc

SEQ ID NO: 263143 - DNA, 20 bp, Artificial Sequence
  Description of Artificial Sequence: Synthetic oligonucleotide
  Target: ATXN1; (+) strand; PAM type: YTN; PAM sequence: TTT
atctgcaacatggagatgct

SEQ ID NO: 263144 - DNA, 20 bp, Artificial Sequence
  Description of Artificial Sequence: Synthetic oligonucleotide
  Target: ATXN1; (+) strand; PAM type: YTN; PAM sequence: TTA
tctgcaacatggagatgcta

SEQ ID NO: 263145 - DNA, 20 bp, Artificial Sequence
  Description of Artificial Sequence: Synthetic oligonucleotide
  Target: ATXN1; (+) strand; PAM type: YTN; PAM sequence: CTG
caacatggagatgctatgag

SEQ ID NO: 263146 - DNA, 20 bp, Artificial Sequence
  Description of Artificial Sequence: Synthetic oligonucleotide
  Target: ATXN1; (+) strand; PAM type: YTN; PAM sequence: CTA
tgagtttctgaagattcctt

SEQ ID NO: 263147 - DNA, 20 bp, Artificial Sequence
  Description of Artificial Sequence: Synthetic oligonucleotide
  Target: ATXN1; (+) strand; PAM type: YTN; PAM sequence: TTT
ctgaagattccttaatatct

SEQ ID NO: 263148 - DNA, 20 bp, Artificial Sequence
  Description of Artificial Sequence: Synthetic oligonucleotide
  Target: ATXN1; (+) strand; PAM type: YTN; PAM sequence: TTC
tgaagattccttaatatctc

SEQ ID NO: 263149 - DNA, 20 bp, Artificial Sequence
  Description of Artificial Sequence: Synthetic oligonucleotide
  Target: ATXN1; (+) strand; PAM type: YTN; PAM sequence: CTG
aagattccttaatatctcat

SEQ ID NO: 263150 - DNA, 20 bp, Artificial Sequence
  Description of Artificial Sequence: Synthetic oligonucleotide
  Target: ATXN1; (+) strand; PAM type: YTN; PAM sequence: TTC
cttaatatctcataaaaata

SEQ ID NO: 263151 - DNA, 20 bp, Artificial Sequence
  Description of Artificial Sequence: Synthetic oligonucleotide
  Target: ATXN1; (+) strand; PAM type: YTN; PAM sequence: CTT
aatatctcataaaaataaca

SEQ ID NO: 263152 - DNA, 20 bp, Artificial Sequence
  Description of Artificial Sequence: Synthetic oligonucleotide
  Target: ATXN1; (+) strand; PAM type: YTN; PAM sequence: TTA
atatctcataaaaataacat

SEQ ID NO: 263153 - DNA, 20 bp, Artificial Sequence
  Description of Artificial Sequence: Synthetic oligonucleotide
  Target: ATXN1; (+) strand; PAM type: YTN; PAM sequence: CTC
ataaaaataacataaaacca

SEQ ID NO: 263154 - DNA, 20 bp, Artificial Sequence
  Description of Artificial Sequence: Synthetic oligonucleotide
  Target: ATXN1; (+) strand; PAM type: YTN; PAM sequence: CTC
catatgaagtattcaatgaa

SEQ ID NO: 263155 - DNA, 20 bp, Artificial Sequence
  Description of Artificial Sequence: Synthetic oligonucleotide
  Target: ATXN1; (+) strand; PAM type: YTN; PAM sequence: TTC
aatgaatagcttcctccctt

SEQ ID NO: 263156 - DNA, 20 bp, Artificial Sequence
  Description of Artificial Sequence: Synthetic oligonucleotide
  Target: ATXN1; (+) strand; PAM type: YTN; PAM sequence: CTT
cctcccttctggggaccttg

SEQ ID NO: 263157 - DNA, 20 bp, Artificial Sequence
  Description of Artificial Sequence: Synthetic oligonucleotide
  Target: ATXN1; (+) strand; PAM type: YTN; PAM sequence: TTC
ctcccttctggggaccttgt

SEQ ID NO: 263158 - DNA, 20 bp, Artificial Sequence
  Description of Artificial Sequence: Synthetic oligonucleotide
  Target: ATXN1; (+) strand; PAM type: YTN; PAM sequence: CTC
ccttctggggaccttgtaga

SEQ ID NO: 263159 - DNA, 20 bp, Artificial Sequence
  Description of Artificial Sequence: Synthetic oligonucleotide
  Target: ATXN1; (+) strand; PAM type: YTN; PAM sequence: CTT
ctggggaccttgtagaaatg

SEQ ID NO: 263160 - DNA, 20 bp, Artificial Sequence
  Description of Artificial Sequence: Synthetic oligonucleotide
  Target: ATXN1; (+) strand; PAM type: YTN; PAM sequence: TTC
tggggaccttgtagaaatgc

SEQ ID NO: 263161 - DNA, 20 bp, Artificial Sequence
  Description of Artificial Sequence: Synthetic oligonucleotide
  Target: ATXN1; (+) strand; PAM type: YTN; PAM sequence: CTG
gggaccttgtagaaatgctg

SEQ ID NO: 263162 - DNA, 20 bp, Artificial Sequence
  Description of Artificial Sequence: Synthetic oligonucleotide
  Target: ATXN1; (+) strand; PAM type: YTN; PAM sequence: CTT
gtagaaatgctgatgaggct

SEQ ID NO: 263163 - DNA, 20 bp, Artificial Sequence
  Description of Artificial Sequence: Synthetic oligonucleotide
  Target: ATXN1; (+) strand; PAM type: YTN; PAM sequence: TTG
tagaaatgctgatgaggctg

SEQ ID NO: 263164 - DNA, 20 bp, Artificial Sequence
  Description of Artificial Sequence: Synthetic oligonucleotide
  Target: ATXN1; (+) strand; PAM type: YTN; PAM sequence: CTG
atgaggctgctccagcgacc

SEQ ID NO: 263165 - DNA, 20 bp, Artificial Sequence
  Description of Artificial Sequence: Synthetic oligonucleotide
  Target: ATXN1; (+) strand; PAM type: YTN; PAM sequence: CTG
ctccagcgaccaaaatcaat

SEQ ID NO: 263166 - DNA, 20 bp, Artificial Sequence
  Description of Artificial Sequence: Synthetic oligonucleotide
  Target: ATXN1; (+) strand; PAM type: YTN; PAM sequence: CTC
cagcgaccaaaatcaatgtc

SEQ ID NO: 263167 - DNA, 20 bp, Artificial Sequence
  Description of Artificial Sequence: Synthetic oligonucleotide
  Target: ATXN1; (+) strand; PAM type: YTN; PAM sequence: CTT
gggaaaggaccttctaggtg

SEQ ID NO: 263168 - DNA, 20 bp, Artificial Sequence
  Description of Artificial Sequence: Synthetic oligonucleotide
  Target: ATXN1; (+) strand; PAM type: YTN; PAM sequence: TTG
ggaaaggaccttctaggtga

SEQ ID NO: 263169 - DNA, 20 bp, Artificial Sequence
  Description of Artificial Sequence: Synthetic oligonucleotide
  Target: ATXN1; (+) strand; PAM type: YTN; PAM sequence: CTT
ctaggtgaaggatgtcaacc

SEQ ID NO: 263170 - DNA, 20 bp, Artificial Sequence
  Description of Artificial Sequence: Synthetic oligonucleotide
  Target: ATXN1; (+) strand; PAM type: YTN; PAM sequence: TTC
taggtgaaggatgtcaaccc

SEQ ID NO: 263171 - DNA, 20 bp, Artificial Sequence
  Description of Artificial Sequence: Synthetic oligonucleotide
  Target: ATXN1; (+) strand; PAM type: YTN; PAM sequence: CTA
ggtgaaggatgtcaacccca

SEQ ID NO: 263172 - DNA, 20 bp, Artificial Sequence
  Description of Artificial Sequence: Synthetic oligonucleotide
  Target: ATXN1; (+) strand; PAM type: YTN; PAM sequence: TTC
ctaaacatcatggagaggtc

SEQ ID NO: 263173 - DNA, 20 bp, Artificial Sequence
  Description of Artificial Sequence: Synthetic oligonucleotide
  Target: ATXN1; (+) strand; PAM type: YTN; PAM sequence: CTA
aacatcatggagaggtcctc

SEQ ID NO: 263174 - DNA, 20 bp, Artificial Sequence
  Description of Artificial Sequence: Synthetic oligonucleotide
  Target: ATXN1; (+) strand; PAM type: YTN; PAM sequence: CTC
tcagaaatacaggtgtccat

SEQ ID NO: 263175 - DNA, 20 bp, Artificial Sequence
  Description of Artificial Sequence: Synthetic oligonucleotide
  Target: ATXN1; (+) strand; PAM type: YTN; PAM sequence: CTC
agaaatacaggtgtccatcc

SEQ ID NO: 263176 - DNA, 20 bp, Artificial Sequence
  Description of Artificial Sequence: Synthetic oligonucleotide
  Target: ATXN1; (+) strand; PAM type: YTN; PAM sequence: CTA
acctctttcagcctcacttt

SEQ ID NO: 263177 - DNA, 20 bp, Artificial Sequence
  Description of Artificial Sequence: Synthetic oligonucleotide
  Target: ATXN1; (+) strand; PAM type: YTN; PAM sequence: CTC
tttcagcctcactttagtgg

SEQ ID NO: 263178 - DNA, 20 bp, Artificial Sequence
  Description of Artificial Sequence: Synthetic oligonucleotide
  Target: ATXN1; (+) strand; PAM type: YTN; PAM sequence: CTT
tcagcctcactttagtggtt

SEQ ID NO: 263179 - DNA, 20 bp, Artificial Sequence
  Description of Artificial Sequence: Synthetic oligonucleotide
  Target: ATXN1; (+) strand; PAM type: YTN; PAM sequence: TTT
cagcctcactttagtggtta

SEQ ID NO: 263180 - DNA, 20 bp, Artificial Sequence
  Description of Artificial Sequence: Synthetic oligonucleotide
  Target: ATXN1; (+) strand; PAM type: YTN; PAM sequence: TTC
agcctcactttagtggttat

SEQ ID NO: 263181 - DNA, 20 bp, Artificial Sequence
  Description of Artificial Sequence: Synthetic oligonucleotide
  Target: ATXN1; (+) strand; PAM type: YTN; PAM sequence: CTC
actttagtggttatctgtga

SEQ ID NO: 263182 - DNA, 20 bp, Artificial Sequence
  Description of Artificial Sequence: Synthetic oligonucleotide
  Target: ATXN1; (+) strand; PAM type: YTN; PAM sequence: CTT
tagtggttatctgtgaacgc

SEQ ID NO: 263183 - DNA, 20 bp, Artificial Sequence
  Description of Artificial Sequence: Synthetic oligonucleotide
  Target: ATXN1; (+) strand; PAM type: YTN; PAM sequence: TTT
agtggttatctgtgaacgca

SEQ ID NO: 263184 - DNA, 20 bp, Artificial Sequence
  Description of Artificial Sequence: Synthetic oligonucleotide
  Target: ATXN1; (+) strand; PAM type: YTN; PAM sequence: TTA
gtggttatctgtgaacgcac

SEQ ID NO: 263185 - DNA, 20 bp, Artificial Sequence
  Description of Artificial Sequence: Synthetic oligonucleotide
  Target: ATXN1; (+) strand; PAM type: YTN; PAM sequence: TTA
tctgtgaacgcacctgatcc

SEQ ID NO: 263186 - DNA, 20 bp, Artificial Sequence
  Description of Artificial Sequence: Synthetic oligonucleotide
  Target: ATXN1; (+) strand; PAM type: YTN; PAM sequence: CTG
tgaacgcacctgatccatga

SEQ ID NO: 263187 - DNA, 20 bp, Artificial Sequence
  Description of Artificial Sequence: Synthetic oligonucleotide
  Target: ATXN1; (+) strand; PAM type: YTN; PAM sequence: CTG
atccatgaggattaaaagga

SEQ ID NO: 263188 - DNA, 20 bp, Artificial Sequence
  Description of Artificial Sequence: Synthetic oligonucleotide
  Target: ATXN1; (+) strand; PAM type: YTN; PAM sequence: TTA
aaaggacaacaggggcggcg

SEQ ID NO: 263189 - DNA, 20 bp, Artificial Sequence
  Description of Artificial Sequence: Synthetic oligonucleotide
  Target: ATXN1; (+) strand; PAM type: YTN; PAM sequence: TTA
gaacaaagattaaagtagac

SEQ ID NO: 263190 - DNA, 20 bp, Artificial Sequence
  Description of Artificial Sequence: Synthetic oligonucleotide
  Target: ATXN1; (+) strand; PAM type: YTN; PAM sequence: TTA
aagtagacccccccaagggc

SEQ ID NO: 263191 - DNA, 20 bp, Artificial Sequence
  Description of Artificial Sequence: Synthetic oligonucleotide
  Target: ATXN1; (+) strand; PAM type: YTN; PAM sequence: CTA
tgaagagccacatggccatt

SEQ ID NO: 263192 - DNA, 20 bp, Artificial Sequence
  Description of Artificial Sequence: Synthetic oligonucleotide
  Target: ATXN1; (+) strand; PAM type: YTN; PAM sequence: TTC
cttgagaattactaatcatg

SEQ ID NO: 263193 - DNA, 20 bp, Artificial Sequence
  Description of Artificial Sequence: Synthetic oligonucleotide
  Target: ATXN1; (+) strand; PAM type: YTN; PAM sequence: CTT
gagaattactaatcatgaat

SEQ ID NO: 263194 - DNA, 20 bp, Artificial Sequence
  Description of Artificial Sequence: Synthetic oligonucleotide
  Target: ATXN1; (+) strand; PAM type: YTN; PAM sequence: TTG
agaattactaatcatgaatc

SEQ ID NO: 263195 - DNA, 20 bp, Artificial Sequence
  Description of Artificial Sequence: Synthetic oligonucleotide
  Target: ATXN1; (+) strand; PAM type: YTN; PAM sequence: TTA
ctaatcatgaatcattcggt

SEQ ID NO: 263196 - DNA, 20 bp, Artificial Sequence
  Description of Artificial Sequence: Synthetic oligonucleotide
  Target: ATXN1; (+) strand; PAM type: YTN; PAM sequence: CTA
atcatgaatcattcggttct

SEQ ID NO: 263197 - DNA, 20 bp, Artificial Sequence
  Description of Artificial Sequence: Synthetic oligonucleotide
  Target: ATXN1; (+) strand; PAM type: YTN; PAM sequence: TTC
ggttctccaggatgctcctt

SEQ ID NO: 263198 - DNA, 20 bp, Artificial Sequence
  Description of Artificial Sequence: Synthetic oligonucleotide
  Target: ATXN1; (+) strand; PAM type: YTN; PAM sequence: TTC
tccaggatgctcctttggct

SEQ ID NO: 263199 - DNA, 20 bp, Artificial Sequence
  Description of Artificial Sequence: Synthetic oligonucleotide
  Target: ATXN1; (+) strand; PAM type: YTN; PAM sequence: CTC
caggatgctcctttggctta

SEQ ID NO: 263200 - DNA, 20 bp, Artificial Sequence
  Description of Artificial Sequence: Synthetic oligonucleotide
  Target: ATXN1; (+) strand; PAM type: YTN; PAM sequence: CTC
ctttggcttaaaccgaagtc

SEQ ID NO: 263201 - DNA, 20 bp, Artificial Sequence
  Description of Artificial Sequence: Synthetic oligonucleotide
  Target: ATXN1; (+) strand; PAM type: YTN; PAM sequence: CTT
tggcttaaaccgaagtcaat

SEQ ID NO: 263202 - DNA, 20 bp, Artificial Sequence
  Description of Artificial Sequence: Synthetic oligonucleotide
  Target: ATXN1; (+) strand; PAM type: YTN; PAM sequence: TTT
ggcttaaaccgaagtcaatc

SEQ ID NO: 263203 - DNA, 20 bp, Artificial Sequence
  Description of Artificial Sequence: Synthetic oligonucleotide
  Target: ATXN1; (+) strand; PAM type: YTN; PAM sequence: TTG
gcttaaaccgaagtcaatct

SEQ ID NO: 263204 - DNA, 20 bp, Artificial Sequence
  Description of Artificial Sequence: Synthetic oligonucleotide
  Target: ATXN1; (+) strand; PAM type: YTN; PAM sequence: CTT
aaaccgaagtcaatcttttc

SEQ ID NO: 263205 - DNA, 20 bp, Artificial Sequence
  Description of Artificial Sequence: Synthetic oligonucleotide
  Target: ATXN1; (+) strand; PAM type: YTN; PAM sequence: TTA
aaccgaagtcaatcttttct

SEQ ID NO: 263206 - DNA, 20 bp, Artificial Sequence
  Description of Artificial Sequence: Synthetic oligonucleotide
  Target: ATXN1; (+) strand; PAM type: YTN; PAM sequence: CTT
ttctaagcattaaatgggga

SEQ ID NO: 263207 - DNA, 20 bp, Artificial Sequence
  Description of Artificial Sequence: Synthetic oligonucleotide
  Target: ATXN1; (+) strand; PAM type: YTN; PAM sequence: TTT
tctaagcattaaatggggac

SEQ ID NO: 263208 - DNA, 20 bp, Artificial Sequence
  Description of Artificial Sequence: Synthetic oligonucleotide
  Target: ATXN1; (+) strand; PAM type: YTN; PAM sequence: TTT
ctaagcattaaatggggaca

SEQ ID NO: 263209 - DNA, 20 bp, Artificial Sequence
  Description of Artificial Sequence: Synthetic oligonucleotide
  Target: ATXN1; (+) strand; PAM type: YTN; PAM sequence: TTC
taagcattaaatggggacat

SEQ ID NO: 263210 - DNA, 20 bp, Artificial Sequence
  Description of Artificial Sequence: Synthetic oligonucleotide
  Target: ATXN1; (+) strand; PAM type: YTN; PAM sequence: CTA
agcattaaatggggacatct

SEQ ID NO: 263211 - DNA, 20 bp, Artificial Sequence
  Description of Artificial Sequence: Synthetic oligonucleotide
  Target: ATXN1; (+) strand; PAM type: YTN; PAM sequence: TTA
aatggggacatcttctcttc

SEQ ID NO: 263212 - DNA, 20 bp, Artificial Sequence
  Description of Artificial Sequence: Synthetic oligonucleotide
  Target: ATXN1; (+) strand; PAM type: YTN; PAM sequence: CTT
ctcttcccatttaaaagcaa

SEQ ID NO: 263213 - DNA, 20 bp, Artificial Sequence
  Description of Artificial Sequence: Synthetic oligonucleotide
  Target: ATXN1; (+) strand; PAM type: YTN; PAM sequence: TTC
tcttcccatttaaaagcaag

SEQ ID NO: 263214 - DNA, 20 bp, Artificial Sequence
  Description of Artificial Sequence: Synthetic oligonucleotide
  Target: ATXN1; (+) strand; PAM type: YTN; PAM sequence: CTC
ttcccatttaaaagcaagca

SEQ ID NO: 263215 - DNA, 20 bp, Artificial Sequence
  Description of Artificial Sequence: Synthetic oligonucleotide
  Target: ATXN1; (+) strand; PAM type: YTN; PAM sequence: CTT
cccatttaaaagcaagcagt

SEQ ID NO: 263216 - DNA, 20 bp, Artificial Sequence
  Description of Artificial Sequence: Synthetic oligonucleotide
  Target: ATXN1; (+) strand; PAM type: YTN; PAM sequence: TTC
ccatttaaaagcaagcagtt

SEQ ID NO: 263217 - DNA, 20 bp, Artificial Sequence
  Description of Artificial Sequence: Synthetic oligonucleotide
  Target: ATXN1; (+) strand; PAM type: YTN; PAM sequence: TTT
aaaagcaagcagttgccact

SEQ ID NO: 263218 - DNA, 20 bp, Artificial Sequence
  Description of Artificial Sequence: Synthetic oligonucleotide
  Target: ATXN1; (+) strand; PAM type: YTN; PAM sequence: TTA
aaagcaagcagttgccactt

SEQ ID NO: 263219 - DNA, 20 bp, Artificial Sequence
  Description of Artificial Sequence: Synthetic oligonucleotide
  Target: ATXN1; (+) strand; PAM type: YTN; PAM sequence: TTG
ccacttcagctgtacaaatt

SEQ ID NO: 263220 - DNA, 20 bp, Artificial Sequence
  Description of Artificial Sequence: Synthetic oligonucleotide
  Target: ATXN1; (+) strand; PAM type: YTN; PAM sequence: CTT
cagctgtacaaattatatag

SEQ ID NO: 263221 - DNA, 20 bp, Artificial Sequence
  Description of Artificial Sequence: Synthetic oligonucleotide
  Target: ATXN1; (+) strand; PAM type: YTN; PAM sequence: TTC
agctgtacaaattatatagg

SEQ ID NO: 263222 - DNA, 20 bp, Artificial Sequence
  Description of Artificial Sequence: Synthetic oligonucleotide
  Target: ATXN1; (+) strand; PAM type: YTN; PAM sequence: CTG
tacaaattatataggattga

SEQ ID NO: 263223 - DNA, 20 bp, Artificial Sequence
  Description of Artificial Sequence: Synthetic oligonucleotide
  Target: ATXN1; (+) strand; PAM type: YTN; PAM sequence: TTA
tataggattgaaaatagtat

SEQ ID NO: 263224 - DNA, 20 bp, Artificial Sequence
  Description of Artificial Sequence: Synthetic oligonucleotide
  Target: ATXN1; (+) strand; PAM type: YTN; PAM sequence: TTG
aaaatagtataactggttgg

SEQ ID NO: 263225 - DNA, 20 bp, Artificial Sequence
  Description of Artificial Sequence: Synthetic oligonucleotide
  Target: ATXN1; (+) strand; PAM type: YTN; PAM sequence: CTG
gttgggcacagttgctcacg

SEQ ID NO: 263226 - DNA, 20 bp, Artificial Sequence
  Description of Artificial Sequence: Synthetic oligonucleotide
  Target: ATXN1; (+) strand; PAM type: YTN; PAM sequence: TTG
ggcacagttgctcacgcctg

SEQ ID NO: 263227 - DNA, 20 bp, Artificial Sequence
  Description of Artificial Sequence: Synthetic oligonucleotide
  Target: ATXN1; (+) strand; PAM type: YTN; PAM sequence: TTG
ctcacgcctgtaatcccaga

SEQ ID NO: 263228 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagaact

SEQ ID NO: 263229 - DNA, 20 bp, Artificial Sequence
  Description of Artificial Sequence: Synthetic oligonucleotide
  Target: ATXN1; (+) strand; PAM type: YTN; PAM sequence: CTG
taatcccagaactttgggat

SEQ ID NO: 263230 - DNA, 20 bp, Artificial Sequence
  Description of Artificial Sequence: Synthetic oligonucleotide
  Target: ATXN1; (+) strand; PAM type: YTN; PAM sequence: CTT
tgggatgcccaggtgggtgg

SEQ ID NO: 263231 - DNA, 20 bp, Artificial Sequence
  Description of Artificial Sequence: Synthetic oligonucleotide
  Target: ATXN1; (+) strand; PAM type: YTN; PAM sequence: TTT
gggatgcccaggtgggtgga

SEQ ID NO: 263232 - DNA, 20 bp, Artificial Sequence
  Description of Artificial Sequence: Synthetic oligonucleotide
  Target: ATXN1; (+) strand; PAM type: YTN; PAM sequence: TTG
ggatgcccaggtgggtggat

SEQ ID NO: 263233 - DNA, 20 bp, Artificial Sequence
  Description of Artificial Sequence: Synthetic oligonucleotide
  Target: ATXN1; (+) strand; PAM type: YTN; PAM sequence: TTC
gagacaagcctggccaacac

SEQ ID NO: 263234 - DNA, 20 bp, Artificial Sequence
  Description of Artificial Sequence: Synthetic oligonucleotide
  Target: ATXN1; (+) strand; PAM type: YTN; PAM sequence: CTG
gccaacacagtgaaacactg

SEQ ID NO: 263235 - DNA, 20 bp, Artificial Sequence
  Description of Artificial Sequence: Synthetic oligonucleotide
  Target: ATXN1; (+) strand; PAM type: YTN; PAM sequence: CTG
tctctactaaaaatacaaaa

SEQ ID NO: 263236 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 263237 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagt

SEQ ID NO: 263238 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagtctc

SEQ ID NO: 263239 - DNA, 20 bp, Artificial Sequence
  Description of Artificial Sequence: Synthetic oligonucleotide
  Target: ATXN1; (+) strand; PAM type: YTN; PAM sequence: TTA
gtctctactgaaaatacaaa

SEQ ID NO: 263240 - DNA, 20 bp, Artificial Sequence
  Description of Artificial Sequence: Synthetic oligonucleotide
  Target: ATXN1; (+) strand; PAM type: YTN; PAM sequence: CTC
tactgaaaatacaaaaatta

SEQ ID NO: 263241 - DNA, 20 bp, Artificial Sequence
  Description of Artificial Sequence: Synthetic oligonucleotide
  Target: ATXN1; (+) strand; PAM type: YTN; PAM sequence: CTA
ctgaaaatacaaaaattagt

SEQ ID NO: 263242 - DNA, 20 bp, Artificial Sequence
  Description of Artificial Sequence: Synthetic oligonucleotide
  Target: ATXN1; (+) strand; PAM type: YTN; PAM sequence: CTG
aaaatacaaaaattagttag

SEQ ID NO: 263243 - DNA, 20 bp, Artificial Sequence
  Description of Artificial Sequence: Synthetic oligonucleotide
  Target: ATXN1; (+) strand; PAM type: YTN; PAM sequence: TTA
gttagctactcaggaggctg

SEQ ID NO: 263244 - DNA, 20 bp, Artificial Sequence
  Description of Artificial Sequence: Synthetic oligonucleotide
  Target: ATXN1; (+) strand; PAM type: YTN; PAM sequence: TTA
gctactcaggaggctgaggc

SEQ ID NO: 263245 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctgaggcagaa

SEQ ID NO: 263246 - DNA, 20 bp, Artificial Sequence
  Description of Artificial Sequence: Synthetic oligonucleotide
  Target: ATXN1; (+) strand; PAM type: YTN; PAM sequence: CTC
aggaggctgaggcagaagaa

SEQ ID NO: 263247 - DNA, 20 bp, Artificial Sequence
  Description of Artificial Sequence: Synthetic oligonucleotide
  Target: ATXN1; (+) strand; PAM type: YTN; PAM sequence: CTG
aggcagaagaatcacttgaa

SEQ ID NO: 263248 - DNA, 20 bp, Artificial Sequence
  Description of Artificial Sequence: Synthetic oligonucleotide
  Target: ATXN1; (+) strand; PAM type: YTN; PAM sequence: CTT
gaacccgagggccagagttt

SEQ ID NO: 263249 - DNA, 20 bp, Artificial Sequence
  Description of Artificial Sequence: Synthetic oligonucleotide
  Target: ATXN1; (+) strand; PAM type: YTN; PAM sequence: TTG
aacccgagggccagagtttg

SEQ ID NO: 263250 - DNA, 20 bp, Artificial Sequence
  Description of Artificial Sequence: Synthetic oligonucleotide
  Target: ATXN1; (+) strand; PAM type: YTN; PAM sequence: TTT
gcagtgagccaagatcacac

SEQ ID NO: 263251 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaagatcacacc

SEQ ID NO: 263252 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcgacag

SEQ ID NO: 263253 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcgacagagcga

SEQ ID NO: 263254 - DNA, 20 bp, Artificial Sequence
  Description of Artificial Sequence: Synthetic oligonucleotide
  Target: ATXN1; (+) strand; PAM type: YTN; PAM sequence: CTG
ggcgacagagcgagactccg

SEQ ID NO: 263255 - DNA, 20 bp, Artificial Sequence
  Description of Artificial Sequence: Synthetic oligonucleotide
  Target: ATXN1; (+) strand; PAM type: YTN; PAM sequence: CTC
cgtctcaaaaaaaaaggcca

SEQ ID NO: 263256 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaggccaggtgca

SEQ ID NO: 263257 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcccagcact

SEQ ID NO: 263258 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 263259 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggccggcag

SEQ ID NO: 263260 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggccggcaga

SEQ ID NO: 263261 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggccggcagat

SEQ ID NO: 263262 - DNA, 20 bp, Artificial Sequence
  Description of Artificial Sequence: Synthetic oligonucleotide
  Target: ATXN1; (+) strand; PAM type: YTN; PAM sequence: CTG
aggtcgggagttggagacca

SEQ ID NO: 263263 - DNA, 20 bp, Artificial Sequence
  Description of Artificial Sequence: Synthetic oligonucleotide
  Target: ATXN1; (+) strand; PAM type: YTN; PAM sequence: TTG
gagaccagcccgaccaacat

SEQ ID NO: 263264 - DNA, 20 bp, Artificial Sequence
  Description of Artificial Sequence: Synthetic oligonucleotide
  Target: ATXN1; (+) strand; PAM type: YTN; PAM sequence: CTC
atctctgctaaaaatgtaaa

SEQ ID NO: 263265 - DNA, 20 bp, Artificial Sequence
  Description of Artificial Sequence: Synthetic oligonucleotide
  Target: ATXN1; (+) strand; PAM type: YTN; PAM sequence: CTC
tgctaaaaatgtaaaattag

SEQ ID NO: 263266 - DNA, 20 bp, Artificial Sequence
  Description of Artificial Sequence: Synthetic oligonucleotide
  Target: ATXN1; (+) strand; PAM type: YTN; PAM sequence: CTG
ctaaaaatgtaaaattagcc

SEQ ID NO: 263267 - DNA, 20 bp, Artificial Sequence
  Description of Artificial Sequence: Synthetic oligonucleotide
  Target: ATXN1; (+) strand; PAM type: YTN; PAM sequence: CTA
aaaatgtaaaattagccggg

SEQ ID NO: 263268 - DNA, 20 bp, Artificial Sequence
  Description of Artificial Sequence: Synthetic oligonucleotide
  Target: ATXN1; (+) strand; PAM type: YTN; PAM sequence: TTA
gccgggcgtggtggcacatg

SEQ ID NO: 263269 - DNA, 20 bp, Artificial Sequence
  Description of Artificial Sequence: Synthetic oligonucleotide
  Target: ATXN1; (+) strand; PAM type: YTN; PAM sequence: CTG
taatcccagctactcagaag

SEQ ID NO: 263270 - DNA, 20 bp, Artificial Sequence
  Description of Artificial Sequence: Synthetic oligonucleotide
  Target: ATXN1; (+) strand; PAM type: YTN; PAM sequence: CTA
ctcagaaggctgaggcagga

SEQ ID NO: 263271 - DNA, 20 bp, Artificial Sequence
  Description of Artificial Sequence: Synthetic oligonucleotide
  Target: ATXN1; (+) strand; PAM type: YTN; PAM sequence: CTC
agaaggctgaggcaggagaa

SEQ ID NO: 263272 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaaccacttgaa

SEQ ID NO: 263273 - DNA, 20 bp, Artificial Sequence
  Description of Artificial Sequence: Synthetic oligonucleotide
  Target: ATXN1; (+) strand; PAM type: YTN; PAM sequence: CTT
gaacccaggaggcggaggtt

SEQ ID NO: 263274 - DNA, 20 bp, Artificial Sequence
  Description of Artificial Sequence: Synthetic oligonucleotide
  Target: ATXN1; (+) strand; PAM type: YTN; PAM sequence: TTG
aacccaggaggcggaggttg

SEQ ID NO: 263275 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaagatcgtgcc

SEQ ID NO: 263276 - DNA, 20 bp, Artificial Sequence
  Description of Artificial Sequence: Synthetic oligonucleotide
  Target: ATXN1; (+) strand; PAM type: YTN; PAM sequence: TTG
ctctccagcgtgggcaacaa

SEQ ID NO: 263277 - DNA, 20 bp, Artificial Sequence
  Description of Artificial Sequence: Synthetic oligonucleotide
  Target: ATXN1; (+) strand; PAM type: YTN; PAM sequence: CTC
tccagcgtgggcaacaagag

SEQ ID NO: 263278 - DNA, 20 bp, Artificial Sequence
  Description of Artificial Sequence: Synthetic oligonucleotide
  Target: ATXN1; (+) strand; PAM type: YTN; PAM sequence: CTC
cagcgtgggcaacaagagca

SEQ ID NO: 263279 - DNA, 20 bp, Artificial Sequence
  Description of Artificial Sequence: Synthetic oligonucleotide
  Target: ATXN1; (+) strand; PAM type: YTN; PAM sequence: CTC
cgtctcaaaaaaaaaaaaag

SEQ ID NO: 263280 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaagaaagaa

SEQ ID NO: 263281 - DNA, 20 bp, Artificial Sequence
  Description of Artificial Sequence: Synthetic oligonucleotide
  Target: ATXN1; (+) strand; PAM type: YTN; PAM sequence: TTG
aaagaaacgtggagtttgta

SEQ ID NO: 263282 - DNA, 20 bp, Artificial Sequence
  Description of Artificial Sequence: Synthetic oligonucleotide
  Target: ATXN1; (+) strand; PAM type: YTN; PAM sequence: TTT
gtaattagagttctcttttc

SEQ ID NO: 263283 - DNA, 20 bp, Artificial Sequence
  Description of Artificial Sequence: Synthetic oligonucleotide
  Target: ATXN1; (+) strand; PAM type: YTN; PAM sequence: TTG
taattagagttctcttttcc

SEQ ID NO: 263284 - DNA, 20 bp, Artificial Sequence
  Description of Artificial Sequence: Synthetic oligonucleotide
  Target: ATXN1; (+) strand; PAM type: YTN; PAM sequence: TTA
gagttctcttttcccccatt

SEQ ID NO: 263285 - DNA, 20 bp, Artificial Sequence
  Description of Artificial Sequence: Synthetic oligonucleotide
  Target: ATXN1; (+) strand; PAM type: YTN; PAM sequence: TTC
tcttttcccccattctcaaa

SEQ ID NO: 263286 - DNA, 20 bp, Artificial Sequence
  Description of Artificial Sequence: Synthetic oligonucleotide
  Target: ATXN1; (+) strand; PAM type: YTN; PAM sequence: CTC
ttttcccccattctcaaagc

SEQ ID NO: 263287 - DNA, 20 bp, Artificial Sequence
  Description of Artificial Sequence: Synthetic oligonucleotide
  Target: ATXN1; (+) strand; PAM type: YTN; PAM sequence: CTT
ttcccccattctcaaagcaa

SEQ ID NO: 263288 - DNA, 20 bp, Artificial Sequence
  Description of Artificial Sequence: Synthetic oligonucleotide
  Target: ATXN1; (+) strand; PAM type: YTN; PAM sequence: TTT
tcccccattctcaaagcaaa

SEQ ID NO: 263289 - DNA, 20 bp, Artificial Sequence
  Description of Artificial Sequence: Synthetic oligonucleotide
  Target: ATXN1; (+) strand; PAM type: YTN; PAM sequence: TTT
cccccattctcaaagcaaac

SEQ ID NO: 263290 - DNA, 20 bp, Artificial Sequence
  Description of Artificial Sequence: Synthetic oligonucleotide
  Target: ATXN1; (+) strand; PAM type: YTN; PAM sequence: TTC
ccccattctcaaagcaaaca

SEQ ID NO: 263291 - DNA, 20 bp, Artificial Sequence
  Description of Artificial Sequence: Synthetic oligonucleotide
  Target: ATXN1; (+) strand; PAM type: YTN; PAM sequence: TTC
tcaaagcaaacagaaacaaa

SEQ ID NO: 263292 - DNA, 20 bp, Artificial Sequence
  Description of Artificial Sequence: Synthetic oligonucleotide
  Target: ATXN1; (+) strand; PAM type: YTN; PAM sequence: CTC
aaagcaaacagaaacaaatt

SEQ ID NO: 263293 - DNA, 20 bp, Artificial Sequence
  Description of Artificial Sequence: Synthetic oligonucleotide
  Target: ATXN1; (+) strand; PAM type: YTN; PAM sequence: TTT
cacaaaaacaagttgtttaa

SEQ ID NO: 263294 - DNA, 20 bp, Artificial Sequence
  Description of Artificial Sequence: Synthetic oligonucleotide
  Target: ATXN1; (+) strand; PAM type: YTN; PAM sequence: TTC
acaaaaacaagttgtttaaa

SEQ ID NO: 263295 - DNA, 20 bp, Artificial Sequence
  Description of Artificial Sequence: Synthetic oligonucleotide
  Target: ATXN1; (+) strand; PAM type: YTN; PAM sequence: TTG
tttaaaaggttgctatcctc

SEQ ID NO: 263296 - DNA, 20 bp, Artificial Sequence
  Description of Artificial Sequence: Synthetic oligonucleotide
  Target: ATXN1; (+) strand; PAM type: YTN; PAM sequence: TTT
aaaaggttgctatcctcctg

SEQ ID NO: 263297 - DNA, 20 bp, Artificial Sequence
  Description of Artificial Sequence: Synthetic oligonucleotide
  Target: ATXN1; (+) strand; PAM type: YTN; PAM sequence: TTA
aaaggttgctatcctcctgt

SEQ ID NO: 263298 - DNA, 20 bp, Artificial Sequence
  Description of Artificial Sequence: Synthetic oligonucleotide
  Target: ATXN1; (+) strand; PAM type: YTN; PAM sequence: TTG
ctatcctcctgtttctatct

SEQ ID NO: 263299 - DNA, 20 bp, Artificial Sequence
  Description of Artificial Sequence: Synthetic oligonucleotide
  Target: ATXN1; (+) strand; PAM type: YTN; PAM sequence: CTA
tcctcctgtttctatcttca

SEQ ID NO: 263300 - DNA, 20 bp, Artificial Sequence
  Description of Artificial Sequence: Synthetic oligonucleotide
  Target: ATXN1; (+) strand; PAM type: YTN; PAM sequence: CTC
ctgtttctatcttcagtctt

SEQ ID NO: 263301 - DNA, 20 bp, Artificial Sequence
  Description of Artificial Sequence: Synthetic oligonucleotide
  Target: ATXN1; (+) strand; PAM type: YTN; PAM sequence: CTG
tttctatcttcagtcttgct

SEQ ID NO: 263302 - DNA, 20 bp, Artificial Sequence
  Description of Artificial Sequence: Synthetic oligonucleotide
  Target: ATXN1; (+) strand; PAM type: YTN; PAM sequence: TTT
ctatcttcagtcttgctgtc

SEQ ID NO: 263303 - DNA, 20 bp, Artificial Sequence
  Description of Artificial Sequence: Synthetic oligonucleotide
  Target: ATXN1; (+) strand; PAM type: YTN; PAM sequence: TTC
tatcttcagtcttgctgtct

SEQ ID NO: 263304 - DNA, 20 bp, Artificial Sequence
  Description of Artificial Sequence: Synthetic oligonucleotide
  Target: ATXN1; (+) strand; PAM type: YTN; PAM sequence: CTA
tcttcagtcttgctgtcttt

SEQ ID NO: 263305 - DNA, 20 bp, Artificial Sequence
  Description of Artificial Sequence: Synthetic oligonucleotide
  Target: ATXN1; (+) strand; PAM type: YTN; PAM sequence: CTT
cagtcttgctgtctttgtct

SEQ ID NO: 263306 - DNA, 20 bp, Artificial Sequence
  Description of Artificial Sequence: Synthetic oligonucleotide
  Target: ATXN1; (+) strand; PAM type: YTN; PAM sequence: TTC
agtcttgctgtctttgtctt

SEQ ID NO: 263307 - DNA, 20 bp, Artificial Sequence
  Description of Artificial Sequence: Synthetic oligonucleotide
  Target: ATXN1; (+) strand; PAM type: YTN; PAM sequence: CTT
gctgtctttgtctttctaag

SEQ ID NO: 263308 - DNA, 20 bp, Artificial Sequence
  Description of Artificial Sequence: Synthetic oligonucleotide
  Target: ATXN1; (+) strand; PAM type: YTN; PAM sequence: TTG
ctgtctttgtctttctaaga

SEQ ID NO: 263309 - DNA, 20 bp, Artificial Sequence
  Description of Artificial Sequence: Synthetic oligonucleotide
  Target: ATXN1; (+) strand; PAM type: YTN; PAM sequence: CTG
tctttgtctttctaagatgc

SEQ ID NO: 263310 - DNA, 20 bp, Artificial Sequence
  Description of Artificial Sequence: Synthetic oligonucleotide
  Target: ATXN1; (+) strand; PAM type: YTN; PAM sequence: CTT
tgtctttctaagatgccaga

SEQ ID NO: 263311 - DNA, 20 bp, Artificial Sequence
  Description of Artificial Sequence: Synthetic oligonucleotide
  Target: ATXN1; (+) strand; PAM type: YTN; PAM sequence: TTT
gtctttctaagatgccagag

SEQ ID NO: 263312 - DNA, 20 bp, Artificial Sequence
  Description of Artificial Sequence: Synthetic oligonucleotide
  Target: ATXN1; (+) strand; PAM type: YTN; PAM sequence: TTG
tctttctaagatgccagaga

SEQ ID NO: 263313 - DNA, 20 bp, Artificial Sequence
  Description of Artificial Sequence: Synthetic oligonucleotide
  Target: ATXN1; (+) strand; PAM type: YTN; PAM sequence: CTT
tctaagatgccagagaagtt

SEQ ID NO: 263314 - DNA, 20 bp, Artificial Sequence
  Description of Artificial Sequence: Synthetic oligonucleotide
  Target: ATXN1; (+) strand; PAM type: YTN; PAM sequence: TTT
ctaagatgccagagaagttt

SEQ ID NO: 263315 - DNA, 20 bp, Artificial Sequence
  Description of Artificial Sequence: Synthetic oligonucleotide
  Target: ATXN1; (+) strand; PAM type: YTN; PAM sequence: TTC
taagatgccagagaagtttc

SEQ ID NO: 263316 - DNA, 20 bp, Artificial Sequence
  Description of Artificial Sequence: Synthetic oligonucleotide
  Target: ATXN1; (+) strand; PAM type: YTN; PAM sequence: CTA
agatgccagagaagtttcct

SEQ ID NO: 263317 - DNA, 20 bp, Artificial Sequence
  Description of Artificial Sequence: Synthetic oligonucleotide
  Target: ATXN1; (+) strand; PAM type: YTN; PAM sequence: TTT
cctctgcatatagaaaatat

SEQ ID NO: 263318 - DNA, 20 bp, Artificial Sequence
  Description of Artificial Sequence: Synthetic oligonucleotide
  Target: ATXN1; (+) strand; PAM type: YTN; PAM sequence: TTC
ctctgcatatagaaaatatt

SEQ ID NO: 263319 - DNA, 20 bp, Artificial Sequence
  Description of Artificial Sequence: Synthetic oligonucleotide
  Target: ATXN1; (+) strand; PAM type: YTN; PAM sequence: CTC
tgcatatagaaaatattctg

SEQ ID NO: 263320 - DNA, 20 bp, Artificial Sequence
  Description of Artificial Sequence: Synthetic oligonucleotide
  Target: ATXN1; (+) strand; PAM type: YTN; PAM sequence: CTG
catatagaaaatattctggg

SEQ ID NO: 263321 - DNA, 20 bp, Artificial Sequence
  Description of Artificial Sequence: Synthetic oligonucleotide
  Target: ATXN1; (+) strand; PAM type: YTN; PAM sequence: TTC
tgggatttgtctgtcttgtg

SEQ ID NO: 263322 - DNA, 20 bp, Artificial Sequence
  Description of Artificial Sequence: Synthetic oligonucleotide
  Target: ATXN1; (+) strand; PAM type: YTN; PAM sequence: CTG
ggatttgtctgtcttgtgcc

SEQ ID NO: 263323 - DNA, 20 bp, Artificial Sequence
  Description of Artificial Sequence: Synthetic oligonucleotide
  Target: ATXN1; (+) strand; PAM type: YTN; PAM sequence: TTT
gtctgtcttgtgccctcact

SEQ ID NO: 263324 - DNA, 20 bp, Artificial Sequence
  Description of Artificial Sequence: Synthetic oligonucleotide
  Target: ATXN1; (+) strand; PAM type: YTN; PAM sequence: TTG
tctgtcttgtgccctcacta

SEQ ID NO: 263325 - DNA, 20 bp, Artificial Sequence
  Description of Artificial Sequence: Synthetic oligonucleotide
  Target: ATXN1; (+) strand; PAM type: YTN; PAM sequence: CTG
tcttgtgccctcactaggga

SEQ ID NO: 263326 - DNA, 20 bp, Artificial Sequence
  Description of Artificial Sequence: Synthetic oligonucleotide
  Target: ATXN1; (+) strand; PAM type: YTN; PAM sequence: CTT
gtgccctcactagggaagtc

SEQ ID NO: 263327 - DNA, 20 bp, Artificial Sequence
  Description of Artificial Sequence: Synthetic oligonucleotide
  Target: ATXN1; (+) strand; PAM type: YTN; PAM sequence: TTG
tgccctcactagggaagtcc

SEQ ID NO: 263328 - DNA, 20 bp, Artificial Sequence
  Description of Artificial Sequence: Synthetic oligonucleotide
  Target: ATXN1; (+) strand; PAM type: YTN; PAM sequence: CTC
actagggaagtccccttagg

SEQ ID NO: 263329 - DNA, 20 bp, Artificial Sequence
  Description of Artificial Sequence: Synthetic oligonucleotide
  Target: ATXN1; (+) strand; PAM type: YTN; PAM sequence: CTA
gggaagtccccttaggcgtc

SEQ ID NO: 263330 - DNA, 20 bp, Artificial Sequence
  Description of Artificial Sequence: Synthetic oligonucleotide
  Target: ATXN1; (+) strand; PAM type: YTN; PAM sequence: CTT
aggcgtccgaatgtcaggcc

SEQ ID NO: 263331 - DNA, 20 bp, Artificial Sequence
  Description of Artificial Sequence: Synthetic oligonucleotide
  Target: ATXN1; (+) strand; PAM type: YTN; PAM sequence: TTA
ggcgtccgaatgtcaggccg

SEQ ID NO: 263332 - DNA, 20 bp, Artificial Sequence
  Description of Artificial Sequence: Synthetic oligonucleotide
  Target: ATXN1; (+) strand; PAM type: YTN; PAM sequence: TTC
ttagattgcctttttgccta

SEQ ID NO: 263333 - DNA, 20 bp, Artificial Sequence
  Description of Artificial Sequence: Synthetic oligonucleotide
  Target: ATXN1; (+) strand; PAM type: YTN; PAM sequence: CTT
agattgcctttttgcctata

SEQ ID NO: 263334 - DNA, 20 bp, Artificial Sequence
  Description of Artificial Sequence: Synthetic oligonucleotide
  Target: ATXN1; (+) strand; PAM type: YTN; PAM sequence: TTA
gattgcctttttgcctataa

SEQ ID NO: 263335 - DNA, 20 bp, Artificial Sequence
  Description of Artificial Sequence: Synthetic oligonucleotide
  Target: ATXN1; (+) strand; PAM type: YTN; PAM sequence: TTG
cctttttgcctataacacac

SEQ ID NO: 263336 - DNA, 20 bp, Artificial Sequence
  Description of Artificial Sequence: Synthetic oligonucleotide
  Target: ATXN1; (+) strand; PAM type: YTN; PAM sequence: CTT
tttgcctataacacacgagg

SEQ ID NO: 263337 - DNA, 20 bp, Artificial Sequence
  Description of Artificial Sequence: Synthetic oligonucleotide
  Target: ATXN1; (+) strand; PAM type: YTN; PAM sequence: TTT
ttgcctataacacacgaggt

SEQ ID NO: 263338 - DNA, 20 bp, Artificial Sequence
  Description of Artificial Sequence: Synthetic oligonucleotide
  Target: ATXN1; (+) strand; PAM type: YTN; PAM sequence: TTT
tgcctataacacacgaggtt

SEQ ID NO: 263339 - DNA, 20 bp, Artificial Sequence
  Description of Artificial Sequence: Synthetic oligonucleotide
  Target: ATXN1; (+) strand; PAM type: YTN; PAM sequence: TTT
gcctataacacacgaggttg

SEQ ID NO: 263340 - DNA, 20 bp, Artificial Sequence
  Description of Artificial Sequence: Synthetic oligonucleotide
  Target: ATXN1; (+) strand; PAM type: YTN; PAM sequence: TTG
cctataacacacgaggttgt

SEQ ID NO: 263341 - DNA, 20 bp, Artificial Sequence
  Description of Artificial Sequence: Synthetic oligonucleotide
  Target: ATXN1; (+) strand; PAM type: YTN; PAM sequence: CTA
taacacacgaggttgtaatg

SEQ ID NO: 263342 - DNA, 20 bp, Artificial Sequence
  Description of Artificial Sequence: Synthetic oligonucleotide
  Target: ATXN1; (+) strand; PAM type: YTN; PAM sequence: TTG
taatgtggctcatgaacaag

SEQ ID NO: 263343 - DNA, 20 bp, Artificial Sequence
  Description of Artificial Sequence: Synthetic oligonucleotide
  Target: ATXN1; (+) strand; PAM type: YTN; PAM sequence: CTC
atgaacaagacagatgccta

SEQ ID NO: 263344 - DNA, 20 bp, Artificial Sequence
  Description of Artificial Sequence: Synthetic oligonucleotide
  Target: ATXN1; (+) strand; PAM type: YTN; PAM sequence: CTA
ctatagcaagtagaattctg

SEQ ID NO: 263345 - DNA, 20 bp, Artificial Sequence
  Description of Artificial Sequence: Synthetic oligonucleotide
  Target: ATXN1; (+) strand; PAM type: YTN; PAM sequence: CTA
tagcaagtagaattctgcaa

SEQ ID NO: 263346 - DNA, 20 bp, Artificial Sequence
  Description of Artificial Sequence: Synthetic oligonucleotide
  Target: ATXN1; (+) strand; PAM type: YTN; PAM sequence: TTC
tgcaaacgacattcaatgac

SEQ ID NO: 263347 - DNA, 20 bp, Artificial Sequence
  Description of Artificial Sequence: Synthetic oligonucleotide
  Target: ATXN1; (+) strand; PAM type: YTN; PAM sequence: CTG
caaacgacattcaatgacat

SEQ ID NO: 263348 - DNA, 20 bp, Artificial Sequence
  Description of Artificial Sequence: Synthetic oligonucleotide
  Target: ATXN1; (+) strand; PAM type: YTN; PAM sequence: TTC
aatgacatccacagagagaa

SEQ ID NO: 263349 - DNA, 20 bp, Artificial Sequence
  Description of Artificial Sequence: Synthetic oligonucleotide
  Target: ATXN1; (+) strand; PAM type: YTN; PAM sequence: CTG
caactcggtagaaaagaaac

SEQ ID NO: 263350 - DNA, 20 bp, Artificial Sequence
  Description of Artificial Sequence: Synthetic oligonucleotide
  Target: ATXN1; (+) strand; PAM type: YTN; PAM sequence: CTC
ggtagaaaagaaacacgatg

SEQ ID NO: 263351 - DNA, 20 bp, Artificial Sequence
  Description of Artificial Sequence: Synthetic oligonucleotide
  Target: ATXN1; (+) strand; PAM type: YTN; PAM sequence: TTT
ggtcaactgagcaccagact

SEQ ID NO: 263352 - DNA, 20 bp, Artificial Sequence
  Description of Artificial Sequence: Synthetic oligonucleotide
  Target: ATXN1; (+) strand; PAM type: YTN; PAM sequence: TTG
gtcaactgagcaccagactg

SEQ ID NO: 263353 - DNA, 20 bp, Artificial Sequence
  Description of Artificial Sequence: Synthetic oligonucleotide
  Target: ATXN1; (+) strand; PAM type: YTN; PAM sequence: CTG
agcaccagactgtgagcttt

SEQ ID NO: 263354 - DNA, 20 bp, Artificial Sequence
  Description of Artificial Sequence: Synthetic oligonucleotide
  Target: ATXN1; (+) strand; PAM type: YTN; PAM sequence: CTG
tgagctttttgagggtaaag

SEQ ID NO: 263355 - DNA, 20 bp, Artificial Sequence
  Description of Artificial Sequence: Synthetic oligonucleotide
  Target: ATXN1; (+) strand; PAM type: YTN; PAM sequence: CTT
tttgagggtaaagattatgt

SEQ ID NO: 263356 - DNA, 20 bp, Artificial Sequence
  Description of Artificial Sequence: Synthetic oligonucleotide
  Target: ATXN1; (+) strand; PAM type: YTN; PAM sequence: TTT
ttgagggtaaagattatgtt

SEQ ID NO: 263357 - DNA, 20 bp, Artificial Sequence
  Description of Artificial Sequence: Synthetic oligonucleotide
  Target: ATXN1; (+) strand; PAM type: YTN; PAM sequence: TTT
tgagggtaaagattatgttt

SEQ ID NO: 263358 - DNA, 20 bp, Artificial Sequence
  Description of Artificial Sequence: Synthetic oligonucleotide
  Target: ATXN1; (+) strand; PAM type: YTN; PAM sequence: TTT
gagggtaaagattatgtttt

SEQ ID NO: 263359 - DNA, 20 bp, Artificial Sequence
  Description of Artificial Sequence: Synthetic oligonucleotide
  Target: ATXN1; (+) strand; PAM type: YTN; PAM sequence: TTG
agggtaaagattatgttttc

SEQ ID NO: 263360 - DNA, 20 bp, Artificial Sequence
  Description of Artificial Sequence: Synthetic oligonucleotide
  Target: ATXN1; (+) strand; PAM type: YTN; PAM sequence: TTA
tgttttctccgagttcaggg

SEQ ID NO: 263361 - DNA, 20 bp, Artificial Sequence
  Description of Artificial Sequence: Synthetic oligonucleotide
  Target: ATXN1; (+) strand; PAM type: YTN; PAM sequence: TTT
tctccgagttcagggtgtat

SEQ ID NO: 263362 - DNA, 20 bp, Artificial Sequence
  Description of Artificial Sequence: Synthetic oligonucleotide
  Target: ATXN1; (+) strand; PAM type: YTN; PAM sequence: TTT
ctccgagttcagggtgtatt

SEQ ID NO: 263363 - DNA, 20 bp, Artificial Sequence
  Description of Artificial Sequence: Synthetic oligonucleotide
  Target: ATXN1; (+) strand; PAM type: YTN; PAM sequence: TTC
tccgagttcagggtgtattg

SEQ ID NO: 263364 - DNA, 20 bp, Artificial Sequence
  Description of Artificial Sequence: Synthetic oligonucleotide
  Target: ATXN1; (+) strand; PAM type: YTN; PAM sequence: CTC
cgagttcagggtgtattgct

SEQ ID NO: 263365 - DNA, 20 bp, Artificial Sequence
  Description of Artificial Sequence: Synthetic oligonucleotide
  Target: ATXN1; (+) strand; PAM type: YTN; PAM sequence: TTC
agggtgtattgctggcattc

SEQ ID NO: 263366 - DNA, 20 bp, Artificial Sequence
  Description of Artificial Sequence: Synthetic oligonucleotide
  Target: ATXN1; (+) strand; PAM type: YTN; PAM sequence: TTG
ctggcattcaataaatattt

SEQ ID NO: 263367 - DNA, 20 bp, Artificial Sequence
  Description of Artificial Sequence: Synthetic oligonucleotide
  Target: ATXN1; (+) strand; PAM type: YTN; PAM sequence: CTG
gcattcaataaatatttagg

SEQ ID NO: 263368 - DNA, 20 bp, Artificial Sequence
  Description of Artificial Sequence: Synthetic oligonucleotide
  Target: ATXN1; (+) strand; PAM type: YTN; PAM sequence: TTC
aataaatatttagggaatga

SEQ ID NO: 263369 - DNA, 20 bp, Artificial Sequence
  Description of Artificial Sequence: Synthetic oligonucleotide
  Target: ATXN1; (+) strand; PAM type: YTN; PAM sequence: TTT
agggaatgaatacatgcagg

SEQ ID NO: 263370 - DNA, 20 bp, Artificial Sequence
  Description of Artificial Sequence: Synthetic oligonucleotide
  Target: ATXN1; (+) strand; PAM type: YTN; PAM sequence: TTA
gggaatgaatacatgcaggg

SEQ ID NO: 263371 - DNA, 20 bp, Artificial Sequence
  Description of Artificial Sequence: Synthetic oligonucleotide
  Target: ATXN1; (+) strand; PAM type: YTN; PAM sequence: TTA
caaatacggttcagaattca

SEQ ID NO: 263372 - DNA, 20 bp, Artificial Sequence
  Description of Artificial Sequence: Synthetic oligonucleotide
  Target: ATXN1; (+) strand; PAM type: YTN; PAM sequence: TTC
agaattcataactagtaatg

SEQ ID NO: 263373 - DNA, 20 bp, Artificial Sequence
  Description of Artificial Sequence: Synthetic oligonucleotide
  Target: ATXN1; (+) strand; PAM type: YTN; PAM sequence: TTC
ataactagtaatgaatgata

SEQ ID NO: 263374 - DNA, 20 bp, Artificial Sequence
  Description of Artificial Sequence: Synthetic oligonucleotide
  Target: ATXN1; (+) strand; PAM type: YTN; PAM sequence: CTA
gtaatgaatgatatgagaaa

SEQ ID NO: 263375 - DNA, 20 bp, Artificial Sequence
  Description of Artificial Sequence: Synthetic oligonucleotide
  Target: ATXN1; (+) strand; PAM type: YTN; PAM sequence: CTT
tccagattttgttgatagca

SEQ ID NO: 263376 - DNA, 20 bp, Artificial Sequence
  Description of Artificial Sequence: Synthetic oligonucleotide
  Target: ATXN1; (+) strand; PAM type: YTN; PAM sequence: TTT
ccagattttgttgatagcat

SEQ ID NO: 263377 - DNA, 20 bp, Artificial Sequence
  Description of Artificial Sequence: Synthetic oligonucleotide
  Target: ATXN1; (+) strand; PAM type: YTN; PAM sequence: TTC
cagattttgttgatagcata

SEQ ID NO: 263378 - DNA, 20 bp, Artificial Sequence
  Description of Artificial Sequence: Synthetic oligonucleotide
  Target: ATXN1; (+) strand; PAM type: YTN; PAM sequence: TTT
tgttgatagcataagattaa

SEQ ID NO: 263379 - DNA, 20 bp, Artificial Sequence
  Description of Artificial Sequence: Synthetic oligonucleotide
  Target: ATXN1; (+) strand; PAM type: YTN; PAM sequence: TTT
gttgatagcataagattaaa

SEQ ID NO: 263380 - DNA, 20 bp, Artificial Sequence
  Description of Artificial Sequence: Synthetic oligonucleotide
  Target: ATXN1; (+) strand; PAM type: YTN; PAM sequence: TTG
ttgatagcataagattaaat

SEQ ID NO: 263381 - DNA, 20 bp, Artificial Sequence
  Description of Artificial Sequence: Synthetic oligonucleotide
  Target: ATXN1; (+) strand; PAM type: YTN; PAM sequence: TTG
atagcataagattaaattca

SEQ ID NO: 263382 - DNA, 20 bp, Artificial Sequence
  Description of Artificial Sequence: Synthetic oligonucleotide
  Target: ATXN1; (+) strand; PAM type: YTN; PAM sequence: TTA
aattcagctggaaaaggaaa

SEQ ID NO: 263383 - DNA, 20 bp, Artificial Sequence
  Description of Artificial Sequence: Synthetic oligonucleotide
  Target: ATXN1; (+) strand; PAM type: YTN; PAM sequence: TTC
agctggaaaaggaaaacatt

SEQ ID NO: 263384 - DNA, 20 bp, Artificial Sequence
  Description of Artificial Sequence: Synthetic oligonucleotide
  Target: ATXN1; (+) strand; PAM type: YTN; PAM sequence: CTG
gaaaaggaaaacatttagga

SEQ ID NO: 263385 - DNA, 20 bp, Artificial Sequence
  Description of Artificial Sequence: Synthetic oligonucleotide
  Target: ATXN1; (+) strand; PAM type: YTN; PAM sequence: TTT
aggattatccatctctgagt

SEQ ID NO: 263386 - DNA, 20 bp, Artificial Sequence
  Description of Artificial Sequence: Synthetic oligonucleotide
  Target: ATXN1; (+) strand; PAM type: YTN; PAM sequence: TTA
ggattatccatctctgagtg

SEQ ID NO: 263387 - DNA, 20 bp, Artificial Sequence
  Description of Artificial Sequence: Synthetic oligonucleotide
  Target: ATXN1; (+) strand; PAM type: YTN; PAM sequence: TTA
tccatctctgagtgattgtg

SEQ ID NO: 263388 - DNA, 20 bp, Artificial Sequence
  Description of Artificial Sequence: Synthetic oligonucleotide
  Target: ATXN1; (+) strand; PAM type: YTN; PAM sequence: CTC
tgagtgattgtgtgtcagtc

SEQ ID NO: 263389 - DNA, 20 bp, Artificial Sequence
  Description of Artificial Sequence: Synthetic oligonucleotide
  Target: ATXN1; (+) strand; PAM type: YTN; PAM sequence: CTG
agtgattgtgtgtcagtctt

SEQ ID NO: 263390 - DNA, 20 bp, Artificial Sequence
  Description of Artificial Sequence: Synthetic oligonucleotide
  Target: ATXN1; (+) strand; PAM type: YTN; PAM sequence: TTG
tgtgtcagtcttcagaggaa
